United States Patent
Makeev

(10) Patent No.: US 7,312,035 B2
(45) Date of Patent: Dec. 25, 2007

(54) METHODS OF GENETIC ANALYSIS OF YEAST

(75) Inventor: Tanya Makeev, Cupertino, CA (US)

(73) Assignee: Affymetrix, Inc., Santa Clara, CA (US)

( * ) Notice: Subject to any disclaimer, the term of this patent is extended or adjusted under 35 U.S.C. 154(b) by 413 days.

(21) Appl. No.: 10/934,048

(22) Filed: Sep. 3, 2004

(65) Prior Publication Data

US 2006/0051770 A1    Mar. 9, 2006

(51) Int. Cl.
  C12M 1/34   (2006.01)
  C12M 3/00   (2006.01)
  C07H 21/04  (2006.01)
  C12Q 1/68   (2006.01)

(52) U.S. Cl. ............ 435/6; 435/91.1; 435/287.2; 536/23.1; 536/24.3

(58) Field of Classification Search ............ None
  See application file for complete search history.

(56) References Cited

U.S. PATENT DOCUMENTS

| | | | |
|---|---|---|---|
| 5,143,854 | A | 9/1992 | Pirrung et al. |
| 5,800,992 | A | 9/1998 | Fodor et al. |
| 5,994,075 | A | 11/1999 | Goodfellow |
| 6,309,822 | B1 * | 10/2001 | Fodor et al. ............ 435/6 |
| 6,821,724 | B1 | 11/2004 | Mittman et al. |
| 2003/0044866 | A1 | 3/2003 | Boone |

OTHER PUBLICATIONS

Affymetrix GeneChip Yeast Genome 2.0 array (2004-2005).*
Genbank Accession Nos. NC_001133-NC_001148, and NC_001224.*
(Wood et al; Nature, vol. 412, 2002, pp. 871-880.*
Chen et al; Molecular Biology of the Cell, Jan. 2003, vol. 14, pp. 214-229.*
Lashkari et al; PNAS, vol. 94, pp. 13057-13062; 1997.*
Wodicka et al, Genome-wide expression monitoring in *Saccharomyces cerevisiae*, Nature Biotechnology 15:1359-1367 (1997).
Affymetrix GeneChip Ye6100 Instructions for use, PN 700163 Rev. 1, May 1998.
GeneChip Yeast Genome S98 array Product Insert, PN 700290 Rev. 1, Feb. 2000.
Winzeler et al., Direct allelic variation scanning of the yeast genome, Science 281:1194-7 (1998).
Lockhart et al., Expression monitoring by hybridization to high-density oligonucleotide arrays, Nat. Biotech 14:1675-80 (1996).
Lashkari et al., Yeast microarrays for genome wide parallel genetic and gene expression analysis, PNAS 94:13057-62 (1997).
Talla et al., A novel design of whole-genome microarray probes for *Saccharomyces cerevisiae* which minimizes cross hybridization, BMC Genomic 4:38 (2003).
Bosch et al., Operon Array-Ready Oligo Sets provide sequence-optimized 70mers for DNA microarrays, QiagenNews 4:1, 10-11 (2001).
Frey et al., Gene Expression Arrays: Highly sensitive detection of expression patterns with improved tools for target amplification, Biochemica 2:27-29 (2002).
Bernstein et al., Methylation of histone H3 Lys 4 in coding regions of active genes, PNAS 99:8695-8700 (2002).

* cited by examiner

*Primary Examiner*—Jehanne Sitton
(74) *Attorney, Agent, or Firm*—Sandra E. Wells

(57) ABSTRACT

Arrays of oligonucleotide probes which are complementary to a plurality of *S. cerevisisae* and *S. pombe* genes are disclosed. The arrays may be used to measure the expression levels of a plurality of genes simultaneously.

15 Claims, No Drawings

METHODS OF GENETIC ANALYSIS OF YEAST

FIELD OF THE INVENTION

Arrays of oligonucleotide probes complementary to selected genomic regions of yeast are disclosed. The arrays may be used to monitor the expression of a plurality of genes in parallel. The invention therefore relates to diverse fields impacted by the nature of molecular interaction, including chemistry, biology, medicine, and medical diagnostics.

REFERENCE TO SEQUENCE LISTING

The Sequence Listing submitted on compact disk is hereby incorporated by reference. The file on the disk is named 3699seqlist.txt, the file is 17,106 KB and the date of creation is Sep. 2, 2004.

BACKGROUND OF THE INVENTION

Many biological functions are carried out by regulating the expression levels of various genes, either through changes in levels of transcription (e.g. through control of initiation, provision of RNA precursors, RNA processing, etc.) of particular genes, through changes in the copy number of the genetic DNA, through changes in RNA processing such as polyadenylation and splicing or RNA stability or through changes in protein synthesis. For example, control of the cell cycle and cell differentiation, as well as diseases, are characterized by the variations in the transcription levels of a group of genes. Gene expression is not only responsible for physiological functions, but also associated with pathogenesis. For example, the lack of sufficient functional tumor suppressor genes and/or the over expression of oncogene/protooncogenes leads to tumorgenesis. (See, e.g., Marshall, Cell, 64: 313-326 (1991) and Weinberg, Science, 254: 1138-1146 (1991)). Thus, changes in the expression levels of particular genes (e.g. oncogenes or tumor suppressors), serve as signposts for the presence and progression of various diseases.

Arrays of probes to the yeast *Saccharomyces cerevisisae* have been available, for example, the Affymetrix Yeast Genome S98 array, described in U.S. patent application Ser. No. 09/953,570 and the Ye6100 array set. Probe selection for each of these arrays was based on the *S. cerevisiae* genome sequence information available at the time of the array design. Over time the public databases of genomic sequence are updated and refined to reflect new information. As such, our understanding of the genome changes over time, for example, sequencing errors are corrected, polymorphisms are identified, transcripts are mapped more accurately, new genes are identified, exon-intron boundaries are mapped, and transcription start sites and polyadenylation sites are mapped. Arrays useful for monitoring expression need to change to reflect changes in the genomic sequence and annotations to the genome.

SUMMARY OF THE INVENTION

Arrays of oligonucleotide probes for monitoring the expression of yeast genes are disclosed. In a preferred embodiment an array comprising nucleic acid probes where each probe is one of the sequences listed in SEQ ID Nos. 1-120,855 is disclosed. Each probe sequence may be present in a feature of known or determinable location that can be distinguished from other features that contain probes of different sequence. In one embodiment each different probe sequence is present in a different area on the surface of a solid support.

In one embodiment the invention comprises an array comprising any 10 or more, 100 or more, 1000, or more, 10,000 or more or 100,000 or more nucleic acid probes containing 15 or more consecutive nucleotides from the sequences listed in SEQ ID NOS: 1-120,855, or the complement thereof. In a further embodiment, the invention comprises the use of any of the disclosed arrays to: monitor gene expression levels by hybridization of the array to a nucleic acid library; monitor gene expression levels by hybridization to an mRNA-protein fusion compound; identify polymorphisms; identify biallelic markers; produce genetic maps; analyze genetic variation; comparatively analyze gene expression between different species, different strains or samples that have undergone different treatments, or to analyze gene knockouts. In a further embodiment the invention comprises a method of analysis comprising hybridizing one or more pools of nucleic acids to an array comprising at least 1,000 or more of the probes disclosed in SEQ ID Nos. 1-120,855 and detecting said hybridization. In a further embodiment the invention comprises the use of any one or more of the fragments disclosed in SEQ ID Nos. 1-120,855 as a primer for PCR. In a further embodiment the invention comprises the use of any one or more of the fragments disclosed in SEQ ID Nos. 1-120,855 as a ligand. In another embodiment each of the sequences in SEQ ID Nos. 1-120, 855 is synthesized on an array as a probe and the array is used to monitor gene expression from a biological sample isolated from yeast.

DETAILED DESCRIPTION OF THE INVENTION

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series* (*Vols. I-IV*), *Using Antibodies: A Laboratory Manual, Cells: A Laboratory Manual, PCR Primer: A Laboratory Manual*, and Molecular *Cloning: A Laboratory Manual* (all from Cold Spring Harbor Laboratory Press), Stryer, L. (1995) *Biochemistry* (4th Ed.) Freeman, New York, Gait, *"Oligonucleotide Synthesis: A Practical Approach"* 1984, IRL Press, London, Nelson and Cox (2000), *Lehninger, Principles of Biochemistry* $3^{rd}$ Ed., W.H. Freeman Pub., New York, N.Y. and Berg et al. (2002) *Biochemistry*, $5^{th}$ Ed., W.H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252,743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication No. WO 99/36760) and PCT/US01/04285 (International Publication No. WO 01/58593), which are all incorporated herein by reference in their entirety for all purposes.

Patents that describe synthesis techniques in specific embodiments include U.S. Pat. Nos. 5,412,087, 6,147,205, 6,262,216, 6,310,189, 5,889,165, and 5,959,098. Nucleic acid arrays are described in many of the above patents, but the same techniques are applied to polypeptide arrays.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring and profiling methods can be shown in U.S. Pat. Nos. 5,800,992, 6,013,449, 6,020,135, 6,033,860, 6,040,138, 6,177,248 and 6,309,822. Genotyping and uses therefore are shown in U.S. Ser. Nos. 10/442,021, 10/013,598 (U.S. Patent Application Publication 20030036069), and U.S. Pat. Nos. 5,856,092, 6,300,063, 5,858,659, 6,284,460, 6,361,947, 6,368,799 and 6,333,179. Other uses are embodied in U.S. Pat. Nos. 5,871,928, 5,902,723, 6,045,996, 5,541,061, and 6,197,506.

The present invention also contemplates sample preparation methods in certain preferred embodiments. Prior to or concurrent with genotyping, the genomic sample may be amplified by a variety of mechanisms, some of which may employ PCR. See, for example, *PCR Technology: Principles and Applications for DNA Amplification* (Ed. H. A. Erlich, Freeman Press, NY, N.Y., 1992); *PCR Protocols: A Guide to Methods and Applications* (Eds. Innis, et al., Academic Press, San Diego, Calif., 1990); Mattila et al., *Nucleic Acids Res.* 19, 4967 (1991); Eckert et al., *PCR Methods and Applications* 1, 17 (1991); PCR (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. The sample may be amplified on the array. See, for example, U.S. Pat. No. 6,300,070 and U.S. Ser. No. 09/513,300, which are incorporated herein by reference.

Other suitable amplification methods include the ligase chain reaction (LCR) (for example, Wu and Wallace, *Genomics* 4, 560 (1989), Landegren et al., *Science* 241, 1077 (1988) and Barringer et al. *Gene* 89:117 (1990)), transcription amplification (Kwoh et al., *Proc. Natl. Acad. Sci. USA* 86, 1173 (1989) and WO88/10315), self-sustained sequence replication (Guatelli et al., *Proc. Nat. Acad. Sci. USA*, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) and nucleic acid based sequence amplification (NABSA). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 4,988,617 and in U.S. Ser. No. 09/854,317, each of which is incorporated herein by reference.

Additional methods of sample preparation and techniques for reducing the complexity of a nucleic sample are described in Dong et al., *Genome Research* 11, 1418 (2001), in U.S. Pat. Nos. 6,361,947, 6,391,592 and U.S. Ser. Nos. 09/916,135, 09/920,491 (U.S. Patent Application Publication 20030096235), Ser. No. 09/910,292 (U.S. Patent Application Publication 20030082543), and Ser. No. 10/013,598.

Methods for conducting polynucleotide hybridization assays have been well developed in the art. Hybridization assay procedures and conditions will vary depending on the application and are selected in accordance with the general binding methods known including those referred to in: Maniatis et al. *Molecular Cloning: A Laboratory Manual* ($2^{nd}$ Ed. Cold Spring Harbor, N.Y, 1989); Berger and Kimmel *Methods in Enzymology*, Vol. 152, *Guide to Molecular Cloning Techniques* (Academic Press, Inc., San Diego, Calif., 1987); Young and Davism, *P.N.A.S*, 80: 1194 (1983). Methods and apparatus for carrying out repeated and controlled hybridization reactions have been described in U.S. Pat. Nos. 5,871,928, 5,874,219, 6,045,996 and 6,386,749, 6,391,623 each of which are incorporated herein by reference The present invention also contemplates signal detection of hybridization between ligands in certain preferred embodiments. For example, methods and apparatus for signal detection and processing of intensity data are disclosed in, U.S. Pat. Nos. 5,143,854; 5,547,839; 5,578,832; 5,631,734; 5,800,992; 5,834,758; 5,856,092; 5,902,723; 5,936,324; 5,981,956; 6,025,601; 6,090,555; 6,141,096; 6,171,793; 6,185,030; 6,201,639; 6,207,960; 6,218,803; 6,225,625; 6,252,236; 6,335,824; 6,403,320; 6,407,858; 6,472,671; 6,490,533; 6,650,411; and 6,643,015, in U.S. patent application Ser. No. 10/389,194, 60/493,495 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, for example Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis Bioinformatics: A Practical Guide for Analysis of Gene and Proteins (Wiley & Sons, Inc., 2nd ed., 2001). See U.S. Pat. No. 6,420,108.

The present invention may also make use of various computer program products and software for a variety of purposes, such as probe design, management of data, analysis, and instrument operation. See, U.S. Pat. Nos. 5,733,729; 5,593,839; 5,795,716; 5,733,729; 5,974,164; 6,066,454; 6,090,555; 6,185,561; 6,188,783; 6,223,127; 6,228,593; 6,229,911; 6,242,180; 6,308,170; 6,361,937; 6,420,108; 6,484,183; 6,505,125; 6,510,391; 6,532,462; 6,546,340; and 6,687,692.

Additionally, the present invention may have preferred embodiments that include methods for providing genetic information over networks such as the Internet as shown in U.S. Ser. Nos. 10/197,621, 10/063,559 (United States Publication Number 20020183936), Ser. Nos. 10/065,856, 10/065,868, 10/328,818, 10/328,872, 10/423,403, and 60/482,389.

I. Definitions

The term "array" as used herein refers to an intentionally created collection of molecules which can be prepared either synthetically or biosynthetically. The molecules in the array can be identical or different from each other. The array can assume a variety of formats, for example, libraries of soluble molecules; libraries of compounds tethered to resin beads, silica chips, or other solid supports.

The term "combinatorial synthesis strategy" as used herein refers to a combinatorial synthesis strategy is an ordered strategy for parallel synthesis of diverse polymer sequences by sequential addition of reagents which may be represented by a reactant matrix and a switch matrix, the product of which is a product matrix. A reactant matrix is a 1 column by m row matrix of the building blocks to be added. The switch matrix is all or a subset of the binary numbers, preferably ordered, between 1 and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

The term "complementary" as used herein refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Alternatively, complementarity exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. See, M. Kanehisa Nucleic Acids Res. 12:203 (1984), incorporated herein by reference.

The term "genome" as used herein is all the genetic material in the chromosomes of an organism. DNA derived from the genetic material in the chromosomes of a particular organism is genomic DNA. A genomic library is a collection of clones made from a set of randomly generated overlapping DNA fragments representing the entire genome of an organism.

The term "hybridization" as used herein refers to the process in which two single-stranded polynucleotides bind non-covalently to form a stable double-stranded polynucleotide; triple-stranded hybridization is also theoretically possible. The resulting (usually) double-stranded polynucleotide is a "hybrid." The proportion of the population of polynucleotides that forms stable hybrids is referred to herein as the "degree of hybridization." Hybridizations are usually performed under stringent conditions, for example, at a salt concentration of no more than about 1 M and a temperature of at least 25° C. For example, conditions of 5×SSPE (750 mM NaCl, 50 mM NaPhosphate, 5 mM EDTA, pH 7.4) and a temperature of 25-30° C. are suitable for allele-specific probe hybridizations or conditions of 100 mM MES, 1 M [Na$^+$], 20 mM EDTA, 0.01% Tween-20 and a temperature of 30-50° C., preferably at about 45-50° C. Hybridizations may be performed in the presence of agents such as herring sperm DNA at about 0.1 mg/ml, acetylated BSA at about 0.5 mg/ml. As other factors may affect the stringency of hybridization, including base composition and length of the complementary strands, presence of organic solvents and extent of base mismatching, the combination of parameters is more important than the absolute measure of any one alone. Hybridization conditions suitable for microarrays are described in the Gene Expression Technical Manual, 2004 and the GeneChip Mapping Assay Manual, 2004.

The term "hybridization probes" as used herein are oligonucleotides capable of binding in a base-specific manner to a complementary strand of nucleic acid. Such probes include peptide nucleic acids, as described in Nielsen et al., *Science* 254, 1497-1500 (1991), LNAs, as described in Koshkin et al. *Tetrahedron* 54:3607-3630, 1998, and U.S. Pat. No. 6,268,490, aptamers, and other nucleic acid analogs and nucleic acid mimetics.

The term "hybridizing specifically to" as used herein refers to the binding, duplexing, or hybridizing of a molecule only to a particular nucleotide sequence or sequences under stringent conditions when that sequence is present in a complex mixture (for example, total cellular) DNA or RNA.

The term "initiation biomonomer" or "initiator biomonomer" as used herein is meant to indicate the first biomonomer which is covalently attached via reactive nucleophiles to the surface of the polymer, or the first biomonomer which is attached to a linker or spacer arm attached to the polymer, the linker or spacer arm being attached to the polymer via reactive nucleophiles.

The term "isolated nucleic acid" as used herein mean an object species invention that is the predominant species present (i.e., on a molar basis it is more abundant than any other individual species in the composition). Preferably, an isolated nucleic acid comprises at least about 50, 80 or 90% (on a molar basis) of all macromolecular species present. Most preferably, the object species is purified to essential homogeneity (contaminant species cannot be detected in the composition by conventional detection methods).

The term "ligand" as used herein refers to a molecule that is recognized by a particular receptor. The agent bound by or reacting with a receptor is called a "ligand," a term which is definitionally meaningful only in terms of its counterpart receptor. The term "ligand" does not imply any particular molecular size or other structural or compositional feature other than that the substance in question is capable of binding or otherwise interacting with the receptor. Also, a ligand may serve either as the natural ligand to which the receptor binds, or as a functional analogue that may act as an agonist or antagonist. Examples of ligands that can be investigated by this invention include, but are not restricted to, agonists and antagonists for cell membrane receptors, toxins and venoms, viral epitopes, hormones (for example, opiates, steroids, etc.), hormone receptors, peptides, enzymes, enzyme substrates, substrate analogs, transition state analogs, cofactors, drugs, proteins, and antibodies.

The phrase "massively parallel screening" refers to the simultaneous screening of at least about 100, about 1000, about 10,000, about 100,000 or about 500,000 different nucleic acid hybridizations, preferably in a single reaction or experiment.

Mismatch: The term "mismatch," "mismatch control" or "mismatch probe" refers to a nucleic acid whose sequence is deliberately designed not to be perfectly complementary to a particular target sequence. As a non-limiting example, for each mismatch (MM) control in a high-density probe array there typically exists a corresponding perfect match (PM) probe that is perfectly complementary to the same particular target sequence. The mismatch may comprise one or more bases. While the mismatch(es) may be located anywhere in the mismatch probe, terminal mismatches are less desirable because a terminal mismatch is less likely to prevent hybridization of the target sequence. In a particularly preferred embodiment, the mismatch is located at the center of the probe, for example if the probe is 25 bases the mismatch position is position 13, also termed the central position, such that the mismatch is most likely to destabilize the duplex with the target sequence under the test hybridization conditions. A homo-mismatch substitutes an adenine (A) for a thymine (T) and vice versa and a guanine (G) for a cytosine (C) and vice versa. For example, if the target sequence was: 5'-AGGTCCA-3', a probe designed with a single homo-mismatch at the central, or fourth position, would result in the following sequence: 3'-TCCTGGT-5', the PM probe would be 3'-TCCAGGT-5'.

The term "mixed population" or sometimes refer by "complex population" as used herein refers to any sample containing both desired and undesired nucleic acids. As a non-limiting example, a complex population of nucleic acids may be total genomic DNA, total genomic RNA or a combination thereof. Moreover, a complex population of nucleic acids may have been enriched for a given population but may include other undesirable populations. For example, a complex population of nucleic acids may be a sample which has been enriched for desired messenger RNA (mRNA) sequences but still includes some undesired ribosomal RNA sequences (rRNA).

The term "monomer" as used herein refers to any member of the set of molecules that can be joined together to form an oligomer or polymer. The set of monomers useful in the present invention includes, but is not restricted to, for the example of (poly)peptide synthesis, the set of L-amino acids, D-amino acids, or synthetic amino acids. As used herein, "monomer" refers to any member of a basis set for synthesis of an oligomer. For example, dimers of L-amino acids form a basis set of 400 "monomers" for synthesis of polypeptides. Different basis sets of monomers may be used at successive steps in the synthesis of a polymer. The term "monomer" also refers to a chemical subunit that can be combined with a different chemical subunit to form a compound larger than either subunit alone.

The term "mRNA" or sometimes refer by "mRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

The term "nucleic acid library" or sometimes refer by "array" as used herein refers to an intentionally created collection of nucleic acids which can be prepared either synthetically or biosynthetically and screened for biological activity in a variety of different formats (for example, libraries of soluble molecules; and libraries of oligos tethered to resin beads, silica chips, or other solid supports). Additionally, the term "array" is meant to include those libraries of nucleic acids which can be prepared by spotting nucleic acids of essentially any length (for example, from 1 to about 1000 nucleotide monomers in length) onto a substrate. The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "nucleic acids" as used herein may include any polymer or oligomer of pyrimidine and purine bases, preferably cytosine, thymine, and uracil, and adenine and guanine, respectively. See Albert L. Lehninger, PRINCIPLES OF BIOCHEMISTRY, at 793-800 (Worth Pub. 1982). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally-occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

The term "oligonucleotide" or sometimes refer by "polynucleotide" as used herein refers to a nucleic acid ranging from at least 2, preferable at least 8, and more preferably at least 20 nucleotides in length or a compound that specifically hybridizes to a polynucleotide. Polynucleotides of the present invention include sequences of deoxyribonucleic acid (DNA) or ribonucleic acid (RNA) which may be isolated from natural sources, recombinantly produced or artificially synthesized and mimetics thereof. A further example of a polynucleotide of the present invention may be peptide nucleic acid (PNA). The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

Perfect match: The term "match," "perfect match," "perfect match probe" or "perfect match control" refers to a nucleic acid that has a sequence that is designed to be perfectly complementary to a particular target sequence or portion thereof. For example, if the target sequence is 5'-GATTGCATA-3' the perfect complement is 5'-TATGCAATC-3'. Where the target sequence is longer than the probe the probe is typically perfectly complementary to a portion (subsequence) of the target sequence. For example, if the target sequence is a fragment that is 800 bases, the perfect match probe may be perfectly complementary to a 25 base region of the target. A perfect match (PM) probe can be a "test probe", a "normalization control" probe, an expression level control probe and the like. A perfect match control or perfect match is, however, distinguished from a "mismatch" or "mismatch probe."

The term "primer" as used herein refers to a single-stranded oligonucleotide capable of acting as a point of initiation for template-directed DNA synthesis under suitable conditions for example, buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

The term "probe" as used herein refers to a surface-immobilized molecule that can be recognized by a particular target. See U.S. Pat. No. 6,582,908 for an example of arrays having all possible combinations of probes with 10, 12, and more bases. Examples of probes that can be investigated by this invention include, but are not restricted to, agonists and antagonists for cell membrane receptors, toxins and venoms, viral epitopes, hormones (for example, opioid peptides, steroids, etc.), hormone receptors, peptides, enzymes, enzyme substrates, cofactors, drugs, lectins, sugars, oligonucleotides, nucleic acids, oligosaccharides, proteins, and monoclonal antibodies.

The term "solid support", "support", and "substrate" as used herein are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations. See U.S. Pat. No. 5,744,305 for exemplary substrates.

The term "target" as used herein refers to a molecule that has an affinity for a given probe. Targets may be naturally-occurring or man-made molecules. Also, they can be employed in their unaltered state or as aggregates with other species. Targets may be attached, covalently or noncovalently, to a binding member, either directly or via a specific binding substance. Examples of targets which can be employed by this invention include, but are not restricted to, antibodies, cell membrane receptors, monoclonal antibodies and antisera reactive with specific antigenic determinants (such as on viruses, cells or other materials), drugs, oligonucleotides, nucleic acids, peptides, cofactors, lectins, sugars, polysaccharides, cells, cellular membranes, and organelles. Targets are sometimes referred to in the art as anti-probes. As the term targets is used herein, no difference in meaning is intended. A "Probe Target Pair" is formed when two macromolecules have combined through molecular recognition to form a complex.

II. Yeast Array

Although yeast is unicellular, it is an ideal model organism for studying eukaryotic cellular and disease processes. The shorter cell cycle of the yeast compared to higher eukaryotes makes it easier to observe cell processes, study biochemical functions and screen compounds. In one embodiment an array is disclosed that allows for simultaneous measurement of relative gene expression levels for a plurality of yeast genes from Saccharomyces cerevisiae, budding yeast, and Schizosaccharomyces pombe, fission yeast. S. cerevisiae is an important model organism for comparative genomics studies to model biochemical and genetic pathways because of the high degree of homology with the human genome. S. cerevisiae is also an important organism for identifying pathways required for fungal survival in a mammalian host environment and for studying phenotypic variation and instability. S. pombe is a fundamental model organism for studying differential gene regulation, cell-cycle control, signal transduction, cellular morphogenesis, and genome organization. Many genes found in S. pombe and S. cerevisiae are highly homologous to human genes known to be involved in human diseases, including many that are relevant to cancer genetics. Gene expression monitoring may also be used to optimize culture conditions to improve yields of recombinant proteins in metabolite production.

In a preferred embodiment an array comprising a plurality of probe sets for detection of expression products from S. cerevisiae, a plurality of probe sets for detection of expression products from S. pombe and a plurality of control probes are disclosed. In a preferred embodiment an array is disclosed that comprises each of the sequences listed in the sequence listing attached to a solid support in a different determinable location. Each sequence in the sequence listing is present in a location, or feature, that is preferably distinct or distinguishable from each of the other sequences in the sequence listing, features may overlap to some extent. A probe set may comprise a plurality of different oligonucleotide probes that are complementary to the same transcript but to different regions of the transcript. Each probe in the probe set may be present in a unique feature. In a preferred embodiment a probe set is comprised of probe pairs and a probe pair is a perfect match probe and the corresponding mismatch probe. The mismatch probe is identical to the perfect match probe except for a mismatch at the central position, position 13 of a 25 mer probe. Mismatch probes may be included on the array for use as controls to measure discrimination and specificity. Antisense probes that are derived from the opposite strand of the gene may also be included.

In preferred embodiments the array comprises a plurality of control probes. Control probes may include, for example, hybridization controls, poly-A controls, manufacturing controls and housekeeping control genes. Hybridization controls may be from an organism other than the organism being studies. In a preferred embodiment probes for the E. coli bioB, bioC, and bioD genes and probes for the P1 Bacteriophage cre gene are included as hybridization controls. A mixture of the transcripts that are complementary to the probe may be included in the hybridization. Probes for B. subtilis dap, lys, phe, thr, and trp genes may be included and used for sample preparation controls. Normalization controls may include probes for GAPDH, Actin, EAf5, SRB4, tfIId, RIP1, URA3 and WBP1. Ribosomal RNA probes may also be included. Other control sequence probes may also be included. Control probes may be included to assay for manufacturing defects, problems with sample preparation and problems with hybridization. Probes for synthetic sequences that are not present in the genome being assayed and are preferably not present in other known genomes may also be included, for example, tag probes such as those disclosed in U.S. patent application Ser. No. 09/827,383.

In a preferred embodiment the array is a single solid support so that the expression levels for at least 5,000 S. cerevisiae transcripts and at least 5,000 S. pombe transcripts may be simultaneously analyzed in a single experiment using a single hybridization. See, for example the U133 Plus 2.0 Array available from Affymetrix. This array allows analysis of over 47,000 human transcripts on a single chip. In another embodiment the probes are divided so that they are on two or more chips or solid supports. Arrays may also be attached to pegs for high throughput analysis. In a preferred embodiment a plurality of the disclosed arrays are attached to pegs in a format that allows hybridization of the arrays in 96 or 384 well microtitre dish format, facilitating highly parallel analysis of a plurality of different samples. In a preferred embodiment sample preparation and array hybridization, staining and washing are performed in an automated manner.

The genomes of S. cerevisisae and S. pombe have been sequenced and are publicly available. The disclosed probe sequences were designed using information from GenBank (May 2004) for S. cerevisisae and from the Sanger Center (June 2004) for S. pombe. The disclosed arrays represent an improvement over arrays present in the prior art because our understanding of the yeast genome has improved. The probes disclosed in the sequence listing were selected using computer based methods such as those described in U.S. Pat. No. 6,309,822. Probe sets typically include 11 oligonucleotide probe pairs. For most probe sets all of the probes in the set are designed to detect the same transcript.

When measuring expression one of skill in the art will recognize that the probes of the array should be designed to be complementary to the sequence to be detected. This may vary depending on which amplification method is used. For example, one method of amplification calls for reverse transcription of the mRNA using an oligo-dt-T7 primer. Double stranded cDNA with an RNA polymerase promoter is then generated and antisense RNA is transcribed and labeled. The antisense RNA is then hybridized to the array. The antisense RNA is complementary to the mRNA so the probes on the array should hybridize to the antisense RNA and should be identical in sequence to a portion of the transcribed mRNA. In another method the amplified nucleic acid to be hybridized to the array is sense, meaning that it has the same sequence as the starting mRNA so the probes should be complementary to the transcribed mRNA. In other embodiments the amplification product that is hybridized to the array may be cDNA that may be in the sense (same as) or antisense (complement of) orientation relative to the starting mRNA.

The present invention provides a pool of unique nucleotide sequences complementary to yeast sequences in particular embodiments which alone, or in combinations of 2 or more, 10 or more, 100 or more, 1,000 or more, 10,000 or more, or 100,000 or more, can be used for a variety of applications.

In one embodiment a high density array of probes suitable for array based massive parallel gene expression of two species of yeast is disclosed. Array based methods for monitoring gene expression are disclosed and discussed in detail in U.S. Pat. No. 5,800,992, U.S. Pat. No. 6,309,822, and PCT Application WO 92/10588 (published on Jun. 25, 1992). Methods of monitoring gene expression are well known. The probes may be arranged into different localized areas, or features, that are about 5 to about 24 square microns in size. Each feature may have many copies of the same probe sequence, for example, more than 1,000, 10,000, 100,000 or 1,000,000 copies of the same sequence. Within a feature some truncated versions of the probe sequence may be present. The borders of individual features may or may not overlap with other features. In another embodiment each different probe sequence is present on a bead. The identity of the probe sequence on the bead may be determined by marking each probe sequence or each bead with a detectable marker or label, for example, a tag sequence. A decoding system may be used to determine the probe attached to a selected bead. See, U.S. Pat. Nos. 6,451,536, 6,646,243, 6,544,739, and 6,440,667.

The development of Very Large Scale Immobilized Polymer Synthesis or VLSIPS™ technology has provided methods for making very large arrays of nucleic acid probes in very small arrays. See U.S. Pat. No. 5,143,854 and PCT Patent Publication Nos. WO 90/15070 and WO 92/10092, and Fodor et al., Science, 251, 767-77 (1991), each of which is incorporated herein by reference. U.S. Pat. No. 5,800,992, describes methods for making arrays of nucleic acid probes that can be used to detect the presence of a nucleic acid containing a specific nucleotide sequence. Methods of forming high density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling.

In a preferred detection method, the array of immobilized nucleic acids, or probes, is contacted with a sample containing target nucleic acids, to which a detectable label is attached. Target nucleic acids hybridize to the probes on the array and any non-hybridized nucleic acids are removed. If the label is fluorescent, the array containing the hybridized target nucleic acids may be exposed to light which excites the fluorescent label. The resulting fluorescent intensity, or brightness, is detected. Relative brightness is used to determine which probe is the best candidate for the perfect match to the hybridized target nucleic acid because fluorescent intensity (brightness) corresponds to binding affinity.

In the array of the present invention the probes are presented in pairs, one probe in each pair being a perfect match to the target sequence and the other probe being identical to the perfect match probe except that the central base is a homo-mismatch. Mismatch probes provide a control for non-specific binding or cross-hybridization to a nucleic acid in the sample other than the target to which the probe is directed. Thus, mismatch probes indicate whether hybridization is or is not specific. For example, if the target is present, the perfect match probes should be consistently brighter than the mismatch probes because fluorescence intensity, or brightness, corresponds to binding affinity. (See, for example U.S. Pat. No. 5,324,633, which is incorporated herein for all purposes.) In addition, if all central mismatches are present, the mismatch probes can be used to detect a mutation. Finally the difference in intensity between the perfect match and the mismatch probe (I(PM)-I(MM)) provides a good measure of the concentration of the hybridized material. See pending PCT Application No. 98/11223, which is incorporated herein by reference for all purposes.

In another embodiment, the current invention provides a pool of sequences which may be used as probes for their complementary targets. A number of uses for nucleic acid probes of defined sequence are known in the art. Some of the uses include: to screen cDNA or genomic DNA libraries, or subclones derived from them, for additional clones containing segments of DNA that have been isolated and previously sequenced; in Southern, northern, or dot-blot hybridization to identify or detect the sequences of specific genes; in Southern, or dot-blot hybridization of genomic DNA to detect specific mutations in genes of known sequence; to detect specific mutations generated by site-directed mutagenesis of cloned genes; as primers for extension by a DNA polymerase, and to map the 5' termini of mRNA molecules by primer extensions. Other uses for probes derived from the sequences disclosed in this invention will be readily apparent to those of skill in the art. See, for example, Lodish et al. *Molecular Cell Biology*, $3^{rd}$ edition, Scientific American Books (1995) p. 229-233, incorporated above, for a description of the construction of genomic libraries.

In another embodiment, the disclosed arrays may be combined with known methods to monitor expression levels of genes in a wide variety of contexts. For example, where the effects of a drug on gene expression are to be determined, the drug will be administered to a culture, sample, or a cell and the gene expression levels will be analyzed. For example, nucleic acids are isolated from the treated culture, sample, cell, or a biological sample from the organism and from an untreated organism sample or cell, hybridized to a high density probe array containing probes directed to the genes of interest and expression levels are determined. Expression levels may be measured relative to the expression of other genes in the sample, for example, genes that are constitutively expressed may be used as normalization controls. The types of drugs that may be used in these types of experiments include, but are not limited to, antibiotics, antivirals, narcotics, anti-cancer drugs, tumor suppressing drugs, and any chemical composition which may affect the expression of genes in vivo or in vitro. Varying growth conditions may also be analyzed for variation in expression.

The current invention is particularly suited to be used in the types of analyses described by, for example, pending U.S. Pat. No. 6,309,822 and PCT Application No. 98/11223, each of which is incorporated by reference in its entirety for all purposes. As described in Wodicka et al., Nature Biotechnology 15 (1997), hereby incorporated by reference in its entirety for all purposes, because mRNA hybridization correlates to gene expression level, hybridization patterns can be compared to determine differential gene expression. As non-limiting examples: hybridization patterns from samples treated with certain types of drugs may be compared to hybridization patterns from samples which have not been treated or which have been treated with a different drug; hybridization patterns for samples infected with a specific virus may be compared against hybridization patterns from non-infected samples; hybridization patterns for samples with cancer may be compared against hybridization patterns for samples without cancer; hybridization patterns of samples from cancerous cells which have been treated with a tumor suppressing drug may be compared against untreated cancerous cells, etc. Zhang et al., Science 276 1268-1272, hereby incorporated by reference in its entirety for all purposes, provides an example of how gene expression data can provide a great deal of insight into cancer research. One skilled in the art will appreciate that a wide range of applications will be available using 2 or more, 10 or more, 100 or more, 1000 or more, 10,000 or more or 100,000 or more of the SEQ ID Nos. 1-120,855 sequences as probes for gene expression analysis.

The combination of the nucleic array technology and the Yeast specific probes in this disclosure is a powerful tool for studying gene expression. Yeast arrays have been used by researchers in a variety of studies.

In another embodiment, the invention may be used in conjunction with the techniques which link specific proteins to the mRNA which encodes the protein. (See for example Roberts and Szostak Proc. Natl, Acad. Sci. 94 12297-12302 (1997). Hybridization of these mRNA-protein fusion compounds to arrays comprised of 2 or more, 10 or more, 100 or more, 1000 or more, 10,000 or more, or 100,000 or more the sequences disclosed in the present invention provides a powerful tool for monitoring expression levels.

In one embodiment, the current invention provides a pool of unique nucleic acid sequences which can be used for parallel analysis of gene expression under selective conditions. Without wishing to be limited, genetic selection under selective conditions could include: variation in the temperature; pH levels; aeration, food (type, texture, amount etc.), carbon source, presence or absence of drugs, inclusion of varying amounts of amino acids; variation in an organism's surroundings; etc. Arrays, such as those in the present invention, can be used to determine whether gene expression is altered when an organism is exposed to selective conditions.

Methods for using nucleic acid arrays to analyze genetic selections under selective conditions are known. (See for example, R. Cho et al., Proc. Natl. Acad. Sci. 95 3752-3757 (1998), incorporated herein in its entirety for all purposes.) Cho et al. describes the use of a high-density array containing oligonucleotides complementary to every gene in the yeast *Saccharomyces cerevisiae* to perform two-hybrid protein-protein interaction screens for *S. cerevisiae* genes implicated in mRNA splicing and microtubule assembly. In another embodiment, the current invention provides a pool of unique nucleic acid sequences which can be used to identify biallelic markers, providing a novel and efficient approach to the study of genetic variation. For example, methods for using high density arrays comprised of probes which are complementary to the genomic DNA of a particular species to interrogate polymorphisms are well known. (See for example, U.S. Pat. No. 6,300,063 which is hereby incorporated by reference herein for all purposes.) Pools of 2 or more, 10 or more, 100 or more, 1000 or more, 10,000 or more, or 100,000 or more of the sequences disclosed in this invention combined with the methods described in the above patent provides a tool for studying genetic variation in the Yeast system.

In another embodiment genetic variation may be correlated with variation in gene expression pattern. Much of the genetic variation between individuals is the result of single nucleotide polymorphisms (SNPs). The presence of SNPs in or near a gene may result in differences in gene expression, which may result, for example, from changes in the rate of transcription, the stability of the mRNA, splicing of the mRNA, or translation of the mRNA. In one embodiment an array comprising SEQ ID Nos. 1-120,855 and probes to genotype selected SNPs in the yeast genome may be used to monitor genotype and expression changes that correlate with differences in genotype.

Arrays of probes to yeast genes have been used to monitor gene expression in a variety of experimental conditions. For example, Evert et al. *J. Biol. Chem.* 279(21), 22585-94, (2004), observed changes in gene expression after spontaneous DNA damage, Gissen et al: *Nat. Genet.* 36(4), 400-4, (2004) observed changes in gene expression after mutation of a specific gene, VPS33B, Jansen et al. *App. Envir. Microbio.* 70(4), 1956-63, (2004) observed changes in gene expression after prolonged grown the maltose-limited media, Kreiman et al. *N.A.R.* 32(9), 2889-900, (2004) identified sets of genes that were co-expressed and identified clusters of cis-regulatory elements in the co-expressed genes, and Orlandi, I. et al. *Jour. of Biol. Chem.* 279(8), 6414-25, (2004) observed changes in expression resulting from a null mutant of ubp10.

In another embodiment of the invention, genetic variation can be used to produce genetic maps of various strains of yeast. Winzeler et al., "Direct Allelic Variation Scanning of the Yeast Genome" *Science*, 281(5380):1194-7. (1998), describes methods for conducting this type of screening with arrays containing probes complementary to the yeast genome. Briefly, genomic DNA from strains which are phenotypically different is isolated, fragmented, and labeled. Each strain is then hybridized to identical arrays comprised of the nucleic acid sequences complementary to the system being studied. Comparison of hybridization patterns between the various strains then serve as genetic markers. As described by Winzler et al, these markers can then be used for linkage analysis. High density arrays created from 2 or more, 10 or more, 100 or more, 1000 or more, 10,000 or more, or 100,000 or more of the sequences disclosed in this invention can be used to study genetic variation using the methods described by Winzler et al.

In another embodiment, the present invention may be used for cross-species comparisons. One skilled in the art will appreciate that it is often useful to determine whether a gene present in one species, for example rat, is present in a conserved format in another species, including, without limitation, *Drosophila*, human, chicken, zebrafish, *Escherichia coli*, mouse or yeast. See, for example, Andersson et al., Mamm. Genome 7(10):717-734 (1996), which is hereby incorporated by reference for all purposes, which describes the utility of cross-species comparisons. The use of 2 or more, 10 or more, 100 or more, 1000 or more, 10,000 or more or 100,000 or more of the sequences disclosed in this invention in an array can be used to determine whether any of the sequence from one or more of the yeast genes represented by the sequences disclosed in this invention is conserved in another species by, for example, hybridizing genomic nucleic acid samples from another species to an array comprised of the sequences disclosed in this invention. Areas of hybridization will yield genomic regions where the nucleotide sequence is highly conserved between the interrogation species and yeast.

In another embodiment, the present invention may be used to characterize the genotype of knockouts. Methods for using gene knockouts to identify a gene are well known. See for example, Lodish et al. *Molecular Cell Biology*, 3$^{rd}$ *Edition*, Scientific American Books pub pp. 292-296 and U.S. Pat. No. 5,679,523, which are hereby incorporated by reference for all purposes. By isolating genomic nucleic acid samples from knockout species with a known phenotype and hybridizing the samples to an array comprised of 2 or more, 10 or more, 100 or more, 1000 or more, 10,000 or more, or 100,000 or more of the sequences disclosed in this invention, candidates genes which contribute to the phenotype will be identified and made accessible for further characterization.

In another embodiment, the present invention may be used to identify new gene family members. Methods of screening libraries with probes are well known. (See, for example, Maniatis et al, incorporated by reference above.) Because the present invention is comprised of nucleic acid sequences from specific known genes, 2 or more, 10 or more, 100 or more, 1000 or more, 10,000 or more, or 100,000 or more of sequences disclosed in this invention may be used as probes to screen genomic libraries to look for additional family members of those genes from which the target sequences are derived.

In another embodiment of the invention, the sequences of this invention may be used to generate primers directed to their corresponding genes as disclosed in the Genbank or any other public database. These primers may be used in such basic techniques as sequencing or PCR, see for example Maniatis et al., incorporated by reference above.

In another embodiment, the invention provides a pool of nucleic acid sequences to be used as ligands for specific genes. The sequences disclosed in this invention may be used as ligands to their corresponding genes as disclosed in the Genbank or any other public database. Compounds which specifically bind known genes are of interest for a variety of uses. One particular clinical use is to act as an antisense protein which specifically binds and disables a gene which has been, for example, linked to a disease. Methods and uses for ligands to specific genes are known. See for example, U.S. Pat. No. 5,723,594, which is hereby incorporated by reference in its entirety for all purposes.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. Thus, for example, polymerase chain reaction (PCR) with labeled primers or labeled nucleotides will provide a labeled amplification product. In another embodiment, transcription amplification, as described above, using a labeled nucleotide (e.g. fluorescein-labeled UTP and/or CTP) incorporates a label into the transcribed nucleic acids. Quantum dots and chemiluminescent labels may also be used.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example nick translation or end-labeling (e.g. with a labeled RNA) by kinasing of the nucleic acid and subsequent attachment (ligation) of a nucleic acid linker joining the sample nucleic acid to a label (e.g., a fluorophore).

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3$H, $^{125}$I, $^{35}$S, $^{14}$C, or $^{32}$P), phosphorescent labels, enzymes (e.g., horse radish peroxidase, alkaline phosphatase and others commonly used in an ELISA), and calorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and calorimetric labels are detected by simply visualizing the colored label.

The label may be added to the target nucleic acid(s) prior to, or after the hybridization. So called "direct labels" are detectable labels that are directly attached to or incorporated into the target nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization. After hybridization, an aviden-conjugated fluorophore will bind the biotin bearing hybrid duplexes providing a label that is easily detected. For a detailed review of methods of labeling nucleic acids and detecting labeled hybridized nucleic acids see *Laboratory Techniques in Biochemistry and Molecular Biology*, Vol. 24: *Hybridization With Nucleic Acid Probes*, P. Tijssen, ed. Elsevier, N.Y., (1993), which is hereby incorporated by reference in its entirety for all purposes.

Protocols for target amplification, labeling and preparation, protocols for target hybridization, washing and scanning, data analysis methods and detailed information about useful controls and methods for array analysis are provided, for example, in the Affymetrix GeneChip® Expression Analysis Technical Manual, Revision 4, released in 2004 is available from Affymetrix, Inc. (PN 701045). This manual is hereby incorporated herein by reference for all purposes.

CONCLUSION

The inventions herein provide a pool of unique nucleic acid sequences which are complementary to a plurality of yeast genes. These sequences can be used for a variety of types of analyses. In preferred embodiments the sequences are assembled into an array of probes.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

SEQUENCE LISTING (120855 sequences)

SEQ ID NO: 1 - DNA, 25 bp, S. cerevisiae
tggtgccggacctggtaatcctcaa

SEQ ID NO: 2 - DNA, 25 bp, S. cerevisiae
ctgcctttagggtggttggttccat

SEQ ID NO: 3 - DNA, 25 bp, S. cerevisiae
cttcccctaaaacagctatttcgca

SEQ ID NO: 4 - DNA, 25 bp, S. cerevisiae
agacgccttaatgacttttttagct

SEQ ID NO: 5 - DNA, 25 bp, S. cerevisiae
aacggacttgaatcgaattccgaag

SEQ ID NO: 6 - DNA, 25 bp, S. cerevisiae
aggcgaattttgtatcctccttcgg

SEQ ID NO: 7 - DNA, 25 bp, S. cerevisiae
agagtggtcaatgggcccgttacga

SEQ ID NO: 8 - DNA, 25 bp, S. cerevisiae
gggctattacggaaagtttggctgt

SEQ ID NO: 9 - DNA, 25 bp, S. cerevisiae
agatagccaaagtgtaatttcggtg

SEQ ID NO: 10 - DNA, 25 bp, S. cerevisiae
ataaaacagtttgccgtggcttttg

SEQ ID NO: 11 - DNA, 25 bp, S. cerevisiae
ttactaccaggtgtcgttgaagtta

SEQ ID NO: 12 - DNA, 25 bp, S. cerevisiae
gttcaaggtactatagggctcccga

SEQ ID NO: 13 - DNA, 25 bp, S. cerevisiae
atacggaaaccgtcgagtgccaacg

SEQ ID NO: 14 - DNA, 25 bp, S. cerevisiae
ggtaacgcaacctcttttggatttg

SEQ ID NO: 15 - DNA, 25 bp, S. cerevisiae
atgcaaccggcagctagacttttat

SEQ ID NO: 16 - DNA, 25 bp, S. cerevisiae
ccggtcgcgggtatcttttagagat

SEQ ID NO: 17 - DNA, 25 bp, S. cerevisiae
tgaccttaacgggtaaactatcgag

SEQ ID NO: 18 - DNA, 25 bp, S. cerevisiae
aactttacgggatcagacctctggc

SEQ ID NO: 19 - DNA, 25 bp, S. cerevisiae
agaagttccccgtggtgcaacattt

SEQ ID NO: 20 - DNA, 25 bp, S. cerevisiae
gggtctaacccgtgccaaatatggt

SEQ ID NO: 21 - DNA, 25 bp, S. cerevisiae
ctgtttggtccagagaaattccgta

SEQ ID NO: 22 - DNA, 25 bp, S. cerevisiae
ttttaactccaagaaatccaccctg

SEQ ID NO: 23 - DNA, 25 bp, S. cerevisiae
aaagggtcctaagatgtccaccatc

SEQ ID NO: 24 - DNA, 25 bp, S. cerevisiae
accactggatggtgagggtacccac

SEQ ID NO: 25 - DNA, 25 bp, S. cerevisiae
gactcattgcaaccggtaaaaccca

SEQ ID NO: 26 - DNA, 25 bp, S. cerevisiae
tggaagtcccatcattaacccctag

SEQ ID NO: 27 - DNA, 25 bp, S. cerevisiae
atactattaatctggaacgccctaa

SEQ ID NO: 28 - DNA, 25 bp, S. cerevisiae
agcaggtaccggtgacgtttccgag

SEQ ID NO: 29 - DNA, 25 bp, S. cerevisiae
aagccaacgggatgggtccttctca

SEQ ID NO: 30 - DNA, 25 bp, S. cerevisiae
aaaggttttcggtgttgtgcaacag

SEQ ID NO: 31 - DNA, 25 bp, S. cerevisiae
aggtggtgctccaggcggtttccca

SEQ ID NO: 32 - DNA, 25 bp, S. cerevisiae
ctagacgttaagtgcccaggttgtt

SEQ ID NO: 33 - DNA, 25 bp, S. cerevisiae
tcgaactttacgttccaagaaaatg

SEQ ID NO: 34 - DNA, 25 bp, S. cerevisiae
ataggttacttcacttttagctact

SEQ ID NO: 35 - DNA, 25 bp, S. cerevisiae
caagccttaactatagtcccaagcc

SEQ ID NO: 36 - DNA, 25 bp, S. cerevisiae
aacttactaagtgagtccggcgcct

SEQ ID NO: 37 - DNA, 25 bp, S. cerevisiae
gctgtttttcagtgtttccggtaag

SEQ ID NO: 38 - DNA, 25 bp, S. cerevisiae
gctttggaaaaaatcggtattgtcg

SEQ ID NO: 39 - DNA, 25 bp, S. cerevisiae
ttccactaccgttacttgggacgat

SEQ ID NO: 40 - DNA, 25 bp, S. cerevisiae
ctacgttaggtacgctaggaactga

SEQ ID NO: 41 - DNA, 25 bp, S. cerevisiae
accgtagaggtctgctagttccaac

SEQ ID NO: 42 - DNA, 25 bp, S. cerevisiae
agtcttcaaaggaggacgttgctaa

SEQ ID NO: 43 - DNA, 25 bp, S. cerevisiae
agacctctaaacgtggaactatggc

SEQ ID NO: 44 - DNA, 25 bp, S. cerevisiae
ggattactaaccgacagtaaatcta

SEQ ID NO: 45 - DNA, 25 bp, S. cerevisiae
ggacccttgattgggaaagcaacta

SEQ ID NO: 46 - DNA, 25 bp, S. cerevisiae
gttggtttagccaccttaattgtca

SEQ ID NO: 47 - DNA, 25 bp, S. cerevisiae
tgggccaaggcgcttaacttaggaa

SEQ ID NO: 48 - DNA, 25 bp, S. cerevisiae
gtggaacgggttgcccttgtataca

SEQ ID NO: 49 - DNA, 25 bp, S. cerevisiae
gtgccccgttttctggttggtgaat

SEQ ID NO: 50 - DNA, 25 bp, S. cerevisiae
ggtgaccggtagaggaactgttcca

SEQ ID NO: 51 - DNA, 25 bp, S. cerevisiae
aggaccgaagtagtacgacgactct

SEQ ID NO: 52 - DNA, 25 bp, S. cerevisiae
agtaccatcggctccggaggaacgc

SEQ ID NO: 53 - DNA, 25 bp, S. cerevisiae
gagagacgacggttctaagggtact

SEQ ID NO: 54 - DNA, 25 bp, S. cerevisiae
ctaacgagggtcagattggcctaat

SEQ ID NO: 55 - DNA, 25 bp, S. cerevisiae
gaaaagtacgactccttgggtcttg

SEQ ID NO: 56 - DNA, 25 bp, S. cerevisiae
aaactgaacgtctcttgcgtttgga

SEQ ID NO: 57 - DNA, 25 bp, S. cerevisiae
aatccaaaggtcacgactttcggtg

SEQ ID NO: 58 - DNA, 25 bp, S. cerevisiae
ataccgggtctgtggccgtagacta

SEQ ID NO: 59 - DNA, 25 bp, S. cerevisiae
taactgggtcggtgggaaactgatt

SEQ ID NO: 60 - DNA, 25 bp, S. cerevisiae
aagccggtaactcaggactaacatt

SEQ ID NO: 61 - DNA, 25 bp, S. cerevisiae
aaagctttaagtcaaactcaggaag

SEQ ID NO: 62 - DNA, 25 bp, S. cerevisiae
ccttgacccgttgggaagttcaatg

SEQ ID NO: 63 - DNA, 25 bp, S. cerevisiae
atcctttcccaagaggttgatcgat

SEQ ID NO: 64 - DNA, 25 bp, S. cerevisiae
aaaatgtaccagagtcgacgacgct

SEQ ID NO: 65 - DNA, 25 bp, S. cerevisiae
gtaacttggtttctcgacgacgaag

SEQ ID NO: 66 - DNA, 25 bp, S. cerevisiae
aaattcggccccacagaaagctaat

SEQ ID NO: 67 - DNA, 25 bp, S. cerevisiae
aagtaagaaccctcaagacgctaat

SEQ ID NO: 68 - DNA, 25 bp, S. cerevisiae
ctacggtaaccctcaatacgctaag

SEQ ID NO: 69 - DNA, 25 bp, S. cerevisiae
cctcgggtttactctacagcggaag

SEQ ID NO: 70 - DNA, 25 bp, S. cerevisiae
agaggagtgcttaaaaccatcaggg

SEQ ID NO: 71 - DNA, 25 bp, S. cerevisiae
ttgggatttggatctcgaaactaca

SEQ ID NO: 72 - DNA, 25 bp, S. cerevisiae
cgttttggacgtgaagccaggctta

SEQ ID NO: 73 - DNA, 25 bp, S. cerevisiae
aggcgcggtagtacaaaccttgaag

SEQ ID NO: 74 - DNA, 25 bp, S. cerevisiae
ctcacgttaagtcaacacctgctaa

SEQ ID NO: 75 - DNA, 25 bp, S. cerevisiae
accgttagactatactttggagaca

SEQ ID NO: 76 - DNA, 25 bp, S. cerevisiae
caccttaaacgtatctttcgaagag

SEQ ID NO: 77 - DNA, 25 bp, S. cerevisiae
cggctgataaaaccgcttttgaaag

SEQ ID NO: 78 - DNA, 25 bp, S. cerevisiae
acctactaaggtgttcgaaagagcg

SEQ ID NO: 79 - DNA, 25 bp, S. cerevisiae
tacggacccgttgttccaatggtag

SEQ ID NO: 80 - DNA, 25 bp, S. cerevisiae
accgaccgttttgtaatatttgcag

SEQ ID NO: 81 - DNA, 25 bp, S. cerevisiae
acccaactcaaagaccacaaagaag

SEQ ID NO: 82 - DNA, 25 bp, S. cerevisiae
acccaactcaaagaccacaaagaag

SEQ ID NO: 83 - DNA, 25 bp, S. cerevisiae
actaggttccaacaacgccaattga

SEQ ID NO: 84 - DNA, 25 bp, S. cerevisiae
gactccgtaaaagaaagccctgcct

SEQ ID NO: 85 - DNA, 25 bp, S. cerevisiae
tggccgtccaatctttaaaccctga

SEQ ID NO: 86 - DNA, 25 bp, S. cerevisiae
ggtttcgaaggtgttacccacagat

SEQ ID NO: 87 - DNA, 25 bp, S. cerevisiae
atttacgaaggagacccggagcgat

SEQ ID NO: 88 - DNA, 25 bp, S. cerevisiae
gtaatatcgaaggaagaaggttggc

SEQ ID NO: 89 - DNA, 25 bp, S. cerevisiae
aaattaaaggcctcctctcaagcgc

SEQ ID NO: 90 - DNA, 25 bp, S. cerevisiae
acctccggagttgcccaaattgtat

SEQ ID NO: 91 - DNA, 25 bp, S. cerevisiae
aactttgggtcataggcggtgttgc

SEQ ID NO: 92 - DNA, 25 bp, S. cerevisiae
agatttgcggcctcaatggtggttg

SEQ ID NO: 93 - DNA, 25 bp, S. cerevisiae
tggaacaaagtctcctaccccgaag

SEQ ID NO: 94 - DNA, 25 bp, S. cerevisiae
ggaaaccaacccaggtaccgatgtg

SEQ ID NO: 95 - DNA, 25 bp, S. cerevisiae
gcgaggaacccctgttggcaaagtt

SEQ ID NO: 96 - DNA, 25 bp, S. cerevisiae
agggtcaatccgcaggtaaattggc

SEQ ID NO: 97 - DNA, 25 bp, S. cerevisiae
aaggaaacgcttctgggccaatggc

SEQ ID NO: 98 - DNA, 25 bp, S. cerevisiae
tgtagggaccgtcaagggctacttt

SEQ ID NO: 99 - DNA, 25 bp, S. cerevisiae
tcccatttttaatcccaactatcca

SEQ ID NO: 100 - DNA, 25 bp, S. cerevisiae
tgccaaattcccgaaagaacacgaa

SEQ ID NO: 101 - DNA, 25 bp, S. cerevisiae
agcaccaacgtcagttacaacttcg

SEQ ID NO: 102 - DNA, 25 bp, S. cerevisiae
ggtcctacggccacaattacatacg

SEQ ID NO: 103 - DNA, 25 bp, S. cerevisiae
aggcccaattgttccagttattacg

SEQ ID NO: 104 - DNA, 25 bp, S. cerevisiae
agtaccccgaatacaaccagtccat

SEQ ID NO: 105 - DNA, 25 bp, S. cerevisiae
atttccaccaactcggtagttcata

SEQ ID NO: 106 - DNA, 25 bp, S. cerevisiae
atgaacctgcaagaccactgggagt

SEQ ID NO: 107 - DNA, 25 bp, S. cerevisiae
aggatcttgactttaacgaacgtag

SEQ ID NO: 108 - DNA, 25 bp, S. cerevisiae
agaacttactacaccgagtcgtcgg

SEQ ID NO: 109 - DNA, 25 bp, S. cerevisiae
accctttttcacaccatggaagcca

SEQ ID NO: 110 - DNA, 25 bp, S. cerevisiae
tagtttcgattatataaaaaggcca

SEQ ID NO: 111 - DNA, 25 bp, S. cerevisiae
aggttggacactttggaacacggca

SEQ ID NO: 112 - DNA, 25 bp, S. cerevisiae
agtcgcggaaatcaccaattggtta

SEQ ID NO: 113 - DNA, 25 bp, S. cerevisiae
ctactattccgatattggtccctgg

SEQ ID NO: 114 - DNA, 25 bp, S. cerevisiae
gtaaattgcaggtacaagtccccgt

SEQ ID NO: 115 - DNA, 25 bp, S. cerevisiae
gggtagtaggttcagtcaccccagc

SEQ ID NO: 116 - DNA, 25 bp, S. cerevisiae
aggaagaattattgccggaaagtca

SEQ ID NO: 117 - DNA, 25 bp, S. cerevisiae
aggacgacttaatcaacttggccaa

SEQ ID NO: 118 - DNA, 25 bp, S. cerevisiae
acgacgctttaagacactactctct

SEQ ID NO: 119 - DNA, 25 bp, S. cerevisiae
gtcgcctttttagaactaacttctg

SEQ ID NO: 120 - DNA, 25 bp, S. cerevisiae
gccccaagaaaacaattagcctcca

SEQ ID NO: 121 - DNA, 25 bp, S. cerevisiae
ctcttgccaaaacaaaaaaatccat

SEQ ID NO: 122 - DNA, 25 bp, S. cerevisiae
cggtaccttcttcaaacaacacaat

SEQ ID NO: 123 - DNA, 25 bp, S. cerevisiae
ggtcccgctttacaaccagaatttg

SEQ ID NO: 124 - DNA, 25 bp, S. cerevisiae
gggccggtttatcaatgggtactat

SEQ ID NO: 125 - DNA, 25 bp, S. cerevisiae
aggcgccgtttgaaaatggcggcaa

SEQ ID NO: 126 - DNA, 25 bp, S. cerevisiae
tatggtcctggtgaaaaggcccgta

SEQ ID NO: 127 - DNA, 25 bp, S. cerevisiae
taacccgattgacgaaaccgacttg

SEQ ID NO: 128 - DNA, 25 bp, S. cerevisiae
aagctgggaaaacatcggtccgaca

SEQ ID NO: 129 - DNA, 25 bp, S. cerevisiae
acattgccgtaatcctcggtaagga

SEQ ID NO: 130 - DNA, 25 bp, S. cerevisiae
gaacggtgaatcattccggtaacct

SEQ ID NO: 131 - DNA, 25 bp, S. cerevisiae
gaacctggaaacaccgtcgaatccg

SEQ ID NO: 132 - DNA, 25 bp, S. cerevisiae
acctggatgcaatcggtagccgggc

SEQ ID NO: 133 - DNA, 25 bp, S. cerevisiae
atgatttgaagttcgggcccggtga

SEQ ID NO: 134 - DNA, 25 bp, S. cerevisiae
ctggaatacaggcaaacggttttat

SEQ ID NO: 135 - DNA, 25 bp, S. cerevisiae
caagggacgctgcagacgacacgac

SEQ ID NO: 136 - DNA, 25 bp, S. cerevisiae
gtaggaaacttagggaacgccattg

SEQ ID NO: 137 - DNA, 25 bp, S. cerevisiae
ccgtaatatcgaaggaagaaggttg

SEQ ID NO: 138 - DNA, 25 bp, S. cerevisiae
gccgcatacccctgtaactaggaag

SEQ ID NO: 139 - DNA, 25 bp, S. cerevisiae
atagccccaccgatgaatttggagg

SEQ ID NO: 140 - DNA, 25 bp, S. cerevisiae
aaaggtttgagacataagttatcca

SEQ ID NO: 141 - DNA, 25 bp, S. cerevisiae
caaagtttaagcatttacactacca

SEQ ID NO: 142 - DNA, 25 bp, S. cerevisiae
caaattggtaacattttcctactca

SEQ ID NO: 143 - DNA, 25 bp, S. cerevisiae
agggtaccaggtcttacacgagtga

SEQ ID NO: 144 - DNA, 25 bp, S. cerevisiae
agaagtttgggtctacaacaagtag

SEQ ID NO: 145 - DNA, 25 bp, S. cerevisiae
gaatttaacggtctaccaggtgctt

SEQ ID NO: 146 - DNA, 25 bp, S. cerevisiae
tttactagacggattaacggacttg

SEQ ID NO: 147 - DNA, 25 bp, S. cerevisiae
cgttcagttttctttggaagccgct

SEQ ID NO: 148 - DNA, 25 bp, S. cerevisiae
cagattagtttccaacggtaccgat

SEQ ID NO: 149 - DNA, 25 bp, S. cerevisiae
attttatgtttgctgagggtacctc

SEQ ID NO: 150 - DNA, 25 bp, S. cerevisiae
ttattaaataatctaagttacctga

SEQ ID NO: 151 - DNA, 25 bp, S. cerevisiae
cttattcggcctgttttccaggaga

SEQ ID NO: 152 - DNA, 25 bp, S. cerevisiae
atcttgggtcccaccttctaggaga

SEQ ID NO: 153 - DNA, 25 bp, S. cerevisiae
attgaagttcccaccatttttccat

SEQ ID NO: 154 - DNA, 25 bp, S. cerevisiae
atagaaggtagctccgtttcttcct

SEQ ID NO: 155 - DNA, 25 bp, S. cerevisiae
aatacgtacaatgcgggaactccct

SEQ ID NO: 156 - DNA, 25 bp, S. cerevisiae
atagggccaaagtccaacagtttag

SEQ ID NO: 157 - DNA, 25 bp, S. cerevisiae
ttagtcgcttaccaccaaaagtacg

SEQ ID NO: 158 - DNA, 25 bp, S. cerevisiae
ggccggacggaatctcgaacgattt

SEQ ID NO: 159 - DNA, 25 bp, S. cerevisiae
cttcttggaggataccctacagtgt

SEQ ID NO: 160 - DNA, 25 bp, S. cerevisiae
ctttagaaatctcaacctacgttgg

SEQ ID NO: 161 - DNA, 25 bp, S. cerevisiae
ctttgcagaaacagaatcctcccgt

SEQ ID NO: 162 - DNA, 25 bp, S. cerevisiae
cttggccaaatatggttattccgat

SEQ ID NO: 163 - DNA, 25 bp, S. cerevisiae
agccctttagagattagtacgtgtg

SEQ ID NO: 164 - DNA, 25 bp, S. cerevisiae
aaatctactacgtggacgaccattt

SEQ ID NO: 165 - DNA, 25 bp, S. cerevisiae
aaactaccggtagcacagtacagtg

SEQ ID NO: 166 - DNA, 25 bp, S. cerevisiae
accagtcccaggctcaacgataagg

SEQ ID NO: 167 - DNA, 25 bp, S. cerevisiae
accatttttggtgaacggccttgat

SEQ ID NO: 168 - DNA, 25 bp, S. cerevisiae
attaatttacctgacaccggccgag

SEQ ID NO: 169 - DNA, 25 bp, S. cerevisiae
acgcaaactacggaggcagcaggca

SEQ ID NO: 170 - DNA, 25 bp, S. cerevisiae
acctaaaagggctcgctgcgattag

SEQ ID NO: 171 - DNA, 25 bp, S. cerevisiae
accaacagtgcgcagaaaccgttag

SEQ ID NO: 172 - DNA, 25 bp, S. cerevisiae
cttcgaagtccgtgaaatcttgcta

SEQ ID NO: 173 - DNA, 25 bp, S. cerevisiae
gttcctaatgggtgttttcttcagt

SEQ ID NO: 174 - DNA, 25 bp, S. cerevisiae
acgacgtcggttctttgttgtgtag

SEQ ID NO: 175 - DNA, 25 bp, S. cerevisiae
aagccaaacttgctggtattttcgc

SEQ ID NO: 176 - DNA, 25 bp, S. cerevisiae
accgcgagttcgagggcacgttagt

SEQ ID NO: 177 - DNA, 25 bp, S. cerevisiae
tcttcgggaacttcgtccgaggaag

SEQ ID NO: 178 - DNA, 25 bp, S. cerevisiae
gtttctttcgcctacgtggaaggag

SEQ ID NO: 179 - DNA, 25 bp, S. cerevisiae
ttttccctacgatccattcaaggtg

SEQ ID NO: 180 - DNA, 25 bp, S. cerevisiae
atcctgcagacgttatggtttccaa

SEQ ID NO: 181 - DNA, 25 bp, S. cerevisiae
acttgcctcaggtggtaacgataac

SEQ ID NO: 182 - DNA, 25 bp, S. cerevisiae
ctttttgtggccattcaagttgtcc

SEQ ID NO: 183 - DNA, 25 bp, S. cerevisiae
attgcctggttctgatcaacgttac

SEQ ID NO: 184 - DNA, 25 bp, S. cerevisiae
aggctttgcttcaggcggaggaact

SEQ ID NO: 185 - DNA, 25 bp, S. cerevisiae
agggcggccgaatctcgaggacaca

SEQ ID NO: 186 - DNA, 25 bp, S. cerevisiae
ctaccgcaccggaagccgatggaaa

SEQ ID NO: 187 - DNA, 25 bp, S. cerevisiae
gtaccaactggatacgtctagggtt

SEQ ID NO: 188 - DNA, 25 bp, S. cerevisiae
ataccaaccttatgggacgcggtag

SEQ ID NO: 189 - DNA, 25 bp, S. cerevisiae
atatcgtccgcaaactttaactcaa

SEQ ID NO: 190 - DNA, 25 bp, S. cerevisiae
aacgaaatgaaagccggcacttcca

SEQ ID NO: 191 - DNA, 25 bp, S. cerevisiae
agccggaaccaatcatagtaactgt

SEQ ID NO: 192 - DNA, 25 bp, S. cerevisiae
agctaaagccttgcctaaaacttga

SEQ ID NO: 193 - DNA, 25 bp, S. cerevisiae
agtactccgtctggattggtggttc

SEQ ID NO: 194 - DNA, 25 bp, S. cerevisiae
gctgctaacgaatacgggttgcccc

SEQ ID NO: 195 - DNA, 25 bp, S. cerevisiae
agctcaaaacactggcgggttccgg

SEQ ID NO: 196 - DNA, 25 bp, S. cerevisiae
atgcctaagagattaagtgggttac

SEQ ID NO: 197 - DNA, 25 bp, S. cerevisiae
acctcaatagggttgggcgtcctca

SEQ ID NO: 198 - DNA, 25 bp, S. cerevisiae
aagtaataccctcaaacagtgttat

SEQ ID NO: 199 - DNA, 25 bp, S. cerevisiae
aacgataacgcctacgaactagatt

SEQ ID NO: 200 - DNA, 25 bp, S. cerevisiae
cggtatccccgctgaccaagtcact

SEQ ID NO: 201 - DNA, 25 bp, S. cerevisiae
cggtatccccgctgaccaagtcact

SEQ ID NO: 202 - DNA, 25 bp, S. cerevisiae
aggaatcaaccctgacgtaactcca

SEQ ID NO: 203 - DNA, 25 bp, S. cerevisiae
aggaaatacctctctcgaaaccaag

SEQ ID NO: 204 - DNA, 25 bp, S. cerevisiae
agcagtagtacctgacctgcaaccc

SEQ ID NO: 205 - DNA, 25 bp, S. cerevisiae
agaaaaggccaaccgctaacgagct

SEQ ID NO: 206 - DNA, 25 bp, S. cerevisiae
gtaaagtcaccgcacctgaagggtc

SEQ ID NO: 207 - DNA, 25 bp, S. cerevisiae
atagggtagtccaccaacagggctc

SEQ ID NO: 208 - DNA, 25 bp, S. cerevisiae
gggttaggttgtcaccacaatcctc

SEQ ID NO: 209 - DNA, 25 bp, S. cerevisiae
aggtcaagggttcatccaaaccatt

SEQ ID NO: 210 - DNA, 25 bp, S. cerevisiae
agggaaggacctcatcagcctatcg

SEQ ID NO: 211 - DNA, 25 bp, S. cerevisiae
cggtaaggccaacaagcaatttgct

SEQ ID NO: 212 - DNA, 25 bp, S. cerevisiae
aggtacggcttactgacgggttcat

SEQ ID NO: 213 - DNA, 25 bp, S. cerevisiae
atacatgacgaatcccgtggccggt

SEQ ID NO: 214 - DNA, 25 bp, S. cerevisiae
atactgtgttaacctaggccacctt

SEQ ID NO: 215 - DNA, 25 bp, S. cerevisiae
atacgatttacgctcaacccggtga

SEQ ID NO: 216 - DNA, 25 bp, S. cerevisiae
atgtcaacctgggaagtaccccgtg

SEQ ID NO: 217 - DNA, 25 bp, S. cerevisiae
attaaactttggtgctggctccact

SEQ ID NO: 218 - DNA, 25 bp, S. cerevisiae
tactaaaccttacagaggacaccgg

SEQ ID NO: 219 - DNA, 25 bp, S. cerevisiae
accactagtttatttagcccagcta

SEQ ID NO: 220 - DNA, 25 bp, S. cerevisiae
atcccaccacccaggaattgagttt

SEQ ID NO: 221 - DNA, 25 bp, S. cerevisiae
agtccggctgctctcaaacaattag

SEQ ID NO: 222 - DNA, 25 bp, S. cerevisiae
atcccggccccttgtataataatgg

SEQ ID NO: 223 - DNA, 25 bp, S. cerevisiae
ctcctacccgagcaagacttttaga

SEQ ID NO: 224 - DNA, 25 bp, S. cerevisiae
cgtgtaccctttgccaaattggcta

SEQ ID NO: 225 - DNA, 25 bp, S. cerevisiae
gacgacaattggagacaaaaaggtt

SEQ ID NO: 226 - DNA, 25 bp, S. cerevisiae
ccgacgcttggcactggttaaattt

SEQ ID NO: 227 - DNA, 25 bp, S. cerevisiae
ctgcgggattaggttctagtacgtt

SEQ ID NO: 228 - DNA, 25 bp, S. cerevisiae
aggttggttctacaagcgtgctgcc

SEQ ID NO: 229 - DNA, 25 bp, S. cerevisiae
cacggccccattcagtttactaaag

SEQ ID NO: 230 - DNA, 25 bp, S. cerevisiae
acgaaaactgtctaggattcttaca

SEQ ID NO: 231 - DNA, 25 bp, S. cerevisiae
attcaacccaattcaggatccgttc

SEQ ID NO: 232 - DNA, 25 bp, S. cerevisiae
attctagtaatacagcggcgagctc

SEQ ID NO: 233 - DNA, 25 bp, S. cerevisiae
ttccgaatgttctcagggaactcgt

SEQ ID NO: 234 - DNA, 25 bp, S. cerevisiae
taccaaggtctacagggacgccagt

SEQ ID NO: 235 - DNA, 25 bp, S. cerevisiae
taccaggaaggtcacgtgccgtact

SEQ ID NO: 236 - DNA, 25 bp, S. cerevisiae
tcccaaagacctcaaagaagatact

SEQ ID NO: 237 - DNA, 25 bp, S. cerevisiae
tcccaaagacctcaaagaagatact

SEQ ID NO: 238 - DNA, 25 bp, S. cerevisiae
accaactactgctggaacggtacta

SEQ ID NO: 239 - DNA, 25 bp, S. cerevisiae
atccttcctccaaaatacggtcact

SEQ ID NO: 240 - DNA, 25 bp, S. cerevisiae
atagttcccctattaacacgttgcg

SEQ ID NO: 241 - DNA, 25 bp, S. cerevisiae
atagtattccgtcaaaacctggtga

SEQ ID NO: 242 - DNA, 25 bp, S. cerevisiae
tttacggtaggccaaaaatcataca

SEQ ID NO: 243 - DNA, 25 bp, S. cerevisiae
tttaaggtggtacaaggcgacgaca

SEQ ID NO: 244 - DNA, 25 bp, S. cerevisiae
attctgcaggccacaaaagtcgact

SEQ ID NO: 245 - DNA, 25 bp, S. cerevisiae
ataaagggcccaagaacggacatgc

SEQ ID NO: 246 - DNA, 25 bp, S. cerevisiae
agacaagtacgcactggacggacag

SEQ ID NO: 247 - DNA, 25 bp, S. cerevisiae
accggcatggtcagcttgcacggaa

SEQ ID NO: 248 - DNA, 25 bp, S. cerevisiae
aggcaattggaatgggtctacgaaa

SEQ ID NO: 249 - DNA, 25 bp, S. cerevisiae
atataccacaaatagtccctcaaaa

SEQ ID NO: 250 - DNA, 25 bp, S. cerevisiae
atttcccgcaagtggccttaagaga

SEQ ID NO: 251 - DNA, 25 bp, S. cerevisiae
atttcccgggtcatcccagaggagt

SEQ ID NO: 252 - DNA, 25 bp, S. cerevisiae
atggtaaaaagcaccgccgcagact

SEQ ID NO: 253 - DNA, 25 bp, S. cerevisiae
tttgtaacggagcaaccccaaggcg

SEQ ID NO: 254 - DNA, 25 bp, S. cerevisiae
ttcgtaaccggccaaattccaacag

SEQ ID NO: 255 - DNA, 25 bp, S. cerevisiae
attcccaccgggagtagattctttg

SEQ ID NO: 256 - DNA, 25 bp, S. cerevisiae
atcgaatccaagcaacctaactctg

SEQ ID NO: 257 - DNA, 25 bp, S. cerevisiae
atccaaaaaggttcgtagggctgct

SEQ ID NO: 258 - DNA, 25 bp, S. cerevisiae
tttaaactacccaatccactgaacg

SEQ ID NO: 259 - DNA, 25 bp, S. cerevisiae
attccattgatctcgcaatccttga

SEQ ID NO: 260 - DNA, 25 bp, S. cerevisiae
attccctttctatagattgtggccc

SEQ ID NO: 261 - DNA, 25 bp, S. cerevisiae
atcagtttggttcccgaaagtcaat

SEQ ID NO: 262 - DNA, 25 bp, S. cerevisiae
atcattcggtgttccggttaaacag

SEQ ID NO: 263 - DNA, 25 bp, S. cerevisiae
aaagggcaattctggctgttaacgc

SEQ ID NO: 264 - DNA, 25 bp, S. cerevisiae
atatatccagagtcgaggtcgtttc

SEQ ID NO: 265 - DNA, 25 bp, S. cerevisiae
atacgacgttctcggtgagttacca

SEQ ID NO: 266 - DNA, 25 bp, S. cerevisiae
ataagccttgcctgggttaactaca

SEQ ID NO: 267 - DNA, 25 bp, S. cerevisiae
atgggcctacggatgacggaacgaa

SEQ ID NO: 268 - DNA, 25 bp, S. cerevisiae
acggccgacgggatctagccagata

SEQ ID NO: 269 - DNA, 25 bp, S. cerevisiae
acggaaggtgagagccagatccaaa

SEQ ID NO: 270 - DNA, 25 bp, S. cerevisiae
aggcgggacctaagctggaagtaat

SEQ ID NO: 271 - DNA, 25 bp, S. cerevisiae
aacgttccttcgctgaaagtagtga

SEQ ID NO: 272 - DNA, 25 bp, S. cerevisiae
atcacgttcccacacaaaggcaatt

SEQ ID NO: 273 - DNA, 25 bp, S. cerevisiae
agcacggctttacaaaaaactctat

SEQ ID NO: 274 - DNA, 25 bp, S. cerevisiae
accacactttggctaacaacgtcga

SEQ ID NO: 275 - DNA, 25 bp, S. cerevisiae
acagtaacggtgctaacgtcgtcgt

SEQ ID NO: 276 - DNA, 25 bp, S. cerevisiae
caaggacaactacctaaagctgggt

SEQ ID NO: 277 - DNA, 25 bp, S. cerevisiae
aatggtcaactactaaacgccggag

SEQ ID NO: 278 - DNA, 25 bp, S. cerevisiae
atggtctacacgatataccccggga

SEQ ID NO: 279 - DNA, 25 bp, S. cerevisiae
aggtctaatgtcaaaactactcgtg

SEQ ID NO: 280 - DNA, 25 bp, S. cerevisiae
aggttatatccgcaactagtggtaa

SEQ ID NO: 281 - DNA, 25 bp, S. cerevisiae
aggactaacgccttttcagggagat

SEQ ID NO: 282 - DNA, 25 bp, S. cerevisiae
agaactcgacggtgtcttgtacgtt

SEQ ID NO: 283 - DNA, 25 bp, S. cerevisiae
aaagcaagtcggtgttggtaagttg

SEQ ID NO: 284 - DNA, 25 bp, S. cerevisiae
caaaatctcccgtggtaataaggtg

SEQ ID NO: 285 - DNA, 25 bp, S. cerevisiae
ctgcaaattccccaaggccaataat

SEQ ID NO: 286 - DNA, 25 bp, S. cerevisiae
actttttccgcaaggccgcattttg

SEQ ID NO: 287 - DNA, 25 bp, S. cerevisiae
tgttaacagggatgactcggacgtc

SEQ ID NO: 288 - DNA, 25 bp, S. cerevisiae
gttcgttcgaaatggtcgtggccca

SEQ ID NO: 289 - DNA, 25 bp, S. cerevisiae
gttccgttagaatgggccgactcca

SEQ ID NO: 290 - DNA, 25 bp, S. cerevisiae
atcccgtacaaatgtagcccacttt

SEQ ID NO: 291 - DNA, 25 bp, S. cerevisiae
caactaaggcgtctgttatgggtac

SEQ ID NO: 292 - DNA, 25 bp, S. cerevisiae
aagaacgggtcttctaagggtgctg

SEQ ID NO: 293 - DNA, 25 bp, S. cerevisiae
actaaggaggcagcgatggcaatta

SEQ ID NO: 294 - DNA, 25 bp, S. cerevisiae
ccgaagacgcggtgcaggtttattt

SEQ ID NO: 295 - DNA, 25 bp, S. cerevisiae
ccgtagaccgtgacctggaagctca

SEQ ID NO: 296 - DNA, 25 bp, S. cerevisiae
gacccgaccggtgttgacaatgctt

SEQ ID NO: 297 - DNA, 25 bp, S. cerevisiae
acgagtttcggatcatacagggttt

SEQ ID NO: 298 - DNA, 25 bp, S. cerevisiae
gagtagggctagcaagataacgttt

SEQ ID NO: 299 - DNA, 25 bp, S. cerevisiae
gctaagggtctacaaaccgttgtcg

SEQ ID NO: 300 - DNA, 25 bp, S. cerevisiae
gccaagggtcctaaatctacgtctg

SEQ ID NO: 301 - DNA, 25 bp, S. cerevisiae
gcccgtggtccaacttagaagtcgt

SEQ ID NO: 302 - DNA, 25 bp, S. cerevisiae
cccacagggtcaaggttcaagtcct

SEQ ID NO: 303 - DNA, 25 bp, S. cerevisiae
tcccaaggacgctgtggtgaaggtt

SEQ ID NO: 304 - DNA, 25 bp, S. cerevisiae
gcccgtagaggctggaatgtccgtt

SEQ ID NO: 305 - DNA, 25 bp, S. cerevisiae
attacggttcaagagccagtgcctt

SEQ ID NO: 306 - DNA, 25 bp, S. cerevisiae
attagagagtcatcggaccaaccgg

SEQ ID NO: 307 - DNA, 25 bp, S. cerevisiae
aatcgtcggcaagaacgcaactggg

SEQ ID NO: 308 - DNA, 25 bp, S. cerevisiae
attcccggacatgtacgccaggtga

SEQ ID NO: 309 - DNA, 25 bp, S. cerevisiae
tcttgtccgggctctactaaggata

SEQ ID NO: 310 - DNA, 25 bp, S. cerevisiae
tcctgcccaattgcctagaaaggtt

SEQ ID NO: 311 - DNA, 25 bp, S. cerevisiae
ctagcgcaactcgtcctgaaaggta

SEQ ID NO: 312 - DNA, 25 bp, S. cerevisiae
cgaccaggccaatccgaagtaattt

SEQ ID NO: 313 - DNA, 25 bp, S. cerevisiae
cggtaagcccaagcctagtacgtgg

SEQ ID NO: 314 - DNA, 25 bp, S. cerevisiae
gccagaagaaccggtttactacgtg

SEQ ID NO: 315 - DNA, 25 bp, S. cerevisiae
atcggaaatacacgctttaaagctt

SEQ ID NO: 316 - DNA, 25 bp, S. cerevisiae
attgtaatggaacgcctggacgaat

SEQ ID NO: 317 - DNA, 25 bp, S. cerevisiae
tcggtagatcaatccggtacggcat

SEQ ID NO: 318 - DNA, 25 bp, S. cerevisiae
cttccaacttaatctttgccagcag

SEQ ID NO: 319 - DNA, 25 bp, S. cerevisiae
cttcaaaacctccagtccaaatgtg

SEQ ID NO: 320 - DNA, 25 bp, S. cerevisiae
tttaaaaccagttgacgaggcggat

SEQ ID NO: 321 - DNA, 25 bp, S. cerevisiae
attgaaaacgccaccaaggacattt

SEQ ID NO: 322 - DNA, 25 bp, S. cerevisiae
aggctggaactctaccgttggtcaa

SEQ ID NO: 323 - DNA, 25 bp, S. cerevisiae
aggccctccaattcgttaagtctat

SEQ ID NO: 324 - DNA, 25 bp, S. cerevisiae
agggcccgctttacactggaggttg

SEQ ID NO: 325 - DNA, 25 bp, S. cerevisiae
cttggcccaattgacctccaagttg

SEQ ID NO: 326 - DNA, 25 bp, S. cerevisiae
cttggacttcaagaacccagaatct

SEQ ID NO: 327 - DNA, 25 bp, S. cerevisiae
gcctcgacctaataactctactttt

SEQ ID NO: 328 - DNA, 25 bp, S. cerevisiae
cctcgaccaggtgaatttacgccaa

SEQ ID NO: 329 - DNA, 25 bp, S. cerevisiae
ccgacccagcctgaattcaaaggta

SEQ ID NO: 330 - DNA, 25 bp, S. cerevisiae
aaaccaggcctgcttacgatgggta

SEQ ID NO: 331 - DNA, 25 bp, S. cerevisiae
aaaccgggtgtatactatacactca

SEQ ID NO: 332 - DNA, 25 bp, S. cerevisiae
aaaccgtttgaagaatatggagctc

SEQ ID NO: 333 - DNA, 25 bp, S. cerevisiae
aaccacgctaactgaaaagggctct

SEQ ID NO: 334 - DNA, 25 bp, S. cerevisiae
tgaacgccggtatcgaaggaccctt

SEQ ID NO: 335 - DNA, 25 bp, S. cerevisiae
aaatccgagctagaaggtgtccctt

SEQ ID NO: 336 - DNA, 25 bp, S. cerevisiae
aaactgctaggatccgtaacggcca

SEQ ID NO: 337 - DNA, 25 bp, S. cerevisiae
agaactaattaatcgttacgcgtat

SEQ ID NO: 338 - DNA, 25 bp, S. cerevisiae
ataagtacgaactcggtccgcggat

SEQ ID NO: 339 - DNA, 25 bp, S. cerevisiae
aacgcaacgaaacatgggcacgcag

SEQ ID NO: 340 - DNA, 25 bp, S. cerevisiae
acccagacgaaaacaagactagagt

SEQ ID NO: 341 - DNA, 25 bp, S. cerevisiae
atcccggcagcttaccaaaacgtgg

SEQ ID NO: 342 - DNA, 25 bp, S. cerevisiae
accagtattcagcaccgttaacaag

SEQ ID NO: 343 - DNA, 25 bp, S. cerevisiae
atgggcttctagcaccttagtggag

SEQ ID NO: 344 - DNA, 25 bp, S. cerevisiae
attcgctaagcctggtcaaattgca

SEQ ID NO: 345 - DNA, 25 bp, S. cerevisiae
attggctgctttcaaggcttacttg

SEQ ID NO: 346 - DNA, 25 bp, S. cerevisiae
attcggtcgcatcaagggtacaaac

SEQ ID NO: 347 - DNA, 25 bp, S. cerevisiae
attcgcgtcgcgtgggcgccgaaaa

SEQ ID NO: 348 - DNA, 25 bp, S. cerevisiae
cttaagtccagtgcaaaacgaacaa

SEQ ID NO: 349 - DNA, 25 bp, S. cerevisiae
atttagtcgcacatcctaaggaaga

SEQ ID NO: 350 - DNA, 25 bp, S. cerevisiae
ataaatattcttcaccggtaagcgg

SEQ ID NO: 351 - DNA, 25 bp, S. cerevisiae
ataagtttttctgtttacgctggag

SEQ ID NO: 352 - DNA, 25 bp, S. cerevisiae
gggttatgccttcaataaaccacta

SEQ ID NO: 353 - DNA, 25 bp, S. cerevisiae
agggttaatgctatcgaacacgtta

SEQ ID NO: 354 - DNA, 25 bp, S. cerevisiae
aggcctgtacttattcggcggagta

SEQ ID NO: 355 - DNA, 25 bp, S. cerevisiae
gggccttactttatcaactaccaat

SEQ ID NO: 356 - DNA, 25 bp, S. cerevisiae
agttggtacatcgaaaggccctcca

SEQ ID NO: 357 - DNA, 25 bp, S. cerevisiae
gtagccaggaatcagtaccgggaaa

SEQ ID NO: 358 - DNA, 25 bp, S. cerevisiae
attttttcaaccttgccagttccag

SEQ ID NO: 359 - DNA, 25 bp, S. cerevisiae
atccggcactcgaatttagggtctt

SEQ ID NO: 360 - DNA, 25 bp, S. cerevisiae
atcggacgggaaacggtgctttctg

SEQ ID NO: 361 - DNA, 25 bp, S. cerevisiae
ctctgccaagaacaagggtcgtatt

SEQ ID NO: 362 - DNA, 25 bp, S. cerevisiae
cctacaaaaaacaggcacatcgtgt

SEQ ID NO: 363 - DNA, 25 bp, S. cerevisiae
agctttggaaaagattggtatcgtc

SEQ ID NO: 364 - DNA, 25 bp, S. cerevisiae
gttggacccgaaccagatttactgt

SEQ ID NO: 365 - DNA, 25 bp, S. cerevisiae
agtaacttggactgccgagcgggtc

SEQ ID NO: 366 - DNA, 25 bp, S. cerevisiae
ataacagttgggtgccgaagtggtt

SEQ ID NO: 367 - DNA, 25 bp, S. cerevisiae
aaacgtttgaaagcgaggctgccca

SEQ ID NO: 368 - DNA, 25 bp, S. cerevisiae
aaaggctttggagaccgaatgctat

SEQ ID NO: 369 - DNA, 25 bp, S. cerevisiae
tttacgcttgggagacccattgtag

SEQ ID NO: 370 - DNA, 25 bp, S. cerevisiae
accccaatgggtcgaccaatggtat

SEQ ID NO: 371 - DNA, 25 bp, S. cerevisiae
gtcaaagctaaacagggcgccggtt

SEQ ID NO: 372 - DNA, 25 bp, S. cerevisiae
gtagaagccataaagttagcccggg

SEQ ID NO: 373 - DNA, 25 bp, S. cerevisiae
ttagaagcagtacatttaacccggg

SEQ ID NO: 374 - DNA, 25 bp, S. cerevisiae
agcaagcccgtaaagaatctcccta

SEQ ID NO: 375 - DNA, 25 bp, S. cerevisiae
aattaccgattatgttccgcctgaa

SEQ ID NO: 376 - DNA, 25 bp, S. cerevisiae
attaccttaggatattcgtcgcgaa

SEQ ID NO: 377 - DNA, 25 bp, S. cerevisiae
atctactttcggtgttaatgccatg

SEQ ID NO: 378 - DNA, 25 bp, S. cerevisiae
atcccgtattttcactcaaacttcg

SEQ ID NO: 379 - DNA, 25 bp, S. cerevisiae
aggcggccttttcagattaacgttg

SEQ ID NO: 380 - DNA, 25 bp, S. cerevisiae
attgaggagtacacacgcggacccg

SEQ ID NO: 381 - DNA, 25 bp, S. cerevisiae
cattttcctactcaacggaaaagtg

SEQ ID NO: 382 - DNA, 25 bp, S. cerevisiae
ctgattcaacgtttaagaccactgt

SEQ ID NO: 383 - DNA, 25 bp, S. cerevisiae
atacaatcgacacttgacaattacg

SEQ ID NO: 384 - DNA, 25 bp, S. cerevisiae
ataccgaatacgtccaagttgaggt

SEQ ID NO: 385 - DNA, 25 bp, S. cerevisiae
atactttctacgtccaagttggagc

SEQ ID NO: 386 - DNA, 25 bp, S. cerevisiae
agttaggtaggctgggctactccgt

SEQ ID NO: 387 - DNA, 25 bp, S. cerevisiae
agtctgggtggagacgttcactctc

SEQ ID NO: 388 - DNA, 25 bp, S. cerevisiae
attcatccaagggttccaagcgttc

SEQ ID NO: 389 - DNA, 25 bp, S. cerevisiae
attgaccactggcaacgaacgtttg

SEQ ID NO: 390 - DNA, 25 bp, S. cerevisiae
atggttggcaagagttaccttcgtt

SEQ ID NO: 391 - DNA, 25 bp, S. cerevisiae
atggcctagaaaaagttcgctacgt

SEQ ID NO: 392 - DNA, 25 bp, S. cerevisiae
attccccgagagagttggcggcttt

SEQ ID NO: 393 - DNA, 25 bp, S. cerevisiae
gggacttcggtgcattggaacctta

SEQ ID NO: 394 - DNA, 25 bp, S. cerevisiae
attatgactgtagccctttttaccg

SEQ ID NO: 395 - DNA, 25 bp, S. cerevisiae
ctattggatcctgaagtcgaacccc

SEQ ID NO: 396 - DNA, 25 bp, S. cerevisiae
tcccttaccttatgacgaaaccgat

SEQ ID NO: 397 - DNA, 25 bp, S. cerevisiae
attcaattccccttacaagacttca

SEQ ID NO: 398 - DNA, 25 bp, S. cerevisiae
attgacagcccaacgtgaaaggttt

SEQ ID NO: 399 - DNA, 25 bp, S. cerevisiae
attgacctgggcagaaggcacgttt

SEQ ID NO: 400 - DNA, 25 bp, S. cerevisiae
attacctgttggtgaagccggcgtc

SEQ ID NO: 401 - DNA, 25 bp, S. cerevisiae
ataggttccgatctagttagttttg

SEQ ID NO: 402 - DNA, 25 bp, S. cerevisiae
agtcgtccgaaagcctgttgatgtg

SEQ ID NO: 403 - DNA, 25 bp, S. cerevisiae
attggacgtaaatcccatctaggta

SEQ ID NO: 404 - DNA, 25 bp, S. cerevisiae
atgtacaagtaacacgtgccacggt

SEQ ID NO: 405 - DNA, 25 bp, S. cerevisiae
attgagaacgggtggccacaggcct

SEQ ID NO: 406 - DNA, 25 bp, S. cerevisiae
attgtgcagtatttgagcggcgctc

SEQ ID NO: 407 - DNA, 25 bp, S. cerevisiae
atccaaggaggcgagctagctgcta

SEQ ID NO: 408 - DNA, 25 bp, S. cerevisiae
gatggcattcagctcggtcagtgtc

SEQ ID NO: 409 - DNA, 25 bp, S. cerevisiae
agcgttaaaccaccaaatgctcctg

SEQ ID NO: 410 - DNA, 25 bp, S. cerevisiae
acgtgtaaaccatgtaatctttgag

SEQ ID NO: 411 - DNA, 25 bp, S. cerevisiae
attcgtcaaacgtgtactatagtgg

SEQ ID NO: 412 - DNA, 25 bp, S. cerevisiae
attgaggcagggtatattttttaat

SEQ ID NO: 413 - DNA, 25 bp, S. cerevisiae
attggcggttgctgttttcatttct

SEQ ID NO: 414 - DNA, 25 bp, S. cerevisiae
atatccggtacgcattttcattagt

SEQ ID NO: 415 - DNA, 25 bp, S. cerevisiae
aacccggacacgttgttattagctg

SEQ ID NO: 416 - DNA, 25 bp, S. cerevisiae
atttgtgggcagtcgttccaaacgc

SEQ ID NO: 417 - DNA, 25 bp, S. cerevisiae
attttgggcgcctctgcggaagaca

SEQ ID NO: 418 - DNA, 25 bp, S. cerevisiae
attgttggtgccgttatggtcagag

SEQ ID NO: 419 - DNA, 25 bp, S. cerevisiae
attcgatcagtggtacaaggagcaa

SEQ ID NO: 420 - DNA, 25 bp, S. cerevisiae
attgggctggattttacgttactca

SEQ ID NO: 421 - DNA, 25 bp, S. cerevisiae
attgcgtacgaattctaacggacta

SEQ ID NO: 422 - DNA, 25 bp, S. cerevisiae
atgtgggacgtttctacaggcgact

SEQ ID NO: 423 - DNA, 25 bp, S. cerevisiae
attggccgcttataacaagaaatcc

SEQ ID NO: 424 - DNA, 25 bp, S. cerevisiae
attgtctccgctcccagaaaaagat

SEQ ID NO: 425 - DNA, 25 bp, S. cerevisiae
attacgggccgtgctcaaattagtt

SEQ ID NO: 426 - DNA, 25 bp, S. cerevisiae
attacggtcggtgcttcgacattta

SEQ ID NO: 427 - DNA, 25 bp, S. cerevisiae
attccggtccagatggtatcgatct

SEQ ID NO: 428 - DNA, 25 bp, S. cerevisiae
attctgaggaccagtgtgtttcccc

SEQ ID NO: 429 - DNA, 25 bp, S. cerevisiae
attgggattatgtcacgaggcactt

SEQ ID NO: 430 - DNA, 25 bp, S. cerevisiae
atagctgaacctgaacctgaacctg

SEQ ID NO: 431 - DNA, 25 bp, S. cerevisiae
actttaccgaattcctaatgccgtg

SEQ ID NO: 432 - DNA, 25 bp, S. cerevisiae
attgcccactaccaggaattagacg

SEQ ID NO: 433 - DNA, 25 bp, S. cerevisiae
attggcgacgaaccgaattacctca

SEQ ID NO: 434 - DNA, 25 bp, S. cerevisiae
attgtccccacctgatctaaaaatt

SEQ ID NO: 435 - DNA, 25 bp, S. cerevisiae
attcccgccgaccaagttaccagag

SEQ ID NO: 436 - DNA, 25 bp, S. cerevisiae
attcccgccgaccaagttaccagag

SEQ ID NO: 437 - DNA, 25 bp, S. cerevisiae
attccctggctgtgggttaccaagt

SEQ ID NO: 438 - DNA, 25 bp, S. cerevisiae
attccctttgattccaacgtggttg

SEQ ID NO: 439 - DNA, 25 bp, S. cerevisiae
attcccgtaagctgacaagatggtt

SEQ ID NO: 440 - DNA, 25 bp, S. cerevisiae
atacctgagaaagcaacctgaccta

SEQ ID NO: 441 - DNA, 25 bp, S. cerevisiae
attgcatccacctagtaacgtacct

SEQ ID NO: 442 - DNA, 25 bp, S. cerevisiae
attgcatccagtggcgccggtgtac

SEQ ID NO: 443 - DNA, 25 bp, S. cerevisiae
attgtccagtccgagggtattgccg

SEQ ID NO: 444 - DNA, 25 bp, S. cerevisiae
attgtcggacctagcttgggtgcca

SEQ ID NO: 445 - DNA, 25 bp, S. cerevisiae
attgtcgtaggttgttgggccacta

SEQ ID NO: 446 - DNA, 25 bp, S. cerevisiae
attacgtagaattcccaatccctga

SEQ ID NO: 447 - DNA, 25 bp, S. cerevisiae
attgtcaaggctgttggtattggtt

SEQ ID NO: 448 - DNA, 25 bp, S. cerevisiae
attcgatacgactcggacgtggttt

SEQ ID NO: 449 - DNA, 25 bp, S. cerevisiae
atgagtattcccatctggacgtttt

SEQ ID NO: 450 - DNA, 25 bp, S. cerevisiae
attactgtcccgactggaagggcgg

SEQ ID NO: 451 - DNA, 25 bp, S. cerevisiae
attggttccagcgacgagaaaacgt

SEQ ID NO: 452 - DNA, 25 bp, S. cerevisiae
attggtccgacattcgaggatcccg

SEQ ID NO: 453 - DNA, 25 bp, S. cerevisiae
attggcccgctgaggagacgctcga

SEQ ID NO: 454 - DNA, 25 bp, S. cerevisiae
attaactggcgatggaatactagcg

SEQ ID NO: 455 - DNA, 25 bp, S. cerevisiae
cttttcgcacactggtaactacggt

SEQ ID NO: 456 - DNA, 25 bp, S. cerevisiae
cagttttcccggcaaagtttggcat

SEQ ID NO: 457 - DNA, 25 bp, S. cerevisiae
aacgaagaatgctccaagtggtact

SEQ ID NO: 458 - DNA, 25 bp, S. cerevisiae
caacctgataaggaaccgggtactg

SEQ ID NO: 459 - DNA, 25 bp, S. cerevisiae
aagcacagaaagcaccccggtggta

SEQ ID NO: 460 - DNA, 25 bp, S. cerevisiae
ataccaatattgcagccggcggtgc

SEQ ID NO: 461 - DNA, 25 bp, S. cerevisiae
ataggacgcattcatacggcggtac

SEQ ID NO: 462 - DNA, 25 bp, S. cerevisiae
attgggctccattgaactttggcgc

SEQ ID NO: 463 - DNA, 25 bp, S. cerevisiae
attggtatccatagctcagcggttc

SEQ ID NO: 464 - DNA, 25 bp, S. cerevisiae
attggttggcacatcatgccttttc

SEQ ID NO: 465 - DNA, 25 bp, S. cerevisiae
attggaagaccacatcctttcactt

SEQ ID NO: 466 - DNA, 25 bp, S. cerevisiae
attggtcaaactatacactttccta

SEQ ID NO: 467 - DNA, 25 bp, S. cerevisiae
atttgaaatttcattgccggtacta

SEQ ID NO: 468 - DNA, 25 bp, S. cerevisiae
agcacttgtcctacgtggggttaga

SEQ ID NO: 469 - DNA, 25 bp, S. cerevisiae
atccaatggcggtggtgggttcctt

SEQ ID NO: 470 - DNA, 25 bp, S. cerevisiae
attcacagagcacatttattggttg

SEQ ID NO: 471 - DNA, 25 bp, S. cerevisiae
attgccgaaaatatcaagcttgcga

SEQ ID NO: 472 - DNA, 25 bp, S. cerevisiae
attttccggagacaacatctttcaa

SEQ ID NO: 473 - DNA, 25 bp, S. cerevisiae
attgtaccaggacaggctcttctta

SEQ ID NO: 474 - DNA, 25 bp, S. cerevisiae
attggtaagcggtagttccactcaa

SEQ ID NO: 475 - DNA, 25 bp, S. cerevisiae
atttgttactggaagcctacccact

SEQ ID NO: 476 - DNA, 25 bp, S. cerevisiae
attgtctacggtgtggctgactcac

SEQ ID NO: 477 - DNA, 25 bp, S. cerevisiae
attgtccaagaagtttgctcacccc

SEQ ID NO: 478 - DNA, 25 bp, S. cerevisiae
attgtcgacaatgcctccatgcagg

SEQ ID NO: 479 - DNA, 25 bp, S. cerevisiae
attgcgaccgtctcgcaagatggga

SEQ ID NO: 480 - DNA, 25 bp, S. cerevisiae
aaggtcctacctgtaatgggctcga

SEQ ID NO: 481 - DNA, 25 bp, S. cerevisiae
attggcccagacgtggttatcggtc

SEQ ID NO: 482 - DNA, 25 bp, S. cerevisiae
attgcagagacagccacgtaccatc

SEQ ID NO: 483 - DNA, 25 bp, S. cerevisiae
attggaagacggtgacatcatctct

SEQ ID NO: 484 - DNA, 25 bp, S. cerevisiae
atttaagatcgtcttcgtcttcgtc

SEQ ID NO: 485 - DNA, 25 bp, S. cerevisiae
attttactagtacttatggcttgga

SEQ ID NO: 486 - DNA, 25 bp, S. cerevisiae
atttggtatcactggtaccctgggt

SEQ ID NO: 487 - DNA, 25 bp, S. cerevisiae
ataggatttcactgaccatcccagt

SEQ ID NO: 488 - DNA, 25 bp, S. cerevisiae
atattgatcgcgaaaggccaacatg

SEQ ID NO: 489 - DNA, 25 bp, S. cerevisiae
attggcagcgctgtcagtccaagaa

SEQ ID NO: 490 - DNA, 25 bp, S. cerevisiae
attggctacagcctcagtaatcaaa

SEQ ID NO: 491 - DNA, 25 bp, S. cerevisiae
attggcaagccttctttatcttcta

SEQ ID NO: 492 - DNA, 25 bp, S. cerevisiae
attggtaccggtttggctgctactc

SEQ ID NO: 493 - DNA, 25 bp, S. cerevisiae
atcgattaccggtgtagcatactct

SEQ ID NO: 494 - DNA, 25 bp, S. cerevisiae
atctgaaaccgagcagtttaccggg

SEQ ID NO: 495 - DNA, 25 bp, S. cerevisiae
attgcccatttgattttaaccgacg

SEQ ID NO: 496 - DNA, 25 bp, S. cerevisiae
attccaagttctttggcctacggag

SEQ ID NO: 497 - DNA, 25 bp, S. cerevisiae
attcgacgtggaaatcgccaaccgc

SEQ ID NO: 498 - DNA, 25 bp, S. cerevisiae
attccttctgaacatagtcgaccgc

SEQ ID NO: 499 - DNA, 25 bp, S. cerevisiae
attccatgcttgtaggtggctgcga

SEQ ID NO: 500 - DNA, 25 bp, S. cerevisiae
attgtgcatccgtagcgtttggtta

SEQ ID NO: 501 - DNA, 25 bp, S. cerevisiae
agtgggagtttctgtgcctattggc

SEQ ID NO: 502 - DNA, 25 bp, S. cerevisiae
aacaagtgaggatccaaccgggctc

SEQ ID NO: 503 - DNA, 25 bp, S. cerevisiae
attgggatccctcttggattacgag

SEQ ID NO: 504 - DNA, 25 bp, S. cerevisiae
attcgagtcccctggagagctacta

SEQ ID NO: 505 - DNA, 25 bp, S. cerevisiae
attcccttcgcgtgagaccatcaaa

SEQ ID NO: 506 - DNA, 25 bp, S. cerevisiae
attgcaccaacgaacagggctgtct

SEQ ID NO: 507 - DNA, 25 bp, S. cerevisiae
attggccacatcaccaaggctttgg

SEQ ID NO: 508 - DNA, 25 bp, S. cerevisiae
attggcacgcctggacaaagatatt

SEQ ID NO: 509 - DNA, 25 bp, S. cerevisiae
attggctgcgtataacaagaagtct

SEQ ID NO: 510 - DNA, 25 bp, S. cerevisiae
attgtccaaacgttcggttgcatag

SEQ ID NO: 511 - DNA, 25 bp, S. cerevisiae
attgttacctggaaaatcatcggaa

SEQ ID NO: 512 - DNA, 25 bp, S. cerevisiae
attgtttctgcgttaatatccggat

SEQ ID NO: 513 - DNA, 25 bp, S. cerevisiae
attatgggtggctcaaatgctatca

SEQ ID NO: 514 - DNA, 25 bp, S. cerevisiae
attgaaggtgatcccaacgcgctag

SEQ ID NO: 515 - DNA, 25 bp, S. cerevisiae
attgcagttgaccaaaccgcgattg

SEQ ID NO: 516 - DNA, 25 bp, S. cerevisiae
attgcagagtgggtagcatgtccat

SEQ ID NO: 517 - DNA, 25 bp, S. cerevisiae
attatggaccatgaggaagctagaa

SEQ ID NO: 518 - DNA, 25 bp, S. cerevisiae
attgaggatctcaaagagaacatta

SEQ ID NO: 519 - DNA, 25 bp, S. cerevisiae
attcatgggccaaaggactatttcc

SEQ ID NO: 520 - DNA, 25 bp, S. cerevisiae
attgagtggaataatggccttgtta

SEQ ID NO: 521 - DNA, 25 bp, S. cerevisiae
attgaggccatgaacattccatgtg

SEQ ID NO: 522 - DNA, 25 bp, S. cerevisiae
attgaagccagggtgcatccagaac

SEQ ID NO: 523 - DNA, 25 bp, S. cerevisiae
atttcaatcatttcaacccggactt

SEQ ID NO: 524 - DNA, 25 bp, S. cerevisiae
atatgacgagacaaccaaccacctt

SEQ ID NO: 525 - DNA, 25 bp, S. cerevisiae
attgtccgaggactctcaccacttg

SEQ ID NO: 526 - DNA, 25 bp, S. cerevisiae
attggttacgatccaactgctcctg

SEQ ID NO: 527 - DNA, 25 bp, S. cerevisiae
attccggccgatcaagctgcgaaga

SEQ ID NO: 528 - DNA, 25 bp, S. cerevisiae
attgccgggccacgtttggaaacag

SEQ ID NO: 529 - DNA, 25 bp, S. cerevisiae
attgcaccaggccaaggattctgaa

SEQ ID NO: 530 - DNA, 25 bp, S. cerevisiae
attgcgccagggaatgctatgccta

SEQ ID NO: 531 - DNA, 25 bp, S. cerevisiae
attgaccaatggtatcactgccgac

SEQ ID NO: 532 - DNA, 25 bp, S. cerevisiae
attgacctgtggaacgtttacgtag

SEQ ID NO: 533 - DNA, 25 bp, S. cerevisiae
attgaacatgttgcccgtgacagga

SEQ ID NO: 534 - DNA, 25 bp, S. cerevisiae
agtggagttagaccccgaatgccaa

SEQ ID NO: 535 - DNA, 25 bp, S. cerevisiae
attgctacttctctaggaacggccg

SEQ ID NO: 536 - DNA, 25 bp, S. cerevisiae
attcacgtagctcttctgaactggc

SEQ ID NO: 537 - DNA, 25 bp, S. cerevisiae
attgggtcacgagtgtctttccgac

SEQ ID NO: 538 - DNA, 25 bp, S. cerevisiae
attggctatatctacgtttatcgct

SEQ ID NO: 539 - DNA, 25 bp, S. cerevisiae
attcgatgattcacggaattctgca

SEQ ID NO: 540 - DNA, 25 bp, S. cerevisiae
attgggcccagttacatttgtacta

SEQ ID NO: 541 - DNA, 25 bp, S. cerevisiae
atcggctccctctggtgataataaa

SEQ ID NO: 542 - DNA, 25 bp, S. cerevisiae
attggccttgtctgcggtgaaatac

SEQ ID NO: 543 - DNA, 25 bp, S. cerevisiae
attggcgaagatgcctttcacaaag

SEQ ID NO: 544 - DNA, 25 bp, S. cerevisiae
attggataggttgtcgcgcgaccag

SEQ ID NO: 545 - DNA, 25 bp, S. cerevisiae
attcggaagacccagatcaagagct

SEQ ID NO: 546 - DNA, 25 bp, S. cerevisiae
attgtcttcactggttccttggcag

SEQ ID NO: 547 - DNA, 25 bp, S. cerevisiae
attacgtacgtcaatcccttacatg

SEQ ID NO: 548 - DNA, 25 bp, S. cerevisiae
attggttaccatcatccaccttatg

SEQ ID NO: 549 - DNA, 25 bp, S. cerevisiae
atagggctccaaaattgcacttcaa

SEQ ID NO: 550 - DNA, 25 bp, S. cerevisiae
attgtacaccagaagattcgttaac

SEQ ID NO: 551 - DNA, 25 bp, S. cerevisiae
attgtcccaggtacctacattcaag

SEQ ID NO: 552 - DNA, 25 bp, S. cerevisiae
attgccccaggtatgcgtaaggtca

SEQ ID NO: 553 - DNA, 25 bp, S. cerevisiae
attgactcactatccactctaggag

SEQ ID NO: 554 - DNA, 25 bp, S. cerevisiae
attgacccgtattccttcgaggatc

SEQ ID NO: 555 - DNA, 25 bp, S. cerevisiae
attgatgccaaaaccgcccattgac

SEQ ID NO: 556 - DNA, 25 bp, S. cerevisiae
attggtgcacaatcaggcctatata

SEQ ID NO: 557 - DNA, 25 bp, S. cerevisiae
attggacccgaatgcctgtataaaa

SEQ ID NO: 558 - DNA, 25 bp, S. cerevisiae
attggcctctttactttccttagat

SEQ ID NO: 559 - DNA, 25 bp, S. cerevisiae
attgggtgtctactaatcaggaaca

SEQ ID NO: 560 - DNA, 25 bp, S. cerevisiae
gttgggttccacacaaggaaggcca

SEQ ID NO: 561 - DNA, 25 bp, S. cerevisiae
attgggttacaaagctaagcaaggt

SEQ ID NO: 562 - DNA, 25 bp, S. cerevisiae
attggtttctcggagtcaagctgga

SEQ ID NO: 563 - DNA, 25 bp, S. cerevisiae
attggttacgcctagtcagcagcat

SEQ ID NO: 564 - DNA, 25 bp, S. cerevisiae
attgggttatccgacacatcatcag

SEQ ID NO: 565 - DNA, 25 bp, S. cerevisiae
attggttgttcccacaagtcgatgc

SEQ ID NO: 566 - DNA, 25 bp, S. cerevisiae
gcattggttgcagttaaaacccggc

SEQ ID NO: 567 - DNA, 25 bp, S. cerevisiae
attgtcttgcaataaacacccgaaa

SEQ ID NO: 568 - DNA, 25 bp, S. cerevisiae
attggaaccacaggattccagctaa

SEQ ID NO: 569 - DNA, 25 bp, S. cerevisiae
attggtatgggaactggctctattt

SEQ ID NO: 570 - DNA, 25 bp, S. cerevisiae
attggtatgggaactggctctattt

SEQ ID NO: 571 - DNA, 25 bp, S. cerevisiae
attgctggaaggcacccttttcgaa

SEQ ID NO: 572 - DNA, 25 bp, S. cerevisiae
attggctaccgatggtgtaaccgat

SEQ ID NO: 573 - DNA, 25 bp, S. cerevisiae
attggatggcctggtaagtaacacc

SEQ ID NO: 574 - DNA, 25 bp, S. cerevisiae
attggcacgccagttggatgtagac

SEQ ID NO: 575 - DNA, 25 bp, S. cerevisiae
attggaatcctgctgctgatcaaca

SEQ ID NO: 576 - DNA, 25 bp, S. cerevisiae
attggagctcgaacgcagacagcaa

SEQ ID NO: 577 - DNA, 25 bp, S. cerevisiae
attcctgctggaaccgacgagatca

SEQ ID NO: 578 - DNA, 25 bp, S. cerevisiae
attggctgctatcgttgaaattatc

SEQ ID NO: 579 - DNA, 25 bp, S. cerevisiae
attccgtggattcgcccaagcgtta

SEQ ID NO: 580 - DNA, 25 bp, S. cerevisiae
attccgggtgtccatctaagagtca

SEQ ID NO: 581 - DNA, 25 bp, S. cerevisiae
attgactgccgtcttctatgacgag

SEQ ID NO: 582 - DNA, 25 bp, S. cerevisiae
attgatagcaccttcactttacgcc

SEQ ID NO: 583 - DNA, 25 bp, S. cerevisiae
attgtaccgcgaactttggaccata

SEQ ID NO: 584 - DNA, 25 bp, S. cerevisiae
attgttgctaccgtttattggccgc

SEQ ID NO: 585 - DNA, 25 bp, S. cerevisiae
attggctcaccaattggattgttaa

SEQ ID NO: 586 - DNA, 25 bp, S. cerevisiae
attgcgtagtacaagctgcgttgga

SEQ ID NO: 587 - DNA, 25 bp, S. cerevisiae
attgctatgtttgttgaaccaacgc

SEQ ID NO: 588 - DNA, 25 bp, S. cerevisiae
attgctatggtctctgttttcgtcg

SEQ ID NO: 589 - DNA, 25 bp, S. cerevisiae
attgtcggctatattagatccttcg

SEQ ID NO: 590 - DNA, 25 bp, S. cerevisiae
attgagcataacgatacccctagca

SEQ ID NO: 591 - DNA, 25 bp, S. cerevisiae
attgtgagaccctccgttcgcaacc

SEQ ID NO: 592 - DNA, 25 bp, S. cerevisiae
attgggcacacaattggcaaccctg

SEQ ID NO: 593 - DNA, 25 bp, S. cerevisiae
attgggccatacgattacacgcttg

SEQ ID NO: 594 - DNA, 25 bp, S. cerevisiae
attggctcagaatttacgggcacga

SEQ ID NO: 595 - DNA, 25 bp, S. cerevisiae
attgtctcagagtttgacgtgattg

SEQ ID NO: 596 - DNA, 25 bp, S. cerevisiae
gttctcgacggttccaaggaggcta

SEQ ID NO: 597 - DNA, 25 bp, S. cerevisiae
atttagtcggtcgtgaactgggcca

SEQ ID NO: 598 - DNA, 25 bp, S. cerevisiae
attgcatagatctccggaacatttg

SEQ ID NO: 599 - DNA, 25 bp, S. cerevisiae
attgtctacacgtctggaaatgctg

SEQ ID NO: 600 - DNA, 25 bp, S. cerevisiae
aggccaacaaactgaacgcggaatt

SEQ ID NO: 601 - DNA, 25 bp, S. cerevisiae
attgccccgacatttgtccagaaga

SEQ ID NO: 602 - DNA, 25 bp, S. cerevisiae
attggcgctctgtctgatataggca

SEQ ID NO: 603 - DNA, 25 bp, S. cerevisiae
attggctggctcttatagaactgtt

SEQ ID NO: 604 - DNA, 25 bp, S. cerevisiae
attggcatctcgtttggaatctcat

SEQ ID NO: 605 - DNA, 25 bp, S. cerevisiae
attggctagttttggatgatgctga

SEQ ID NO: 606 - DNA, 25 bp, S. cerevisiae
attgctgagaacaccaatgttgcta

SEQ ID NO: 607 - DNA, 25 bp, S. cerevisiae
attgggatatttggcatacggctca

SEQ ID NO: 608 - DNA, 25 bp, S. cerevisiae
attgctccaccatcggtcgaggatt

SEQ ID NO: 609 - DNA, 25 bp, S. cerevisiae
attgctgccggtgcggacggtttga

SEQ ID NO: 610 - DNA, 25 bp, S. cerevisiae
attgtgccaactgcgacagaccgtt

SEQ ID NO: 611 - DNA, 25 bp, S. cerevisiae
attgctcgcgaagtagcagaactac

SEQ ID NO: 612 - DNA, 25 bp, S. cerevisiae
attgccatcgcaagctcaggaattg

SEQ ID NO: 613 - DNA, 25 bp, S. cerevisiae
attggacccagacgcctttggagag

SEQ ID NO: 614 - DNA, 25 bp, S. cerevisiae
attggttccagatgtcgtgttgcag

SEQ ID NO: 615 - DNA, 25 bp, S. cerevisiae
attggttcgaacaatctggtcgcaa

SEQ ID NO: 616 - DNA, 25 bp, S. cerevisiae
attggccgccaaaatcgttcagcat

SEQ ID NO: 617 - DNA, 25 bp, S. cerevisiae
attggcatcccaaaacctgacagtg

SEQ ID NO: 618 - DNA, 25 bp, S. cerevisiae
attggctccacaaaacttaccggtg

SEQ ID NO: 619 - DNA, 25 bp, S. cerevisiae
attggatcaagacaccttaccggct

SEQ ID NO: 620 - DNA, 25 bp, S. cerevisiae
attgttcaagcgcaacttctcacag

SEQ ID NO: 621 - DNA, 25 bp, S. cerevisiae
attgtgggagcacctgccttccaag

SEQ ID NO: 622 - DNA, 25 bp, S. cerevisiae
attacaagatgcttcggcgaacccc

SEQ ID NO: 623 - DNA, 25 bp, S. cerevisiae
attgactgtggctactgctgagaac

SEQ ID NO: 624 - DNA, 25 bp, S. cerevisiae
attgtaactaatctttcctattgga

SEQ ID NO: 625 - DNA, 25 bp, S. cerevisiae
attgttaatactctagccgttgtgg

SEQ ID NO: 626 - DNA, 25 bp, S. cerevisiae
attggtactatttcttggctgccag

SEQ ID NO: 627 - DNA, 25 bp, S. cerevisiae
attgagtcgtacacgcaacttgcta

SEQ ID NO: 628 - DNA, 25 bp, S. cerevisiae
attgaagatttcatccgacaggata

SEQ ID NO: 629 - DNA, 25 bp, S. cerevisiae
attgtgtacttcactccaaagaaca

SEQ ID NO: 630 - DNA, 25 bp, S. cerevisiae
attgaccactgaagccccaaagaac

SEQ ID NO: 631 - DNA, 25 bp, S. cerevisiae
attgaatgcaaacctcccgaagaag

SEQ ID NO: 632 - DNA, 25 bp, S. cerevisiae
attgatctgaaacctgatactgcta

SEQ ID NO: 633 - DNA, 25 bp, S. cerevisiae
attgtccttgacaacttcctgcaat

SEQ ID NO: 634 - DNA, 25 bp, S. cerevisiae
attgtatacatctaatccatcggga

SEQ ID NO: 635 - DNA, 25 bp, S. cerevisiae
attgttgccaaagctccaaccactg

SEQ ID NO: 636 - DNA, 25 bp, S. cerevisiae
attgttaaccaagtcaccatcctct

SEQ ID NO: 637 - DNA, 25 bp, S. cerevisiae
attggtggtctcgacaacctaacaa

SEQ ID NO: 638 - DNA, 25 bp, S. cerevisiae
attggttgatcctcaacacaaggct

SEQ ID NO: 639 - DNA, 25 bp, S. cerevisiae
attggattgtcgctaactctggatt

SEQ ID NO: 640 - DNA, 25 bp, S. cerevisiae
attggtgattcgcaacgtacgccca

SEQ ID NO: 641 - DNA, 25 bp, S. cerevisiae
attggttcgtatcatgtcgactcgc

SEQ ID NO: 642 - DNA, 25 bp, S. cerevisiae
attgatgtttttcttcgtctcctgg

SEQ ID NO: 643 - DNA, 25 bp, S. cerevisiae
attgatgctattttggcctcctttt

SEQ ID NO: 644 - DNA, 25 bp, S. cerevisiae
attgaagacgacgaccttggtgatt

SEQ ID NO: 645 - DNA, 25 bp, S. cerevisiae
attgtggcacgaacaacttctggaa

SEQ ID NO: 646 - DNA, 25 bp, S. cerevisiae
attgggctcggatatgctcttgcat

SEQ ID NO: 647 - DNA, 25 bp, S. cerevisiae
attggcgccggatcagaatttcacg

SEQ ID NO: 648 - DNA, 25 bp, S. cerevisiae
attgtgcgacggttatacgttcatt

SEQ ID NO: 649 - DNA, 25 bp, S. cerevisiae
attgtgcgccggatgtaaattctaa

SEQ ID NO: 650 - DNA, 25 bp, S. cerevisiae
attgtccgcggtactgacgtttaga

SEQ ID NO: 651 - DNA, 25 bp, S. cerevisiae
attgtatctgcaacgaagcctgcta

SEQ ID NO: 652 - DNA, 25 bp, S. cerevisiae
attgtacgttgccatatactccacc

SEQ ID NO: 653 - DNA, 25 bp, S. cerevisiae
attggcctgcgaaagaacctcatct

SEQ ID NO: 654 - DNA, 25 bp, S. cerevisiae
attggcctttatatatagactctcg

SEQ ID NO: 655 - DNA, 25 bp, S. cerevisiae
attgtccttacaaagccatatccct

SEQ ID NO: 656 - DNA, 25 bp, S. cerevisiae
attgaatggttcgtcgtcatcgtcc

SEQ ID NO: 657 - DNA, 25 bp, S. cerevisiae
attgctgatattggctgtggattcg

SEQ ID NO: 658 - DNA, 25 bp, S. cerevisiae
attggattctgggattactatcgaa

SEQ ID NO: 659 - DNA, 25 bp, S. cerevisiae
attgaacttttgtctaccaatatgt

SEQ ID NO: 660 - DNA, 25 bp, S. cerevisiae
attgataatgttccatgtgcccaaa

SEQ ID NO: 661 - DNA, 25 bp, S. cerevisiae
attgctcgtcggctggatatactac

SEQ ID NO: 662 - DNA, 25 bp, S. cerevisiae
attgtccgctgcatctggagaaaat

SEQ ID NO: 663 - DNA, 25 bp, S. cerevisiae
attggccgctatcgtcgaaattatt

SEQ ID NO: 664 - DNA, 25 bp, S. cerevisiae
attggcctgcctgtctatatcattt

SEQ ID NO: 665 - DNA, 25 bp, S. cerevisiae
attggcgtgcattttctcagtttta

SEQ ID NO: 666 - DNA, 25 bp, S. cerevisiae
attgctgccagaagaaccggtttac

SEQ ID NO: 667 - DNA, 25 bp, S. cerevisiae
attgtgaagttcaaccggctactaa

SEQ ID NO: 668 - DNA, 25 bp, S. cerevisiae
attgggtgtgttccactcaatctgc

SEQ ID NO: 669 - DNA, 25 bp, S. cerevisiae
attgggttgcttctcaaactgtgaa

SEQ ID NO: 670 - DNA, 25 bp, S. cerevisiae
atatgggacctatatgcggagtggt

SEQ ID NO: 671 - DNA, 25 bp, S. cerevisiae
atttagcctctattgcatcgggtag

SEQ ID NO: 672 - DNA, 25 bp, S. cerevisiae
attgacactttgttgccaggtttgc

SEQ ID NO: 673 - DNA, 25 bp, S. cerevisiae
attgttgcggttatcaggtcttccc

SEQ ID NO: 674 - DNA, 25 bp, S. cerevisiae
attggtaacattttcctactcaacg

SEQ ID NO: 675 - DNA, 25 bp, S. cerevisiae
attgtgtgaggctcttcctctgctc

SEQ ID NO: 676 - DNA, 25 bp, S. cerevisiae
attgtctggctataatctgtggtac

SEQ ID NO: 677 - DNA, 25 bp, S. cerevisiae
atattcgtcaaacaatgggttcccg

SEQ ID NO: 678 - DNA, 25 bp, S. cerevisiae
attcgcgtcaaattaatgggtggta

SEQ ID NO: 679 - DNA, 25 bp, S. cerevisiae
attgggtaatgctcctggcgggaat

SEQ ID NO: 680 - DNA, 25 bp, S. cerevisiae
attcgagtgattcgccctgttggag

SEQ ID NO: 681 - DNA, 25 bp, S. cerevisiae
attggactctttgacacaaccttca

SEQ ID NO: 682 - DNA, 25 bp, S. cerevisiae
attgaactcgggtcatggtccgctt

SEQ ID NO: 683 - DNA, 25 bp, S. cerevisiae
attgaatctcccgaaggccacgatg

SEQ ID NO: 684 - DNA, 25 bp, S. cerevisiae
attgctttatcggtgcaagccacgt

SEQ ID NO: 685 - DNA, 25 bp, S. cerevisiae
attgactttgaatgctttgccaccc

SEQ ID NO: 686 - DNA, 25 bp, S. cerevisiae
attggactcaatctctcgtttgggc

SEQ ID NO: 687 - DNA, 25 bp, S. cerevisiae
attgaaacatacctccatattgccc

SEQ ID NO: 688 - DNA, 25 bp, S. cerevisiae
attggaagcttttcatcccagcaga

SEQ ID NO: 689 - DNA, 25 bp, S. cerevisiae
attggtcttttaattcgctgcgaaa

SEQ ID NO: 690 - DNA, 25 bp, S. cerevisiae
attgggtactatgacttgcctgcta

SEQ ID NO: 691 - DNA, 25 bp, S. cerevisiae
attccgtatcaaacaaaactcccat

SEQ ID NO: 692 - DNA, 25 bp, S. cerevisiae
attcggtagcgggaaagactttgct

SEQ ID NO: 693 - DNA, 25 bp, S. cerevisiae
atagcgggcaggtccctagagtttt

SEQ ID NO: 694 - DNA, 25 bp, S. cerevisiae
atactgggcgtatcctaattattgt

SEQ ID NO: 695 - DNA, 25 bp, S. cerevisiae
atccggcgcggatccaaaggagtat

SEQ ID NO: 696 - DNA, 25 bp, S. cerevisiae
attcagtcgcggtagctcaaaatgg

SEQ ID NO: 697 - DNA, 25 bp, S. cerevisiae
attggtcggcgatgcatctgatact

SEQ ID NO: 698 - DNA, 25 bp, S. cerevisiae
attgggcgatgagctctctgatact

SEQ ID NO: 699 - DNA, 25 bp, S. cerevisiae
attggcgctattgctttggtagctt

SEQ ID NO: 700 - DNA, 25 bp, S. cerevisiae
attggacttgtcatgtttcggtgcc

SEQ ID NO: 701 - DNA, 25 bp, S. cerevisiae
attgtgatacccatttgcacggtcc

SEQ ID NO: 702 - DNA, 25 bp, S. cerevisiae
attgtacaatgctacacgtgcttga

SEQ ID NO: 703 - DNA, 25 bp, S. cerevisiae
attgtcacctgtacactggcattac

SEQ ID NO: 704 - DNA, 25 bp, S. cerevisiae
attgtgcactgcttatcctgtaata

SEQ ID NO: 705 - DNA, 25 bp, S. cerevisiae
attggaattcctcctgcgtataatg

SEQ ID NO: 706 - DNA, 25 bp, S. cerevisiae
attggaattccacgacttgcaagaa

SEQ ID NO: 707 - DNA, 25 bp, S. cerevisiae
attggccattgcgttgtcattgagt

SEQ ID NO: 708 - DNA, 25 bp, S. cerevisiae
attggcacttgtttgtacgatcttt

SEQ ID NO: 709 - DNA, 25 bp, S. cerevisiae
attggttgtctttttgccagctttg

SEQ ID NO: 710 - DNA, 25 bp, S. cerevisiae
attggttgattatgacacccggtgt

SEQ ID NO: 711 - DNA, 25 bp, S. cerevisiae
attagactcctatcccaactaagag

SEQ ID NO: 712 - DNA, 25 bp, S. cerevisiae
attcgactatcttcacgctaacaaa

SEQ ID NO: 713 - DNA, 25 bp, S. cerevisiae
attggcgcttccttaagagtcacta

SEQ ID NO: 714 - DNA, 25 bp, S. cerevisiae
attgaggcccactacagaagaagct

SEQ ID NO: 715 - DNA, 25 bp, S. cerevisiae
attggagcatccgaagccttgaagc

SEQ ID NO: 716 - DNA, 25 bp, S. cerevisiae
attggagacatataccgctggagga

SEQ ID NO: 717 - DNA, 25 bp, S. cerevisiae
attggtgtcaaattccctggcagag

SEQ ID NO: 718 - DNA, 25 bp, S. cerevisiae
attggctctccattattcttggtga

SEQ ID NO: 719 - DNA, 25 bp, S. cerevisiae
attgcgttcgcaatttttcgatggt

SEQ ID NO: 720 - DNA, 25 bp, S. cerevisiae
attggtgacgccatatcattcgtta

SEQ ID NO: 721 - DNA, 25 bp, S. cerevisiae
attgttgcacctattattggcgaca

SEQ ID NO: 722 - DNA, 25 bp, S. cerevisiae
attgatctccccatttgttggaagg

SEQ ID NO: 723 - DNA, 25 bp, S. cerevisiae
attgacgcgaacttgattcctccat

SEQ ID NO: 724 - DNA, 25 bp, S. cerevisiae
attgagacttgtgttgatgccaacg

SEQ ID NO: 725 - DNA, 25 bp, S. cerevisiae
attggtgccaaacttgagcccacga

SEQ ID NO: 726 - DNA, 25 bp, S. cerevisiae
attctgggcaaagtacggccgtact

SEQ ID NO: 727 - DNA, 25 bp, S. cerevisiae
attgatgacgaactttccgccaacg

SEQ ID NO: 728 - DNA, 25 bp, S. cerevisiae
attgtacggtgtctttgccaacttc

SEQ ID NO: 729 - DNA, 25 bp, S. cerevisiae
attgataccgtaaacttgccacttt

SEQ ID NO: 730 - DNA, 25 bp, S. cerevisiae
attgatgtccttaaacactcgcttc

SEQ ID NO: 731 - DNA, 25 bp, S. cerevisiae
attgttaggtcaggcattccctttc

SEQ ID NO: 732 - DNA, 25 bp, S. cerevisiae
attgtgtagaattgcagattccctt

SEQ ID NO: 733 - DNA, 25 bp, S. cerevisiae
attgactgccgctacaaatgccaaa

SEQ ID NO: 734 - DNA, 25 bp, S. cerevisiae
attgactgccgctactaacgctaaa

SEQ ID NO: 735 - DNA, 25 bp, S. cerevisiae
attgttttcaacacctctgtcacta

SEQ ID NO: 736 - DNA, 25 bp, S. cerevisiae
attgattaatgatccacctgcttgg

SEQ ID NO: 737 - DNA, 25 bp, S. cerevisiae
attgaatttgtagaccttgaggagc

SEQ ID NO: 738 - DNA, 25 bp, S. cerevisiae
attgggtttcttttgcttatgtgct

SEQ ID NO: 739 - DNA, 25 bp, S. cerevisiae
attgctttgcttctggtttatgcgc

SEQ ID NO: 740 - DNA, 25 bp, S. cerevisiae
attggactcaacaagttcgctctct

SEQ ID NO: 741 - DNA, 25 bp, S. cerevisiae
attggacccgtgatatgaggcgcaa

SEQ ID NO: 742 - DNA, 25 bp, S. cerevisiae
attgtgtcccgttgtcacaggtcaa

SEQ ID NO: 743 - DNA, 25 bp, S. cerevisiae
attgggccctgtgttgatgctctac

SEQ ID NO: 744 - DNA, 25 bp, S. cerevisiae
atagggctttggtcgtactgtacag

SEQ ID NO: 745 - DNA, 25 bp, S. cerevisiae
atttcctattggtcgggtaacagat

SEQ ID NO: 746 - DNA, 25 bp, S. cerevisiae
attccgccattgcatcctttaaaga

SEQ ID NO: 747 - DNA, 25 bp, S. cerevisiae
attgtcttggcgctttcaaccaaat

SEQ ID NO: 748 - DNA, 25 bp, S. cerevisiae
attgcacttgcaaggttctaccgca

SEQ ID NO: 749 - DNA, 25 bp, S. cerevisiae
attggaggagatcgtcacacttaat

SEQ ID NO: 750 - DNA, 25 bp, S. cerevisiae
attcggtgactgttgctgaagatac

SEQ ID NO: 751 - DNA, 25 bp, S. cerevisiae
attcggtaagcgtcacaacaaatct

SEQ ID NO: 752 - DNA, 25 bp, S. cerevisiae
atcggctttcccttagtattgcttt

SEQ ID NO: 753 - DNA, 25 bp, S. cerevisiae
attccttacgtttgcactgggttga

SEQ ID NO: 754 - DNA, 25 bp, S. cerevisiae
attgttaccgttggtcaatgtagac

SEQ ID NO: 755 - DNA, 25 bp, S. cerevisiae
attgtttgcgctgtcctagtaattt

SEQ ID NO: 756 - DNA, 25 bp, S. cerevisiae
attgcctcagcgctgctgttgagaa

SEQ ID NO: 757 - DNA, 25 bp, S. cerevisiae
attggatcaatgaacgctcagagaa

SEQ ID NO: 758 - DNA, 25 bp, S. cerevisiae
attgcagtccatcacctcatatgaa

SEQ ID NO: 759 - DNA, 25 bp, S. cerevisiae
attggtgattgtaccgcacacacgg

SEQ ID NO: 760 - DNA, 25 bp, S. cerevisiae
attggtatcatatccgatgcactcg

SEQ ID NO: 761 - DNA, 25 bp, S. cerevisiae
attggtcacatttttcatctctaat

SEQ ID NO: 762 - DNA, 25 bp, S. cerevisiae
attggtcttttcgtgctttcagaac

SEQ ID NO: 763 - DNA, 25 bp, S. cerevisiae
attgggaatcctattgtgccagaac

SEQ ID NO: 764 - DNA, 25 bp, S. cerevisiae
attgggtgtgctgcttttgctggcc

SEQ ID NO: 765 - DNA, 25 bp, S. cerevisiae
attgggtgtcacatatacctcgcgg

SEQ ID NO: 766 - DNA, 25 bp, S. cerevisiae
attgggtgctaactatgccccatgc

SEQ ID NO: 767 - DNA, 25 bp, S. cerevisiae
attggtttcaaaatgcacgcgcagc

SEQ ID NO: 768 - DNA, 25 bp, S. cerevisiae
attggttttattaccagcggcacct

SEQ ID NO: 769 - DNA, 25 bp, S. cerevisiae
attgggtttctgatccattcaacgc

SEQ ID NO: 770 - DNA, 25 bp, S. cerevisiae
attgtaccctagtttcaagccgatc

SEQ ID NO: 771 - DNA, 25 bp, S. cerevisiae
attgttcccaactttgaagcctgat

SEQ ID NO: 772 - DNA, 25 bp, S. cerevisiae
attgttctcctacgttgaacctgtc

SEQ ID NO: 773 - DNA, 25 bp, S. cerevisiae
attgttacacagctgcaattactga

SEQ ID NO: 774 - DNA, 25 bp, S. cerevisiae
attggtgatgagtgcccatctggat

SEQ ID NO: 775 - DNA, 25 bp, S. cerevisiae
attgcgctagaaggccacactttgt

SEQ ID NO: 776 - DNA, 25 bp, S. cerevisiae
attgactccacagcaacagctactt

SEQ ID NO: 777 - DNA, 25 bp, S. cerevisiae
attgaggcctcttatcgatgattac

SEQ ID NO: 778 - DNA, 25 bp, S. cerevisiae
attgtctcgttgatcaaggccatcg

SEQ ID NO: 779 - DNA, 25 bp, S. cerevisiae
attgtggcacgtttgcaaggtacca

SEQ ID NO: 780 - DNA, 25 bp, S. cerevisiae
attcctctagctgagaaggtgccta

SEQ ID NO: 781 - DNA, 25 bp, S. cerevisiae
attccgtcgatggtgaagttctttt

SEQ ID NO: 782 - DNA, 25 bp, S. cerevisiae
attgctacctctactaaggtttctg

SEQ ID NO: 783 - DNA, 25 bp, S. cerevisiae
atacttttgtatctggacccacttt

SEQ ID NO: 784 - DNA, 25 bp, S. cerevisiae
aggctgtttcagcaggtttcctcta

SEQ ID NO: 785 - DNA, 25 bp, S. cerevisiae
attgatttacgtccctaatgaggcg

SEQ ID NO: 786 - DNA, 25 bp, S. cerevisiae
attgctattgagctacctccaaacg

SEQ ID NO: 787 - DNA, 25 bp, S. cerevisiae
attgtatgatgacttccctagcaga

SEQ ID NO: 788 - DNA, 25 bp, S. cerevisiae
attgttgctaattacctgtcagact

SEQ ID NO: 789 - DNA, 25 bp, S. cerevisiae
ataccgtaatattccttcgtcccat

SEQ ID NO: 790 - DNA, 25 bp, S. cerevisiae
atacccgtatttgacatttcccaag

SEQ ID NO: 791 - DNA, 25 bp, S. cerevisiae
attcctaattcctttgcgtttgtgt

SEQ ID NO: 792 - DNA, 25 bp, S. cerevisiae
attggtcattcccttggtggaagta

SEQ ID NO: 793 - DNA, 25 bp, S. cerevisiae
attgcttctatctctttggctattg

SEQ ID NO: 794 - DNA, 25 bp, S. cerevisiae
attgctgtcaattctcgttactttg

SEQ ID NO: 795 - DNA, 25 bp, S. cerevisiae
attccgcacatagtgttccgactaa

SEQ ID NO: 796 - DNA, 25 bp, S. cerevisiae
attggtgacttttctcctgatctaa

SEQ ID NO: 797 - DNA, 25 bp, S. cerevisiae
attgggctttatttcctgttggata

SEQ ID NO: 798 - DNA, 25 bp, S. cerevisiae
attgtggcgccatgtacgaggcaat

SEQ ID NO: 799 - DNA, 25 bp, S. cerevisiae
attgccgccgcatctaaaggcagtg

SEQ ID NO: 800 - DNA, 25 bp, S. cerevisiae
attgctactttttctctttttcgag

SEQ ID NO: 801 - DNA, 25 bp, S. cerevisiae
attctaccggttctttcttgcaaag

SEQ ID NO: 802 - DNA, 25 bp, S. cerevisiae
attgcaatatgcagagggtgattat

SEQ ID NO: 803 - DNA, 25 bp, S. cerevisiae
attgccatatcatcattgggttata

SEQ ID NO: 804 - DNA, 25 bp, S. cerevisiae
attgctccaattactggtacgatca

SEQ ID NO: 805 - DNA, 25 bp, S. cerevisiae
attaatcgatttcggttcggctgcc

SEQ ID NO: 806 - DNA, 25 bp, S. cerevisiae
attgaacttacttctcttcctactg

SEQ ID NO: 807 - DNA, 25 bp, S. cerevisiae
attgttcctcattcagggcatcact

SEQ ID NO: 808 - DNA, 25 bp, S. cerevisiae
attgcattcgcatcagtggccatcg

SEQ ID NO: 809 - DNA, 25 bp, S. cerevisiae
attgatgatggctacttgtccttga

SEQ ID NO: 810 - DNA, 25 bp, S. cerevisiae
attgatgaggattattgcccttcaa

SEQ ID NO: 811 - DNA, 25 bp, S. cerevisiae
attgggattgcctttacctgcattc

SEQ ID NO: 812 - DNA, 25 bp, S. cerevisiae
attacgtcaatcctctacagtttct

SEQ ID NO: 813 - DNA, 25 bp, S. cerevisiae
attcctagagccgtggactggttta

SEQ ID NO: 814 - DNA, 25 bp, S. cerevisiae
attcttcgaccgagttgaaacatga

SEQ ID NO: 815 - DNA, 25 bp, S. cerevisiae
attcgtctaggcgatcgtggagaaa

SEQ ID NO: 816 - DNA, 25 bp, S. cerevisiae
attcggaccggctgatggatcaaat

SEQ ID NO: 817 - DNA, 25 bp, S. cerevisiae
atatgtacggatgtatggtcccaaa

SEQ ID NO: 818 - DNA, 25 bp, S. cerevisiae
atagctactgggttagcttcccgac

SEQ ID NO: 819 - DNA, 25 bp, S. cerevisiae
attgctaaggagttgagcttgcccc

SEQ ID NO: 820 - DNA, 25 bp, S. cerevisiae
attgctcaaggtttgtctgacgccg

SEQ ID NO: 821 - DNA, 25 bp, S. cerevisiae
attgtcattggcctgtctttcgaaa

SEQ ID NO: 822 - DNA, 25 bp, S. cerevisiae
attgctattgtagtggaactgtcta

SEQ ID NO: 823 - DNA, 25 bp, S. cerevisiae
attgcatttaatgggcgccttccaa

SEQ ID NO: 824 - DNA, 25 bp, S. cerevisiae
attgtttctacaatcatccctcgtc

SEQ ID NO: 825 - DNA, 25 bp, S. cerevisiae
attgtcctcaaatctactcgtatat

SEQ ID NO: 826 - DNA, 25 bp, S. cerevisiae
attgtcgtcgtttgtttctgtatgt

SEQ ID NO: 827 - DNA, 25 bp, S. cerevisiae
attccacactggtattgacaacggt

SEQ ID NO: 828 - DNA, 25 bp, S. cerevisiae
attccacgtggattgtctaaactgt

SEQ ID NO: 829 - DNA, 25 bp, S. cerevisiae
attgctctcaggtttccaacaactt

SEQ ID NO: 830 - DNA, 25 bp, S. cerevisiae
attgcacaagtttatccaaccccaa

SEQ ID NO: 831 - DNA, 25 bp, S. cerevisiae
attgatagatttgcccaaccaccta

SEQ ID NO: 832 - DNA, 25 bp, S. cerevisiae
attgttggcaagatagtcgtcaaac

SEQ ID NO: 833 - DNA, 25 bp, S. cerevisiae
attgttggctgaaacttcgttccct

SEQ ID NO: 834 - DNA, 25 bp, S. cerevisiae
attgttggctgacatcatctctgaa

SEQ ID NO: 835 - DNA, 25 bp, S. cerevisiae
actgcaagggcctcccggattataa

SEQ ID NO: 836 - DNA, 25 bp, S. cerevisiae
attcttgaactctccggacttacca

SEQ ID NO: 837 - DNA, 25 bp, S. cerevisiae
attgagtggccccagagttacgact

SEQ ID NO: 838 - DNA, 25 bp, S. cerevisiae
ataggtgacctagacttcagcgacc

SEQ ID NO: 839 - DNA, 25 bp, S. cerevisiae
atcaggtagttagacctaggaccaa

SEQ ID NO: 840 - DNA, 25 bp, S. cerevisiae
attgacttcattctcatcacaacca

SEQ ID NO: 841 - DNA, 25 bp, S. cerevisiae
attgttgccgagacccggatattct

SEQ ID NO: 842 - DNA, 25 bp, S. cerevisiae
attgttgtccaaccgaggatgacta

SEQ ID NO: 843 - DNA, 25 bp, S. cerevisiae
attctaagtcttcatcaggtggatt

SEQ ID NO: 844 - DNA, 25 bp, S. cerevisiae
attgctattgtcacgcacggtgttt

SEQ ID NO: 845 - DNA, 25 bp, S. cerevisiae
attgtttgcaccaacacggtacctg

SEQ ID NO: 846 - DNA, 25 bp, S. cerevisiae
attgtcgtggcaggatcatttccct

SEQ ID NO: 847 - DNA, 25 bp, S. cerevisiae
attgctttgcgaggacaagaccgtc

SEQ ID NO: 848 - DNA, 25 bp, S. cerevisiae
attgtctttgagcaccagattccgc

SEQ ID NO: 849 - DNA, 25 bp, S. cerevisiae
atttctttgattttaattcctggag

SEQ ID NO: 850 - DNA, 25 bp, S. cerevisiae
attcctcgtgaatttaactactcgg

SEQ ID NO: 851 - DNA, 25 bp, S. cerevisiae
attcccgtaatatgttcaagatggc

SEQ ID NO: 852 - DNA, 25 bp, S. cerevisiae
attgatcatgattgcccttggtttc

SEQ ID NO: 853 - DNA, 25 bp, S. cerevisiae
attctgcatactacgcttatctttc

SEQ ID NO: 854 - DNA, 25 bp, S. cerevisiae
attgttgcaatgtgtctgaccgcct

SEQ ID NO: 855 - DNA, 25 bp, S. cerevisiae
attgatcacttctttgactccaggc

SEQ ID NO: 856 - DNA, 25 bp, S. cerevisiae
attgctactcaatatcacccagaat

SEQ ID NO: 857 - DNA, 25 bp, S. cerevisiae
attgatggggcatacgcacacggat

SEQ ID NO: 858 - DNA, 25 bp, S. cerevisiae
attgatgttcttttcggatccggca

SEQ ID NO: 859 - DNA, 25 bp, S. cerevisiae
attgttctcaatttggtgccacgga

SEQ ID NO: 860 - DNA, 25 bp, S. cerevisiae
attctcgcgcaatgtggtggacggt

SEQ ID NO: 861 - DNA, 25 bp, S. cerevisiae
attccacaatctttgagggataggt

SEQ ID NO: 862 - DNA, 25 bp, S. cerevisiae
attctagaatccctgttgaatatgg

SEQ ID NO: 863 - DNA, 25 bp, S. cerevisiae
attcatgggcaacaccttccataag

SEQ ID NO: 864 - DNA, 25 bp, S. cerevisiae
attgccgaaggttccaacatgggtt

SEQ ID NO: 865 - DNA, 25 bp, S. cerevisiae
attgcaatacatctgtgccaccttg

SEQ ID NO: 866 - DNA, 25 bp, S. cerevisiae
attgcagtcattacttggcgaacca

SEQ ID NO: 867 - DNA, 25 bp, S. cerevisiae
attgcgccattaaaccagaaccagt

SEQ ID NO: 868 - DNA, 25 bp, S. cerevisiae
attccacttatcaagctcaggcaca

SEQ ID NO: 869 - DNA, 25 bp, S. cerevisiae
attgccagtttctccattggacatc

SEQ ID NO: 870 - DNA, 25 bp, S. cerevisiae
attcctggttttgttggcatactgc

SEQ ID NO: 871 - DNA, 25 bp, S. cerevisiae
atatcttttttgtgtcctgggaacg

SEQ ID NO: 872 - DNA, 25 bp, S. cerevisiae
atatcgttccatcgaagggcggtga

SEQ ID NO: 873 - DNA, 25 bp, S. cerevisiae
atttaatcatgttccctgagggtac

SEQ ID NO: 874 - DNA, 25 bp, S. cerevisiae
attcgcaagtgtatgttaacctcag

SEQ ID NO: 875 - DNA, 25 bp, S. cerevisiae
attcgaatttttcaagccacctgcg

SEQ ID NO: 876 - DNA, 25 bp, S. cerevisiae
attcgattgtttctactccacggat

SEQ ID NO: 877 - DNA, 25 bp, S. cerevisiae
attgtattttactcttcacctgtga

SEQ ID NO: 878 - DNA, 25 bp, S. cerevisiae
attgtattttttggctgtctcctgg

SEQ ID NO: 879 - DNA, 25 bp, S. cerevisiae
attgattcttttactggctaccata

SEQ ID NO: 880 - DNA, 25 bp, S. cerevisiae
attgatgccttatggtgcctactac

SEQ ID NO: 881 - DNA, 25 bp, S. cerevisiae
attgatatctttcgtgtccataccc

SEQ ID NO: 882 - DNA, 25 bp, S. cerevisiae
attgctaccattgctgcggatgcat

SEQ ID NO: 883 - DNA, 25 bp, S. cerevisiae
attcagatgccttaagcggaacccc

SEQ ID NO: 884 - DNA, 25 bp, S. cerevisiae
attaacctcaaatgccagaccacta

SEQ ID NO: 885 - DNA, 25 bp, S. cerevisiae
attgaaactcttacctggaatacta

SEQ ID NO: 886 - DNA, 25 bp, S. cerevisiae
attgacgatctattattgccaggaa

SEQ ID NO: 887 - DNA, 25 bp, S. cerevisiae
attgctcttgcttatcaaggtgcca

SEQ ID NO: 888 - DNA, 25 bp, S. cerevisiae
attgacgatttttcttccctgtaca

SEQ ID NO: 889 - DNA, 25 bp, S. cerevisiae
attgacgatttttacgattcttaca

SEQ ID NO: 890 - DNA, 25 bp, S. cerevisiae
attccgtacttgtacaatggattac

SEQ ID NO: 891 - DNA, 25 bp, S. cerevisiae
attgccgatgacagaccttggtgta

SEQ ID NO: 892 - DNA, 25 bp, S. cerevisiae
attcacgtatataagccggatggat

SEQ ID NO: 893 - DNA, 25 bp, S. cerevisiae
attcctgtgatcaccctggatgtga

SEQ ID NO: 894 - DNA, 25 bp, S. cerevisiae
attgccctagatcatctcatgcatg

SEQ ID NO: 895 - DNA, 25 bp, S. cerevisiae
attccacatggacgttctgattcga

SEQ ID NO: 896 - DNA, 25 bp, S. cerevisiae
attgccaatggtctgttgaccaata

SEQ ID NO: 897 - DNA, 25 bp, S. cerevisiae
attgatttcgcatgtgtctctggtt

SEQ ID NO: 898 - DNA, 25 bp, S. cerevisiae
attgaattcactactcctcgagatc

SEQ ID NO: 899 - DNA, 25 bp, S. cerevisiae
attgatgaatcctttgcacctgaaa

SEQ ID NO: 900 - DNA, 25 bp, S. cerevisiae
attgactctggtagatctgccttga

SEQ ID NO: 901 - DNA, 25 bp, S. cerevisiae
attgacactggttagatgctctgaa

SEQ ID NO: 902 - DNA, 25 bp, S. cerevisiae
attgaatctggcctagttcctcacg

SEQ ID NO: 903 - DNA, 25 bp, S. cerevisiae
attctgttccgaaactccacaggaa

SEQ ID NO: 904 - DNA, 25 bp, S. cerevisiae
attgcatttagaacagaccccggta

SEQ ID NO: 905 - DNA, 25 bp, S. cerevisiae
attccccaaacgactactgcgagta

SEQ ID NO: 906 - DNA, 25 bp, S. cerevisiae
attccctcaaccattgactgacaga

SEQ ID NO: 907 - DNA, 25 bp, S. cerevisiae
attcccatcccagaatacgacgagg

SEQ ID NO: 908 - DNA, 25 bp, S. cerevisiae
attccaaggccaaaacaacacgatg

SEQ ID NO: 909 - DNA, 25 bp, S. cerevisiae
attgctaattccacaacggacgcgc

SEQ ID NO: 910 - DNA, 25 bp, S. cerevisiae
attgaaggccgaattggatagatac

SEQ ID NO: 911 - DNA, 25 bp, S. cerevisiae
attgaagatgcccatactgccttga

SEQ ID NO: 912 - DNA, 25 bp, S. cerevisiae
attgcattgtcgatactgcctcgca

SEQ ID NO: 913 - DNA, 25 bp, S. cerevisiae
attgctctgatactgtaatccacga

SEQ ID NO: 914 - DNA, 25 bp, S. cerevisiae
attccagcaggttccaacgttatca

SEQ ID NO: 915 - DNA, 25 bp, S. cerevisiae
attcaacgagttcttcgcttctgca

SEQ ID NO: 916 - DNA, 25 bp, S. cerevisiae
attctaaaactggacggcttcgctc

SEQ ID NO: 917 - DNA, 25 bp, S. cerevisiae
atgaccaaagacgagccggctacct

SEQ ID NO: 918 - DNA, 25 bp, S. cerevisiae
atacgaaagtatgaatggcaacctg

SEQ ID NO: 919 - DNA, 25 bp, S. cerevisiae
attcgcgacggaggagagatcagac

SEQ ID NO: 920 - DNA, 25 bp, S. cerevisiae
gttcattccgtcagaaccggtacta

SEQ ID NO: 921 - DNA, 25 bp, S. cerevisiae
attcatgcccgttggaaccgtgtca

SEQ ID NO: 922 - DNA, 25 bp, S. cerevisiae
attcgccgcgatagaatccggtggc

SEQ ID NO: 923 - DNA, 25 bp, S. cerevisiae
attcgccctcttcaaattcaatttc

SEQ ID NO: 924 - DNA, 25 bp, S. cerevisiae
attgcagaatgcttgggagttcctt

SEQ ID NO: 925 - DNA, 25 bp, S. cerevisiae
attcgccgagtacattcaagccaat

SEQ ID NO: 926 - DNA, 25 bp, S. cerevisiae
attcccagagtacatcccgatttaa

SEQ ID NO: 927 - DNA, 25 bp, S. cerevisiae
attctcctagaatgtccccatatta

SEQ ID NO: 928 - DNA, 25 bp, S. cerevisiae
attgcccagtttaatccgttcatga

SEQ ID NO: 929 - DNA, 25 bp, S. cerevisiae
attgaagtatttgcagtccagaaac

SEQ ID NO: 930 - DNA, 25 bp, S. cerevisiae
attgaggtgcttttcagtcctgaga

SEQ ID NO: 931 - DNA, 25 bp, S. cerevisiae
attgagtggctctgacgtctgtaaa

SEQ ID NO: 932 - DNA, 25 bp, S. cerevisiae
attgcagtactctgcgggtgtatac

SEQ ID NO: 933 - DNA, 25 bp, S. cerevisiae
attgagcgtctctgcagtttcttac

SEQ ID NO: 934 - DNA, 25 bp, S. cerevisiae
attgctctcgctttgagtcatggta

SEQ ID NO: 935 - DNA, 25 bp, S. cerevisiae
attcagcttgctgatatccatgagc

SEQ ID NO: 936 - DNA, 25 bp, S. cerevisiae
attcgcattggttggacacggttac

SEQ ID NO: 937 - DNA, 25 bp, S. cerevisiae
attgccggtgctgctggaaattttg

SEQ ID NO: 938 - DNA, 25 bp, S. cerevisiae
attcctgatgaaaagctgctaacta

SEQ ID NO: 939 - DNA, 25 bp, S. cerevisiae
attcacggaatcgagctattatctg

SEQ ID NO: 940 - DNA, 25 bp, S. cerevisiae
attgcatccggtttctaattcgaag

SEQ ID NO: 941 - DNA, 25 bp, S. cerevisiae
attcggcggacagcggcagcattaa

SEQ ID NO: 942 - DNA, 25 bp, S. cerevisiae
attgcggccgcgaaatcatgttctg

SEQ ID NO: 943 - DNA, 25 bp, S. cerevisiae
attcggctgacgtccttacaaagta

SEQ ID NO: 944 - DNA, 25 bp, S. cerevisiae
attgcccaagaccagtactttttct

SEQ ID NO: 945 - DNA, 25 bp, S. cerevisiae
attaccaatccttctacttttgtcg

SEQ ID NO: 946 - DNA, 25 bp, S. cerevisiae
attcctatacgctctactgtttaca

SEQ ID NO: 947 - DNA, 25 bp, S. cerevisiae
attccttccgtaactgtttctcaag

SEQ ID NO: 948 - DNA, 25 bp, S. cerevisiae
attccttgggttctggttctgcaac

SEQ ID NO: 949 - DNA, 25 bp, S. cerevisiae
attcaattggtgttcctgagttacc

SEQ ID NO: 950 - DNA, 25 bp, S. cerevisiae
attgactggcttgcattatcatgaa

SEQ ID NO: 951 - DNA, 25 bp, S. cerevisiae
attgccttcaggtgtgatgccactg

SEQ ID NO: 952 - DNA, 25 bp, S. cerevisiae
attgcctttggcgtattcctactaa

SEQ ID NO: 953 - DNA, 25 bp, S. cerevisiae
attgaccgtggtattgctctacaca

SEQ ID NO: 954 - DNA, 25 bp, S. cerevisiae
attgaccgttgtgttcatccagaac

SEQ ID NO: 955 - DNA, 25 bp, S. cerevisiae
attgaattgtatttttgctccaaag

SEQ ID NO: 956 - DNA, 25 bp, S. cerevisiae
attgcagttcttgattggctcgaaa

SEQ ID NO: 957 - DNA, 25 bp, S. cerevisiae
attgcatcatcatctttcgctggcg

SEQ ID NO: 958 - DNA, 25 bp, S. cerevisiae
attgcacataggctttcgacgatca

SEQ ID NO: 959 - DNA, 25 bp, S. cerevisiae
attgcaagaacgcatctcgacgcca

SEQ ID NO: 960 - DNA, 25 bp, S. cerevisiae
attccagaactgtatgtaggcgcca

SEQ ID NO: 961 - DNA, 25 bp, S. cerevisiae
attgcctctttcgttgtgttcaaga

SEQ ID NO: 962 - DNA, 25 bp, S. cerevisiae
attccacctctagttgtttatctgc

SEQ ID NO: 963 - DNA, 25 bp, S. cerevisiae
attcctacaccagttatttcaccga

SEQ ID NO: 964 - DNA, 25 bp, S. cerevisiae
attcgaccccgtaagttgccagcag

SEQ ID NO: 965 - DNA, 25 bp, S. cerevisiae
attcgggccggattattcactttat

SEQ ID NO: 966 - DNA, 25 bp, S. cerevisiae
attcgcgccttaagcaggatccgga

SEQ ID NO: 967 - DNA, 25 bp, S. cerevisiae
attgcctgatttaacggtcctgaac

SEQ ID NO: 968 - DNA, 25 bp, S. cerevisiae
attgctcgtgtaatccaaggcgtcc

SEQ ID NO: 969 - DNA, 25 bp, S. cerevisiae
attgcctcctcttcatatatgactg

SEQ ID NO: 970 - DNA, 25 bp, S. cerevisiae
atccccagtttgattgttgttttgt

SEQ ID NO: 971 - DNA, 25 bp, S. cerevisiae
atttgcttttagaggttggcgatcc

SEQ ID NO: 972 - DNA, 25 bp, S. cerevisiae
attcttcgagaagactggtcgccag

SEQ ID NO: 973 - DNA, 25 bp, S. cerevisiae
attacttggaactcatcggcgtatt

SEQ ID NO: 974 - DNA, 25 bp, S. cerevisiae
attactggaaggctcccggtgatta

SEQ ID NO: 975 - DNA, 25 bp, S. cerevisiae
attgcgaaatttctgctcttctcgt

SEQ ID NO: 976 - DNA, 25 bp, S. cerevisiae
attcggttttcattccagatcaagg

SEQ ID NO: 977 - DNA, 25 bp, S. cerevisiae
attgccgctatgttgatttgttact

SEQ ID NO: 978 - DNA, 25 bp, S. cerevisiae
attccatgccatacaggttagcctc

SEQ ID NO: 979 - DNA, 25 bp, S. cerevisiae
attccccatgccaggtatgatgcca

SEQ ID NO: 980 - DNA, 25 bp, S. cerevisiae
attccatccactgctaaccaaatta

SEQ ID NO: 981 - DNA, 25 bp, S. cerevisiae
attccatccacttgcattacctttt

SEQ ID NO: 982 - DNA, 25 bp, S. cerevisiae
attgccctcagtggattattttgct

SEQ ID NO: 983 - DNA, 25 bp, S. cerevisiae
attgccctcaaaactgtatctcatc

SEQ ID NO: 984 - DNA, 25 bp, S. cerevisiae
attcctccaaaagttgtgtcttcca

SEQ ID NO: 985 - DNA, 25 bp, S. cerevisiae
attgccgtcaaaggttctggttcta

SEQ ID NO: 986 - DNA, 25 bp, S. cerevisiae
attgccgccggtagtgttgtgattc

SEQ ID NO: 987 - DNA, 25 bp, S. cerevisiae
attgcccaattctacgttgctgtat

SEQ ID NO: 988 - DNA, 25 bp, S. cerevisiae
attcccatttgctcagctacgtgat

SEQ ID NO: 989 - DNA, 25 bp, S. cerevisiae
attcaaagcgcgacacatttcaaag

SEQ ID NO: 990 - DNA, 25 bp, S. cerevisiae
attgcacccgacaaatcagccacta

SEQ ID NO: 991 - DNA, 25 bp, S. cerevisiae
attgccttctatcacatcagtacga

SEQ ID NO: 992 - DNA, 25 bp, S. cerevisiae
attgcttgttgtaatcatcgtcccc

SEQ ID NO: 993 - DNA, 25 bp, S. cerevisiae
attctttctgggtggatccgccgta

SEQ ID NO: 994 - DNA, 25 bp, S. cerevisiae
atatcgtaccggagaactcaccgct

SEQ ID NO: 995 - DNA, 25 bp, S. cerevisiae
aacgtacacacgaagggctaactat

SEQ ID NO: 996 - DNA, 25 bp, S. cerevisiae
attcctggcacagaagggttccttt

SEQ ID NO: 997 - DNA, 25 bp, S. cerevisiae
attctcggcatcaaaaccgttggtt

SEQ ID NO: 998 - DNA, 25 bp, S. cerevisiae
attcgctaataaacacccgtggtct

SEQ ID NO: 999 - DNA, 25 bp, S. cerevisiae
attcctaatgaaatgcccctcgaac

SEQ ID NO: 1000 - DNA, 25 bp, S. cerevisiae
attgcctaacccacacttgagaaag

SEQ ID NO: 1001 - DNA, 25 bp, S. cerevisiae
attcgaaaccatgtcagctttgcaa

SEQ ID NO: 1002 - DNA, 25 bp, S. cerevisiae
attcgatctcttcctatacgtttat

SEQ ID NO: 1003 - DNA, 25 bp, S. cerevisiae
attgccatggctatttgacgtttat

SEQ ID NO: 1004 - DNA, 25 bp, S. cerevisiae
attccatgcagttttaccgtcttag

SEQ ID NO: 1005 - DNA, 25 bp, S. cerevisiae
attcccgacgttggcttattatgtg

SEQ ID NO: 1006 - DNA, 25 bp, S. cerevisiae
attcgccattaggtgagcgtggttc

SEQ ID NO: 1007 - DNA, 25 bp, S. cerevisiae
attcgcctggagacatggcagttgc

SEQ ID NO: 1008 - DNA, 25 bp, S. cerevisiae
attcctataatgactgccctcatgc

SEQ ID NO: 1009 - DNA, 25 bp, S. cerevisiae
attgccaatgccctagattatatgc

SEQ ID NO: 1010 - DNA, 25 bp, S. cerevisiae
attgcgcctgcaatgaatacattca

SEQ ID NO: 1011 - DNA, 25 bp, S. cerevisiae
attgctgcctgtaccatggattcaa

SEQ ID NO: 1012 - DNA, 25 bp, S. cerevisiae
attgctgccgttaatggtgtcacct

SEQ ID NO: 1013 - DNA, 25 bp, S. cerevisiae
attgcatgctctcctatttttacct

SEQ ID NO: 1014 - DNA, 25 bp, S. cerevisiae
attgctgcctcacttcttttgaaaa

SEQ ID NO: 1015 - DNA, 25 bp, S. cerevisiae
attgctcattcatctgcttcttata

SEQ ID NO: 1016 - DNA, 25 bp, S. cerevisiae
attgcatgcactatcatcacccttt

SEQ ID NO: 1017 - DNA, 25 bp, S. cerevisiae
atatcattttgactggtacacctgc

SEQ ID NO: 1018 - DNA, 25 bp, S. cerevisiae
attcatgaatggagcgtcactgccg

SEQ ID NO: 1019 - DNA, 25 bp, S. cerevisiae
attgctactaatagcgcttctccga

SEQ ID NO: 1020 - DNA, 25 bp, S. cerevisiae
atatgactttattggttccttcgga

SEQ ID NO: 1021 - DNA, 25 bp, S. cerevisiae
atccacttgtggaggcaccaaagga

SEQ ID NO: 1022 - DNA, 25 bp, S. cerevisiae
attctttctgaaaccgccaattgga

SEQ ID NO: 1023 - DNA, 25 bp, S. cerevisiae
attccgttagtcttggtgctgttta

SEQ ID NO: 1024 - DNA, 25 bp, S. cerevisiae
attgccgcatttgcttccgcagatt

SEQ ID NO: 1025 - DNA, 25 bp, S. cerevisiae
attgcctgtgatttgcgtctcggaa

SEQ ID NO: 1026 - DNA, 25 bp, S. cerevisiae
attctttcatgtacaattcgagcaa

SEQ ID NO: 1027 - DNA, 25 bp, S. cerevisiae
attcttacataggacaatcggccag

SEQ ID NO: 1028 - DNA, 25 bp, S. cerevisiae
attgcttctgtagagagtacgccaa

SEQ ID NO: 1029 - DNA, 25 bp, S. cerevisiae
attgctttctactgactggtgccac

SEQ ID NO: 1030 - DNA, 25 bp, S. cerevisiae
attgcgttggacgaattcgacgttt

SEQ ID NO: 1031 - DNA, 25 bp, S. cerevisiae
aagcgatgggacacccgtggtttgc

SEQ ID NO: 1032 - DNA, 25 bp, S. cerevisiae
attcgttaagtattcctatgtccaa

SEQ ID NO: 1033 - DNA, 25 bp, S. cerevisiae
attccgtctacgagtttgatcaata

SEQ ID NO: 1034 - DNA, 25 bp, S. cerevisiae
attcccgctacaatttttgacaaag

SEQ ID NO: 1035 - DNA, 25 bp, S. cerevisiae
aggaccgtaccatcttaacaattgc

SEQ ID NO: 1036 - DNA, 25 bp, S. cerevisiae
atgtgagtagtagcaattttccctt

SEQ ID NO: 1037 - DNA, 25 bp, S. cerevisiae
atgggcgagggtattgttaccgtct

SEQ ID NO: 1038 - DNA, 25 bp, S. cerevisiae
atttgggtcgatattaaacgcagta

SEQ ID NO: 1039 - DNA, 25 bp, S. cerevisiae
attcctaatctgttgcgaaacctag

SEQ ID NO: 1040 - DNA, 25 bp, S. cerevisiae
attcctgaattgtccgtagtactaa

SEQ ID NO: 1041 - DNA, 25 bp, S. cerevisiae
attccataatgtcctcagtttccta

SEQ ID NO: 1042 - DNA, 25 bp, S. cerevisiae
attgccattattgctaccattatct

SEQ ID NO: 1043 - DNA, 25 bp, S. cerevisiae
attcgctactctctcatggtaacga

SEQ ID NO: 1044 - DNA, 25 bp, S. cerevisiae
attgccgcatccattgggtacactg

SEQ ID NO: 1045 - DNA, 25 bp, S. cerevisiae
attccctctgaatttgcgtacttga

SEQ ID NO: 1046 - DNA, 25 bp, S. cerevisiae
attcttcacgggtctgtcatactta

SEQ ID NO: 1047 - DNA, 25 bp, S. cerevisiae
attcttggagtatcgcctagtgcta

SEQ ID NO: 1048 - DNA, 25 bp, S. cerevisiae
attccgctagtatcgttttgttcct

SEQ ID NO: 1049 - DNA, 25 bp, S. cerevisiae
attccctttccacttttatgttcat

SEQ ID NO: 1050 - DNA, 25 bp, S. cerevisiae
attgctgttttgtctctttttgttc

SEQ ID NO: 1051 - DNA, 25 bp, S. cerevisiae
attgctggtcagagaacttttcctg

SEQ ID NO: 1052 - DNA, 25 bp, S. cerevisiae
attgccgccagaagaactggtttgt

SEQ ID NO: 1053 - DNA, 25 bp, S. cerevisiae
attgctgcccaaaaacgtatctctg

SEQ ID NO: 1054 - DNA, 25 bp, S. cerevisiae
atttgcccaaactagctgaatacgc

SEQ ID NO: 1055 - DNA, 25 bp, S. cerevisiae
attacgcgaccagattgtaatcgcc

SEQ ID NO: 1056 - DNA, 25 bp, S. cerevisiae
atttccgaaggccagggcgcttgat

SEQ ID NO: 1057 - DNA, 25 bp, S. cerevisiae
attcctctaaggtggcagcgttttc

SEQ ID NO: 1058 - DNA, 25 bp, S. cerevisiae
attccaaagggatggcacgctgttt

SEQ ID NO: 1059 - DNA, 25 bp, S. cerevisiae
attcctcaagggtatggtcgttatc

SEQ ID NO: 1060 - DNA, 25 bp, S. cerevisiae
attcttaaggagttcgctggccgct

SEQ ID NO: 1061 - DNA, 25 bp, S. cerevisiae
attcagctactgcatcaaggtcttt

SEQ ID NO: 1062 - DNA, 25 bp, S. cerevisiae
attccgaaggtccagtttttgacag

SEQ ID NO: 1063 - DNA, 25 bp, S. cerevisiae
attcctggagagaccatgtgggttc

SEQ ID NO: 1064 - DNA, 25 bp, S. cerevisiae
atatcgccgaaggttcaagtacttt

SEQ ID NO: 1065 - DNA, 25 bp, S. cerevisiae
attcgccacacattttctactacat

SEQ ID NO: 1066 - DNA, 25 bp, S. cerevisiae
attgcctctagattttctgacccag

SEQ ID NO: 1067 - DNA, 25 bp, S. cerevisiae
attcagtcagaacataccacgccat

SEQ ID NO: 1068 - DNA, 25 bp, S. cerevisiae
attctgatgtcaactcaaccacgca

SEQ ID NO: 1069 - DNA, 25 bp, S. cerevisiae
attgctgctggtgcctccgccgcag

SEQ ID NO: 1070 - DNA, 25 bp, S. cerevisiae
attctggttcacttgccgtcgtatg

SEQ ID NO: 1071 - DNA, 25 bp, S. cerevisiae
attcggccacgatgctatctttgag

SEQ ID NO: 1072 - DNA, 25 bp, S. cerevisiae
attcgatcaagatagcttccgctgc

SEQ ID NO: 1073 - DNA, 25 bp, S. cerevisiae
attcttgagaggttcggcgatatac

SEQ ID NO: 1074 - DNA, 25 bp, S. cerevisiae
attctgatgaggctacgggactaag

SEQ ID NO: 1075 - DNA, 25 bp, S. cerevisiae
attcgtcgacgtactggacactgaa

SEQ ID NO: 1076 - DNA, 25 bp, S. cerevisiae
attcaccttcgtggatccaacaagt

SEQ ID NO: 1077 - DNA, 25 bp, S. cerevisiae
attgccctgtccttattccattttt

SEQ ID NO: 1078 - DNA, 25 bp, S. cerevisiae
attcggttccgatttagatgcctcc

SEQ ID NO: 1079 - DNA, 25 bp, S. cerevisiae
attcggtcttattgcgtttgttgcc

SEQ ID NO: 1080 - DNA, 25 bp, S. cerevisiae
attgccttctttccgaacagtcgag

SEQ ID NO: 1081 - DNA, 25 bp, S. cerevisiae
attcctatttctctgatgacactgg

SEQ ID NO: 1082 - DNA, 25 bp, S. cerevisiae
attcttaatttcgtatgactctgtg

SEQ ID NO: 1083 - DNA, 25 bp, S. cerevisiae
attcgaggttgtagtcttcacggct

SEQ ID NO: 1084 - DNA, 25 bp, S. cerevisiae
attctgggttgtggttcgacatctc

SEQ ID NO: 1085 - DNA, 25 bp, S. cerevisiae
attctgctgcgttttgttagctctg

SEQ ID NO: 1086 - DNA, 25 bp, S. cerevisiae
attctgattgatgttgctgggcctc

SEQ ID NO: 1087 - DNA, 25 bp, S. cerevisiae
attccttgtcttctaagcatcgttc

SEQ ID NO: 1088 - DNA, 25 bp, S. cerevisiae
atttcggtcgtagaagatcttccca

SEQ ID NO: 1089 - DNA, 25 bp, S. cerevisiae
atttccagaggcaccagaagttcca

SEQ ID NO: 1090 - DNA, 25 bp, S. cerevisiae
attttcgctagatccaaaggtccct

SEQ ID NO: 1091 - DNA, 25 bp, S. cerevisiae
attctacctagatcctgaatctgct

SEQ ID NO: 1092 - DNA, 25 bp, S. cerevisiae
attctatccttcaacgataatacat

SEQ ID NO: 1093 - DNA, 25 bp, S. cerevisiae
attctgtccgtgaagctggcggaat

SEQ ID NO: 1094 - DNA, 25 bp, S. cerevisiae
attcgagtcccttgagttgtagatc

SEQ ID NO: 1095 - DNA, 25 bp, S. cerevisiae
attcgatgtcgcctataattgctcc

SEQ ID NO: 1096 - DNA, 25 bp, S. cerevisiae
attgccatgtcgttaagtgctcgtg

SEQ ID NO: 1097 - DNA, 25 bp, S. cerevisiae
attgccttggaggagaatctcgtta

SEQ ID NO: 1098 - DNA, 25 bp, S. cerevisiae
attccggtattgtcactttggctta

SEQ ID NO: 1099 - DNA, 25 bp, S. cerevisiae
attcttggcgatacaccagtctggc

SEQ ID NO: 1100 - DNA, 25 bp, S. cerevisiae
attcttcaccaacgacattctgtgc

SEQ ID NO: 1101 - DNA, 25 bp, S. cerevisiae
attctccatccaactttctagtgtg

SEQ ID NO: 1102 - DNA, 25 bp, S. cerevisiae
attccgtcacttcgatactattgtc

SEQ ID NO: 1103 - DNA, 25 bp, S. cerevisiae
attcctgttcctcaactacatagct

SEQ ID NO: 1104 - DNA, 25 bp, S. cerevisiae
attaagactcctgcatacgacatag

SEQ ID NO: 1105 - DNA, 25 bp, S. cerevisiae
attactcgcatcgtgcatcgaaaca

SEQ ID NO: 1106 - DNA, 25 bp, S. cerevisiae
attcattgcagctactgacgctcag

SEQ ID NO: 1107 - DNA, 25 bp, S. cerevisiae
attgccatatgccactgaagccgaa

SEQ ID NO: 1108 - DNA, 25 bp, S. cerevisiae
agtccacgaagcaaagtctaaccca

SEQ ID NO: 1109 - DNA, 25 bp, S. cerevisiae
attaacgactgcaacaaccaacacc

SEQ ID NO: 1110 - DNA, 25 bp, S. cerevisiae
atatgaacgtcgcagataccaccac

SEQ ID NO: 1111 - DNA, 25 bp, S. cerevisiae
atttgatggccgaggtcaagcctga

SEQ ID NO: 1112 - DNA, 25 bp, S. cerevisiae
attccagctgaacaagtcaccagag

SEQ ID NO: 1113 - DNA, 25 bp, S. cerevisiae
attccatgtgaaaaaatcctgaggg

SEQ ID NO: 1114 - DNA, 25 bp, S. cerevisiae
attccactacttttcacactgaggg

SEQ ID NO: 1115 - DNA, 25 bp, S. cerevisiae
attgccaccacgattccattgatag

SEQ ID NO: 1116 - DNA, 25 bp, S. cerevisiae
attcaagcgctgtatcgagaacgga

SEQ ID NO: 1117 - DNA, 25 bp, S. cerevisiae
attcctatgattgcgcacttctcaa

SEQ ID NO: 1118 - DNA, 25 bp, S. cerevisiae
attctgctctactgccaaatctata

SEQ ID NO: 1119 - DNA, 25 bp, S. cerevisiae
attccttactggcatggaccaacct

SEQ ID NO: 1120 - DNA, 25 bp, S. cerevisiae
attccttccaagaatgctcacgcaa

SEQ ID NO: 1121 - DNA, 25 bp, S. cerevisiae
attccatctctagtatctggcttag

SEQ ID NO: 1122 - DNA, 25 bp, S. cerevisiae
attccagttggccattttcggcata

SEQ ID NO: 1123 - DNA, 25 bp, S. cerevisiae
attccaagtgtcctctttcgttaag

SEQ ID NO: 1124 - DNA, 25 bp, S. cerevisiae
attcgaactgttccttctgggtgaa

SEQ ID NO: 1125 - DNA, 25 bp, S. cerevisiae
attctcaaacttcgctgtcgcaaaa

SEQ ID NO: 1126 - DNA, 25 bp, S. cerevisiae
attcccaagtacatggcacaccgtg

SEQ ID NO: 1127 - DNA, 25 bp, S. cerevisiae
attcccaaggtcagccaaatcgtat

SEQ ID NO: 1128 - DNA, 25 bp, S. cerevisiae
attccaccgcttatttggctcagga

SEQ ID NO: 1129 - DNA, 25 bp, S. cerevisiae
attcgccctttttggtggtaatgca

SEQ ID NO: 1130 - DNA, 25 bp, S. cerevisiae
attcccacgtttacatttcttcatg

SEQ ID NO: 1131 - DNA, 25 bp, S. cerevisiae
atatcccttcttttaaattccatgg

SEQ ID NO: 1132 - DNA, 25 bp, S. cerevisiae
attctcccagttttacaattgcaag

SEQ ID NO: 1133 - DNA, 25 bp, S. cerevisiae
attctgaatcgtatagcctcctttt

SEQ ID NO: 1134 - DNA, 25 bp, S. cerevisiae
attcgagtgcttataccctaactgt

SEQ ID NO: 1135 - DNA, 25 bp, S. cerevisiae
attcgagtggtaatatctgccttga

SEQ ID NO: 1136 - DNA, 25 bp, S. cerevisiae
attcccaagctcatttcctaatgtg

SEQ ID NO: 1137 - DNA, 25 bp, S. cerevisiae
attccacagctgacattacccaatt

SEQ ID NO: 1138 - DNA, 25 bp, S. cerevisiae
attcccgttatgttcactgcattgg

SEQ ID NO: 1139 - DNA, 25 bp, S. cerevisiae
attccaggtgttttgttcattgatg

SEQ ID NO: 1140 - DNA, 25 bp, S. cerevisiae
attccaggcgttccagtgctaatga

SEQ ID NO: 1141 - DNA, 25 bp, S. cerevisiae
attcgaagctgcatacgactttcca

SEQ ID NO: 1142 - DNA, 25 bp, S. cerevisiae
attccagttgcgaacgttttcacta

SEQ ID NO: 1143 - DNA, 25 bp, S. cerevisiae
attcgccttgctatttctttacaca

SEQ ID NO: 1144 - DNA, 25 bp, S. cerevisiae
attccttctctgacttgacgttaca

SEQ ID NO: 1145 - DNA, 25 bp, S. cerevisiae
attctattgtatacggtggtcttca

SEQ ID NO: 1146 - DNA, 25 bp, S. cerevisiae
attctatgtctgatcccggtactac

SEQ ID NO: 1147 - DNA, 25 bp, S. cerevisiae
attcctaatgtggtgccgggattac

SEQ ID NO: 1148 - DNA, 25 bp, S. cerevisiae
attcccgcttgttactgactattgt

SEQ ID NO: 1149 - DNA, 25 bp, S. cerevisiae
attctcgagctaccctatatcatga

SEQ ID NO: 1150 - DNA, 25 bp, S. cerevisiae
atatgattgggcgtgtcctacaggc

SEQ ID NO: 1151 - DNA, 25 bp, S. cerevisiae
attcctggagaagctgaccttgagt

SEQ ID NO: 1152 - DNA, 25 bp, S. cerevisiae
attcactcaccccattgttatagga

SEQ ID NO: 1153 - DNA, 25 bp, S. cerevisiae
attccttgcgcccaatttcatggga

SEQ ID NO: 1154 - DNA, 25 bp, S. cerevisiae
attcgaatcctctccattatggtta

SEQ ID NO: 1155 - DNA, 25 bp, S. cerevisiae
attcggattcgacccattaactgta

SEQ ID NO: 1156 - DNA, 25 bp, S. cerevisiae
attcctcaggatgcacaagcttttg

SEQ ID NO: 1157 - DNA, 25 bp, S. cerevisiae
attcctactgtctcaatggttgtca

SEQ ID NO: 1158 - DNA, 25 bp, S. cerevisiae
attcccggaagctgtatggtctcat

SEQ ID NO: 1159 - DNA, 25 bp, S. cerevisiae
attctttgcgaagtccttggttaat

SEQ ID NO: 1160 - DNA, 25 bp, S. cerevisiae
attcctgttattactctcatgcaag

SEQ ID NO: 1161 - DNA, 25 bp, S. cerevisiae
attcgctactcactactctgataag

SEQ ID NO: 1162 - DNA, 25 bp, S. cerevisiae
attcattcactggttctgcgataga

SEQ ID NO: 1163 - DNA, 25 bp, S. cerevisiae
attcattagcggtcgtgtgctgcgg

SEQ ID NO: 1164 - DNA, 25 bp, S. cerevisiae
attcattatcatcgccacttggcat

SEQ ID NO: 1165 - DNA, 25 bp, S. cerevisiae
attctattggctcgctagcttctaa

SEQ ID NO: 1166 - DNA, 25 bp, S. cerevisiae
attcttcgttgccttttctatcaag

SEQ ID NO: 1167 - DNA, 25 bp, S. cerevisiae
attcctttgggtaagcctggcacag

SEQ ID NO: 1168 - DNA, 25 bp, S. cerevisiae
attccgccatttgaactcgacaact

SEQ ID NO: 1169 - DNA, 25 bp, S. cerevisiae
attccccttcggaactgctgaagtt

SEQ ID NO: 1170 - DNA, 25 bp, S. cerevisiae
attcccgtccatggtacgtgagaca

SEQ ID NO: 1171 - DNA, 25 bp, S. cerevisiae
attcctcttcactggtcgtcaaaaa

SEQ ID NO: 1172 - DNA, 25 bp, S. cerevisiae
attcgctcgaaatggacgattccaa

SEQ ID NO: 1173 - DNA, 25 bp, S. cerevisiae
attccgcggtgttgatggagttcac

SEQ ID NO: 1174 - DNA, 25 bp, S. cerevisiae
attcctgtggatggttgtccccaaa

SEQ ID NO: 1175 - DNA, 25 bp, S. cerevisiae
attccgattgacgattgctacctat

SEQ ID NO: 1176 - DNA, 25 bp, S. cerevisiae
attcatggaggatgtcgctaccgct

SEQ ID NO: 1177 - DNA, 25 bp, S. cerevisiae
attccgccgcatatgcattgtgtag

SEQ ID NO: 1178 - DNA, 25 bp, S. cerevisiae
attcggattctggtattttcggtat

SEQ ID NO: 1179 - DNA, 25 bp, S. cerevisiae
attcgtttggcgttcaagtcggtga

SEQ ID NO: 1180 - DNA, 25 bp, S. cerevisiae
atatcggttggtgtccattctggta

SEQ ID NO: 1181 - DNA, 25 bp, S. cerevisiae
ataagtgggtacgagcttgccttgc

SEQ ID NO: 1182 - DNA, 25 bp, S. cerevisiae
attcctttggatgagcaggccttct

SEQ ID NO: 1183 - DNA, 25 bp, S. cerevisiae
attccctgggttaaagcatgcttcg

SEQ ID NO: 1184 - DNA, 25 bp, S. cerevisiae
attccctgtgtttctcatgagacct

SEQ ID NO: 1185 - DNA, 25 bp, S. cerevisiae
attcctggtcaaactaatggctctg

SEQ ID NO: 1186 - DNA, 25 bp, S. cerevisiae
attaccattattactaaggcctttg

SEQ ID NO: 1187 - DNA, 25 bp, S. cerevisiae
attaccaactggactaagccttcct

SEQ ID NO: 1188 - DNA, 25 bp, S. cerevisiae
attactgcccatggtattaccttct

SEQ ID NO: 1189 - DNA, 25 bp, S. cerevisiae
attcctacccgcaatatatgacttc

SEQ ID NO: 1190 - DNA, 25 bp, S. cerevisiae
attacaagtaactctcctgtctctt

SEQ ID NO: 1191 - DNA, 25 bp, S. cerevisiae
attagtactgggaatggccgcctac

SEQ ID NO: 1192 - DNA, 25 bp, S. cerevisiae
attcgtttgggcaatggcgtggctt

SEQ ID NO: 1193 - DNA, 25 bp, S. cerevisiae
attcttcatgttggccattctacag

SEQ ID NO: 1194 - DNA, 25 bp, S. cerevisiae
attctgacatgttatcggttcttac

SEQ ID NO: 1195 - DNA, 25 bp, S. cerevisiae
attacagtgatctaccgtttcctct

SEQ ID NO: 1196 - DNA, 25 bp, S. cerevisiae
attctaaacaaggtgcggacgccga

SEQ ID NO: 1197 - DNA, 25 bp, S. cerevisiae
attctggaatactctacttccccta

SEQ ID NO: 1198 - DNA, 25 bp, S. cerevisiae
attcggtattaatttggtgtgcgca

SEQ ID NO: 1199 - DNA, 25 bp, S. cerevisiae
attcccaagactacttttacgctca

SEQ ID NO: 1200 - DNA, 25 bp, S. cerevisiae
aatactctaacgctttggaccttct

SEQ ID NO: 1201 - DNA, 25 bp, S. cerevisiae
attccctctctaacattccattatt

SEQ ID NO: 1202 - DNA, 25 bp, S. cerevisiae
attctcctacttagtttcgcttcta

SEQ ID NO: 1203 - DNA, 25 bp, S. cerevisiae
attctatcgcaacttcgtcgtcaaa

SEQ ID NO: 1204 - DNA, 25 bp, S. cerevisiae
attccgcacaagcaaataccacatc

SEQ ID NO: 1205 - DNA, 25 bp, S. cerevisiae
attcccactggattactctatgcta

SEQ ID NO: 1206 - DNA, 25 bp, S. cerevisiae
atctacttgggatatcgcaccttag

SEQ ID NO: 1207 - DNA, 25 bp, S. cerevisiae
attactggacgatgacgactcctcg

SEQ ID NO: 1208 - DNA, 25 bp, S. cerevisiae
attctgcaatcgctatccggtggag

SEQ ID NO: 1209 - DNA, 25 bp, S. cerevisiae
attttggtcggtgattctggtgaac

SEQ ID NO: 1210 - DNA, 25 bp, S. cerevisiae
atttaagcacgcagttttgggaaga

SEQ ID NO: 1211 - DNA, 25 bp, S. cerevisiae
attcattatccgttgtggtggctaa

SEQ ID NO: 1212 - DNA, 25 bp, S. cerevisiae
attaatcaccacatccacgagtttg

SEQ ID NO: 1213 - DNA, 25 bp, S. cerevisiae
attcaggcaatctaatccaagcgtt

SEQ ID NO: 1214 - DNA, 25 bp, S. cerevisiae
attccgctgacttatcccgtgttaa

SEQ ID NO: 1215 - DNA, 25 bp, S. cerevisiae
attcccatacacacaagacttctac

SEQ ID NO: 1216 - DNA, 25 bp, S. cerevisiae
attcccaccgctagcaagacatgct

SEQ ID NO: 1217 - DNA, 25 bp, S. cerevisiae
attcagactgcccaaacaaattcta

SEQ ID NO: 1218 - DNA, 25 bp, S. cerevisiae
attcaggctgcccaaatgctcaagc

SEQ ID NO: 1219 - DNA, 25 bp, S. cerevisiae
attacgaccgatccaagtgccaaga

SEQ ID NO: 1220 - DNA, 25 bp, S. cerevisiae
attctcttgacgagcaattgccaga

SEQ ID NO: 1221 - DNA, 25 bp, S. cerevisiae
attcccttgttagcttcgagatcag

SEQ ID NO: 1222 - DNA, 25 bp, S. cerevisiae
attcgcctattatttcttctggatc

SEQ ID NO: 1223 - DNA, 25 bp, S. cerevisiae
attcatgcagcctacactattgtca

SEQ ID NO: 1224 - DNA, 25 bp, S. cerevisiae
attctgactctaactccagttcgga

SEQ ID NO: 1225 - DNA, 25 bp, S. cerevisiae
attcacttttcatttcaccaacagg

SEQ ID NO: 1226 - DNA, 25 bp, S. cerevisiae
attcgctaaaccattggcctctaag

SEQ ID NO: 1227 - DNA, 25 bp, S. cerevisiae
attcacttgaactatttggcccata

SEQ ID NO: 1228 - DNA, 25 bp, S. cerevisiae
atttctaatacccactttctatgcg

SEQ ID NO: 1229 - DNA, 25 bp, S. cerevisiae
attcttttacgatatttccagtgct

SEQ ID NO: 1230 - DNA, 25 bp, S. cerevisiae
attctgttcctttctcgacagcgaa

SEQ ID NO: 1231 - DNA, 25 bp, S. cerevisiae
attctgtacggttcattggcaccag

SEQ ID NO: 1232 - DNA, 25 bp, S. cerevisiae
attcaaggcgagaatccactccaga

SEQ ID NO: 1233 - DNA, 25 bp, S. cerevisiae
attactgtggaaggactttctgccc

SEQ ID NO: 1234 - DNA, 25 bp, S. cerevisiae
attagctccggaaactttgaccaag

SEQ ID NO: 1235 - DNA, 25 bp, S. cerevisiae
atgtggccttggacaactttacttt

SEQ ID NO: 1236 - DNA, 25 bp, S. cerevisiae
agggacggcccaagttgtgactctt

SEQ ID NO: 1237 - DNA, 25 bp, S. cerevisiae
cggtgacgggttcttgaacttctat

SEQ ID NO: 1238 - DNA, 25 bp, S. cerevisiae
cggtgccaacttgtttaacgctact

SEQ ID NO: 1239 - DNA, 25 bp, S. cerevisiae
atggatgcgaacaccttaaacgtat

SEQ ID NO: 1240 - DNA, 25 bp, S. cerevisiae
attttgaccttctctactactttga

SEQ ID NO: 1241 - DNA, 25 bp, S. cerevisiae
attcatgccacacttcaaacgtaca

SEQ ID NO: 1242 - DNA, 25 bp, S. cerevisiae
attcatcgtcccaaaatcgttcaac

SEQ ID NO: 1243 - DNA, 25 bp, S. cerevisiae
attacgtacccgatcatgttgcaaa

SEQ ID NO: 1244 - DNA, 25 bp, S. cerevisiae
attacgatttcggtttgttgccatt

SEQ ID NO: 1245 - DNA, 25 bp, S. cerevisiae
attactaggtcgtctgttggtctac

SEQ ID NO: 1246 - DNA, 25 bp, S. cerevisiae
attcccaggcacgtgatgtcgagta

SEQ ID NO: 1247 - DNA, 25 bp, S. cerevisiae
attcgcgcacccgtgatcgagagaa

SEQ ID NO: 1248 - DNA, 25 bp, S. cerevisiae
attcaagcccatgctgtgcgggaat

SEQ ID NO: 1249 - DNA, 25 bp, S. cerevisiae
atctacccaggcagaggtaccttgt

SEQ ID NO: 1250 - DNA, 25 bp, S. cerevisiae
attcgtccaggaagggtaccatgaa

SEQ ID NO: 1251 - DNA, 25 bp, S. cerevisiae
attctttattcatcaggtatcccac

SEQ ID NO: 1252 - DNA, 25 bp, S. cerevisiae
attctgttcttctacgtttgctacc

SEQ ID NO: 1253 - DNA, 25 bp, S. cerevisiae
attcttggcttcattcttgttgggt

SEQ ID NO: 1254 - DNA, 25 bp, S. cerevisiae
attcttgcgaacgatatcaatgctt

SEQ ID NO: 1255 - DNA, 25 bp, S. cerevisiae
attaaccaaccaagaccaccaagag

SEQ ID NO: 1256 - DNA, 25 bp, S. cerevisiae
attcaatctaacgtagccgaccgaa

SEQ ID NO: 1257 - DNA, 25 bp, S. cerevisiae
attcaactcaacatttttccgcaac

SEQ ID NO: 1258 - DNA, 25 bp, S. cerevisiae
attaaataatctaagttacctgata

SEQ ID NO: 1259 - DNA, 25 bp, S. cerevisiae
attacaatcctcaaacgggccgtag

SEQ ID NO: 1260 - DNA, 25 bp, S. cerevisiae
attactaccgatatcatgtcccgtg

SEQ ID NO: 1261 - DNA, 25 bp, S. cerevisiae
attcagtaacgctaccgccagtggg

SEQ ID NO: 1262 - DNA, 25 bp, S. cerevisiae
attagtaagtgacccagtacctggc

SEQ ID NO: 1263 - DNA, 25 bp, S. cerevisiae
attcagttggactttcagctacctg

SEQ ID NO: 1264 - DNA, 25 bp, S. cerevisiae
attcgatattgattctccagtccct

SEQ ID NO: 1265 - DNA, 25 bp, S. cerevisiae
attcaggagaaatctacgagcggta

SEQ ID NO: 1266 - DNA, 25 bp, S. cerevisiae
attcgtgataacaagctggtgtctg

SEQ ID NO: 1267 - DNA, 25 bp, S. cerevisiae
attcgaagctgttgagcacccagat

SEQ ID NO: 1268 - DNA, 25 bp, S. cerevisiae
attagatacctcaagctcagccgat

SEQ ID NO: 1269 - DNA, 25 bp, S. cerevisiae
attcttgatcacgaaggccttgtca

SEQ ID NO: 1270 - DNA, 25 bp, S. cerevisiae
attctattcagcgatcatgccgact

SEQ ID NO: 1271 - DNA, 25 bp, S. cerevisiae
attctttgaccaatgctggcactgg

SEQ ID NO: 1272 - DNA, 25 bp, S. cerevisiae
attcgataacgaccatcgtgtccta

SEQ ID NO: 1273 - DNA, 25 bp, S. cerevisiae
attctagcaaagagccttctccagc

SEQ ID NO: 1274 - DNA, 25 bp, S. cerevisiae
attattacacatcgcctcgaagcta

SEQ ID NO: 1275 - DNA, 25 bp, S. cerevisiae
atttgaggtcgcgatttggaaactt

SEQ ID NO: 1276 - DNA, 25 bp, S. cerevisiae
atcttcgcttgggattggaaaactg

SEQ ID NO: 1277 - DNA, 25 bp, S. cerevisiae
attcgacctgatgtatgccaaacgt

SEQ ID NO: 1278 - DNA, 25 bp, S. cerevisiae
attcgacctgatatcatgctctcta

SEQ ID NO: 1279 - DNA, 25 bp, S. cerevisiae
attcgtcgtttggatcatttcgtca

SEQ ID NO: 1280 - DNA, 25 bp, S. cerevisiae
attctgtgctttatggtcctattcc

SEQ ID NO: 1281 - DNA, 25 bp, S. cerevisiae
attcttgtcaatattcaccacctac

SEQ ID NO: 1282 - DNA, 25 bp, S. cerevisiae
attctagctatcattattcccatcc

SEQ ID NO: 1283 - DNA, 25 bp, S. cerevisiae
attcagcaagatgttgatgccatga

SEQ ID NO: 1284 - DNA, 25 bp, S. cerevisiae
attcaggattgttgttcgattagta

SEQ ID NO: 1285 - DNA, 25 bp, S. cerevisiae
attacgtttatgacgcgactttcat

SEQ ID NO: 1286 - DNA, 25 bp, S. cerevisiae
ataccggcggagttacagggtctgc

SEQ ID NO: 1287 - DNA, 25 bp, S. cerevisiae
attcttttctaaacagctgctgcgt

SEQ ID NO: 1288 - DNA, 25 bp, S. cerevisiae
attctttccatcctgtagacgggtt

SEQ ID NO: 1289 - DNA, 25 bp, S. cerevisiae
attcaactccccaatggttggtttg

SEQ ID NO: 1290 - DNA, 25 bp, S. cerevisiae
attacaggccctaaagacacaccgt

SEQ ID NO: 1291 - DNA, 25 bp, S. cerevisiae
attcacatccggcatcaagagcgtc

SEQ ID NO: 1292 - DNA, 25 bp, S. cerevisiae
attaccatgccaccaaaggctgtca

SEQ ID NO: 1293 - DNA, 25 bp, S. cerevisiae
attcaacatatcgataccgcttcca

SEQ ID NO: 1294 - DNA, 25 bp, S. cerevisiae
attcaacaaacaccgttctcatgca

SEQ ID NO: 1295 - DNA, 25 bp, S. cerevisiae
attcgtccacccaaaatttcatcaa

SEQ ID NO: 1296 - DNA, 25 bp, S. cerevisiae
attcgtacgtccgttatgtggtcaa

SEQ ID NO: 1297 - DNA, 25 bp, S. cerevisiae
attctgctccgtgcgttaatcaatt

SEQ ID NO: 1298 - DNA, 25 bp, S. cerevisiae
attcatccggtaagtcaggcgtcat

SEQ ID NO: 1299 - DNA, 25 bp, S. cerevisiae
attagacgaatgttccacgacccta

SEQ ID NO: 1300 - DNA, 25 bp, S. cerevisiae
attagacgtttcctccgacagaaga

SEQ ID NO: 1301 - DNA, 25 bp, S. cerevisiae
attagcatcagccttgaagtgcctg

SEQ ID NO: 1302 - DNA, 25 bp, S. cerevisiae
attacgagagcggacgatgcacccc

SEQ ID NO: 1303 - DNA, 25 bp, S. cerevisiae
attcacatgggaataggaccctcca

SEQ ID NO: 1304 - DNA, 25 bp, S. cerevisiae
attactttcaagtgcccatactgcc

SEQ ID NO: 1305 - DNA, 25 bp, S. cerevisiae
attaaatgatgcatgggccactagt

SEQ ID NO: 1306 - DNA, 25 bp, S. cerevisiae
attatcaagcacacatggccccggt

SEQ ID NO: 1307 - DNA, 25 bp, S. cerevisiae
attaaagttccagggcggcgcattt

SEQ ID NO: 1308 - DNA, 25 bp, S. cerevisiae
attaacactttctgtgggcgctact

SEQ ID NO: 1309 - DNA, 25 bp, S. cerevisiae
attatcgccatcactggtggtggta

SEQ ID NO: 1310 - DNA, 25 bp, S. cerevisiae
attctcccatcagaagtggcgttta

SEQ ID NO: 1311 - DNA, 25 bp, S. cerevisiae
attcttcccaatccagtcgcgatta

SEQ ID NO: 1312 - DNA, 25 bp, S. cerevisiae
attctttccaattgtgtcatcgatg

SEQ ID NO: 1313 - DNA, 25 bp, S. cerevisiae
attcaacaaattcatctggtgcaga

SEQ ID NO: 1314 - DNA, 25 bp, S. cerevisiae
attcagaaagagtctacgttgcatt

SEQ ID NO: 1315 - DNA, 25 bp, S. cerevisiae
attcaagaatgtgctactgcctcat

SEQ ID NO: 1316 - DNA, 25 bp, S. cerevisiae
attaatgcacagtccatgccctttt

SEQ ID NO: 1317 - DNA, 25 bp, S. cerevisiae
attcaatacagtctacgaggcccac

SEQ ID NO: 1318 - DNA, 25 bp, S. cerevisiae
attaatactgctatatccacccaac

SEQ ID NO: 1319 - DNA, 25 bp, S. cerevisiae
attagaagactttgtccactcacaa

SEQ ID NO: 1320 - DNA, 25 bp, S. cerevisiae
atatcaagggcctcgtagcgatgac

SEQ ID NO: 1321 - DNA, 25 bp, S. cerevisiae
atatcaagtggatccttccggttcc

SEQ ID NO: 1322 - DNA, 25 bp, S. cerevisiae
attacagattcaaccttgccagtgg

SEQ ID NO: 1323 - DNA, 25 bp, S. cerevisiae
attacgagcatctctatcccaatgg

SEQ ID NO: 1324 - DNA, 25 bp, S. cerevisiae
atatacgatgactcaactactgttg

SEQ ID NO: 1325 - DNA, 25 bp, S. cerevisiae
attacgatgacatacctggtgacgg

SEQ ID NO: 1326 - DNA, 25 bp, S. cerevisiae
attacaggacctactcggagcggga

SEQ ID NO: 1327 - DNA, 25 bp, S. cerevisiae
attacaaagccctccagagtcggaa

SEQ ID NO: 1328 - DNA, 25 bp, S. cerevisiae
attaccttcaccaccaggatttgaa

SEQ ID NO: 1329 - DNA, 25 bp, S. cerevisiae
attaccttattacccagcagtctta

SEQ ID NO: 1330 - DNA, 25 bp, S. cerevisiae
attacccatcaatatgtcacagtac

SEQ ID NO: 1331 - DNA, 25 bp, S. cerevisiae
attctcctctaattatgctcctgta

SEQ ID NO: 1332 - DNA, 25 bp, S. cerevisiae
attctaccccgactttggacataat

SEQ ID NO: 1333 - DNA, 25 bp, S. cerevisiae
attctccacctcgactaaagacaaa

SEQ ID NO: 1334 - DNA, 25 bp, S. cerevisiae
attcttcacacgtcacaaactcaaa

SEQ ID NO: 1335 - DNA, 25 bp, S. cerevisiae
attctacagcgccatctaacgaaaa

SEQ ID NO: 1336 - DNA, 25 bp, S. cerevisiae
attctcagcacttgtcctacgtggg

SEQ ID NO: 1337 - DNA, 25 bp, S. cerevisiae
attcggcagttgtcctcacgtagat

SEQ ID NO: 1338 - DNA, 25 bp, S. cerevisiae
attcaatgcgtttttagcgggattc

SEQ ID NO: 1339 - DNA, 25 bp, S. cerevisiae
attaaagctgaactggcaaggatga

SEQ ID NO: 1340 - DNA, 25 bp, S. cerevisiae
attagaatctgagtcatggcaagaa

SEQ ID NO: 1341 - DNA, 25 bp, S. cerevisiae
attagcaatcgacccatcaagcaag

SEQ ID NO: 1342 - DNA, 25 bp, S. cerevisiae
attacactcgatccgttccaaacaa

SEQ ID NO: 1343 - DNA, 25 bp, S. cerevisiae
attactactcttcgcaatcatttcc

SEQ ID NO: 1344 - DNA, 25 bp, S. cerevisiae
attactgttgaatccactttcccat

SEQ ID NO: 1345 - DNA, 25 bp, S. cerevisiae
attatgatctagtcacccctggtaa

SEQ ID NO: 1346 - DNA, 25 bp, S. cerevisiae
attagatgaatatcacggcctgtac

SEQ ID NO: 1347 - DNA, 25 bp, S. cerevisiae
attagagctgaacccgcgattgtat

SEQ ID NO: 1348 - DNA, 25 bp, S. cerevisiae
attagcgtgagcaccaagatcagtt

SEQ ID NO: 1349 - DNA, 25 bp, S. cerevisiae
attctccgcggtactcagacgataa

SEQ ID NO: 1350 - DNA, 25 bp, S. cerevisiae
atatcattggagagctcgatagctg

SEQ ID NO: 1351 - DNA, 25 bp, S. cerevisiae
attcttttggcaccttctatggtga

SEQ ID NO: 1352 - DNA, 25 bp, S. cerevisiae
attcattacggcctttccatggtat

SEQ ID NO: 1353 - DNA, 25 bp, S. cerevisiae
attcaatggcggttcacgttggtga

SEQ ID NO: 1354 - DNA, 25 bp, S. cerevisiae
attcataacttagatcgagctcgag

SEQ ID NO: 1355 - DNA, 25 bp, S. cerevisiae
attcaattcatctccactggtcata

SEQ ID NO: 1356 - DNA, 25 bp, S. cerevisiae
attcagattcaatggcacgtcctca

SEQ ID NO: 1357 - DNA, 25 bp, S. cerevisiae
attcagcccaaactagaatcgctct

SEQ ID NO: 1358 - DNA, 25 bp, S. cerevisiae
attcagatggtcctctcggtggtgc

SEQ ID NO: 1359 - DNA, 25 bp, S. cerevisiae
attcattggatctctgcgtgttggg

SEQ ID NO: 1360 - DNA, 25 bp, S. cerevisiae
attagttccatgatgcgtttccgca

SEQ ID NO: 1361 - DNA, 25 bp, S. cerevisiae
attaggtggtagtgcatcgtccgca

SEQ ID NO: 1362 - DNA, 25 bp, S. cerevisiae
attagcgggtcgttaacaccagata

SEQ ID NO: 1363 - DNA, 25 bp, S. cerevisiae
ctttgtcccggtcaaattcagtacg

SEQ ID NO: 1364 - DNA, 25 bp, S. cerevisiae
attttcctctttcacaattcagtcc

SEQ ID NO: 1365 - DNA, 25 bp, S. cerevisiae
attcagggtttgatgtttcctctaa

SEQ ID NO: 1366 - DNA, 25 bp, S. cerevisiae
attcaggctgttatggacgattgtt

SEQ ID NO: 1367 - DNA, 25 bp, S. cerevisiae
attcagccggaatttgtggactttc

SEQ ID NO: 1368 - DNA, 25 bp, S. cerevisiae
attatcccgcagtgaggtgctctta

SEQ ID NO: 1369 - DNA, 25 bp, S. cerevisiae
attcaccgggcatcgttgtcgacaa

SEQ ID NO: 1370 - DNA, 25 bp, S. cerevisiae
attaccagggacgtgtcggcgatgc

SEQ ID NO: 1371 - DNA, 25 bp, S. cerevisiae
attaccacggatggcattaccgcag

SEQ ID NO: 1372 - DNA, 25 bp, S. cerevisiae
attacacctggtgagcataccatgg

SEQ ID NO: 1373 - DNA, 25 bp, S. cerevisiae
attcaagcactgttggctagcccta

SEQ ID NO: 1374 - DNA, 25 bp, S. cerevisiae
attaaaccaggtgacattcttgtaa

SEQ ID NO: 1375 - DNA, 25 bp, S. cerevisiae
aagcgtacggttctccatttacatt

SEQ ID NO: 1376 - DNA, 25 bp, S. cerevisiae
attacggttttgttcatggattcag

SEQ ID NO: 1377 - DNA, 25 bp, S. cerevisiae
attcatgccggatttttcaagtgtc

SEQ ID NO: 1378 - DNA, 25 bp, S. cerevisiae
attctagttcattgattcacggcgg

SEQ ID NO: 1379 - DNA, 25 bp, S. cerevisiae
attcaagtttttgcccaggtggacg

SEQ ID NO: 1380 - DNA, 25 bp, S. cerevisiae
attcaagtttctatatgggctgcaa

SEQ ID NO: 1381 - DNA, 25 bp, S. cerevisiae
attagaggcgtgttgtcttccttag

SEQ ID NO: 1382 - DNA, 25 bp, S. cerevisiae
attacatgtgcgctagattacctaa

SEQ ID NO: 1383 - DNA, 25 bp, S. cerevisiae
attaattgctggtaagtcttctgac

SEQ ID NO: 1384 - DNA, 25 bp, S. cerevisiae
attaattcaggcttatccagatgta

SEQ ID NO: 1385 - DNA, 25 bp, S. cerevisiae
attagtgacagtctggtcggcaccg

SEQ ID NO: 1386 - DNA, 25 bp, S. cerevisiae
attcacattcaggttcgttctcttc

SEQ ID NO: 1387 - DNA, 25 bp, S. cerevisiae
atttcattgcaagatgggccttttc

SEQ ID NO: 1388 - DNA, 25 bp, S. cerevisiae
attttcctactagatcctatcctta

SEQ ID NO: 1389 - DNA, 25 bp, S. cerevisiae
attaatcttttagacctgccctttg

SEQ ID NO: 1390 - DNA, 25 bp, S. cerevisiae
attacttttcaaattcctcctcatt

SEQ ID NO: 1391 - DNA, 25 bp, S. cerevisiae
attcattttctttaccgcctacgag

SEQ ID NO: 1392 - DNA, 25 bp, S. cerevisiae
attcatttttctctcgatgtcggcg

SEQ ID NO: 1393 - DNA, 25 bp, S. cerevisiae
attcatctatatattaccagttgta

SEQ ID NO: 1394 - DNA, 25 bp, S. cerevisiae
attcacgccattcctataacatcag

SEQ ID NO: 1395 - DNA, 25 bp, S. cerevisiae
attacaccatctcctgtggcaataa

SEQ ID NO: 1396 - DNA, 25 bp, S. cerevisiae
attacaccagtacagctcctaaagt

SEQ ID NO: 1397 - DNA, 25 bp, S. cerevisiae
atgctacgacgtccaacttatttcc

SEQ ID NO: 1398 - DNA, 25 bp, S. cerevisiae
attcacgaagcttcctttgttctac

SEQ ID NO: 1399 - DNA, 25 bp, S. cerevisiae
attattcagcgtctctatgtttagg

SEQ ID NO: 1400 - DNA, 25 bp, S. cerevisiae
attattctgggcatccgtgtacagg

SEQ ID NO: 1401 - DNA, 25 bp, S. cerevisiae
attaactgtggcatcctgtttggct

SEQ ID NO: 1402 - DNA, 25 bp, S. cerevisiae
attaacttggtacctgtcttctctt

SEQ ID NO: 1403 - DNA, 25 bp, S. cerevisiae
attaacgggatacctctttccatgc

SEQ ID NO: 1404 - DNA, 25 bp, S. cerevisiae
attcttcgccatatcttgtgtatcc

SEQ ID NO: 1405 - DNA, 25 bp, S. cerevisiae
attcagactacaattacttccccta

SEQ ID NO: 1406 - DNA, 25 bp, S. cerevisiae
attcttctaatatttctgttcccaa

SEQ ID NO: 1407 - DNA, 25 bp, S. cerevisiae
attcttttcaattctttatccgcat

SEQ ID NO: 1408 - DNA, 25 bp, S. cerevisiae
attcatttgtccatttgtcagccgg

SEQ ID NO: 1409 - DNA, 25 bp, S. cerevisiae
attcattcctccattgtttgtcttg

SEQ ID NO: 1410 - DNA, 25 bp, S. cerevisiae
attttttcgagtcttacagaaccat

SEQ ID NO: 1411 - DNA, 25 bp, S. cerevisiae
attcttaccgagcattaactaccca

SEQ ID NO: 1412 - DNA, 25 bp, S. cerevisiae
attcacctccaaacgatattccatg

SEQ ID NO: 1413 - DNA, 25 bp, S. cerevisiae
attcacttccggtagcaaatccatg

SEQ ID NO: 1414 - DNA, 25 bp, S. cerevisiae
attagcgggctttacatggtcgaaa

SEQ ID NO: 1415 - DNA, 25 bp, S. cerevisiae
attacgggccgtagcattgatgctg

SEQ ID NO: 1416 - DNA, 25 bp, S. cerevisiae
attatcgacgatgtcatgactgcag

SEQ ID NO: 1417 - DNA, 25 bp, S. cerevisiae
attcttgagcggctatgacctgacg

SEQ ID NO: 1418 - DNA, 25 bp, S. cerevisiae
atatgcaaggtctgttgaattccca

SEQ ID NO: 1419 - DNA, 25 bp, S. cerevisiae
attcactggtgatctaaattctaca

SEQ ID NO: 1420 - DNA, 25 bp, S. cerevisiae
attcttggtgctactaatcctttgg

SEQ ID NO: 1421 - DNA, 25 bp, S. cerevisiae
attcttcgttcacaagcacttcttg

SEQ ID NO: 1422 - DNA, 25 bp, S. cerevisiae
attagtggttcacccgatttcactg

SEQ ID NO: 1423 - DNA, 25 bp, S. cerevisiae
attagctggagctgacactgtcctt

SEQ ID NO: 1424 - DNA, 25 bp, S. cerevisiae
attaggtctaccagtcggtgccatc

SEQ ID NO: 1425 - DNA, 25 bp, S. cerevisiae
attcattcttcgtttccgatgagcc

SEQ ID NO: 1426 - DNA, 25 bp, S. cerevisiae
attaccatggctgtatccgagccgt

SEQ ID NO: 1427 - DNA, 25 bp, S. cerevisiae
attcacgctggtgttcttgagccaa

SEQ ID NO: 1428 - DNA, 25 bp, S. cerevisiae
attactttccctgctgacccagaag

SEQ ID NO: 1429 - DNA, 25 bp, S. cerevisiae
attactttaccagccgactcagaag

SEQ ID NO: 1430 - DNA, 25 bp, S. cerevisiae
attagctcatttgcgaatacctgcc

SEQ ID NO: 1431 - DNA, 25 bp, S. cerevisiae
attagccattttgttatccacgccg

SEQ ID NO: 1432 - DNA, 25 bp, S. cerevisiae
attcagctgatttcgttttgcccgt

SEQ ID NO: 1433 - DNA, 25 bp, S. cerevisiae
attactccgactgttggactcgcca

SEQ ID NO: 1434 - DNA, 25 bp, S. cerevisiae
attttccgatggtgttggctactca

SEQ ID NO: 1435 - DNA, 25 bp, S. cerevisiae
attcaaattaacaagccccgtcgct

SEQ ID NO: 1436 - DNA, 25 bp, S. cerevisiae
attcaaagattactacctccaggcc

SEQ ID NO: 1437 - DNA, 25 bp, S. cerevisiae
attcacagcatgatgaggagtctca

SEQ ID NO: 1438 - DNA, 25 bp, S. cerevisiae
attcataattctactgaggctgcaa

SEQ ID NO: 1439 - DNA, 25 bp, S. cerevisiae
attatgatagttacccacgcagcca

SEQ ID NO: 1440 - DNA, 25 bp, S. cerevisiae
attcatgctttaggtcagcctgata

SEQ ID NO: 1441 - DNA, 25 bp, S. cerevisiae
attcatcgtctgtgtcgtcatatac

SEQ ID NO: 1442 - DNA, 25 bp, S. cerevisiae
attcaagcatcttttggccaagccc

SEQ ID NO: 1443 - DNA, 25 bp, S. cerevisiae
attaacatcatcaacggcctacacg

SEQ ID NO: 1444 - DNA, 25 bp, S. cerevisiae
attaatgagctattgggcctgcccg

SEQ ID NO: 1445 - DNA, 25 bp, S. cerevisiae
attacatcgaagtgggtgccgactc

SEQ ID NO: 1446 - DNA, 25 bp, S. cerevisiae
attaattcagatcaacctctccacg

SEQ ID NO: 1447 - DNA, 25 bp, S. cerevisiae
atttggccttggagacttaccgcaa

SEQ ID NO: 1448 - DNA, 25 bp, S. cerevisiae
attatccttttggttgggcgccgca

SEQ ID NO: 1449 - DNA, 25 bp, S. cerevisiae
attacactatttttgctcaggcgcc

SEQ ID NO: 1450 - DNA, 25 bp, S. cerevisiae
attagagtatttgcgctctcccaag

SEQ ID NO: 1451 - DNA, 25 bp, S. cerevisiae
attactctaagtgttgtctggcaag

SEQ ID NO: 1452 - DNA, 25 bp, S. cerevisiae
attaccccagtgtttttgcgcaaga

SEQ ID NO: 1453 - DNA, 25 bp, S. cerevisiae
attacccaaagtagttccgatcaag

SEQ ID NO: 1454 - DNA, 25 bp, S. cerevisiae
attatcttcaatttcgtcaggcgac

SEQ ID NO: 1455 - DNA, 25 bp, S. cerevisiae
atatcggtccactggcgtttttagt

SEQ ID NO: 1456 - DNA, 25 bp, S. cerevisiae
atatgtttgcccaggtttgtttcaa

SEQ ID NO: 1457 - DNA, 25 bp, S. cerevisiae
attttcccgcttgttgtgcactttt

SEQ ID NO: 1458 - DNA, 25 bp, S. cerevisiae
atttttcaccatcagtttgactttg

SEQ ID NO: 1459 - DNA, 25 bp, S. cerevisiae
attcatttctttcctgttaagctta

SEQ ID NO: 1460 - DNA, 25 bp, S. cerevisiae
attcaccattcaatccgttactttc

SEQ ID NO: 1461 - DNA, 25 bp, S. cerevisiae
attaaggctgccattgaccgcgttg

SEQ ID NO: 1462 - DNA, 25 bp, S. cerevisiae
attacgtatcgcatttcgctgcgtt

SEQ ID NO: 1463 - DNA, 25 bp, S. cerevisiae
attacgttctcaacagcttctgtgt

SEQ ID NO: 1464 - DNA, 25 bp, S. cerevisiae
attatcctgcagtgaggagtcctta

SEQ ID NO: 1465 - DNA, 25 bp, S. cerevisiae
attatatctgcctgacgactatcca

SEQ ID NO: 1466 - DNA, 25 bp, S. cerevisiae
atttattatatggagcagatgcttg

SEQ ID NO: 1467 - DNA, 25 bp, S. cerevisiae
attttcatacacctaacctcggaag

SEQ ID NO: 1468 - DNA, 25 bp, S. cerevisiae
attaatgtcctcttaactcgtggcg

SEQ ID NO: 1469 - DNA, 25 bp, S. cerevisiae
attaagtggtcaatccgcaggtgta

SEQ ID NO: 1470 - DNA, 25 bp, S. cerevisiae
attaatgagtacactggcggcccgt

SEQ ID NO: 1471 - DNA, 25 bp, S. cerevisiae
attatcacagtacagagtgttgcaa

SEQ ID NO: 1472 - DNA, 25 bp, S. cerevisiae
attagcacgccgcaatggagacaaa

SEQ ID NO: 1473 - DNA, 25 bp, S. cerevisiae
attacgcatcctaatgctggtccta

SEQ ID NO: 1474 - DNA, 25 bp, S. cerevisiae
attcacctcttgttttcggcaaata

SEQ ID NO: 1475 - DNA, 25 bp, S. cerevisiae
attacaccttgatttattgccagca

SEQ ID NO: 1476 - DNA, 25 bp, S. cerevisiae
attagcacgtaagcatttgtccaaa

SEQ ID NO: 1477 - DNA, 25 bp, S. cerevisiae
attcaccatatattcatcatctgcg

SEQ ID NO: 1478 - DNA, 25 bp, S. cerevisiae
attcaacatcagaggcagatttgcc

SEQ ID NO: 1479 - DNA, 25 bp, S. cerevisiae
atttaccagggtcattatgcctccg

SEQ ID NO: 1480 - DNA, 25 bp, S. cerevisiae
attaaccatggaatgttcccctcgc

SEQ ID NO: 1481 - DNA, 25 bp, S. cerevisiae
attcaatctgcaagacctttcgatg

SEQ ID NO: 1482 - DNA, 25 bp, S. cerevisiae
attaatctcacacatccatgacggc

SEQ ID NO: 1483 - DNA, 25 bp, S. cerevisiae
attactaatgaatccagcacacttg

SEQ ID NO: 1484 - DNA, 25 bp, S. cerevisiae
attacacaagactctccaacatcat

SEQ ID NO: 1485 - DNA, 25 bp, S. cerevisiae
attcacacggacgatcttccagaag

SEQ ID NO: 1486 - DNA, 25 bp, S. cerevisiae
attactaggagctatgcttcaggaa

SEQ ID NO: 1487 - DNA, 25 bp, S. cerevisiae
attactgaagaagcttcccagcata

SEQ ID NO: 1488 - DNA, 25 bp, S. cerevisiae
atttccaatgataacgtccctgacg

SEQ ID NO: 1489 - DNA, 25 bp, S. cerevisiae
atttttgattagtgtcccgatcgcc

SEQ ID NO: 1490 - DNA, 25 bp, S. cerevisiae
atttttggtcagattccttcattgc

SEQ ID NO: 1491 - DNA, 25 bp, S. cerevisiae
atttattccaaggttgcccacaagc

SEQ ID NO: 1492 - DNA, 25 bp, S. cerevisiae
atttttccaaccagagtacccagtg

SEQ ID NO: 1493 - DNA, 25 bp, S. cerevisiae
atttttgccaatgctgggaaaccgc

SEQ ID NO: 1494 - DNA, 25 bp, S. cerevisiae
atagaaggcaaacccctctacaatc

SEQ ID NO: 1495 - DNA, 25 bp, S. cerevisiae
ataagaaaagatccctccaacacca

SEQ ID NO: 1496 - DNA, 25 bp, S. cerevisiae
gtggattctaaatactcggtccctt

SEQ ID NO: 1497 - DNA, 25 bp, S. cerevisiae
aggtggccaggatacttggtcctcg

SEQ ID NO: 1498 - DNA, 25 bp, S. cerevisiae
ccgagacaacgctgttaaggcctat

SEQ ID NO: 1499 - DNA, 25 bp, S. cerevisiae
atctggtaactctgttgaagacgtt

SEQ ID NO: 1500 - DNA, 25 bp, S. cerevisiae
atttttgaccatgatcgggacgttc

SEQ ID NO: 1501 - DNA, 25 bp, S. cerevisiae
attcaagaaaatccctgccaacgtt

SEQ ID NO: 1502 - DNA, 25 bp, S. cerevisiae
attcaagaatacacctgccaatgga

SEQ ID NO: 1503 - DNA, 25 bp, S. cerevisiae
attacgatgtgttcaatgctctggg

SEQ ID NO: 1504 - DNA, 25 bp, S. cerevisiae
attacgcagcgattccattcggata

SEQ ID NO: 1505 - DNA, 25 bp, S. cerevisiae
attaccgtgaccgtgtgagacaatt

SEQ ID NO: 1506 - DNA, 25 bp, S. cerevisiae
attcacggcggtggtgcgtacgtaa

SEQ ID NO: 1507 - DNA, 25 bp, S. cerevisiae
attactggcggtgtggctactgata

SEQ ID NO: 1508 - DNA, 25 bp, S. cerevisiae
attcaatgattccatggtctcctct

SEQ ID NO: 1509 - DNA, 25 bp, S. cerevisiae
attaatgattgccatcttgcctcct

SEQ ID NO: 1510 - DNA, 25 bp, S. cerevisiae
attttcgtagccagagaatatcctc

SEQ ID NO: 1511 - DNA, 25 bp, S. cerevisiae
attaatgtacaccaattcacccgca

SEQ ID NO: 1512 - DNA, 25 bp, S. cerevisiae
atatgagtttgacgtattaccacca

SEQ ID NO: 1513 - DNA, 25 bp, S. cerevisiae
attacaattctttggcttcacaagt

SEQ ID NO: 1514 - DNA, 25 bp, S. cerevisiae
attactactgtcatggctacccaat

SEQ ID NO: 1515 - DNA, 25 bp, S. cerevisiae
attactaaacgttccagcaccagag

SEQ ID NO: 1516 - DNA, 25 bp, S. cerevisiae
attcaaaaacaatccgcagtccgcg

SEQ ID NO: 1517 - DNA, 25 bp, S. cerevisiae
attacaaaaagctcattcactccgg

SEQ ID NO: 1518 - DNA, 25 bp, S. cerevisiae
attactgtcgaagttccattcccat

SEQ ID NO: 1519 - DNA, 25 bp, S. cerevisiae
attacttcaagagagccaccgcttt

SEQ ID NO: 1520 - DNA, 25 bp, S. cerevisiae
atttacagtacttaggccacccaat

SEQ ID NO: 1521 - DNA, 25 bp, S. cerevisiae
attaacgatccattagccccaaaat

SEQ ID NO: 1522 - DNA, 25 bp, S. cerevisiae
attatttacataacggcccactaga

SEQ ID NO: 1523 - DNA, 25 bp, S. cerevisiae
atttttgaacaagatccctatgagt

SEQ ID NO: 1524 - DNA, 25 bp, S. cerevisiae
atttcgataacggttcctcaagcct

SEQ ID NO: 1525 - DNA, 25 bp, S. cerevisiae
attttcaaacatgttccagcggcct

SEQ ID NO: 1526 - DNA, 25 bp, S. cerevisiae
atttttcaacggattaggcgctgac

SEQ ID NO: 1527 - DNA, 25 bp, S. cerevisiae
atttttcgccagtggtgagcacgga

SEQ ID NO: 1528 - DNA, 25 bp, S. cerevisiae
cttttgcaacggttcaggaggccca

SEQ ID NO: 1529 - DNA, 25 bp, S. cerevisiae
attttcaaaggagtgggcaagccca

SEQ ID NO: 1530 - DNA, 25 bp, S. cerevisiae
attttataaccatatgcgccagccc

SEQ ID NO: 1531 - DNA, 25 bp, S. cerevisiae
attttaaccaatccgtgccatttcg

SEQ ID NO: 1532 - DNA, 25 bp, S. cerevisiae
attatgggacactgccggccaagaa

SEQ ID NO: 1533 - DNA, 25 bp, S. cerevisiae
attaaactcagtagctcgcctacgt

SEQ ID NO: 1534 - DNA, 25 bp, S. cerevisiae
attaatttcaccattgctgctacct

SEQ ID NO: 1535 - DNA, 25 bp, S. cerevisiae
attaatcctgctgttcttgtatctc

SEQ ID NO: 1536 - DNA, 25 bp, S. cerevisiae
attagtctttcgctcctatctgaac

SEQ ID NO: 1537 - DNA, 25 bp, S. cerevisiae
attactgttaccttgcctattgtca

SEQ ID NO: 1538 - DNA, 25 bp, S. cerevisiae
attagtcgttcccattcacgtacaa

SEQ ID NO: 1539 - DNA, 25 bp, S. cerevisiae
attatggctcattgccctagctcta

SEQ ID NO: 1540 - DNA, 25 bp, S. cerevisiae
attagagtctattcccattctgggt

SEQ ID NO: 1541 - DNA, 25 bp, S. cerevisiae
attaagatcatctcctcataccgtt

SEQ ID NO: 1542 - DNA, 25 bp, S. cerevisiae
attagagtgctctctcatcaagccg

SEQ ID NO: 1543 - DNA, 25 bp, S. cerevisiae
attaatgcattctcatatccaccct

SEQ ID NO: 1544 - DNA, 25 bp, S. cerevisiae
attacgttcctttgccagctccatc

SEQ ID NO: 1545 - DNA, 25 bp, S. cerevisiae
attactggttcattagctgctgcta

SEQ ID NO: 1546 - DNA, 25 bp, S. cerevisiae
attactcaagtcagtggtgtcacac

SEQ ID NO: 1547 - DNA, 25 bp, S. cerevisiae
attaccacggcagggcagttggcac

SEQ ID NO: 1548 - DNA, 25 bp, S. cerevisiae
attacccggtatgcacattgaagcg

SEQ ID NO: 1549 - DNA, 25 bp, S. cerevisiae
attaatgtccgttgccaatttcgcg

SEQ ID NO: 1550 - DNA, 25 bp, S. cerevisiae
attattgactcctccaacttgttag

SEQ ID NO: 1551 - DNA, 25 bp, S. cerevisiae
atttggtcacgcttacgaagctttc

SEQ ID NO: 1552 - DNA, 25 bp, S. cerevisiae
attaagcgcatccttgggccaagtg

SEQ ID NO: 1553 - DNA, 25 bp, S. cerevisiae
attacagccaggttccgctagagag

SEQ ID NO: 1554 - DNA, 25 bp, S. cerevisiae
attaaacgagttaccagaggcagac

SEQ ID NO: 1555 - DNA, 25 bp, S. cerevisiae
attaaagccagctatctccaaggct

SEQ ID NO: 1556 - DNA, 25 bp, S. cerevisiae
attaaagccagccatctccagtgct

SEQ ID NO: 1557 - DNA, 25 bp, S. cerevisiae
attacacagctcctatagccgtcta

SEQ ID NO: 1558 - DNA, 25 bp, S. cerevisiae
atttcacagacaggatagctgcgtg

SEQ ID NO: 1559 - DNA, 25 bp, S. cerevisiae
attaccctattagtctggatttcca

SEQ ID NO: 1560 - DNA, 25 bp, S. cerevisiae
attaccgttctgattgcgttctaag

SEQ ID NO: 1561 - DNA, 25 bp, S. cerevisiae
attaccggtggctttgctgagttga

SEQ ID NO: 1562 - DNA, 25 bp, S. cerevisiae
attatctctcaattgggccctgaag

SEQ ID NO: 1563 - DNA, 25 bp, S. cerevisiae
attattgccaataacgccgtggagg

SEQ ID NO: 1564 - DNA, 25 bp, S. cerevisiae
attacaacatctgacgacgtccagg

SEQ ID NO: 1565 - DNA, 25 bp, S. cerevisiae
attacaacaatgctaaggccccaca

SEQ ID NO: 1566 - DNA, 25 bp, S. cerevisiae
atatacatacaacaagggccgccgc

SEQ ID NO: 1567 - DNA, 25 bp, S. cerevisiae
attagaattggtatgcgataactga

SEQ ID NO: 1568 - DNA, 25 bp, S. cerevisiae
atgtaaacgatacgtggtccgccgc

SEQ ID NO: 1569 - DNA, 25 bp, S. cerevisiae
attaggcctaaaggtgtcgccacgc

SEQ ID NO: 1570 - DNA, 25 bp, S. cerevisiae
attattgccgccttactggtaggat

SEQ ID NO: 1571 - DNA, 25 bp, S. cerevisiae
attactgacgagttagctggaaaac

SEQ ID NO: 1572 - DNA, 25 bp, S. cerevisiae
attaggactgcgcagactgtccttg

SEQ ID NO: 1573 - DNA, 25 bp, S. cerevisiae
attttggtgcaatcaactctttgag

SEQ ID NO: 1574 - DNA, 25 bp, S. cerevisiae
atattatggctgaggcccctttacg

SEQ ID NO: 1575 - DNA, 25 bp, S. cerevisiae
attttgcgtttctctatcggagtac

SEQ ID NO: 1576 - DNA, 25 bp, S. cerevisiae
atttagcggctatcccattgggtaa

SEQ ID NO: 1577 - DNA, 25 bp, S. cerevisiae
attagagggctcataccactggtat

SEQ ID NO: 1578 - DNA, 25 bp, S. cerevisiae
attacaggtctcattctccagtgaa

SEQ ID NO: 1579 - DNA, 25 bp, S. cerevisiae
atttgatggttcgtccaccagtgga

SEQ ID NO: 1580 - DNA, 25 bp, S. cerevisiae
attaggcgaatgcttcacaagtgga

SEQ ID NO: 1581 - DNA, 25 bp, S. cerevisiae
attacgatgaatctccgctgcggga

SEQ ID NO: 1582 - DNA, 25 bp, S. cerevisiae
attagcgatgtatcccctagtgcta

SEQ ID NO: 1583 - DNA, 25 bp, S. cerevisiae
attagccgtcaccagtatagagtct

SEQ ID NO: 1584 - DNA, 25 bp, S. cerevisiae
attactctatacttctggctcagca

SEQ ID NO: 1585 - DNA, 25 bp, S. cerevisiae
attaccaaccatttgacatgtcagc

SEQ ID NO: 1586 - DNA, 25 bp, S. cerevisiae
agctaccgactctgctaatgtaacc

SEQ ID NO: 1587 - DNA, 25 bp, S. cerevisiae
attacgccctcatgttattaaacta

SEQ ID NO: 1588 - DNA, 25 bp, S. cerevisiae
atatacccctactttacaaaatgat

SEQ ID NO: 1589 - DNA, 25 bp, S. cerevisiae
atttgcccacgactttggctaaagt

SEQ ID NO: 1590 - DNA, 25 bp, S. cerevisiae
attattcgacgactatcacctagaa

SEQ ID NO: 1591 - DNA, 25 bp, S. cerevisiae
attactgcaacgactttggcgagcg

SEQ ID NO: 1592 - DNA, 25 bp, S. cerevisiae
attactcaccctcttcggatgcttg

SEQ ID NO: 1593 - DNA, 25 bp, S. cerevisiae
attagatccataaatcccactctct

SEQ ID NO: 1594 - DNA, 25 bp, S. cerevisiae
attagcccattcttccatcagattt

SEQ ID NO: 1595 - DNA, 25 bp, S. cerevisiae
attaccactatattctagcgatgag

SEQ ID NO: 1596 - DNA, 25 bp, S. cerevisiae
attattgccatgacattctcctgct

SEQ ID NO: 1597 - DNA, 25 bp, S. cerevisiae
attaccatccacgtatcacgtttgc

SEQ ID NO: 1598 - DNA, 25 bp, S. cerevisiae
attactcctactaccaagacttgca

SEQ ID NO: 1599 - DNA, 25 bp, S. cerevisiae
attactattagcacctcaactccat

SEQ ID NO: 1600 - DNA, 25 bp, S. cerevisiae
attagttgaacttctcgctcaggaa

SEQ ID NO: 1601 - DNA, 25 bp, S. cerevisiae
attagtggaggtttagctgctgcaa

SEQ ID NO: 1602 - DNA, 25 bp, S. cerevisiae
attacgatgggtctaggctcaacga

SEQ ID NO: 1603 - DNA, 25 bp, S. cerevisiae
attacgatgctgatgcaatagatca

SEQ ID NO: 1604 - DNA, 25 bp, S. cerevisiae
attacgatgctgacgccatagacca

SEQ ID NO: 1605 - DNA, 25 bp, S. cerevisiae
attacgatgctgacgaattggctga

SEQ ID NO: 1606 - DNA, 25 bp, S. cerevisiae
attatcaggtgttctcgcaggtgga

SEQ ID NO: 1607 - DNA, 25 bp, S. cerevisiae
atttcttcagactttagtgacccct

SEQ ID NO: 1608 - DNA, 25 bp, S. cerevisiae
attttacttgggtcaagcggcattt

SEQ ID NO: 1609 - DNA, 25 bp, S. cerevisiae
attatcccttgctcactacggtatt

SEQ ID NO: 1610 - DNA, 25 bp, S. cerevisiae
attatccgctgaacataccacgttg

SEQ ID NO: 1611 - DNA, 25 bp, S. cerevisiae
attatacctggcgagatactgaagc

SEQ ID NO: 1612 - DNA, 25 bp, S. cerevisiae
attatcgtcgtggagctcactcaag

SEQ ID NO: 1613 - DNA, 25 bp, S. cerevisiae
attaggtctgatccagtattggcta

SEQ ID NO: 1614 - DNA, 25 bp, S. cerevisiae
attacttgcttcctgaatcagccag

SEQ ID NO: 1615 - DNA, 25 bp, S. cerevisiae
atttcacgtatgctgattcactagg

SEQ ID NO: 1616 - DNA, 25 bp, S. cerevisiae
atttattgccgggttcactgatgag

SEQ ID NO: 1617 - DNA, 25 bp, S. cerevisiae
attatttccaacttcaatcctgaga

SEQ ID NO: 1618 - DNA, 25 bp, S. cerevisiae
atttcgagctaccaagtatccacag

SEQ ID NO: 1619 - DNA, 25 bp, S. cerevisiae
attttcagcccgacgtttgcaaaga

SEQ ID NO: 1620 - DNA, 25 bp, S. cerevisiae
attagtccttgtttgttcgattatg

SEQ ID NO: 1621 - DNA, 25 bp, S. cerevisiae
attactacgtaaatgctcccggtgt

SEQ ID NO: 1622 - DNA, 25 bp, S. cerevisiae
atctaaattttcctactctgactcc

SEQ ID NO: 1623 - DNA, 25 bp, S. cerevisiae
attaggtgtttatgtttccgatatc

SEQ ID NO: 1624 - DNA, 25 bp, S. cerevisiae
attaggtgtcctacggtgtttgaat

SEQ ID NO: 1625 - DNA, 25 bp, S. cerevisiae
atttgcggatacgatcgaggctttc

SEQ ID NO: 1626 - DNA, 25 bp, S. cerevisiae
attatcgccgtcaaaggctctggtt

SEQ ID NO: 1627 - DNA, 25 bp, S. cerevisiae
atttacatggacagatacgcggata

SEQ ID NO: 1628 - DNA, 25 bp, S. cerevisiae
atttacaggaccgtgctcagggaac

SEQ ID NO: 1629 - DNA, 25 bp, S. cerevisiae
attataagtggtgtgccgacggacg

SEQ ID NO: 1630 - DNA, 25 bp, S. cerevisiae
attaccgtggatgaggccctggagc

SEQ ID NO: 1631 - DNA, 25 bp, S. cerevisiae
atagataccgaagcaaacactgaga

SEQ ID NO: 1632 - DNA, 25 bp, S. cerevisiae
atatcagaacgagccaacaccttgt

SEQ ID NO: 1633 - DNA, 25 bp, S. cerevisiae
atacggaattttgcgttgcctttga

SEQ ID NO: 1634 - DNA, 25 bp, S. cerevisiae
atttggctttagtttttgctccagg

SEQ ID NO: 1635 - DNA, 25 bp, S. cerevisiae
attagagtgccattgttttcgccgc

SEQ ID NO: 1636 - DNA, 25 bp, S. cerevisiae
attatggatcctcatgtcggcacac

SEQ ID NO: 1637 - DNA, 25 bp, S. cerevisiae
attatctacaaggtgcacagagaca

SEQ ID NO: 1638 - DNA, 25 bp, S. cerevisiae
atttggaacaggtcactgagacgct

SEQ ID NO: 1639 - DNA, 25 bp, S. cerevisiae
atttacgacgaactattggctgctt

SEQ ID NO: 1640 - DNA, 25 bp, S. cerevisiae
attttcgaggaccttgtcaccttga

SEQ ID NO: 1641 - DNA, 25 bp, S. cerevisiae
atttactcggcagcttctacgtaag

SEQ ID NO: 1642 - DNA, 25 bp, S. cerevisiae
atttcttccgaaaataagcgtccag

SEQ ID NO: 1643 - DNA, 25 bp, S. cerevisiae
atctgttttgcgttacgggttgcca

SEQ ID NO: 1644 - DNA, 25 bp, S. cerevisiae
atatatacctttgaacccattccgc

SEQ ID NO: 1645 - DNA, 25 bp, S. cerevisiae
attatttcctgttagacccatggcc

SEQ ID NO: 1646 - DNA, 25 bp, S. cerevisiae
atatcattttcgattccctagggcg

SEQ ID NO: 1647 - DNA, 25 bp, S. cerevisiae
attattgtttgaagcccctatgcga

SEQ ID NO: 1648 - DNA, 25 bp, S. cerevisiae
attttagatttggaccctcgtacag

SEQ ID NO: 1649 - DNA, 25 bp, S. cerevisiae
atttacttttgttgccatgggtaca

SEQ ID NO: 1650 - DNA, 25 bp, S. cerevisiae
attacctctctttctatttagtcga

SEQ ID NO: 1651 - DNA, 25 bp, S. cerevisiae
attaccaccgtttggctgttacact

SEQ ID NO: 1652 - DNA, 25 bp, S. cerevisiae
attatcatgaagtccccatttcgcc

SEQ ID NO: 1653 - DNA, 25 bp, S. cerevisiae
attttgaaggccgacatgtacgaaa

SEQ ID NO: 1654 - DNA, 25 bp, S. cerevisiae
atttcgacaccggaagtgcctaaga

SEQ ID NO: 1655 - DNA, 25 bp, S. cerevisiae
attatttccatcaaatttgcccagt

SEQ ID NO: 1656 - DNA, 25 bp, S. cerevisiae
attatttcggtattcttgcccttgg

SEQ ID NO: 1657 - DNA, 25 bp, S. cerevisiae
atttttggagtaccttgccactcaa

SEQ ID NO: 1658 - DNA, 25 bp, S. cerevisiae
atttttagctttcatcaggattcca

SEQ ID NO: 1659 - DNA, 25 bp, S. cerevisiae
atttttcattgtatctaccgcttac

SEQ ID NO: 1660 - DNA, 25 bp, S. cerevisiae
attagttttggcattcattgcttga

SEQ ID NO: 1661 - DNA, 25 bp, S. cerevisiae
attaggtattgctactgctccagtc

SEQ ID NO: 1662 - DNA, 25 bp, S. cerevisiae
attagcatgtctagcgtaccgtgaa

SEQ ID NO: 1663 - DNA, 25 bp, S. cerevisiae
atttttcaccgagttagcatccaag

SEQ ID NO: 1664 - DNA, 25 bp, S. cerevisiae
attagactcgcctacagatttggaa

SEQ ID NO: 1665 - DNA, 25 bp, S. cerevisiae
attattctccgctacttatatgcag

SEQ ID NO: 1666 - DNA, 25 bp, S. cerevisiae
attttcccaggaaccagtcatttga

SEQ ID NO: 1667 - DNA, 25 bp, S. cerevisiae
atttcgcggcaaaacaagtcattta

SEQ ID NO: 1668 - DNA, 25 bp, S. cerevisiae
atttcggtcatcatcagcaacagca

SEQ ID NO: 1669 - DNA, 25 bp, S. cerevisiae
attatcggtattgacagctgccata

SEQ ID NO: 1670 - DNA, 25 bp, S. cerevisiae
attagagcctccaaggtcttaccag

SEQ ID NO: 1671 - DNA, 25 bp, S. cerevisiae
attttgcctccaagaattgtcccag

SEQ ID NO: 1672 - DNA, 25 bp, S. cerevisiae
atttggagctcaaccaatattcccc

SEQ ID NO: 1673 - DNA, 25 bp, S. cerevisiae
attattaccacattacctactattg

SEQ ID NO: 1674 - DNA, 25 bp, S. cerevisiae
attttatttccaccgttatgcaaag

SEQ ID NO: 1675 - DNA, 25 bp, S. cerevisiae
attagctaagctgcacaagttatca

SEQ ID NO: 1676 - DNA, 25 bp, S. cerevisiae
atttggctgcgggactgtaggactc

SEQ ID NO: 1677 - DNA, 25 bp, S. cerevisiae
attttgtcttgccaatgccggagtc

SEQ ID NO: 1678 - DNA, 25 bp, S. cerevisiae
atttccctagtttgattgacccaca

SEQ ID NO: 1679 - DNA, 25 bp, S. cerevisiae
attttctatgtctacatgggtccca

SEQ ID NO: 1680 - DNA, 25 bp, S. cerevisiae
attttcgcattcttctggagaccta

SEQ ID NO: 1681 - DNA, 25 bp, S. cerevisiae
atttggccctgctattgtgataccc

SEQ ID NO: 1682 - DNA, 25 bp, S. cerevisiae
attttgcctacatctttacctcaga

SEQ ID NO: 1683 - DNA, 25 bp, S. cerevisiae
attattactatctctttcgcttccg

SEQ ID NO: 1684 - DNA, 25 bp, S. cerevisiae
attagtgcagatccagcctgattcc

SEQ ID NO: 1685 - DNA, 25 bp, S. cerevisiae
attatcgttcgctcatggtttgcaa

SEQ ID NO: 1686 - DNA, 25 bp, S. cerevisiae
attatccattgctttgttgtcaaca

SEQ ID NO: 1687 - DNA, 25 bp, S. cerevisiae
attattgctggctcaacgatctgtc

SEQ ID NO: 1688 - DNA, 25 bp, S. cerevisiae
atttaactcagatctaccttccaca

SEQ ID NO: 1689 - DNA, 25 bp, S. cerevisiae
attatcaccctttgtatcttactgt

SEQ ID NO: 1690 - DNA, 25 bp, S. cerevisiae
atttgcttgaggcatggttccgttt

SEQ ID NO: 1691 - DNA, 25 bp, S. cerevisiae
atttgccaaggctagattgaccgag

SEQ ID NO: 1692 - DNA, 25 bp, S. cerevisiae
atttgactacgcataattcctacga

SEQ ID NO: 1693 - DNA, 25 bp, S. cerevisiae
atattccagccgatcaaattccaaa

SEQ ID NO: 1694 - DNA, 25 bp, S. cerevisiae
atttcagcccagactatacttaaaa

SEQ ID NO: 1695 - DNA, 25 bp, S. cerevisiae
atttatccctttacctctgcaacaa

SEQ ID NO: 1696 - DNA, 25 bp, S. cerevisiae
atttatggagcacgccgattagccg

SEQ ID NO: 1697 - DNA, 25 bp, S. cerevisiae
attttctgacaagctttcctcaaag

SEQ ID NO: 1698 - DNA, 25 bp, S. cerevisiae
atttaaccatgcaaccattcccaat

SEQ ID NO: 1699 - DNA, 25 bp, S. cerevisiae
atttcaacacattcccttggtcaat

SEQ ID NO: 1700 - DNA, 25 bp, S. cerevisiae
attatcaactacgttcttttcagta

SEQ ID NO: 1701 - DNA, 25 bp, S. cerevisiae
atttcttctacagacgttccttcag

SEQ ID NO: 1702 - DNA, 25 bp, S. cerevisiae
attttattctcagcacttgtcctac

SEQ ID NO: 1703 - DNA, 25 bp, S. cerevisiae
atttttctggcaacttttctcaaca

SEQ ID NO: 1704 - DNA, 25 bp, S. cerevisiae
attatcagcatcgttgttttcccta

SEQ ID NO: 1705 - DNA, 25 bp, S. cerevisiae
attattctatttttacgatgcgttg

SEQ ID NO: 1706 - DNA, 25 bp, S. cerevisiae
atttatttcggaagccctggcattt

SEQ ID NO: 1707 - DNA, 25 bp, S. cerevisiae
attttttctcgtatgcttggtctta

SEQ ID NO: 1708 - DNA, 25 bp, S. cerevisiae
atttctaagggtgtcagctctccat

SEQ ID NO: 1709 - DNA, 25 bp, S. cerevisiae
attttacggagctgcaggtggtgcc

SEQ ID NO: 1710 - DNA, 25 bp, S. cerevisiae
attttacctgaatgtgcttctgccc

SEQ ID NO: 1711 - DNA, 25 bp, S. cerevisiae
attttcactctggatcaattttcga

SEQ ID NO: 1712 - DNA, 25 bp, S. cerevisiae
attttccctattttgcctatttgcg

SEQ ID NO: 1713 - DNA, 25 bp, S. cerevisiae
attattgccgctatatggttattta

SEQ ID NO: 1714 - DNA, 25 bp, S. cerevisiae
attatcagccctattcgttcggtga

SEQ ID NO: 1715 - DNA, 25 bp, S. cerevisiae
attattggtgatggtgcttgtggca

SEQ ID NO: 1716 - DNA, 25 bp, S. cerevisiae
atttacttccgttgtggcttaagtg

SEQ ID NO: 1717 - DNA, 25 bp, S. cerevisiae
attttgctactggttatgatgccga

SEQ ID NO: 1718 - DNA, 25 bp, S. cerevisiae
attttgctttgactgcttgcatgcc

SEQ ID NO: 1719 - DNA, 25 bp, S. cerevisiae
attttgctgttactcattctgttca

SEQ ID NO: 1720 - DNA, 25 bp, S. cerevisiae
atttttgtggccaatactgcttcag

SEQ ID NO: 1721 - DNA, 25 bp, S. cerevisiae
attatctctgaggtcaattccgaaa

SEQ ID NO: 1722 - DNA, 25 bp, S. cerevisiae
attatcatccgctgaacatccgaat

SEQ ID NO: 1723 - DNA, 25 bp, S. cerevisiae
attattcccttggacatcactgaca

SEQ ID NO: 1724 - DNA, 25 bp, S. cerevisiae
attttccaggatatcatcaccggag

SEQ ID NO: 1725 - DNA, 25 bp, S. cerevisiae
atttcagccaggtcaaaagccggag

SEQ ID NO: 1726 - DNA, 25 bp, S. cerevisiae
attatcgcccttagccaagacggat

SEQ ID NO: 1727 - DNA, 25 bp, S. cerevisiae
attatcatgctgtacccgcaagcgg

SEQ ID NO: 1728 - DNA, 25 bp, S. cerevisiae
atttctgatatccaggcggactctt

SEQ ID NO: 1729 - DNA, 25 bp, S. cerevisiae
attattgcatgcgacagcggttcaa

SEQ ID NO: 1730 - DNA, 25 bp, S. cerevisiae
atttaacggctctccaatcgatgga

SEQ ID NO: 1731 - DNA, 25 bp, S. cerevisiae
atttagtcggttcactttggcgcca

SEQ ID NO: 1732 - DNA, 25 bp, S. cerevisiae
atcttcaacgggaaactctggcggc

SEQ ID NO: 1733 - DNA, 25 bp, S. cerevisiae
atttaccgccgaagaccatagcgat

SEQ ID NO: 1734 - DNA, 25 bp, S. cerevisiae
attttagcaattccaggccaagccc

SEQ ID NO: 1735 - DNA, 25 bp, S. cerevisiae
atttgggcgctttggtgggctatac

SEQ ID NO: 1736 - DNA, 25 bp, S. cerevisiae
attttgggatttcgagtggcgtcca

SEQ ID NO: 1737 - DNA, 25 bp, S. cerevisiae
atttgccacaacatacgtcggtaca

SEQ ID NO: 1738 - DNA, 25 bp, S. cerevisiae
attttactacttccgttgactcaca

SEQ ID NO: 1739 - DNA, 25 bp, S. cerevisiae
atttacctagctattggttctccag

SEQ ID NO: 1740 - DNA, 25 bp, S. cerevisiae
atttacgctaacatatgggtccata

SEQ ID NO: 1741 - DNA, 25 bp, S. cerevisiae
attttgggcatattgacgccggcca

SEQ ID NO: 1742 - DNA, 25 bp, S. cerevisiae
atttggacccaaattcagctctttt

SEQ ID NO: 1743 - DNA, 25 bp, S. cerevisiae
attatgagtacacgtgtccctcgag

SEQ ID NO: 1744 - DNA, 25 bp, S. cerevisiae
attatcgtgcatttcacttgctctg

SEQ ID NO: 1745 - DNA, 25 bp, S. cerevisiae
attatagccataacgttcgcagaaa

SEQ ID NO: 1746 - DNA, 25 bp, S. cerevisiae
attattacatcctctgttccaagcg

SEQ ID NO: 1747 - DNA, 25 bp, S. cerevisiae
attttgtcgtcctttgtatcgtcta

SEQ ID NO: 1748 - DNA, 25 bp, S. cerevisiae
attttgtcctcgttgatttctctaa

SEQ ID NO: 1749 - DNA, 25 bp, S. cerevisiae
atattcatttctaccattttccccg

SEQ ID NO: 1750 - DNA, 25 bp, S. cerevisiae
attttatctttctttgtcctttgcg

SEQ ID NO: 1751 - DNA, 25 bp, S. cerevisiae
attttgtcatcgatgctacctcatg

SEQ ID NO: 1752 - DNA, 25 bp, S. cerevisiae
attttgctatgcttgcacaccagac

SEQ ID NO: 1753 - DNA, 25 bp, S. cerevisiae
attattgctcattatccaccaaccg

SEQ ID NO: 1754 - DNA, 25 bp, S. cerevisiae
atttgaattcaaacatggtccaatg

SEQ ID NO: 1755 - DNA, 25 bp, S. cerevisiae
attatcattttctttgctgtccaat

SEQ ID NO: 1756 - DNA, 25 bp, S. cerevisiae
attatcctcttattctctcttgcaa

SEQ ID NO: 1757 - DNA, 25 bp, S. cerevisiae
attatccaatatgtctcctcatcct

SEQ ID NO: 1758 - DNA, 25 bp, S. cerevisiae
atttacaaacgcatcctcagtcatc

SEQ ID NO: 1759 - DNA, 25 bp, S. cerevisiae
atttcaacttgttcaccgatctaag

SEQ ID NO: 1760 - DNA, 25 bp, S. cerevisiae
gattttccccgacaaagttatctag

SEQ ID NO: 1761 - DNA, 25 bp, S. cerevisiae
atttctctccgccaggaaactgata

SEQ ID NO: 1762 - DNA, 25 bp, S. cerevisiae
attttcttcagattggtacgctaca

SEQ ID NO: 1763 - DNA, 25 bp, S. cerevisiae
atttatcgttgttccagatctctta

SEQ ID NO: 1764 - DNA, 25 bp, S. cerevisiae
attatcttgtataccgcaggcagct

SEQ ID NO: 1765 - DNA, 25 bp, S. cerevisiae
attatcaatacaaacgcacgcgcta

SEQ ID NO: 1766 - DNA, 25 bp, S. cerevisiae
attatcactaattactggcgctcaa

SEQ ID NO: 1767 - DNA, 25 bp, S. cerevisiae
attatcggaatataggcctcatggt

SEQ ID NO: 1768 - DNA, 25 bp, S. cerevisiae
atttccgaacgttgacgtctggcta

SEQ ID NO: 1769 - DNA, 25 bp, S. cerevisiae
atttaaatatccctggccttgctgg

SEQ ID NO: 1770 - DNA, 25 bp, S. cerevisiae
atattatagtcgtgcgccgccattt

SEQ ID NO: 1771 - DNA, 25 bp, S. cerevisiae
atttttctcaaatgcaagcgatctt

SEQ ID NO: 1772 - DNA, 25 bp, S. cerevisiae
attttttaatattagcgtgagcacc

SEQ ID NO: 1773 - DNA, 25 bp, S. cerevisiae
atttttctgaatctgaggctacacc

SEQ ID NO: 1774 - DNA, 25 bp, S. cerevisiae
acctctattagagccggatatccat

SEQ ID NO: 1775 - DNA, 25 bp, S. cerevisiae
attttgttggcgttcctgttgaatg

SEQ ID NO: 1776 - DNA, 25 bp, S. cerevisiae
attttcagcgcctatgttccttcta

SEQ ID NO: 1777 - DNA, 25 bp, S. cerevisiae
atttgctgccactcaagggtggatt

SEQ ID NO: 1778 - DNA, 25 bp, S. cerevisiae
atttgtattcgcaggcaactaagcc

SEQ ID NO: 1779 - DNA, 25 bp, S. cerevisiae
atttgataacgctgaccacgaatgt

SEQ ID NO: 1780 - DNA, 25 bp, S. cerevisiae
atttatgaacgcttactcaggtgag

SEQ ID NO: 1781 - DNA, 25 bp, S. cerevisiae
atttctgaatggctatccagcttag

SEQ ID NO: 1782 - DNA, 25 bp, S. cerevisiae
atttaattttcttcgatttactgtg

SEQ ID NO: 1783 - DNA, 25 bp, S. cerevisiae
attatttcctttgctgctttcatcc

SEQ ID NO: 1784 - DNA, 25 bp, S. cerevisiae
atttcctcctttttgtcttgacgat

SEQ ID NO: 1785 - DNA, 25 bp, S. cerevisiae
atttccatcgaaattagtctttcgc

SEQ ID NO: 1786 - DNA, 25 bp, S. cerevisiae
atttccaccatgtattctactttcc

SEQ ID NO: 1787 - DNA, 25 bp, S. cerevisiae
atttcgcaactgcaggaactttcag

SEQ ID NO: 1788 - DNA, 25 bp, S. cerevisiae
atttggagtctcctcaccaggcttt

SEQ ID NO: 1789 - DNA, 25 bp, S. cerevisiae
atttatgacttcaatgcccaagctg

SEQ ID NO: 1790 - DNA, 25 bp, S. cerevisiae
atttaggcagctgggctcgaaacaa

SEQ ID NO: 1791 - DNA, 25 bp, S. cerevisiae
atttagcgccgtaatcgacaggaga

SEQ ID NO: 1792 - DNA, 25 bp, S. cerevisiae
atttaggtcattatccgtgtctgat

SEQ ID NO: 1793 - DNA, 25 bp, S. cerevisiae
attttggacatgtcgtcctcgatga

SEQ ID NO: 1794 - DNA, 25 bp, S. cerevisiae
attttgcgaattcgtgccccatcat

SEQ ID NO: 1795 - DNA, 25 bp, S. cerevisiae
attttccaacaaatctggcctgctg

SEQ ID NO: 1796 - DNA, 25 bp, S. cerevisiae
attttccagaaatcaggccatcgtg

SEQ ID NO: 1797 - DNA, 25 bp, S. cerevisiae
attttctgggttttctagcgcgtgc

SEQ ID NO: 1798 - DNA, 25 bp, S. cerevisiae
atttggttgggagtactacctacag

SEQ ID NO: 1799 - DNA, 25 bp, S. cerevisiae
atttactagccgatcactacttatc

SEQ ID NO: 1800 - DNA, 25 bp, S. cerevisiae
atttttgaccgcctactatcgaatt

SEQ ID NO: 1801 - DNA, 25 bp, S. cerevisiae
atttacaaccacgaaactgcctcta

SEQ ID NO: 1802 - DNA, 25 bp, S. cerevisiae
attttccatcagctcggttcattag

SEQ ID NO: 1803 - DNA, 25 bp, S. cerevisiae
atttcgaaacactgcaggccgtgac

SEQ ID NO: 1804 - DNA, 25 bp, S. cerevisiae
atttcacaacgatttccaacgcttc

SEQ ID NO: 1805 - DNA, 25 bp, S. cerevisiae
atttacctgatttggcttcgcattc

SEQ ID NO: 1806 - DNA, 25 bp, S. cerevisiae
atttttgtcacgaacaccatcacgg

SEQ ID NO: 1807 - DNA, 25 bp, S. cerevisiae
attttctgccacttcaagctctgaa

SEQ ID NO: 1808 - DNA, 25 bp, S. cerevisiae
attttcgctaggtatcgtcagagac

SEQ ID NO: 1809 - DNA, 25 bp, S. cerevisiae
attttgagtgaatcgctcgcgagac

SEQ ID NO: 1810 - DNA, 25 bp, S. cerevisiae
atttcaacagatcggcgcaggcgta

SEQ ID NO: 1811 - DNA, 25 bp, S. cerevisiae
atttcacacagtccttgcaagcatt

SEQ ID NO: 1812 - DNA, 25 bp, S. cerevisiae
atttacaccgactatcacagctatt

SEQ ID NO: 1813 - DNA, 25 bp, S. cerevisiae
atttagtcgcgttagcacacctgat

SEQ ID NO: 1814 - DNA, 25 bp, S. cerevisiae
attttggcagttacgtctcgagcta

SEQ ID NO: 1815 - DNA, 25 bp, S. cerevisiae
attttgatggttcctgatccgtggt

SEQ ID NO: 1816 - DNA, 25 bp, S. cerevisiae
attttctggtctttatcgtggtgtt

SEQ ID NO: 1817 - DNA, 25 bp, S. cerevisiae
atattcgtgggttttgcgtactttg

SEQ ID NO: 1818 - DNA, 25 bp, S. cerevisiae
atttagtgggttctgccttatcttc

SEQ ID NO: 1819 - DNA, 25 bp, S. cerevisiae
atttgggtagttgtgttgtgatttc

SEQ ID NO: 1820 - DNA, 25 bp, S. cerevisiae
atttctattccaccgatctgaacga

SEQ ID NO: 1821 - DNA, 25 bp, S. cerevisiae
attttttccgctgatggatgactga

SEQ ID NO: 1822 - DNA, 25 bp, S. cerevisiae
atttgccaagggactcggcgatgtc

SEQ ID NO: 1823 - DNA, 25 bp, S. cerevisiae
atttctgagaggaaccgtctggtaa

SEQ ID NO: 1824 - DNA, 25 bp, S. cerevisiae
attttcaagctgatcctttgggaac

SEQ ID NO: 1825 - DNA, 25 bp, S. cerevisiae
attttcagagccaccttcggagtat

SEQ ID NO: 1826 - DNA, 25 bp, S. cerevisiae
atttgtcgagccaccaaaggactct

SEQ ID NO: 1827 - DNA, 25 bp, S. cerevisiae
atttccggcctctataacagaactc

SEQ ID NO: 1828 - DNA, 25 bp, S. cerevisiae
atttctcaatgcgatcactacagta

SEQ ID NO: 1829 - DNA, 25 bp, S. cerevisiae
atttcatcattcttcacctggttct

SEQ ID NO: 1830 - DNA, 25 bp, S. cerevisiae
atttacacttctttcagcgtcgttg

SEQ ID NO: 1831 - DNA, 25 bp, S. cerevisiae
attttctctcattataccgacgcag

SEQ ID NO: 1832 - DNA, 25 bp, S. cerevisiae
attttgactattccatacgcccatg

SEQ ID NO: 1833 - DNA, 25 bp, S. cerevisiae
attttacttatgtctacgctcctgt

SEQ ID NO: 1834 - DNA, 25 bp, S. cerevisiae
attttctgttatgccacaacctggg

SEQ ID NO: 1835 - DNA, 25 bp, S. cerevisiae
atttccatgcctatgggcggattca

SEQ ID NO: 1836 - DNA, 25 bp, S. cerevisiae
atattcctggtgaggcaaactcctt

SEQ ID NO: 1837 - DNA, 25 bp, S. cerevisiae
atttgcagcttttttaccaccagcc

SEQ ID NO: 1838 - DNA, 25 bp, S. cerevisiae
atttcattactcatttggcatcaca

SEQ ID NO: 1839 - DNA, 25 bp, S. cerevisiae
ataagacgcctgaagcataagctga

SEQ ID NO: 1840 - DNA, 25 bp, S. cerevisiae
atttgccggtatgcgaacgtgatca

SEQ ID NO: 1841 - DNA, 25 bp, S. cerevisiae
atttctacatgctaatattacgatc

SEQ ID NO: 1842 - DNA, 25 bp, S. cerevisiae
atttttcttcttctatgccatcaac

SEQ ID NO: 1843 - DNA, 25 bp, S. cerevisiae
attttcgacttttgattgcgctgtg

SEQ ID NO: 1844 - DNA, 25 bp, S. cerevisiae
atttcgcccattggaaatgcaggta

SEQ ID NO: 1845 - DNA, 25 bp, S. cerevisiae
atttccaccattccactacaagatg

SEQ ID NO: 1846 - DNA, 25 bp, S. cerevisiae
atttctattccaacactttgagaca

SEQ ID NO: 1847 - DNA, 25 bp, S. cerevisiae
atattccatttccaattgccgcaaa

SEQ ID NO: 1848 - DNA, 25 bp, S. cerevisiae
atttcttgttcagtggtcatccttg

SEQ ID NO: 1849 - DNA, 25 bp, S. cerevisiae
attttctctcatatccagacgaagc

SEQ ID NO: 1850 - DNA, 25 bp, S. cerevisiae
atttggagacctgttactgtgatac

SEQ ID NO: 1851 - DNA, 25 bp, S. cerevisiae
atttcgccgaacttggtcgctactg

SEQ ID NO: 1852 - DNA, 25 bp, S. cerevisiae
atttccctatttttcatcgtactgg

SEQ ID NO: 1853 - DNA, 25 bp, S. cerevisiae
atttggtttttgttcagcgtcctga

SEQ ID NO: 1854 - DNA, 25 bp, S. cerevisiae
atttaattttcgttctcttctgcaa

SEQ ID NO: 1855 - DNA, 25 bp, S. cerevisiae
atttgctgctggtgaagtttcgggt

SEQ ID NO: 1856 - DNA, 25 bp, S. cerevisiae
agttcaagaccgtggtttgtccgct

SEQ ID NO: 1857 - DNA, 25 bp, S. cerevisiae
agaatacgtcccaggtttactctcg

SEQ ID NO: 1858 - DNA, 25 bp, S. cerevisiae
atataaccccaagcgttttgctgct

SEQ ID NO: 1859 - DNA, 25 bp, S. cerevisiae
atggaggaccacacccttgtggcca

SEQ ID NO: 1860 - DNA, 25 bp, S. cerevisiae
agagaaaccaatcctccttgggcct

SEQ ID NO: 1861 - DNA, 25 bp, S. cerevisiae
aggaaccacaggctcccttggccaa

SEQ ID NO: 1862 - DNA, 25 bp, S. cerevisiae
ataggagccctgttataccgtagaa

SEQ ID NO: 1863 - DNA, 25 bp, S. cerevisiae
atagcaaacctgtacttccgtggga

SEQ ID NO: 1864 - DNA, 25 bp, S. cerevisiae
atatgaaaccgtattgcgaaccaat

SEQ ID NO: 1865 - DNA, 25 bp, S. cerevisiae
atatcccaagagctattccagacca

SEQ ID NO: 1866 - DNA, 25 bp, S. cerevisiae
atattccgccttacaagccaattgt

SEQ ID NO: 1867 - DNA, 25 bp, S. cerevisiae
atattaatgatttaccccagattgt

SEQ ID NO: 1868 - DNA, 25 bp, S. cerevisiae
atttgactactttccatactgttgg

SEQ ID NO: 1869 - DNA, 25 bp, S. cerevisiae
atttactctatttccaaatgtggac

SEQ ID NO: 1870 - DNA, 25 bp, S. cerevisiae
atttgccttgtactattgaggccga

SEQ ID NO: 1871 - DNA, 25 bp, S. cerevisiae
atttagtgcaccaagtctgcctcag

SEQ ID NO: 1872 - DNA, 25 bp, S. cerevisiae
atttagctacttcctcaagcatcag

SEQ ID NO: 1873 - DNA, 25 bp, S. cerevisiae
atttagcgagcaagatccggcccag

SEQ ID NO: 1874 - DNA, 25 bp, S. cerevisiae
atttatgcgaaaagcgatgccccac

SEQ ID NO: 1875 - DNA, 25 bp, S. cerevisiae
atttagtcatcattcctcaaacctc

SEQ ID NO: 1876 - DNA, 25 bp, S. cerevisiae
atttatctttattagcgacggcact

SEQ ID NO: 1877 - DNA, 25 bp, S. cerevisiae
attttagtcgcactcattgccttga

SEQ ID NO: 1878 - DNA, 25 bp, S. cerevisiae
atttttgactgctttatcgttcgag

SEQ ID NO: 1879 - DNA, 25 bp, S. cerevisiae
atttttctctcatgatctcttacca

SEQ ID NO: 1880 - DNA, 25 bp, S. cerevisiae
atttttgggctgctggatcatcacc

SEQ ID NO: 1881 - DNA, 25 bp, S. cerevisiae
atttttgcccaatgacatgctagta

SEQ ID NO: 1882 - DNA, 25 bp, S. cerevisiae
atttttccatccagacgcgcaggac

SEQ ID NO: 1883 - DNA, 25 bp, S. cerevisiae
atttataccttgtagacggcggaga

SEQ ID NO: 1884 - DNA, 25 bp, S. cerevisiae
atttcggcacttatggctttgttta

SEQ ID NO: 1885 - DNA, 25 bp, S. cerevisiae
atttggactctggattggctttttt

SEQ ID NO: 1886 - DNA, 25 bp, S. cerevisiae
atttacctgcttccgttaattggca

SEQ ID NO: 1887 - DNA, 25 bp, S. cerevisiae
atttagcactcgtacgttactagtc

SEQ ID NO: 1888 - DNA, 25 bp, S. cerevisiae
atattacccagttcgattccaaaat

SEQ ID NO: 1889 - DNA, 25 bp, S. cerevisiae
atttattccgtacttgtacaatgga

SEQ ID NO: 1890 - DNA, 25 bp, S. cerevisiae
atttttcacaccctttatcactaga

SEQ ID NO: 1891 - DNA, 25 bp, S. cerevisiae
atttcaatcacctcatttatctctc

SEQ ID NO: 1892 - DNA, 25 bp, S. cerevisiae
atatccaaacgtcttttgtccaaag

SEQ ID NO: 1893 - DNA, 25 bp, S. cerevisiae
atattctacggtgttctggatcaag

SEQ ID NO: 1894 - DNA, 25 bp, S. cerevisiae
atttattgggctgctcttggaccat

SEQ ID NO: 1895 - DNA, 25 bp, S. cerevisiae
atttttgaagcttatccaggactac

SEQ ID NO: 1896 - DNA, 25 bp, S. cerevisiae
atttttagcgcttctcgcaggaaaa

SEQ ID NO: 1897 - DNA, 25 bp, S. cerevisiae
atttctaatggttcatctacccaag

SEQ ID NO: 1898 - DNA, 25 bp, S. cerevisiae
atttgtttatccgtacgatgtacct

SEQ ID NO: 1899 - DNA, 25 bp, S. cerevisiae
atttgcttttacttctcttgtaggt

SEQ ID NO: 1900 - DNA, 25 bp, S. cerevisiae
atttgtctcaccaccagaggaggaa

SEQ ID NO: 1901 - DNA, 25 bp, S. cerevisiae
atttatcatgccaaaccagagggaa

SEQ ID NO: 1902 - DNA, 25 bp, S. cerevisiae
atttgcgtacgctctaagttatgat

SEQ ID NO: 1903 - DNA, 25 bp, S. cerevisiae
atttctttcctgttaagcttatatc

SEQ ID NO: 1904 - DNA, 25 bp, S. cerevisiae
atttttcccattcccagacaatgtt

SEQ ID NO: 1905 - DNA, 25 bp, S. cerevisiae
atttctttcattttgccaggccttt

SEQ ID NO: 1906 - DNA, 25 bp, S. cerevisiae
atttttgtggaatcggctgctgtca

SEQ ID NO: 1907 - DNA, 25 bp, S. cerevisiae
atttggctggcagtaagtcctcgtc

SEQ ID NO: 1908 - DNA, 25 bp, S. cerevisiae
atttactccggtaggcagtctcata

SEQ ID NO: 1909 - DNA, 25 bp, S. cerevisiae
atttagctgctgctgtcagtgattt

SEQ ID NO: 1910 - DNA, 25 bp, S. cerevisiae
atttgggcgcttctgaaactcatct

SEQ ID NO: 1911 - DNA, 25 bp, S. cerevisiae
atttgaacgttcgtcaggacatcat

SEQ ID NO: 1912 - DNA, 25 bp, S. cerevisiae
atttaccgctcaaaacagcttctca

SEQ ID NO: 1913 - DNA, 25 bp, S. cerevisiae
atttatctatgggacttctggtaag

SEQ ID NO: 1914 - DNA, 25 bp, S. cerevisiae
atttatccttgcaactggtgtgcta

SEQ ID NO: 1915 - DNA, 25 bp, S. cerevisiae
atttgctacaatctcatggccgtta

SEQ ID NO: 1916 - DNA, 25 bp, S. cerevisiae
atttctgacatcatgttgcaccctc

SEQ ID NO: 1917 - DNA, 25 bp, S. cerevisiae
atttctgtttgacctgacacgtcca

SEQ ID NO: 1918 - DNA, 25 bp, S. cerevisiae
atatttacccgagatatggtcacac

SEQ ID NO: 1919 - DNA, 25 bp, S. cerevisiae
atattgtaaccgtgtttgacctggc

SEQ ID NO: 1920 - DNA, 25 bp, S. cerevisiae
atttggcaaccgcaagttccgtgga

SEQ ID NO: 1921 - DNA, 25 bp, S. cerevisiae
atttatggatttacagctgcctgtc

SEQ ID NO: 1922 - DNA, 25 bp, S. cerevisiae
atttcagacatgcttgctgtccttg

SEQ ID NO: 1923 - DNA, 25 bp, S. cerevisiae
atttctgaagccttgttccaggtag

SEQ ID NO: 1924 - DNA, 25 bp, S. cerevisiae
atttaaacaccagtatgccgcctaa

SEQ ID NO: 1925 - DNA, 25 bp, S. cerevisiae
atttaaatcatctgctttccctcaa

SEQ ID NO: 1926 - DNA, 25 bp, S. cerevisiae
atttaggccatcttattcttcccaa

SEQ ID NO: 1927 - DNA, 25 bp, S. cerevisiae
atttaagcactttattcacctccac

SEQ ID NO: 1928 - DNA, 25 bp, S. cerevisiae
atttctggattgagagcccactctg

SEQ ID NO: 1929 - DNA, 25 bp, S. cerevisiae
atttcttcactgcagaacacacctg

SEQ ID NO: 1930 - DNA, 25 bp, S. cerevisiae
atattatacacagccaaccagtcct

SEQ ID NO: 1931 - DNA, 25 bp, S. cerevisiae
atttggagactaccttggaatccga

SEQ ID NO: 1932 - DNA, 25 bp, S. cerevisiae
atttggacgccaatgtttttagatt

SEQ ID NO: 1933 - DNA, 25 bp, S. cerevisiae
atttgaacgactttgtccggagtga

SEQ ID NO: 1934 - DNA, 25 bp, S. cerevisiae
atttcaacagatactttgccggatg

SEQ ID NO: 1935 - DNA, 25 bp, S. cerevisiae
atttatgctcaaactttcgctggct

SEQ ID NO: 1936 - DNA, 25 bp, S. cerevisiae
atttccctgtgcattgtacttcaaa

SEQ ID NO: 1937 - DNA, 25 bp, S. cerevisiae
atttagttcgctattttcaccgcag

SEQ ID NO: 1938 - DNA, 25 bp, S. cerevisiae
atattcgttctgagactttcgtcga

SEQ ID NO: 1939 - DNA, 25 bp, S. cerevisiae
atttccggtgccatatggacgcagt

SEQ ID NO: 1940 - DNA, 25 bp, S. cerevisiae
atttcagctggcttcaaatcgacca

SEQ ID NO: 1941 - DNA, 25 bp, S. cerevisiae
atttcctgagttcaatccagcgtta

SEQ ID NO: 1942 - DNA, 25 bp, S. cerevisiae
atttgtgcttgtcttgttcgagttc

SEQ ID NO: 1943 - DNA, 25 bp, S. cerevisiae
atttctggagagctttatcgatgag

SEQ ID NO: 1944 - DNA, 25 bp, S. cerevisiae
atttgccgctaagcataggcgctgt

SEQ ID NO: 1945 - DNA, 25 bp, S. cerevisiae
atttgtccacgcgtaatgttttcca

SEQ ID NO: 1946 - DNA, 25 bp, S. cerevisiae
atttgtccccacaatcctatttagt

SEQ ID NO: 1947 - DNA, 25 bp, S. cerevisiae
atatttcttcccctcgttaagtgtg

SEQ ID NO: 1948 - DNA, 25 bp, S. cerevisiae
atagtgttttcctcggtgatattct

SEQ ID NO: 1949 - DNA, 25 bp, S. cerevisiae
atagtgggattcttcctggtgactt

SEQ ID NO: 1950 - DNA, 25 bp, S. cerevisiae
atttcgggtcttattggcgctgaga

SEQ ID NO: 1951 - DNA, 25 bp, S. cerevisiae
atttcgtaccttttgatgcgggcaa

SEQ ID NO: 1952 - DNA, 25 bp, S. cerevisiae
atattgcgtaaggtcgttttcccat

SEQ ID NO: 1953 - DNA, 25 bp, S. cerevisiae
atttgagtcctcctttttgtcctat

SEQ ID NO: 1954 - DNA, 25 bp, S. cerevisiae
atttcgccttgactgcttcgcaaaa

SEQ ID NO: 1955 - DNA, 25 bp, S. cerevisiae
atttccccattttctcgaattgcag

SEQ ID NO: 1956 - DNA, 25 bp, S. cerevisiae
atttcgcgccggcaatatactggtc

SEQ ID NO: 1957 - DNA, 25 bp, S. cerevisiae
atttgctatttttggacagcgctag

SEQ ID NO: 1958 - DNA, 25 bp, S. cerevisiae
atttgacaatcacaggcagcgtacc

SEQ ID NO: 1959 - DNA, 25 bp, S. cerevisiae
atttgaattacttgcctcgatacgg

SEQ ID NO: 1960 - DNA, 25 bp, S. cerevisiae
atttacaagcacatccctgaaggga

SEQ ID NO: 1961 - DNA, 25 bp, S. cerevisiae
atttcatggaaaccgctactatttt

SEQ ID NO: 1962 - DNA, 25 bp, S. cerevisiae
atattaggttctccaagtgccttct

SEQ ID NO: 1963 - DNA, 25 bp, S. cerevisiae
atttggcataaatctcagctggagg

SEQ ID NO: 1964 - DNA, 25 bp, S. cerevisiae
atttcatgaaaaatctcggcgcttc

SEQ ID NO: 1965 - DNA, 25 bp, S. cerevisiae
atttctagagacatttggcattcca

SEQ ID NO: 1966 - DNA, 25 bp, S. cerevisiae
atcttccggaattcaatgggtgcca

SEQ ID NO: 1967 - DNA, 25 bp, S. cerevisiae
atttcccagcagagaaggtagccag

SEQ ID NO: 1968 - DNA, 25 bp, S. cerevisiae
atttccaggctggtcgaagtaccgc

SEQ ID NO: 1969 - DNA, 25 bp, S. cerevisiae
atttgcagagcgtgtcggcgtacca

SEQ ID NO: 1970 - DNA, 25 bp, S. cerevisiae
atttggtggatactgacgcgctgtc

SEQ ID NO: 1971 - DNA, 25 bp, S. cerevisiae
atttggcacagttcatcagccgttg

SEQ ID NO: 1972 - DNA, 25 bp, S. cerevisiae
atttggttggcatcaccattgtccg

SEQ ID NO: 1973 - DNA, 25 bp, S. cerevisiae
atttgtttggccaagtgcatttcac

SEQ ID NO: 1974 - DNA, 25 bp, S. cerevisiae
atattgttttgctattggccattac

SEQ ID NO: 1975 - DNA, 25 bp, S. cerevisiae
atttgcctctttcttgctactacaa

SEQ ID NO: 1976 - DNA, 25 bp, S. cerevisiae
atttgaccctatcttgtaccctgag

SEQ ID NO: 1977 - DNA, 25 bp, S. cerevisiae
atttgttccgttggtcttacacgag

SEQ ID NO: 1978 - DNA, 25 bp, S. cerevisiae
atttcagctctttcaagttcctcga

SEQ ID NO: 1979 - DNA, 25 bp, S. cerevisiae
atttctttgttccacattctcttga

SEQ ID NO: 1980 - DNA, 25 bp, S. cerevisiae
atttctgaatctttcccgtggaagg

SEQ ID NO: 1981 - DNA, 25 bp, S. cerevisiae
atttcagagctataccgctggtgaa

SEQ ID NO: 1982 - DNA, 25 bp, S. cerevisiae
atttcacagttatttcgccgcagga

SEQ ID NO: 1983 - DNA, 25 bp, S. cerevisiae
atttcattcttgtcctatcacagca

SEQ ID NO: 1984 - DNA, 25 bp, S. cerevisiae
atttgcaatgttgactctctctcca

SEQ ID NO: 1985 - DNA, 25 bp, S. cerevisiae
atttgaagccttttcatccacctaa

SEQ ID NO: 1986 - DNA, 25 bp, S. cerevisiae
ataggccgcctttttctaattagag

SEQ ID NO: 1987 - DNA, 25 bp, S. cerevisiae
atatggccctttgtttgcctttgat

SEQ ID NO: 1988 - DNA, 25 bp, S. cerevisiae
ataggcctctactctggtcttttgg

SEQ ID NO: 1989 - DNA, 25 bp, S. cerevisiae
atcaccccaagcacgggcattttta

SEQ ID NO: 1990 - DNA, 25 bp, S. cerevisiae
atcaggccctactggaggtgttatt

SEQ ID NO: 1991 - DNA, 25 bp, S. cerevisiae
atcttccaccgttgaaactgtttct

SEQ ID NO: 1992 - DNA, 25 bp, S. cerevisiae
atttcacgacggtcaactgcgtttt

SEQ ID NO: 1993 - DNA, 25 bp, S. cerevisiae
atattactattttcagactgtgtta

SEQ ID NO: 1994 - DNA, 25 bp, S. cerevisiae
atttcacgaaatgatggcactatag

SEQ ID NO: 1995 - DNA, 25 bp, S. cerevisiae
atttcatccacattttagcacactt

SEQ ID NO: 1996 - DNA, 25 bp, S. cerevisiae
atattagccaactttagacaactct

SEQ ID NO: 1997 - DNA, 25 bp, S. cerevisiae
atttcagcagaagccatccattggt

SEQ ID NO: 1998 - DNA, 25 bp, S. cerevisiae
atttcatcgaagactctccggagat

SEQ ID NO: 1999 - DNA, 25 bp, S. cerevisiae
atttcattgatacattgcccacaga

SEQ ID NO: 2000 - DNA, 25 bp, S. cerevisiae
atttggccgaattccaccaggtgga

SEQ ID NO: 2001 - DNA, 25 bp, S. cerevisiae
atttcttctgaaacttccggtggag

SEQ ID NO: 2002 - DNA, 25 bp, S. cerevisiae
atttcttgtttttccctcatttgca

SEQ ID NO: 2003 - DNA, 25 bp, S. cerevisiae
atttctgtttctttccgtcatttag

SEQ ID NO: 2004 - DNA, 25 bp, S. cerevisiae
atattactggatctgcctcgatttc

SEQ ID NO: 2005 - DNA, 25 bp, S. cerevisiae
atttcatcttgcactgcatctcaga

SEQ ID NO: 2006 - DNA, 25 bp, S. cerevisiae
atttccaaagctcgtctcatgtgtg

SEQ ID NO: 2007 - DNA, 25 bp, S. cerevisiae
atttccgtccgcaaagttctgttgt

SEQ ID NO: 2008 - DNA, 25 bp, S. cerevisiae
atttcctctacgaaagtgcggcttt

SEQ ID NO: 2009 - DNA, 25 bp, S. cerevisiae
atttccctagtttatgctctggcta

SEQ ID NO: 2010 - DNA, 25 bp, S. cerevisiae
atttcccaatggctacactgacgat

SEQ ID NO: 2011 - DNA, 25 bp, S. cerevisiae
atttcggaactgctaaagacgcctt

SEQ ID NO: 2012 - DNA, 25 bp, S. cerevisiae
atttctgctgcatctggtaaggtcg

SEQ ID NO: 2013 - DNA, 25 bp, S. cerevisiae
atattgaatgatcctgcagtacaga

SEQ ID NO: 2014 - DNA, 25 bp, S. cerevisiae
atttcgaagtatctgctcatagcct

SEQ ID NO: 2015 - DNA, 25 bp, S. cerevisiae
atttcttctgctgttgagacttctg

SEQ ID NO: 2016 - DNA, 25 bp, S. cerevisiae
atttcgtctgcattgttcgttttga

SEQ ID NO: 2017 - DNA, 25 bp, S. cerevisiae
atttcgcaagatggttctgcttttg

SEQ ID NO: 2018 - DNA, 25 bp, S. cerevisiae
atttctcttatcctctctattatca

SEQ ID NO: 2019 - DNA, 25 bp, S. cerevisiae
atttggtgtgtcctttatctacgcc

SEQ ID NO: 2020 - DNA, 25 bp, S. cerevisiae
atatcggtatggctttagcttccgc

SEQ ID NO: 2021 - DNA, 25 bp, S. cerevisiae
atgacggaactgttggaagcctcca

SEQ ID NO: 2022 - DNA, 25 bp, S. cerevisiae
atttgaaacatgtgccagactccga

SEQ ID NO: 2023 - DNA, 25 bp, S. cerevisiae
atttgagtcctacatcgaccctgaa

SEQ ID NO: 2024 - DNA, 25 bp, S. cerevisiae
atttgactttggcatcgcaacctgc

SEQ ID NO: 2025 - DNA, 25 bp, S. cerevisiae
atttggtcaattgatctgcatggcc

SEQ ID NO: 2026 - DNA, 25 bp, S. cerevisiae
atttgagaacccaagctgcatctgc

SEQ ID NO: 2027 - DNA, 25 bp, S. cerevisiae
atttgcagcagacggcgacgcttta

SEQ ID NO: 2028 - DNA, 25 bp, S. cerevisiae
atattggcgccgatcctaattacag

SEQ ID NO: 2029 - DNA, 25 bp, S. cerevisiae
atattgggcctggtccaccaaagaa

SEQ ID NO: 2030 - DNA, 25 bp, S. cerevisiae
atttgtgggtgcttacactccagaa

SEQ ID NO: 2031 - DNA, 25 bp, S. cerevisiae
atctttagagcacggaaatcgcgaa

SEQ ID NO: 2032 - DNA, 25 bp, S. cerevisiae
atttgcaagagcgtttccatgccgc

SEQ ID NO: 2033 - DNA, 25 bp, S. cerevisiae
atttgcagaatcgttttggcctcac

SEQ ID NO: 2034 - DNA, 25 bp, S. cerevisiae
atttgagaggttcccaggcgatact

SEQ ID NO: 2035 - DNA, 25 bp, S. cerevisiae
atttgagaggtaccaggtgcccgct

SEQ ID NO: 2036 - DNA, 25 bp, S. cerevisiae
atttgaactctaccgtgtggcacga

SEQ ID NO: 2037 - DNA, 25 bp, S. cerevisiae
atttgaacatgatccggaggcaagc

SEQ ID NO: 2038 - DNA, 25 bp, S. cerevisiae
atattgaaatggtcacacgcagtga

SEQ ID NO: 2039 - DNA, 25 bp, S. cerevisiae
atatcaattcggtgagcaagtcccc

SEQ ID NO: 2040 - DNA, 25 bp, S. cerevisiae
atacactttggacagaaacaccgct

SEQ ID NO: 2041 - DNA, 25 bp, S. cerevisiae
atatgttttgcgactggacgaccct

SEQ ID NO: 2042 - DNA, 25 bp, S. cerevisiae
atatcgtcgatatctccagtaccct

SEQ ID NO: 2043 - DNA, 25 bp, S. cerevisiae
atatttcgaaactcagtgtccttca

SEQ ID NO: 2044 - DNA, 25 bp, S. cerevisiae
atatttcaaatgagcggtcctcctc

SEQ ID NO: 2045 - DNA, 25 bp, S. cerevisiae
atttccgataatggcacgtcctatg

SEQ ID NO: 2046 - DNA, 25 bp, S. cerevisiae
agttctaatactcaggtttggacca

SEQ ID NO: 2047 - DNA, 25 bp, S. cerevisiae
atggttccatttgacgtccctgaaa

SEQ ID NO: 2048 - DNA, 25 bp, S. cerevisiae
atatttaatctttgactgtcccggt

SEQ ID NO: 2049 - DNA, 25 bp, S. cerevisiae
atttcccaatgttgactctgcatcg

SEQ ID NO: 2050 - DNA, 25 bp, S. cerevisiae
atttctcacataacttggctctcaa

SEQ ID NO: 2051 - DNA, 25 bp, S. cerevisiae
atttccacaaccaaagtcatcaacc

SEQ ID NO: 2052 - DNA, 25 bp, S. cerevisiae
atattgtcaaaccactgtctcacac

SEQ ID NO: 2053 - DNA, 25 bp, S. cerevisiae
atattctacaactcgactgctactg

SEQ ID NO: 2054 - DNA, 25 bp, S. cerevisiae
atttgattcagaccgctaagctact

SEQ ID NO: 2055 - DNA, 25 bp, S. cerevisiae
atttgattgatttcggtctgggctc

SEQ ID NO: 2056 - DNA, 25 bp, S. cerevisiae
atgactatagatctccgttgggtgt

SEQ ID NO: 2057 - DNA, 25 bp, S. cerevisiae
atgatagaagtctcgttacggtgtt

SEQ ID NO: 2058 - DNA, 25 bp, S. cerevisiae
atatatcgcaagcaagtttgggatt

SEQ ID NO: 2059 - DNA, 25 bp, S. cerevisiae
atatacccaggttttgttcgcatct

SEQ ID NO: 2060 - DNA, 25 bp, S. cerevisiae
atttcgctgcgttcttcatcgatgc

SEQ ID NO: 2061 - DNA, 25 bp, S. cerevisiae
atttctgatggccacgcaatgctaa

SEQ ID NO: 2062 - DNA, 25 bp, S. cerevisiae
atttcgcactcctgatagcattagc

SEQ ID NO: 2063 - DNA, 25 bp, S. cerevisiae
atttcctgtctattgcacacactag

SEQ ID NO: 2064 - DNA, 25 bp, S. cerevisiae
atttggtcatgggtgctgttaggca

SEQ ID NO: 2065 - DNA, 25 bp, S. cerevisiae
atttgcttttgcatgtttgagcgca

SEQ ID NO: 2066 - DNA, 25 bp, S. cerevisiae
atttgatcgtcgtcttttggtaccg

SEQ ID NO: 2067 - DNA, 25 bp, S. cerevisiae
atttcctgtgctcatttgtggtgac

SEQ ID NO: 2068 - DNA, 25 bp, S. cerevisiae
atattcaccccattactgaagcaca

SEQ ID NO: 2069 - DNA, 25 bp, S. cerevisiae
atttgaaccagctttctcgagctac

SEQ ID NO: 2070 - DNA, 25 bp, S. cerevisiae
atttgtgtctgtgaaccctaatgca

SEQ ID NO: 2071 - DNA, 25 bp, S. cerevisiae
atttgcccttcacaaaatctctgtc

SEQ ID NO: 2072 - DNA, 25 bp, S. cerevisiae
atttccacatactccaaatctgcag

SEQ ID NO: 2073 - DNA, 25 bp, S. cerevisiae
atatctgcaccatatctaaattcgc

SEQ ID NO: 2074 - DNA, 25 bp, S. cerevisiae
atttgctggatatactacctgccct

SEQ ID NO: 2075 - DNA, 25 bp, S. cerevisiae
atttgctggtcatgaattcacattc

SEQ ID NO: 2076 - DNA, 25 bp, S. cerevisiae
atttggagatccttacttgcacaac

SEQ ID NO: 2077 - DNA, 25 bp, S. cerevisiae
atatttggacactcattgcgccgac

SEQ ID NO: 2078 - DNA, 25 bp, S. cerevisiae
atttgtggaacaagcatgtctgcag

SEQ ID NO: 2079 - DNA, 25 bp, S. cerevisiae
atatcagaggaattggacacgcaga

SEQ ID NO: 2080 - DNA, 25 bp, S. cerevisiae
atatcagcacgttgggcatacctca

SEQ ID NO: 2081 - DNA, 25 bp, S. cerevisiae
atacgacgtggagaaggccgccgaa

SEQ ID NO: 2082 - DNA, 25 bp, S. cerevisiae
atgctgcccctgaagtcttaggagg

SEQ ID NO: 2083 - DNA, 25 bp, S. cerevisiae
atttccaccgtattgctggcaatcg

SEQ ID NO: 2084 - DNA, 25 bp, S. cerevisiae
atttccctcttgttgtcgctatttt

SEQ ID NO: 2085 - DNA, 25 bp, S. cerevisiae
atagttccatttttaccagtgtttg

SEQ ID NO: 2086 - DNA, 25 bp, S. cerevisiae
atttcccattcggtgcaacaggttt

SEQ ID NO: 2087 - DNA, 25 bp, S. cerevisiae
atttcccgacagatcaaacgctatt

SEQ ID NO: 2088 - DNA, 25 bp, S. cerevisiae
atattctcactacgttcaacactct

SEQ ID NO: 2089 - DNA, 25 bp, S. cerevisiae
atattcttcaactccaacacaaacg

SEQ ID NO: 2090 - DNA, 25 bp, S. cerevisiae
atttccgaaggtggcatcaacgaac

SEQ ID NO: 2091 - DNA, 25 bp, S. cerevisiae
atttcctgcataaatcttgcccgaa

SEQ ID NO: 2092 - DNA, 25 bp, S. cerevisiae
atttcctttgtgtttgccattggcg

SEQ ID NO: 2093 - DNA, 25 bp, S. cerevisiae
atattcacttttttcgccatgtaca

SEQ ID NO: 2094 - DNA, 25 bp, S. cerevisiae
atatttatttacacatgcgcctgtt

SEQ ID NO: 2095 - DNA, 25 bp, S. cerevisiae
atttgctattttacattcgccgtca

SEQ ID NO: 2096 - DNA, 25 bp, S. cerevisiae
atttgctgctgtttctttcgtccta

SEQ ID NO: 2097 - DNA, 25 bp, S. cerevisiae
atttgcccaagttatccctacaaga

SEQ ID NO: 2098 - DNA, 25 bp, S. cerevisiae
atattctacaaggaatcccggcaag

SEQ ID NO: 2099 - DNA, 25 bp, S. cerevisiae
atctttgaacaggagaccgcggcca

SEQ ID NO: 2100 - DNA, 25 bp, S. cerevisiae
atttggaagcaggtcttccgcgcca

SEQ ID NO: 2101 - DNA, 25 bp, S. cerevisiae
atttggcaatgtgtctatcctttag

SEQ ID NO: 2102 - DNA, 25 bp, S. cerevisiae
atattctgacagaccttacctatgt

SEQ ID NO: 2103 - DNA, 25 bp, S. cerevisiae
atttgagaaaagctgccccattgca

SEQ ID NO: 2104 - DNA, 25 bp, S. cerevisiae
atttggtactatctttctattatca

SEQ ID NO: 2105 - DNA, 25 bp, S. cerevisiae
atttggtcgtggctcatttgatgaa

SEQ ID NO: 2106 - DNA, 25 bp, S. cerevisiae
atttgccaggtgatatcttcttact

SEQ ID NO: 2107 - DNA, 25 bp, S. cerevisiae
atttccatggtgcttctttatcaga

SEQ ID NO: 2108 - DNA, 25 bp, S. cerevisiae
atttccagccggattttatcatcca

SEQ ID NO: 2109 - DNA, 25 bp, S. cerevisiae
ataaatccgtagtggcattacagcc

SEQ ID NO: 2110 - DNA, 25 bp, S. cerevisiae
acgaagacccggatgtgtgggacac

SEQ ID NO: 2111 - DNA, 25 bp, S. cerevisiae
acgaaaccaagtgctgacggaatta

SEQ ID NO: 2112 - DNA, 25 bp, S. cerevisiae
caggaaacccggatgacggcattaa

SEQ ID NO: 2113 - DNA, 25 bp, S. cerevisiae
agcgaatttccataagggcgactat

SEQ ID NO: 2114 - DNA, 25 bp, S. cerevisiae
aggacaacaccaacaagggccctga

SEQ ID NO: 2115 - DNA, 25 bp, S. cerevisiae
atgagaaggacctcttcagggccct

SEQ ID NO: 2116 - DNA, 25 bp, S. cerevisiae
agagaagcggttgttacggctcccg

SEQ ID NO: 2117 - DNA, 25 bp, S. cerevisiae
aacaacggagtctgtaggtggcacc

SEQ ID NO: 2118 - DNA, 25 bp, S. cerevisiae
atagaacgtcctttttgctgggcag

SEQ ID NO: 2119 - DNA, 25 bp, S. cerevisiae
atatatcactccagcctacttgtta

SEQ ID NO: 2120 - DNA, 25 bp, S. cerevisiae
atattatccagtccatctagcttca

SEQ ID NO: 2121 - DNA, 25 bp, S. cerevisiae
atattaccagtactcacatgcgaat

SEQ ID NO: 2122 - DNA, 25 bp, S. cerevisiae
atcatgtcccgtatactgcaagtag

SEQ ID NO: 2123 - DNA, 25 bp, S. cerevisiae
atatctgaccacatctggaaaacta

SEQ ID NO: 2124 - DNA, 25 bp, S. cerevisiae
atttgagcccaattgcagacgatca

SEQ ID NO: 2125 - DNA, 25 bp, S. cerevisiae
atttgaggagaattgcgcccatagc

SEQ ID NO: 2126 - DNA, 25 bp, S. cerevisiae
atttgatacataaggctcgctctag

SEQ ID NO: 2127 - DNA, 25 bp, S. cerevisiae
atttgaatgctactaccgccatgga

SEQ ID NO: 2128 - DNA, 25 bp, S. cerevisiae
atatacacgtcactagccggaggcg

SEQ ID NO: 2129 - DNA, 25 bp, S. cerevisiae
atatcaactggactggccacggtgg

SEQ ID NO: 2130 - DNA, 25 bp, S. cerevisiae
atataagcatgcagccgggtcgtcg

SEQ ID NO: 2131 - DNA, 25 bp, S. cerevisiae
atataaggaaccagcttcagccacg

SEQ ID NO: 2132 - DNA, 25 bp, S. cerevisiae
atatacgctaaagttaatcgcccag

SEQ ID NO: 2133 - DNA, 25 bp, S. cerevisiae
ataacggtaactcagagccccaggg

SEQ ID NO: 2134 - DNA, 25 bp, S. cerevisiae
atcaacagttttagggactcaccca

SEQ ID NO: 2135 - DNA, 25 bp, S. cerevisiae
atagacaattccacgggccaagctg

SEQ ID NO: 2136 - DNA, 25 bp, S. cerevisiae
atagaaagccctgccggtcaaaaga

SEQ ID NO: 2137 - DNA, 25 bp, S. cerevisiae
atcatcaaagccgatgaccacgctt

SEQ ID NO: 2138 - DNA, 25 bp, S. cerevisiae
atatcaaagcgctaatctacctgtg

SEQ ID NO: 2139 - DNA, 25 bp, S. cerevisiae
atatcaatggcacgttgtccctgga

SEQ ID NO: 2140 - DNA, 25 bp, S. cerevisiae
atatcaagctggacgtaccgctcgg

SEQ ID NO: 2141 - DNA, 25 bp, S. cerevisiae
atttgttggacaaactcctcgcgta

SEQ ID NO: 2142 - DNA, 25 bp, S. cerevisiae
atttgtttctctatcgatcttccag

SEQ ID NO: 2143 - DNA, 25 bp, S. cerevisiae
atatatgtttgcgttctggatcccc

SEQ ID NO: 2144 - DNA, 25 bp, S. cerevisiae
atttgtgtcatcttctaacaccgta

SEQ ID NO: 2145 - DNA, 25 bp, S. cerevisiae
atttgctgtattgcgaaatccgccc

SEQ ID NO: 2146 - DNA, 25 bp, S. cerevisiae
atttggcagagcttcgtatgtcggc

SEQ ID NO: 2147 - DNA, 25 bp, S. cerevisiae
atattcctctttactgatgactccg

SEQ ID NO: 2148 - DNA, 25 bp, S. cerevisiae
atatcccatgacttcagcagcattg

SEQ ID NO: 2149 - DNA, 25 bp, S. cerevisiae
atatcacctaagtagcagcctgcta

SEQ ID NO: 2150 - DNA, 25 bp, S. cerevisiae
atatatcctaggtgtgactggcaga

SEQ ID NO: 2151 - DNA, 25 bp, S. cerevisiae
ctagtcgtacggatccttctaaatt

SEQ ID NO: 2152 - DNA, 25 bp, S. cerevisiae
atttggctactgttgaacctacatt

SEQ ID NO: 2153 - DNA, 25 bp, S. cerevisiae
atattggctacgttggatcctttct

SEQ ID NO: 2154 - DNA, 25 bp, S. cerevisiae
atattcttatcgttggtggcagttc

SEQ ID NO: 2155 - DNA, 25 bp, S. cerevisiae
atttgtgccacatccatctgtttgt

SEQ ID NO: 2156 - DNA, 25 bp, S. cerevisiae
atcttgcgtgcccaacacgttaaga

SEQ ID NO: 2157 - DNA, 25 bp, S. cerevisiae
atttgggttcaatcgctggcagaga

SEQ ID NO: 2158 - DNA, 25 bp, S. cerevisiae
atattacttctgacaccacatacct

SEQ ID NO: 2159 - DNA, 25 bp, S. cerevisiae
atattccatggcatatcctagccgt

SEQ ID NO: 2160 - DNA, 25 bp, S. cerevisiae
atattttctcagctgtcacgtgcga

SEQ ID NO: 2161 - DNA, 25 bp, S. cerevisiae
atttgttcttggttcatgcgcagta

SEQ ID NO: 2162 - DNA, 25 bp, S. cerevisiae
atttgctcgagtttagtgccactgc

SEQ ID NO: 2163 - DNA, 25 bp, S. cerevisiae
atttgcaccacgttagtcacatctg

SEQ ID NO: 2164 - DNA, 25 bp, S. cerevisiae
atttgaccccactgctcaattgaat

SEQ ID NO: 2165 - DNA, 25 bp, S. cerevisiae
atactacgccaagactattttattc

SEQ ID NO: 2166 - DNA, 25 bp, S. cerevisiae
atattcccaatactgcgcgtgtaac

SEQ ID NO: 2167 - DNA, 25 bp, S. cerevisiae
atattactgtaccagcttgctgaag

SEQ ID NO: 2168 - DNA, 25 bp, S. cerevisiae
atatttactactacaggcggccaga

SEQ ID NO: 2169 - DNA, 25 bp, S. cerevisiae
atatctatatctcatttggcggccc

SEQ ID NO: 2170 - DNA, 25 bp, S. cerevisiae
atatattcgcatatctagcgcggct

SEQ ID NO: 2171 - DNA, 25 bp, S. cerevisiae
atttgtatcactggtaggctccttc

SEQ ID NO: 2172 - DNA, 25 bp, S. cerevisiae
atatttccccagagtcaagagcctt

SEQ ID NO: 2173 - DNA, 25 bp, S. cerevisiae
atcagtgtccccagcggaagggtgt

SEQ ID NO: 2174 - DNA, 25 bp, S. cerevisiae
atagaggccaactttggaacggttg

SEQ ID NO: 2175 - DNA, 25 bp, S. cerevisiae
atattactcacagtttggctccggt

SEQ ID NO: 2176 - DNA, 25 bp, S. cerevisiae
atattccggcacatgtatctacaat

SEQ ID NO: 2177 - DNA, 25 bp, S. cerevisiae
atattccccatcaatgtggtccaag

SEQ ID NO: 2178 - DNA, 25 bp, S. cerevisiae
atttgcaaggctctgatggtccaag

SEQ ID NO: 2179 - DNA, 25 bp, S. cerevisiae
atttggctctgattggtgtcgtgat

SEQ ID NO: 2180 - DNA, 25 bp, S. cerevisiae
atatctgtgcgaattgcctatccat

SEQ ID NO: 2181 - DNA, 25 bp, S. cerevisiae
atattcaatgcgtgcgattctctct

SEQ ID NO: 2182 - DNA, 25 bp, S. cerevisiae
atattccagccgtcaatggtgccat

SEQ ID NO: 2183 - DNA, 25 bp, S. cerevisiae
atattaaactcgcactcactagcct

SEQ ID NO: 2184 - DNA, 25 bp, S. cerevisiae
atatttaatccgcagaatcccctca

SEQ ID NO: 2185 - DNA, 25 bp, S. cerevisiae
atatcaattccaaattctggcgcga

SEQ ID NO: 2186 - DNA, 25 bp, S. cerevisiae
atttgattcaatatctcttcgcaga

SEQ ID NO: 2187 - DNA, 25 bp, S. cerevisiae
atattgttcgctatcccagcgctga

SEQ ID NO: 2188 - DNA, 25 bp, S. cerevisiae
atatatttcatctcgtgtaggctgg

SEQ ID NO: 2189 - DNA, 25 bp, S. cerevisiae
atattgctcgtatcagtggaggcga

SEQ ID NO: 2190 - DNA, 25 bp, S. cerevisiae
atatcatcaaaaccctggcaatgga

SEQ ID NO: 2191 - DNA, 25 bp, S. cerevisiae
atatacagagcatcgcctccagtag

SEQ ID NO: 2192 - DNA, 25 bp, S. cerevisiae
atatcttcttgcaggagattcttcc

SEQ ID NO: 2193 - DNA, 25 bp, S. cerevisiae
atatttctgcttcattctacccaat

SEQ ID NO: 2194 - DNA, 25 bp, S. cerevisiae
atattcctgtggttttaccgggcat

SEQ ID NO: 2195 - DNA, 25 bp, S. cerevisiae
atttgatgtgattttcggtcctgcc

SEQ ID NO: 2196 - DNA, 25 bp, S. cerevisiae
atattcggctatatcgaggcacgct

SEQ ID NO: 2197 - DNA, 25 bp, S. cerevisiae
atataagcaatatgcgccgggccca

SEQ ID NO: 2198 - DNA, 25 bp, S. cerevisiae
atattagctatatccggcgttgaca

SEQ ID NO: 2199 - DNA, 25 bp, S. cerevisiae
atagttttacgagcatgtttgacaa

SEQ ID NO: 2200 - DNA, 25 bp, S. cerevisiae
atagagttttcttccatttcgccta

SEQ ID NO: 2201 - DNA, 25 bp, S. cerevisiae
ataattgtagtcacgttaacgcatt

SEQ ID NO: 2202 - DNA, 25 bp, S. cerevisiae
atataagcccggtagtcccatcgga

SEQ ID NO: 2203 - DNA, 25 bp, S. cerevisiae
atagaggtacgctcgtgtccacgga

SEQ ID NO: 2204 - DNA, 25 bp, S. cerevisiae
atatggttactcactgttttcggtt

SEQ ID NO: 2205 - DNA, 25 bp, S. cerevisiae
atatttttcccggtgacaatgtcaa

SEQ ID NO: 2206 - DNA, 25 bp, S. cerevisiae
atatttgtcgccgagatgctcaaac

SEQ ID NO: 2207 - DNA, 25 bp, S. cerevisiae
atatttcctcaatttgttacgccaa

SEQ ID NO: 2208 - DNA, 25 bp, S. cerevisiae
atatacccatcgatgctgcatttac

SEQ ID NO: 2209 - DNA, 25 bp, S. cerevisiae
agatggccccgacgattttgaattc

SEQ ID NO: 2210 - DNA, 25 bp, S. cerevisiae
ataggtcccgagctttctcaaataa

SEQ ID NO: 2211 - DNA, 25 bp, S. cerevisiae
atatggtcccgtttttgctatcact

SEQ ID NO: 2212 - DNA, 25 bp, S. cerevisiae
atagggttcctgaattttacattga

SEQ ID NO: 2213 - DNA, 25 bp, S. cerevisiae
ctacggttccgtcactgattactaa

SEQ ID NO: 2214 - DNA, 25 bp, S. cerevisiae
cttcggtactggtaagagattggct

SEQ ID NO: 2215 - DNA, 25 bp, S. cerevisiae
atatcggatacgcataagtttgagc

SEQ ID NO: 2216 - DNA, 25 bp, S. cerevisiae
atatcctggtcgcaacagctgtagc

SEQ ID NO: 2217 - DNA, 25 bp, S. cerevisiae
atttggctgtcttggctttggtcat

SEQ ID NO: 2218 - DNA, 25 bp, S. cerevisiae
atatctactgtttggctctatgcga

SEQ ID NO: 2219 - DNA, 25 bp, S. cerevisiae
atatccgcgtttggtaagcatgaaa

SEQ ID NO: 2220 - DNA, 25 bp, S. cerevisiae
atgactcggatgcacaaaactacaa

SEQ ID NO: 2221 - DNA, 25 bp, S. cerevisiae
atgacgtggtgctcaatgaactact

SEQ ID NO: 2222 - DNA, 25 bp, S. cerevisiae
ataaaagtcacaactcccaatcgca

SEQ ID NO: 2223 - DNA, 25 bp, S. cerevisiae
gaatctgaaggttacgggttccgct

SEQ ID NO: 2224 - DNA, 25 bp, S. cerevisiae
atactccaggaatcggtgttcccgg

SEQ ID NO: 2225 - DNA, 25 bp, S. cerevisiae
atcaccgacaaatcgctggtatttc

SEQ ID NO: 2226 - DNA, 25 bp, S. cerevisiae
atatcccaagtcacaattctccaat

SEQ ID NO: 2227 - DNA, 25 bp, S. cerevisiae
atttggctctttatgacgatctcag

SEQ ID NO: 2228 - DNA, 25 bp, S. cerevisiae
atattcgctcttttacaggcattga

SEQ ID NO: 2229 - DNA, 25 bp, S. cerevisiae
atattagtgttattcatcgggctgg

SEQ ID NO: 2230 - DNA, 25 bp, S. cerevisiae
atattcgtgtttttctgcaagcggt

SEQ ID NO: 2231 - DNA, 25 bp, S. cerevisiae
atatctcggtgttgtttgcactgct

SEQ ID NO: 2232 - DNA, 25 bp, S. cerevisiae
atattcgcgggatgcatcgttggcc

SEQ ID NO: 2233 - DNA, 25 bp, S. cerevisiae
atattcaaggcgtgagtctctggct

SEQ ID NO: 2234 - DNA, 25 bp, S. cerevisiae
atattctcggaagctgtcattgcac

SEQ ID NO: 2235 - DNA, 25 bp, S. cerevisiae
atatatcgcgtcaggactctgtctc

SEQ ID NO: 2236 - DNA, 25 bp, S. cerevisiae
atatcaaaccaccacagtcgtatgc

SEQ ID NO: 2237 - DNA, 25 bp, S. cerevisiae
atattttgggccagctcatgttcca

SEQ ID NO: 2238 - DNA, 25 bp, S. cerevisiae
atatcattttatcgtccttgtccaa

SEQ ID NO: 2239 - DNA, 25 bp, S. cerevisiae
atatcattacctgcttttaccaaag

SEQ ID NO: 2240 - DNA, 25 bp, S. cerevisiae
atattgtagcggtgtttatccagga

SEQ ID NO: 2241 - DNA, 25 bp, S. cerevisiae
atttggctggagttattgcacacac

SEQ ID NO: 2242 - DNA, 25 bp, S. cerevisiae
atttggtccaatgctggctcacaaa

SEQ ID NO: 2243 - DNA, 25 bp, S. cerevisiae
atataactctctgtctatctgggct

SEQ ID NO: 2244 - DNA, 25 bp, S. cerevisiae
atctgacactttgttcttgggtaac

SEQ ID NO: 2245 - DNA, 25 bp, S. cerevisiae
atatcacttgggatccatctggtag

SEQ ID NO: 2246 - DNA, 25 bp, S. cerevisiae
atatacccacaaattgcccatcgaa

SEQ ID NO: 2247 - DNA, 25 bp, S. cerevisiae
atatatacaaccatgccttctgctg

SEQ ID NO: 2248 - DNA, 25 bp, S. cerevisiae
atatatacgggcagcagcaccagct

SEQ ID NO: 2249 - DNA, 25 bp, S. cerevisiae
atattggatggtgcccattctggtg

SEQ ID NO: 2250 - DNA, 25 bp, S. cerevisiae
atatcggtgtttccaactttgctgt

SEQ ID NO: 2251 - DNA, 25 bp, S. cerevisiae
atattcgtatttcaagcccctttca

SEQ ID NO: 2252 - DNA, 25 bp, S. cerevisiae
atattcccatcaaaagggctctttt

SEQ ID NO: 2253 - DNA, 25 bp, S. cerevisiae
atatcccctctggaattgttgtttc

SEQ ID NO: 2254 - DNA, 25 bp, S. cerevisiae
atatcggttgctggaatttggcatt

SEQ ID NO: 2255 - DNA, 25 bp, S. cerevisiae
atatctactgatgaactcgtcggtt

SEQ ID NO: 2256 - DNA, 25 bp, S. cerevisiae
atatcatcttgacaccacacattgg

SEQ ID NO: 2257 - DNA, 25 bp, S. cerevisiae
atatgcatccaagagctcatccaaa

SEQ ID NO: 2258 - DNA, 25 bp, S. cerevisiae
atatcagcactaacaaacaaaacaa

SEQ ID NO: 2259 - DNA, 25 bp, S. cerevisiae
atatgaaccttccaacaaaactgag

SEQ ID NO: 2260 - DNA, 25 bp, S. cerevisiae
atattagcagctccttagaagttgt

SEQ ID NO: 2261 - DNA, 25 bp, S. cerevisiae
atattgactggccttccaacatagg

SEQ ID NO: 2262 - DNA, 25 bp, S. cerevisiae
atttggcatatgcttcacccagaga

SEQ ID NO: 2263 - DNA, 25 bp, S. cerevisiae
atatcattgaattcgtcccaccaga

SEQ ID NO: 2264 - DNA, 25 bp, S. cerevisiae
atatacttaccctaccaccacatgc

SEQ ID NO: 2265 - DNA, 25 bp, S. cerevisiae
atataatattccctacatcaccaac

SEQ ID NO: 2266 - DNA, 25 bp, S. cerevisiae
atagatctggtcgtacggcccgtgc

SEQ ID NO: 2267 - DNA, 25 bp, S. cerevisiae
atatactggtgactatggtccccat

SEQ ID NO: 2268 - DNA, 25 bp, S. cerevisiae
atattcgacatgttctgttgcagtg

SEQ ID NO: 2269 - DNA, 25 bp, S. cerevisiae
atattctgagtattctgggcgtttt

SEQ ID NO: 2270 - DNA, 25 bp, S. cerevisiae
atatgaggatctgttcccgttgtct

SEQ ID NO: 2271 - DNA, 25 bp, S. cerevisiae
atatgcttctgcagatggatccaag

SEQ ID NO: 2272 - DNA, 25 bp, S. cerevisiae
atatgccaaggccatgtatccattg

SEQ ID NO: 2273 - DNA, 25 bp, S. cerevisiae
atatagatcgcaccctgacgcattt

SEQ ID NO: 2274 - DNA, 25 bp, S. cerevisiae
atatagctagcaccagtgaacatct

SEQ ID NO: 2275 - DNA, 25 bp, S. cerevisiae
ataggtcgaattctgcacataggtc

SEQ ID NO: 2276 - DNA, 25 bp, S. cerevisiae
atcaggtccagttgcgtacaagggc

SEQ ID NO: 2277 - DNA, 25 bp, S. cerevisiae
atattctcctgctgtttggtttaac

SEQ ID NO: 2278 - DNA, 25 bp, S. cerevisiae
atattctcgatgtgctacgcctttc

SEQ ID NO: 2279 - DNA, 25 bp, S. cerevisiae
atatagcagttactccactccattt

SEQ ID NO: 2280 - DNA, 25 bp, S. cerevisiae
atataccacatatcggctactcctg

SEQ ID NO: 2281 - DNA, 25 bp, S. cerevisiae
atattactcatctcgatctttcctg

SEQ ID NO: 2282 - DNA, 25 bp, S. cerevisiae
atatgggagatcctgccactgtgaa

SEQ ID NO: 2283 - DNA, 25 bp, S. cerevisiae
atagacgagacactgcaacgcttag

SEQ ID NO: 2284 - DNA, 25 bp, S. cerevisiae
atatacgtgcagttatcgctttagg

SEQ ID NO: 2285 - DNA, 25 bp, S. cerevisiae
atatcagggcagttaaatttcgaaa

SEQ ID NO: 2286 - DNA, 25 bp, S. cerevisiae
atatttgggctactggttctataac

SEQ ID NO: 2287 - DNA, 25 bp, S. cerevisiae
atattctcgtctccttatctgtagc

SEQ ID NO: 2288 - DNA, 25 bp, S. cerevisiae
atatttccagttatccgccagctgg

SEQ ID NO: 2289 - DNA, 25 bp, S. cerevisiae
atattgtacaattaggccccaccgg

SEQ ID NO: 2290 - DNA, 25 bp, S. cerevisiae
atataataaaacagccacgccccgt

SEQ ID NO: 2291 - DNA, 25 bp, S. cerevisiae
aaaaaaggacgcagcacgcctcgag

SEQ ID NO: 2292 - DNA, 25 bp, S. cerevisiae
aatggaagcaggaccaaggccaccg

SEQ ID NO: 2293 - DNA, 25 bp, S. cerevisiae
atagtaggagcaggccaagcggcac

SEQ ID NO: 2294 - DNA, 25 bp, S. cerevisiae
atacgattgagcctgcagattcact

SEQ ID NO: 2295 - DNA, 25 bp, S. cerevisiae
atattttggccatattcactgcctt

SEQ ID NO: 2296 - DNA, 25 bp, S. cerevisiae
atattttggcagtgttcaaccctcc

SEQ ID NO: 2297 - DNA, 25 bp, S. cerevisiae
atataagtggcaacgcttcggccct

SEQ ID NO: 2298 - DNA, 25 bp, S. cerevisiae
atataatgatcgatgcagcctcctc

SEQ ID NO: 2299 - DNA, 25 bp, S. cerevisiae
atatgtactagaagagcccactcct

SEQ ID NO: 2300 - DNA, 25 bp, S. cerevisiae
atattatcatcgtcggtggcactac

SEQ ID NO: 2301 - DNA, 25 bp, S. cerevisiae
atatagtgattctttgccgctacgg

SEQ ID NO: 2302 - DNA, 25 bp, S. cerevisiae
atatttgtccatttacgttcgtgat

SEQ ID NO: 2303 - DNA, 25 bp, S. cerevisiae
atatgttccaagaaagtgttctgct

SEQ ID NO: 2304 - DNA, 25 bp, S. cerevisiae
atatttatggattcaagccgcgatg

SEQ ID NO: 2305 - DNA, 25 bp, S. cerevisiae
atattttggcatttccctgcagctg

SEQ ID NO: 2306 - DNA, 25 bp, S. cerevisiae
atatttggtcactagctcgatgtct

SEQ ID NO: 2307 - DNA, 25 bp, S. cerevisiae
atatcagggacagggctcagtatta

SEQ ID NO: 2308 - DNA, 25 bp, S. cerevisiae
atatctcgcaaaggtccgttagcca

SEQ ID NO: 2309 - DNA, 25 bp, S. cerevisiae
atattcttcccaatttatgcttcta

SEQ ID NO: 2310 - DNA, 25 bp, S. cerevisiae
atatgtctatcccatctttagcttc

SEQ ID NO: 2311 - DNA, 25 bp, S. cerevisiae
atatctatcacctttcttatcgcaa

SEQ ID NO: 2312 - DNA, 25 bp, S. cerevisiae
atatgtgtcggattcttcttcggcg

SEQ ID NO: 2313 - DNA, 25 bp, S. cerevisiae
atgcattatttgttcctttgggcgg

SEQ ID NO: 2314 - DNA, 25 bp, S. cerevisiae
atatggccaggcttgctcagatgct

SEQ ID NO: 2315 - DNA, 25 bp, S. cerevisiae
atatcacagctgtctagggagcgct

SEQ ID NO: 2316 - DNA, 25 bp, S. cerevisiae
atattatcgctgactacttacctcc

SEQ ID NO: 2317 - DNA, 25 bp, S. cerevisiae
aattttgggcaatcgagtaacgcag

SEQ ID NO: 2318 - DNA, 25 bp, S. cerevisiae
atatttctggcgcttctgatgaaac

SEQ ID NO: 2319 - DNA, 25 bp, S. cerevisiae
atagtaccgaatcacccagacaatg

SEQ ID NO: 2320 - DNA, 25 bp, S. cerevisiae
atagtacccttatcagctggaaata

SEQ ID NO: 2321 - DNA, 25 bp, S. cerevisiae
atcagggtcgaaagagcccaatttc

SEQ ID NO: 2322 - DNA, 25 bp, S. cerevisiae
atatcagtgtcgaatctagcccttc

SEQ ID NO: 2323 - DNA, 25 bp, S. cerevisiae
atataatcagcttcaccatccttta

SEQ ID NO: 2324 - DNA, 25 bp, S. cerevisiae
atatatatacccacacactctctca

SEQ ID NO: 2325 - DNA, 25 bp, S. cerevisiae
atatatatacccacacactctctca

SEQ ID NO: 2326 - DNA, 25 bp, S. cerevisiae
atatatacccacacactctctcaca

SEQ ID NO: 2327 - DNA, 25 bp, S. cerevisiae
atatacccacacactctctcacatc

SEQ ID NO: 2328 - DNA, 25 bp, S. cerevisiae
atatgttccaagctgctcatccaac

SEQ ID NO: 2329 - DNA, 25 bp, S. cerevisiae
atatttggacaaactgcatcgcgaa

SEQ ID NO: 2330 - DNA, 25 bp, S. cerevisiae
atataccgttgaacattccgcaaag

SEQ ID NO: 2331 - DNA, 25 bp, S. cerevisiae
atagtaaactcattcttggcgtccc

SEQ ID NO: 2332 - DNA, 25 bp, S. cerevisiae
atatgctccttgctatttggcgatg

SEQ ID NO: 2333 - DNA, 25 bp, S. cerevisiae
atatacgattttttccagagccaga

SEQ ID NO: 2334 - DNA, 25 bp, S. cerevisiae
atatatcgggagtttcacaacagca

SEQ ID NO: 2335 - DNA, 25 bp, S. cerevisiae
atattcatattcgtatccaacagag

SEQ ID NO: 2336 - DNA, 25 bp, S. cerevisiae
atataagctgacgatccgcataaag

SEQ ID NO: 2337 - DNA, 25 bp, S. cerevisiae
atatactctttggtgcacatgcagg

SEQ ID NO: 2338 - DNA, 25 bp, S. cerevisiae
atatatgtctatggtctctggcgaa

SEQ ID NO: 2339 - DNA, 25 bp, S. cerevisiae
atatttgcttttacttctcttgtag

SEQ ID NO: 2340 - DNA, 25 bp, S. cerevisiae
ataggttacatttcatcccaggaac

SEQ ID NO: 2341 - DNA, 25 bp, S. cerevisiae
atagtttccaattatcagatcaggc

SEQ ID NO: 2342 - DNA, 25 bp, S. cerevisiae
atatattcggttttcatccgcggcc

SEQ ID NO: 2343 - DNA, 25 bp, S. cerevisiae
ataacgacgactatcctgaacttga

SEQ ID NO: 2344 - DNA, 25 bp, S. cerevisiae
atatccgaggaatcttctcaacttg

SEQ ID NO: 2345 - DNA, 25 bp, S. cerevisiae
atatgccgtacaaacttgccaagtt

SEQ ID NO: 2346 - DNA, 25 bp, S. cerevisiae
atagatggtactcagcttccgacga

SEQ ID NO: 2347 - DNA, 25 bp, S. cerevisiae
acgacgatgacgacggtccgaagtt

SEQ ID NO: 2348 - DNA, 25 bp, S. cerevisiae
atagtttctacgctttgttctgctg

SEQ ID NO: 2349 - DNA, 25 bp, S. cerevisiae
atatggtttagacctttttgcgcca

SEQ ID NO: 2350 - DNA, 25 bp, S. cerevisiae
atatatttcctaccgattttgcctc

SEQ ID NO: 2351 - DNA, 25 bp, S. cerevisiae
atatcctacttcagtcttttcacga

SEQ ID NO: 2352 - DNA, 25 bp, S. cerevisiae
ataccaagtcattggtcgtcgttta

SEQ ID NO: 2353 - DNA, 25 bp, S. cerevisiae
atatgaccgctttgttcacgttctt

SEQ ID NO: 2354 - DNA, 25 bp, S. cerevisiae
aggcttctaaggctacaggtgcttc

SEQ ID NO: 2355 - DNA, 25 bp, S. cerevisiae
atagcttctacgtgggagggtatcc

SEQ ID NO: 2356 - DNA, 25 bp, S. cerevisiae
atagcattccacgtagggtcggtca

SEQ ID NO: 2357 - DNA, 25 bp, S. cerevisiae
atatgaatccccaagggtcctgttc

SEQ ID NO: 2358 - DNA, 25 bp, S. cerevisiae
atagaactgtctacctgactgccag

SEQ ID NO: 2359 - DNA, 25 bp, S. cerevisiae
ataaactgccctatgacgccaaagg

SEQ ID NO: 2360 - DNA, 25 bp, S. cerevisiae
atataatggcgcctttacgagaaaa

SEQ ID NO: 2361 - DNA, 25 bp, S. cerevisiae
atattttattgccactccaacaaga

SEQ ID NO: 2362 - DNA, 25 bp, S. cerevisiae
atatccagtattcatccaaacacga

SEQ ID NO: 2363 - DNA, 25 bp, S. cerevisiae
ataggcattacaactcgcaaaacca

SEQ ID NO: 2364 - DNA, 25 bp, S. cerevisiae
atatgcgttgacagtccagcgttgc

SEQ ID NO: 2365 - DNA, 25 bp, S. cerevisiae
atatggcatcatcaaaccggcaatt

SEQ ID NO: 2366 - DNA, 25 bp, S. cerevisiae
atagctgcacatgagtataccggat

SEQ ID NO: 2367 - DNA, 25 bp, S. cerevisiae
atatccagatgtgggcatacctgca

SEQ ID NO: 2368 - DNA, 25 bp, S. cerevisiae
atatgatcaattggactgtcgtcag

SEQ ID NO: 2369 - DNA, 25 bp, S. cerevisiae
agtgaaattctacacgccggtcgac

SEQ ID NO: 2370 - DNA, 25 bp, S. cerevisiae
aggaaattggaagccgccgcccaag

SEQ ID NO: 2371 - DNA, 25 bp, S. cerevisiae
atagagagttgctccagtggtccag

SEQ ID NO: 2372 - DNA, 25 bp, S. cerevisiae
atagtgagtgttcccactggtgcag

SEQ ID NO: 2373 - DNA, 25 bp, S. cerevisiae
atagtgagggcttcgagcgcgacaa

SEQ ID NO: 2374 - DNA, 25 bp, S. cerevisiae
atatggagactcacatgcgatcgaa

SEQ ID NO: 2375 - DNA, 25 bp, S. cerevisiae
atatcaagacgctgacggccaacaa

SEQ ID NO: 2376 - DNA, 25 bp, S. cerevisiae
atatcaatcgtcttagagctgcccc

SEQ ID NO: 2377 - DNA, 25 bp, S. cerevisiae
atatcaaacctttactgatccctcc

SEQ ID NO: 2378 - DNA, 25 bp, S. cerevisiae
atatctactccgaatttgtcctctg

SEQ ID NO: 2379 - DNA, 25 bp, S. cerevisiae
atatcatttcttgggctggttacaa

SEQ ID NO: 2380 - DNA, 25 bp, S. cerevisiae
atatctttcattgcgttatctggca

SEQ ID NO: 2381 - DNA, 25 bp, S. cerevisiae
atacgaggctacctgtttctgagga

SEQ ID NO: 2382 - DNA, 25 bp, S. cerevisiae
atatcgatactagtgctgccttgga

SEQ ID NO: 2383 - DNA, 25 bp, S. cerevisiae
atatttgtgtctccatcgcttacag

SEQ ID NO: 2384 - DNA, 25 bp, S. cerevisiae
atagtagtcttcttcggtacaggtc

SEQ ID NO: 2385 - DNA, 25 bp, S. cerevisiae
atatgtcctctttgtcatggtgtag

SEQ ID NO: 2386 - DNA, 25 bp, S. cerevisiae
atatcatctctcataccacattgta

SEQ ID NO: 2387 - DNA, 25 bp, S. cerevisiae
atagtgctaagcaatgtccgcccta

SEQ ID NO: 2388 - DNA, 25 bp, S. cerevisiae
atatctcttcactgatttccatgga

SEQ ID NO: 2389 - DNA, 25 bp, S. cerevisiae
ataggtatcctgatggttcggtgga

SEQ ID NO: 2390 - DNA, 25 bp, S. cerevisiae
atatgtaacctatttgcactcgaat

SEQ ID NO: 2391 - DNA, 25 bp, S. cerevisiae
atatgtccgtattatcagagattca

SEQ ID NO: 2392 - DNA, 25 bp, S. cerevisiae
atagatgccctagatgacgttaaaa

SEQ ID NO: 2393 - DNA, 25 bp, S. cerevisiae
atagtggctggtcccaaatcggaga

SEQ ID NO: 2394 - DNA, 25 bp, S. cerevisiae
atatcagagttattatccccatcga

SEQ ID NO: 2395 - DNA, 25 bp, S. cerevisiae
atatccaaatccgtctttgccgact

SEQ ID NO: 2396 - DNA, 25 bp, S. cerevisiae
ataccattaccagatttggcggcaa

SEQ ID NO: 2397 - DNA, 25 bp, S. cerevisiae
atatctgtccctgaattcagttcta

SEQ ID NO: 2398 - DNA, 25 bp, S. cerevisiae
atatctacccgatgatctcgactac

SEQ ID NO: 2399 - DNA, 25 bp, S. cerevisiae
atagaccaccaatgatgcttccaac

SEQ ID NO: 2400 - DNA, 25 bp, S. cerevisiae
atatatctcccttgggctgtcagaa

SEQ ID NO: 2401 - DNA, 25 bp, S. cerevisiae
atatatcgtggaacagcgctgtaga

SEQ ID NO: 2402 - DNA, 25 bp, S. cerevisiae
atatgactgtgctaccatcctggag

SEQ ID NO: 2403 - DNA, 25 bp, S. cerevisiae
atatgtcatgattaccttcgccgct

SEQ ID NO: 2404 - DNA, 25 bp, S. cerevisiae
atgagatcagcacatacgtcggcgc

SEQ ID NO: 2405 - DNA, 25 bp, S. cerevisiae
atcgttagcaaccatgactccagta

SEQ ID NO: 2406 - DNA, 25 bp, S. cerevisiae
ataggtcagcattccatatttggtt

SEQ ID NO: 2407 - DNA, 25 bp, S. cerevisiae
atatcccacagcagtatcagcatca

SEQ ID NO: 2408 - DNA, 25 bp, S. cerevisiae
atatcacacaagctgtactgcccat

SEQ ID NO: 2409 - DNA, 25 bp, S. cerevisiae
atataccttataatcctgccacttt

SEQ ID NO: 2410 - DNA, 25 bp, S. cerevisiae
atatacgttatcaccctcaagcgtg

SEQ ID NO: 2411 - DNA, 25 bp, S. cerevisiae
ataacggtacctgtccaagctgtaa

SEQ ID NO: 2412 - DNA, 25 bp, S. cerevisiae
ataatccagtacttggttcggtata

SEQ ID NO: 2413 - DNA, 25 bp, S. cerevisiae
atatgacgcctttttgttcggtgtt

SEQ ID NO: 2414 - DNA, 25 bp, S. cerevisiae
atatcacgtttcttgtttccggtag

SEQ ID NO: 2415 - DNA, 25 bp, S. cerevisiae
atatctccggatacttcagcaactg

SEQ ID NO: 2416 - DNA, 25 bp, S. cerevisiae
atatcactcggaagtggtgctgcaa

SEQ ID NO: 2417 - DNA, 25 bp, S. cerevisiae
atatcacccacaatggttcgtcagg

SEQ ID NO: 2418 - DNA, 25 bp, S. cerevisiae
atatcataacagacaccagcttcct

SEQ ID NO: 2419 - DNA, 25 bp, S. cerevisiae
atgcgtaacagacctcagtaccact

SEQ ID NO: 2420 - DNA, 25 bp, S. cerevisiae
atagttactaccagtatcctcttcc

SEQ ID NO: 2421 - DNA, 25 bp, S. cerevisiae
atatggttctattccgtactcttgt

SEQ ID NO: 2422 - DNA, 25 bp, S. cerevisiae
atatgggtccacttggaggcgatct

SEQ ID NO: 2423 - DNA, 25 bp, S. cerevisiae
atatggcgaaccttagagtgctcta

SEQ ID NO: 2424 - DNA, 25 bp, S. cerevisiae
atatcgcaagcacctttggtcttac

SEQ ID NO: 2425 - DNA, 25 bp, S. cerevisiae
atactggaacgctgggacttgggaa

SEQ ID NO: 2426 - DNA, 25 bp, S. cerevisiae
atagctgggacaccgggacttctag

SEQ ID NO: 2427 - DNA, 25 bp, S. cerevisiae
atatgctaaaactgcgattccaccg

SEQ ID NO: 2428 - DNA, 25 bp, S. cerevisiae
atatcttacaaaagcgcttgcgcga

SEQ ID NO: 2429 - DNA, 25 bp, S. cerevisiae
atatcgctccacataatctcatcga

SEQ ID NO: 2430 - DNA, 25 bp, S. cerevisiae
atatgtttctaccaactcacgactg

SEQ ID NO: 2431 - DNA, 25 bp, S. cerevisiae
atatgacttctggatatgcctcgaa

SEQ ID NO: 2432 - DNA, 25 bp, S. cerevisiae
atatgacctggcctgatgactggac

SEQ ID NO: 2433 - DNA, 25 bp, S. cerevisiae
atatgtctctgaatgccaaggatgg

SEQ ID NO: 2434 - DNA, 25 bp, S. cerevisiae
atatgtctagcaacgccattcaacg

SEQ ID NO: 2435 - DNA, 25 bp, S. cerevisiae
atatgttagcacaaggttcgccagc

SEQ ID NO: 2436 - DNA, 25 bp, S. cerevisiae
atatctttgcctagcgatgttgaca

SEQ ID NO: 2437 - DNA, 25 bp, S. cerevisiae
atgaatttgtagacgctttgaagct

SEQ ID NO: 2438 - DNA, 25 bp, S. cerevisiae
atatgcttttcgctgcttattactc

SEQ ID NO: 2439 - DNA, 25 bp, S. cerevisiae
atatccgttgtatttcactgatcaa

SEQ ID NO: 2440 - DNA, 25 bp, S. cerevisiae
atatcacgttggtctcatccgaaaa

SEQ ID NO: 2441 - DNA, 25 bp, S. cerevisiae
atatcccgtctccttcatataaaga

SEQ ID NO: 2442 - DNA, 25 bp, S. cerevisiae
atatccgagttcatcttcaagaggt

SEQ ID NO: 2443 - DNA, 25 bp, S. cerevisiae
atatccagattactttcctgagtgg

SEQ ID NO: 2444 - DNA, 25 bp, S. cerevisiae
atatccagccgtatcatccgatggg

SEQ ID NO: 2445 - DNA, 25 bp, S. cerevisiae
atatccatggcacaagctcgctata

SEQ ID NO: 2446 - DNA, 25 bp, S. cerevisiae
atatcatgtgtgctttgcatcgaaa

SEQ ID NO: 2447 - DNA, 25 bp, S. cerevisiae
atatcagagtctttgcaatcgtcaa

SEQ ID NO: 2448 - DNA, 25 bp, S. cerevisiae
atatcaacattaacagcggccgaac

SEQ ID NO: 2449 - DNA, 25 bp, S. cerevisiae
atagtggttgacatgctggctagtc

SEQ ID NO: 2450 - DNA, 25 bp, S. cerevisiae
ataggtgttagtgccaccggcggca

SEQ ID NO: 2451 - DNA, 25 bp, S. cerevisiae
atagtggttagtgccatgtccgtgc

SEQ ID NO: 2452 - DNA, 25 bp, S. cerevisiae
atagtggttggtgtactacctgcaa

SEQ ID NO: 2453 - DNA, 25 bp, S. cerevisiae
atgggtagtggcagttcgacttcaa

SEQ ID NO: 2454 - DNA, 25 bp, S. cerevisiae
atatgcttcatgacggacttcttac

SEQ ID NO: 2455 - DNA, 25 bp, S. cerevisiae
ataccattactctcaaccaactact

SEQ ID NO: 2456 - DNA, 25 bp, S. cerevisiae
ataccaaattcccacacctaataat

SEQ ID NO: 2457 - DNA, 25 bp, S. cerevisiae
ataggacaattactgatacccaata

SEQ ID NO: 2458 - DNA, 25 bp, S. cerevisiae
ataggccatttaccagtcatccatt

SEQ ID NO: 2459 - DNA, 25 bp, S. cerevisiae
atatctgaggatgccgtgcgcacaa

SEQ ID NO: 2460 - DNA, 25 bp, S. cerevisiae
atatctgcagggaaggctgccgcca

SEQ ID NO: 2461 - DNA, 25 bp, S. cerevisiae
atagagatgcccgttcttctagaaa

SEQ ID NO: 2462 - DNA, 25 bp, S. cerevisiae
atatcagccgcggatttttgaacaa

SEQ ID NO: 2463 - DNA, 25 bp, S. cerevisiae
atatcgtatctgctggttctttgta

SEQ ID NO: 2464 - DNA, 25 bp, S. cerevisiae
atatcggtcgcattcatttgtttgg

SEQ ID NO: 2465 - DNA, 25 bp, S. cerevisiae
atagtagccacgtcaccgattatag

SEQ ID NO: 2466 - DNA, 25 bp, S. cerevisiae
atagtcccagcgacacaagcattgt

SEQ ID NO: 2467 - DNA, 25 bp, S. cerevisiae
atacgtgttgccgaaactagaggtg

SEQ ID NO: 2468 - DNA, 25 bp, S. cerevisiae
atggtgccgacaatggtaaccccaa

SEQ ID NO: 2469 - DNA, 25 bp, S. cerevisiae
atagcaaaggttttccagactccgc

SEQ ID NO: 2470 - DNA, 25 bp, S. cerevisiae
atatcgctgataaaaggcccttgcc

SEQ ID NO: 2471 - DNA, 25 bp, S. cerevisiae
atagtgtttgttgtacgcttatgta

SEQ ID NO: 2472 - DNA, 25 bp, S. cerevisiae
atatcaggcttttttgcgccgttag

SEQ ID NO: 2473 - DNA, 25 bp, S. cerevisiae
atatctcctggtgaaatcgctggac

SEQ ID NO: 2474 - DNA, 25 bp, S. cerevisiae
atatcgcctgtaagtgaatcattgg

SEQ ID NO: 2475 - DNA, 25 bp, S. cerevisiae
atatcgactgggaggccttgaagca

SEQ ID NO: 2476 - DNA, 25 bp, S. cerevisiae
atacgaaggcagagacgcggacgac

SEQ ID NO: 2477 - DNA, 25 bp, S. cerevisiae
ataccataggtgagtccgtcatcaa

SEQ ID NO: 2478 - DNA, 25 bp, S. cerevisiae
atatgctaaagtttggccgtccgaa

SEQ ID NO: 2479 - DNA, 25 bp, S. cerevisiae
atatgacaaacctgtgccttctcag

SEQ ID NO: 2480 - DNA, 25 bp, S. cerevisiae
atatggatatgtcctttccttccac

SEQ ID NO: 2481 - DNA, 25 bp, S. cerevisiae
atatccatagacattatcactcccc

SEQ ID NO: 2482 - DNA, 25 bp, S. cerevisiae
atatcgtggtggcagctcatacaac

SEQ ID NO: 2483 - DNA, 25 bp, S. cerevisiae
atatgggtgtgaccgcttgcaacaa

SEQ ID NO: 2484 - DNA, 25 bp, S. cerevisiae
atagtgcggctcacctttaacaagc

SEQ ID NO: 2485 - DNA, 25 bp, S. cerevisiae
atagtgcaggctttacagatgtaac

SEQ ID NO: 2486 - DNA, 25 bp, S. cerevisiae
atatggaatgctgctgctgcggtgc

SEQ ID NO: 2487 - DNA, 25 bp, S. cerevisiae
atatgatgatctccccatcagtggt

SEQ ID NO: 2488 - DNA, 25 bp, S. cerevisiae
atagagagctgttgcgatccgtgac

SEQ ID NO: 2489 - DNA, 25 bp, S. cerevisiae
atatgcatctggttggatccgtaag

SEQ ID NO: 2490 - DNA, 25 bp, S. cerevisiae
atatgtgctggctcgtttgttgatt

SEQ ID NO: 2491 - DNA, 25 bp, S. cerevisiae
atatgatcgccctagtgaactgttg

SEQ ID NO: 2492 - DNA, 25 bp, S. cerevisiae
atactccaatcgatcccagtttaag

SEQ ID NO: 2493 - DNA, 25 bp, S. cerevisiae
ataatcaactggatcccctttactt

SEQ ID NO: 2494 - DNA, 25 bp, S. cerevisiae
atagcatcaagctgagtgactccgt

SEQ ID NO: 2495 - DNA, 25 bp, S. cerevisiae
atgagccaagatagcgaggacgatt

SEQ ID NO: 2496 - DNA, 25 bp, S. cerevisiae
atatgtctaatgacgaggccgaaga

SEQ ID NO: 2497 - DNA, 25 bp, S. cerevisiae
atatggaattgttgtccagcccgcg

SEQ ID NO: 2498 - DNA, 25 bp, S. cerevisiae
atagtgattggtttgacgccgtcga

SEQ ID NO: 2499 - DNA, 25 bp, S. cerevisiae
atacttgtttcaagaaggtgttgtc

SEQ ID NO: 2500 - DNA, 25 bp, S. cerevisiae
atacttgtttcaagaaggtgttgtc

SEQ ID NO: 2501 - DNA, 25 bp, S. cerevisiae
atatgatcgtaagtgctgatgcaga

SEQ ID NO: 2502 - DNA, 25 bp, S. cerevisiae
atagaaacaatccagctgcagaatg

SEQ ID NO: 2503 - DNA, 25 bp, S. cerevisiae
atagcacaagcgttcactgcgtcag

SEQ ID NO: 2504 - DNA, 25 bp, S. cerevisiae
atagatacgattccatctgcgtctg

SEQ ID NO: 2505 - DNA, 25 bp, S. cerevisiae
atatctgccacgtttgatgaccaag

SEQ ID NO: 2506 - DNA, 25 bp, S. cerevisiae
atatgcccaagattttgcccatcag

SEQ ID NO: 2507 - DNA, 25 bp, S. cerevisiae
atatcgaatagcttctcctcaacag

SEQ ID NO: 2508 - DNA, 25 bp, S. cerevisiae
atatgttttccttacacttcaagaa

SEQ ID NO: 2509 - DNA, 25 bp, S. cerevisiae
ataacgttcgtatcctagatagacg

SEQ ID NO: 2510 - DNA, 25 bp, S. cerevisiae
atctacgtttgttggcgccgacgtc

SEQ ID NO: 2511 - DNA, 25 bp, S. cerevisiae
atatgctgatcttttccgggacttc

SEQ ID NO: 2512 - DNA, 25 bp, S. cerevisiae
atatggtacagctattggcgcaaga

SEQ ID NO: 2513 - DNA, 25 bp, S. cerevisiae
atagagtcggactatccacgcaaag

SEQ ID NO: 2514 - DNA, 25 bp, S. cerevisiae
ataggtacccacaaacgccgatgag

SEQ ID NO: 2515 - DNA, 25 bp, S. cerevisiae
atatcctacgccctaacgagcaatt

SEQ ID NO: 2516 - DNA, 25 bp, S. cerevisiae
agacttgtcgcacctaagccaaaaa

SEQ ID NO: 2517 - DNA, 25 bp, S. cerevisiae
atatgtgtgcgatactagctggcat

SEQ ID NO: 2518 - DNA, 25 bp, S. cerevisiae
atatgcttccaaggtcacgtgcact

SEQ ID NO: 2519 - DNA, 25 bp, S. cerevisiae
atatccatatgttctgttgtcacag

SEQ ID NO: 2520 - DNA, 25 bp, S. cerevisiae
ataggctacttcactcaacatcatg

SEQ ID NO: 2521 - DNA, 25 bp, S. cerevisiae
atagtctacaacaacgtccgcatgg

SEQ ID NO: 2522 - DNA, 25 bp, S. cerevisiae
atatccgacataggtctgttcgatt

SEQ ID NO: 2523 - DNA, 25 bp, S. cerevisiae
atatcctgacgctgatttaccttga

SEQ ID NO: 2524 - DNA, 25 bp, S. cerevisiae
atatggctgacacgtgtggtacgct

SEQ ID NO: 2525 - DNA, 25 bp, S. cerevisiae
atatggatggcactggtgtttccag

SEQ ID NO: 2526 - DNA, 25 bp, S. cerevisiae
atatgcgttgactctgttgctgaaa

SEQ ID NO: 2527 - DNA, 25 bp, S. cerevisiae
atatgctaatgatcctgttctgcta

SEQ ID NO: 2528 - DNA, 25 bp, S. cerevisiae
atatgctcctattgtcattgtcgct

SEQ ID NO: 2529 - DNA, 25 bp, S. cerevisiae
ataattcaattattcccggccctat

SEQ ID NO: 2530 - DNA, 25 bp, S. cerevisiae
atgaatctaaataaaccgtcccaat

SEQ ID NO: 2531 - DNA, 25 bp, S. cerevisiae
atactcaagaaaacctcgtcaccgt

SEQ ID NO: 2532 - DNA, 25 bp, S. cerevisiae
atatgggtagcccttcagcagcatc

SEQ ID NO: 2533 - DNA, 25 bp, S. cerevisiae
atagcggtactcctcataatcataa

SEQ ID NO: 2534 - DNA, 25 bp, S. cerevisiae
atagcgttactttaagcaatgatca

SEQ ID NO: 2535 - DNA, 25 bp, S. cerevisiae
ataggagccctccaatgttacaact

SEQ ID NO: 2536 - DNA, 25 bp, S. cerevisiae
atagcaaccgctactggaactcttt

SEQ ID NO: 2537 - DNA, 25 bp, S. cerevisiae
atgaatcgtcgtggcggtaacttcg

SEQ ID NO: 2538 - DNA, 25 bp, S. cerevisiae
atacttgctgttgccgataacttct

SEQ ID NO: 2539 - DNA, 25 bp, S. cerevisiae
atacgaagttgttgtgttcacggca

SEQ ID NO: 2540 - DNA, 25 bp, S. cerevisiae
atatcctccaagaccagtacactaa

SEQ ID NO: 2541 - DNA, 25 bp, S. cerevisiae
atatcgcccaaaaagcatgcaattg

SEQ ID NO: 2542 - DNA, 25 bp, S. cerevisiae
atatgccgccattaaacgtgattat

SEQ ID NO: 2543 - DNA, 25 bp, S. cerevisiae
atatccaaactactgcgtgagcatg

SEQ ID NO: 2544 - DNA, 25 bp, S. cerevisiae
atatcccatggcaactggacagtgc

SEQ ID NO: 2545 - DNA, 25 bp, S. cerevisiae
atatcccatggctactggaccagta

SEQ ID NO: 2546 - DNA, 25 bp, S. cerevisiae
atatgcgttggccaaggaacagcta

SEQ ID NO: 2547 - DNA, 25 bp, S. cerevisiae
atatccctgggctggaaataccgag

SEQ ID NO: 2548 - DNA, 25 bp, S. cerevisiae
atacctcgaggtgggaaatgtccga

SEQ ID NO: 2549 - DNA, 25 bp, S. cerevisiae
atagctgccgagagagggttccctg

SEQ ID NO: 2550 - DNA, 25 bp, S. cerevisiae
atagagctgctcaacgaattattcg

SEQ ID NO: 2551 - DNA, 25 bp, S. cerevisiae
atagaggcacatccaattttttgag

SEQ ID NO: 2552 - DNA, 25 bp, S. cerevisiae
atagcacgtcccttgtttcttgtgg

SEQ ID NO: 2553 - DNA, 25 bp, S. cerevisiae
atacctgatgtagagctaagccatg

SEQ ID NO: 2554 - DNA, 25 bp, S. cerevisiae
atatgccttctacacttagccaatg

SEQ ID NO: 2555 - DNA, 25 bp, S. cerevisiae
atagggttcaagtcttatccgatga

SEQ ID NO: 2556 - DNA, 25 bp, S. cerevisiae
atagggtccatagcttgcttcggga

SEQ ID NO: 2557 - DNA, 25 bp, S. cerevisiae
atagctttgggatctttgccgggac

SEQ ID NO: 2558 - DNA, 25 bp, S. cerevisiae
atacgttcgaattgcattgctccag

SEQ ID NO: 2559 - DNA, 25 bp, S. cerevisiae
atcagcgtccggatacattaacgat

SEQ ID NO: 2560 - DNA, 25 bp, S. cerevisiae
atcaggtgccggctaaggacaaact

SEQ ID NO: 2561 - DNA, 25 bp, S. cerevisiae
actccgaatggccaagggattacga

SEQ ID NO: 2562 - DNA, 25 bp, S. cerevisiae
atatcctacatccatttcatttccg

SEQ ID NO: 2563 - DNA, 25 bp, S. cerevisiae
atatccttgtgacttcttttcatcc

SEQ ID NO: 2564 - DNA, 25 bp, S. cerevisiae
atatccacgggttatttttgtctcg

SEQ ID NO: 2565 - DNA, 25 bp, S. cerevisiae
atatgccctccgtaacctatatgag

SEQ ID NO: 2566 - DNA, 25 bp, S. cerevisiae
atagacgccaaacctgcactatttg

SEQ ID NO: 2567 - DNA, 25 bp, S. cerevisiae
atagatcatgacaatagaccaattt

SEQ ID NO: 2568 - DNA, 25 bp, S. cerevisiae
atagtcggctttttagcttcctggc

SEQ ID NO: 2569 - DNA, 25 bp, S. cerevisiae
atatgctggtctattcttctatccg

SEQ ID NO: 2570 - DNA, 25 bp, S. cerevisiae
atagtagtcaacaattcccagagct

SEQ ID NO: 2571 - DNA, 25 bp, S. cerevisiae
atagatacctacatctcctggagca

SEQ ID NO: 2572 - DNA, 25 bp, S. cerevisiae
ataggcgccggatacagcgcgaatt

SEQ ID NO: 2573 - DNA, 25 bp, S. cerevisiae
accaaggttactctgtggacaggtt

SEQ ID NO: 2574 - DNA, 25 bp, S. cerevisiae
atagagcgcccctcatttgataatt

SEQ ID NO: 2575 - DNA, 25 bp, S. cerevisiae
atagtgcgcctcttgatgtgtatga

SEQ ID NO: 2576 - DNA, 25 bp, S. cerevisiae
atagtggtgcttctatgtcgcaggt

SEQ ID NO: 2577 - DNA, 25 bp, S. cerevisiae
atatgagtgcccactgtccatgtgc

SEQ ID NO: 2578 - DNA, 25 bp, S. cerevisiae
atatggcacgtctcattcacagtac

SEQ ID NO: 2579 - DNA, 25 bp, S. cerevisiae
atatgtcgatgaacaatccaagaac

SEQ ID NO: 2580 - DNA, 25 bp, S. cerevisiae
atatgtcgatgaacaatccaagaac

SEQ ID NO: 2581 - DNA, 25 bp, S. cerevisiae
atatggcatggactcaaccgacaag

SEQ ID NO: 2582 - DNA, 25 bp, S. cerevisiae
atatgctctgcaatagatcccaaga

SEQ ID NO: 2583 - DNA, 25 bp, S. cerevisiae
atatgtttgcatactcgccgtttta

SEQ ID NO: 2584 - DNA, 25 bp, S. cerevisiae
atatgtcctgtgtcatttgcttcaa

SEQ ID NO: 2585 - DNA, 25 bp, S. cerevisiae
atatgccctgataccgattaaagcc

SEQ ID NO: 2586 - DNA, 25 bp, S. cerevisiae
atagcgctgctgaagcctctagaga

SEQ ID NO: 2587 - DNA, 25 bp, S. cerevisiae
atagagctgctgcactagcgaagtt

SEQ ID NO: 2588 - DNA, 25 bp, S. cerevisiae
atatgtcttcagatccttcattgga

SEQ ID NO: 2589 - DNA, 25 bp, S. cerevisiae
atcagacgctactaccagttctaac

SEQ ID NO: 2590 - DNA, 25 bp, S. cerevisiae
atcgtccgcaggtggtttagaccta

SEQ ID NO: 2591 - DNA, 25 bp, S. cerevisiae
atcagctactttgcggtttaaccca

SEQ ID NO: 2592 - DNA, 25 bp, S. cerevisiae
atagcgtcgttgtttgtctgtggat

SEQ ID NO: 2593 - DNA, 25 bp, S. cerevisiae
atagcagccggtttttcatgtgtta

SEQ ID NO: 2594 - DNA, 25 bp, S. cerevisiae
atacgccggtattttaacttcatct

SEQ ID NO: 2595 - DNA, 25 bp, S. cerevisiae
atacgcccgatatctcaaataccaa

SEQ ID NO: 2596 - DNA, 25 bp, S. cerevisiae
atactccaccagaagataaacctaa

SEQ ID NO: 2597 - DNA, 25 bp, S. cerevisiae
atacgccacccttatgaaacggaga

SEQ ID NO: 2598 - DNA, 25 bp, S. cerevisiae
ataccaccaacgttcgacaagggag

SEQ ID NO: 2599 - DNA, 25 bp, S. cerevisiae
ataccccaaactttcgaattgccag

SEQ ID NO: 2600 - DNA, 25 bp, S. cerevisiae
atacccactaaattacggtcgcacg

SEQ ID NO: 2601 - DNA, 25 bp, S. cerevisiae
ataccgcttataccaaatgttccag

SEQ ID NO: 2602 - DNA, 25 bp, S. cerevisiae
atagttcagctggtgggttccttta

SEQ ID NO: 2603 - DNA, 25 bp, S. cerevisiae
ataggcaaggcgtacatggcgtgac

SEQ ID NO: 2604 - DNA, 25 bp, S. cerevisiae
atagagctatcgttccgggtgttaa

SEQ ID NO: 2605 - DNA, 25 bp, S. cerevisiae
atagcgttcgtgacctcagggagat

SEQ ID NO: 2606 - DNA, 25 bp, S. cerevisiae
ataggatgctcgtcttactagaaga

SEQ ID NO: 2607 - DNA, 25 bp, S. cerevisiae
ataggactcgtggtcccagaagaaa

SEQ ID NO: 2608 - DNA, 25 bp, S. cerevisiae
atatggtatgttcgtccgatccaca

SEQ ID NO: 2609 - DNA, 25 bp, S. cerevisiae
atagctgcagtgaacaaccctcaag

SEQ ID NO: 2610 - DNA, 25 bp, S. cerevisiae
atagtgcattttctgcagcctcaga

SEQ ID NO: 2611 - DNA, 25 bp, S. cerevisiae
atagccatattccagtatcctcaac

SEQ ID NO: 2612 - DNA, 25 bp, S. cerevisiae
atagtatttctatgggcgtctcata

SEQ ID NO: 2613 - DNA, 25 bp, S. cerevisiae
atatgtgactgttaaggcgaatgtt

SEQ ID NO: 2614 - DNA, 25 bp, S. cerevisiae
atagcgacttgttgtggcgcaaccc

SEQ ID NO: 2615 - DNA, 25 bp, S. cerevisiae
ataccaccagattgcgggaagatac

SEQ ID NO: 2616 - DNA, 25 bp, S. cerevisiae
ataccaccagtatcgatgcgctgag

SEQ ID NO: 2617 - DNA, 25 bp, S. cerevisiae
atactacactggtgttgcttggtaa

SEQ ID NO: 2618 - DNA, 25 bp, S. cerevisiae
atacgacttggtgtggctggctaac

SEQ ID NO: 2619 - DNA, 25 bp, S. cerevisiae
ataccactacgtcaggttctacagt

SEQ ID NO: 2620 - DNA, 25 bp, S. cerevisiae
atacccacggtcaaggatatttcgc

SEQ ID NO: 2621 - DNA, 25 bp, S. cerevisiae
atacgaccggtgctgtgcaaattca

SEQ ID NO: 2622 - DNA, 25 bp, S. cerevisiae
atacgtacggtccttgaacgtgctt

SEQ ID NO: 2623 - DNA, 25 bp, S. cerevisiae
atagatttcgagctaacgctgcaag

SEQ ID NO: 2624 - DNA, 25 bp, S. cerevisiae
atagcattatcgacctttgcgtgaa

SEQ ID NO: 2625 - DNA, 25 bp, S. cerevisiae
atagatcttgggtgtatgcttgtac

SEQ ID NO: 2626 - DNA, 25 bp, S. cerevisiae
atactccttggactgtgacttttca

SEQ ID NO: 2627 - DNA, 25 bp, S. cerevisiae
ataacggttggcacgaactggctct

SEQ ID NO: 2628 - DNA, 25 bp, S. cerevisiae
atagtcttacctgccaaactgagag

SEQ ID NO: 2629 - DNA, 25 bp, S. cerevisiae
ataggctcatttccttatacgctgc

SEQ ID NO: 2630 - DNA, 25 bp, S. cerevisiae
atatggccagattacttgcaacact

SEQ ID NO: 2631 - DNA, 25 bp, S. cerevisiae
atatgtgctcgtttttgaatgccag

SEQ ID NO: 2632 - DNA, 25 bp, S. cerevisiae
ataggtgctatcgttggtcgtttca

SEQ ID NO: 2633 - DNA, 25 bp, S. cerevisiae
ataggattatccaggtgccctctct

SEQ ID NO: 2634 - DNA, 25 bp, S. cerevisiae
ataggttatcaccatactccgtaca

SEQ ID NO: 2635 - DNA, 25 bp, S. cerevisiae
ataggactccttttgcagatccacg

SEQ ID NO: 2636 - DNA, 25 bp, S. cerevisiae
atagtgcccaattcattcagtcctt

SEQ ID NO: 2637 - DNA, 25 bp, S. cerevisiae
ataggcacaaatccatcggttcaaa

SEQ ID NO: 2638 - DNA, 25 bp, S. cerevisiae
atatggcgcccatgacggttaaact

SEQ ID NO: 2639 - DNA, 25 bp, S. cerevisiae
ataggcgcatcctgggaatctaaaa

SEQ ID NO: 2640 - DNA, 25 bp, S. cerevisiae
atagtggcgcctatcagaaccaaaa

SEQ ID NO: 2641 - DNA, 25 bp, S. cerevisiae
atagtggagagatttcgtacagcga

SEQ ID NO: 2642 - DNA, 25 bp, S. cerevisiae
ataaatgctcgatggtgtctataga

SEQ ID NO: 2643 - DNA, 25 bp, S. cerevisiae
ataccatgctcgctaaggctcaagg

SEQ ID NO: 2644 - DNA, 25 bp, S. cerevisiae
ataccactccgattcaccattaggt

SEQ ID NO: 2645 - DNA, 25 bp, S. cerevisiae
atacctcggccattcaagactagtt

SEQ ID NO: 2646 - DNA, 25 bp, S. cerevisiae
ataccagaacctctgccggttgaga

SEQ ID NO: 2647 - DNA, 25 bp, S. cerevisiae
ataccacgacacctgaactgtttga

SEQ ID NO: 2648 - DNA, 25 bp, S. cerevisiae
ataccattggcagaacacgatcgtg

SEQ ID NO: 2649 - DNA, 25 bp, S. cerevisiae
ataccatgtggccaatccactgaca

SEQ ID NO: 2650 - DNA, 25 bp, S. cerevisiae
ataccgcattcgcaactaagctatc

SEQ ID NO: 2651 - DNA, 25 bp, S. cerevisiae
atacccctgacgaactaactactgt

SEQ ID NO: 2652 - DNA, 25 bp, S. cerevisiae
atacaccgtgacatactactgaaca

SEQ ID NO: 2653 - DNA, 25 bp, S. cerevisiae
ataccacctacatacgacgaagctg

SEQ ID NO: 2654 - DNA, 25 bp, S. cerevisiae
ataccgtctcatctactgacaaagg

SEQ ID NO: 2655 - DNA, 25 bp, S. cerevisiae
ataccgttgcagaagtccagactca

SEQ ID NO: 2656 - DNA, 25 bp, S. cerevisiae
atccgctagcacacggttggcttaa

SEQ ID NO: 2657 - DNA, 25 bp, S. cerevisiae
atcacctacctactaagtgccgtaa

SEQ ID NO: 2658 - DNA, 25 bp, S. cerevisiae
ataggctactacaaatcttccctca

SEQ ID NO: 2659 - DNA, 25 bp, S. cerevisiae
atacgcccttgctatgggttacagg

SEQ ID NO: 2660 - DNA, 25 bp, S. cerevisiae
atacctccttgcatgacaggtgtca

SEQ ID NO: 2661 - DNA, 25 bp, S. cerevisiae
atagcaccacagaggcaggagccgt

SEQ ID NO: 2662 - DNA, 25 bp, S. cerevisiae
atcagcgcctcaatcaaaggaacta

SEQ ID NO: 2663 - DNA, 25 bp, S. cerevisiae
atagcgcccgagcacgtgatcaaag

SEQ ID NO: 2664 - DNA, 25 bp, S. cerevisiae
atagcacccgaggtcgttagtacta

SEQ ID NO: 2665 - DNA, 25 bp, S. cerevisiae
ataaccccatggtgattgtggacaa

SEQ ID NO: 2666 - DNA, 25 bp, S. cerevisiae
atacccctaggaacatttgagattg

SEQ ID NO: 2667 - DNA, 25 bp, S. cerevisiae
ataaccttaggttcttccatcttgg

SEQ ID NO: 2668 - DNA, 25 bp, S. cerevisiae
atcaacctcgggaaattctcgtcgg

SEQ ID NO: 2669 - DNA, 25 bp, S. cerevisiae
ataaattagttgttataagcgatgc

SEQ ID NO: 2670 - DNA, 25 bp, S. cerevisiae
atagaaacactacttattacagata

SEQ ID NO: 2671 - DNA, 25 bp, S. cerevisiae
atacctctagcgctggtgatgacga

SEQ ID NO: 2672 - DNA, 25 bp, S. cerevisiae
atacctggagtactggtgcaacccc

SEQ ID NO: 2673 - DNA, 25 bp, S. cerevisiae
atagttctgctattggatgtggtat

SEQ ID NO: 2674 - DNA, 25 bp, S. cerevisiae
atagaattgtgtagaattgcagatt

SEQ ID NO: 2675 - DNA, 25 bp, S. cerevisiae
atacgatgccggtcatatggtgccc

SEQ ID NO: 2676 - DNA, 25 bp, S. cerevisiae
ataggatcgttgtcactgggcactc

SEQ ID NO: 2677 - DNA, 25 bp, S. cerevisiae
ataagtttcagagtggtgggcccag

SEQ ID NO: 2678 - DNA, 25 bp, S. cerevisiae
ataggtcttcacgtatggtggccaa

SEQ ID NO: 2679 - DNA, 25 bp, S. cerevisiae
ataggtcgcccgtattgccattata

SEQ ID NO: 2680 - DNA, 25 bp, S. cerevisiae
atagggccgtctgtatgttgtcaaa

SEQ ID NO: 2681 - DNA, 25 bp, S. cerevisiae
ataccagccttccaacttctgtaaa

SEQ ID NO: 2682 - DNA, 25 bp, S. cerevisiae
atagtactcttgaggctcttctact

SEQ ID NO: 2683 - DNA, 25 bp, S. cerevisiae
atacgcttcgagatggtctgcggct

SEQ ID NO: 2684 - DNA, 25 bp, S. cerevisiae
atacgcattcagtatgtcccgctag

SEQ ID NO: 2685 - DNA, 25 bp, S. cerevisiae
atacctgctgtaatatgcccgtggg

SEQ ID NO: 2686 - DNA, 25 bp, S. cerevisiae
atagtgatggctacgatggctctgt

SEQ ID NO: 2687 - DNA, 25 bp, S. cerevisiae
atagtctctgctcatagaactccac

SEQ ID NO: 2688 - DNA, 25 bp, S. cerevisiae
atagggcactggcaattcaccacac

SEQ ID NO: 2689 - DNA, 25 bp, S. cerevisiae
atagactggccatgttcttgaccga

SEQ ID NO: 2690 - DNA, 25 bp, S. cerevisiae
ataggctcagatcgctcttttacaa

SEQ ID NO: 2691 - DNA, 25 bp, S. cerevisiae
atacgccaacagcttttaactcaca

SEQ ID NO: 2692 - DNA, 25 bp, S. cerevisiae
atacggaatctactccattaaggag

SEQ ID NO: 2693 - DNA, 25 bp, S. cerevisiae
atacggcaactcaaacttcggaggt

SEQ ID NO: 2694 - DNA, 25 bp, S. cerevisiae
atagggatcctcagcctttgaagag

SEQ ID NO: 2695 - DNA, 25 bp, S. cerevisiae
atagggaaccttgcttgcagacaga

SEQ ID NO: 2696 - DNA, 25 bp, S. cerevisiae
ataccttagagatgatgcgcttttg

SEQ ID NO: 2697 - DNA, 25 bp, S. cerevisiae
atgaaccaatagtctccgaacgaat

SEQ ID NO: 2698 - DNA, 25 bp, S. cerevisiae
ataaactatacctcgaatacaaaag

SEQ ID NO: 2699 - DNA, 25 bp, S. cerevisiae
gtcaaggttacctcaacgtactaag

SEQ ID NO: 2700 - DNA, 25 bp, S. cerevisiae
atcaacctaacctgcaacttacaag

SEQ ID NO: 2701 - DNA, 25 bp, S. cerevisiae
atagggataaccttgctacatggta

SEQ ID NO: 2702 - DNA, 25 bp, S. cerevisiae
atagtgaattcccactgaccagctt

SEQ ID NO: 2703 - DNA, 25 bp, S. cerevisiae
atagtggcatattcggagtcccttg

SEQ ID NO: 2704 - DNA, 25 bp, S. cerevisiae
atagctgtcatatcggttttcttgt

SEQ ID NO: 2705 - DNA, 25 bp, S. cerevisiae
ataccaacaactagtcatacagatt

SEQ ID NO: 2706 - DNA, 25 bp, S. cerevisiae
atagctcattgaacgcttcatccga

SEQ ID NO: 2707 - DNA, 25 bp, S. cerevisiae
atagatgtatttatggtcagccttc

SEQ ID NO: 2708 - DNA, 25 bp, S. cerevisiae
atagctctgctatcgagacaacgta

SEQ ID NO: 2709 - DNA, 25 bp, S. cerevisiae
atagctcttagctgggcaagttcaa

SEQ ID NO: 2710 - DNA, 25 bp, S. cerevisiae
atagtttgccctttgagtatccaca

SEQ ID NO: 2711 - DNA, 25 bp, S. cerevisiae
atagatggtgcccttgtggtcacca

SEQ ID NO: 2712 - DNA, 25 bp, S. cerevisiae
atacgtaccgttaagtctcaagcaa

SEQ ID NO: 2713 - DNA, 25 bp, S. cerevisiae
atacgataccgttcccggacatcaa

SEQ ID NO: 2714 - DNA, 25 bp, S. cerevisiae
atacattatgcggtactcccgacta

SEQ ID NO: 2715 - DNA, 25 bp, S. cerevisiae
atactccaactttttgttcgtgcca

SEQ ID NO: 2716 - DNA, 25 bp, S. cerevisiae
atacttcccctagtgtgttgtacca

SEQ ID NO: 2717 - DNA, 25 bp, S. cerevisiae
atactgcttgcgttttgattaataa

SEQ ID NO: 2718 - DNA, 25 bp, S. cerevisiae
atactgtaggccctgctactgctaa

SEQ ID NO: 2719 - DNA, 25 bp, S. cerevisiae
atagggaggacgaccagctgctgaa

SEQ ID NO: 2720 - DNA, 25 bp, S. cerevisiae
atagaaaggcagctccacgttttgg

SEQ ID NO: 2721 - DNA, 25 bp, S. cerevisiae
ataatacccgatgtcagcaagtccc

SEQ ID NO: 2722 - DNA, 25 bp, S. cerevisiae
atagctacatcgctcttcaaaggcc

SEQ ID NO: 2723 - DNA, 25 bp, S. cerevisiae
atagtgacaggccttgtctacgctc

SEQ ID NO: 2724 - DNA, 25 bp, S. cerevisiae
atgtaacatcggtgtcggccaagtc

SEQ ID NO: 2725 - DNA, 25 bp, S. cerevisiae
atagagacgggagttccacctctgc

SEQ ID NO: 2726 - DNA, 25 bp, S. cerevisiae
atagcccggacagatcgacttatgc

SEQ ID NO: 2727 - DNA, 25 bp, S. cerevisiae
atagaccgtattcatgcgactttcc

SEQ ID NO: 2728 - DNA, 25 bp, S. cerevisiae
atagtatgcttttttgcccatgtcc

SEQ ID NO: 2729 - DNA, 25 bp, S. cerevisiae
atagtagccttcattgcctggtaca

SEQ ID NO: 2730 - DNA, 25 bp, S. cerevisiae
atacccttttgattgcctgtttatg

SEQ ID NO: 2731 - DNA, 25 bp, S. cerevisiae
atagcgttatgacaacccctactag

SEQ ID NO: 2732 - DNA, 25 bp, S. cerevisiae
atgactttagatcaaacgctttcga

SEQ ID NO: 2733 - DNA, 25 bp, S. cerevisiae
ataccctgcattcaagtccgttaag

SEQ ID NO: 2734 - DNA, 25 bp, S. cerevisiae
atagaaattgtccagcgtactccgg

SEQ ID NO: 2735 - DNA, 25 bp, S. cerevisiae
atagacagaagtacagcgccctccg

SEQ ID NO: 2736 - DNA, 25 bp, S. cerevisiae
atagaagaggttctgccctttggct

SEQ ID NO: 2737 - DNA, 25 bp, S. cerevisiae
atagaaacgtcgcagccctcaggag

SEQ ID NO: 2738 - DNA, 25 bp, S. cerevisiae
ataacgtcccaggtcacagtggaaa

SEQ ID NO: 2739 - DNA, 25 bp, S. cerevisiae
ataagatcatcaccggtgcctgggc

SEQ ID NO: 2740 - DNA, 25 bp, S. cerevisiae
atcactaaagggtttatgcctccgt

SEQ ID NO: 2741 - DNA, 25 bp, S. cerevisiae
atacccagaggttgatttgccttag

SEQ ID NO: 2742 - DNA, 25 bp, S. cerevisiae
ataacggagttatgattgcccaagc

SEQ ID NO: 2743 - DNA, 25 bp, S. cerevisiae
ataaagttttccttatcacccagca

SEQ ID NO: 2744 - DNA, 25 bp, S. cerevisiae
atacgagttttccatgatagaccaa

SEQ ID NO: 2745 - DNA, 25 bp, S. cerevisiae
atacgtctttcttgtggaccagcag

SEQ ID NO: 2746 - DNA, 25 bp, S. cerevisiae
atagatcatcattaccggtggcaga

SEQ ID NO: 2747 - DNA, 25 bp, S. cerevisiae
atacttgcaacaggcggtgacgacg

SEQ ID NO: 2748 - DNA, 25 bp, S. cerevisiae
atagcgccattgactactcatgtga

SEQ ID NO: 2749 - DNA, 25 bp, S. cerevisiae
atactgttactggagctcatgctat

SEQ ID NO: 2750 - DNA, 25 bp, S. cerevisiae
atagttgggcatggcagctctgtaa

SEQ ID NO: 2751 - DNA, 25 bp, S. cerevisiae
atactgctgcagttttggactggct

SEQ ID NO: 2752 - DNA, 25 bp, S. cerevisiae
atactgcggcgtgtgcgacgtctat

SEQ ID NO: 2753 - DNA, 25 bp, S. cerevisiae
atactaactgctgtatggcccctgt

SEQ ID NO: 2754 - DNA, 25 bp, S. cerevisiae
atagcacaaacgctctgggtccgat

SEQ ID NO: 2755 - DNA, 25 bp, S. cerevisiae
atagccataagtccctgggccaatg

SEQ ID NO: 2756 - DNA, 25 bp, S. cerevisiae
atagcgcagatgattcctggtatga

SEQ ID NO: 2757 - DNA, 25 bp, S. cerevisiae
atgatgcggtttacgaatcggtccc

SEQ ID NO: 2758 - DNA, 25 bp, S. cerevisiae
atgatgggtactaccgtcggtgtct

SEQ ID NO: 2759 - DNA, 25 bp, S. cerevisiae
atacggtatcccagtcttgagcatt

SEQ ID NO: 2760 - DNA, 25 bp, S. cerevisiae
atactcgtcaccctaggtctagtta

SEQ ID NO: 2761 - DNA, 25 bp, S. cerevisiae
ataccgaacgtgacatggagctttt

SEQ ID NO: 2762 - DNA, 25 bp, S. cerevisiae
atacaatttgcagccattccatggg

SEQ ID NO: 2763 - DNA, 25 bp, S. cerevisiae
atagcaatgtatcccatcacctatg

SEQ ID NO: 2764 - DNA, 25 bp, S. cerevisiae
atagacattattgctgccctttcac

SEQ ID NO: 2765 - DNA, 25 bp, S. cerevisiae
atagaaacaccccttacatgtcaca

SEQ ID NO: 2766 - DNA, 25 bp, S. cerevisiae
atagaaatctctttgttcgcgcagt

SEQ ID NO: 2767 - DNA, 25 bp, S. cerevisiae
atagacatctcattttcccggcatt

SEQ ID NO: 2768 - DNA, 25 bp, S. cerevisiae
atagccatcaagcacgagccatact

SEQ ID NO: 2769 - DNA, 25 bp, S. cerevisiae
atagaccatgacgatagaccaatct

SEQ ID NO: 2770 - DNA, 25 bp, S. cerevisiae
atagcacctattttacctggtcaac

SEQ ID NO: 2771 - DNA, 25 bp, S. cerevisiae
atactatctttgctcagtcctttga

SEQ ID NO: 2772 - DNA, 25 bp, S. cerevisiae
atacgttcaaggtgcggagatcatc

SEQ ID NO: 2773 - DNA, 25 bp, S. cerevisiae
ataactctaacgtcgcaacaggcac

SEQ ID NO: 2774 - DNA, 25 bp, S. cerevisiae
atagactttacgttcactcatccat

SEQ ID NO: 2775 - DNA, 25 bp, S. cerevisiae
atagacacttacttaaccccagaga

SEQ ID NO: 2776 - DNA, 25 bp, S. cerevisiae
ataactgtgcgtctaacggccaaaa

SEQ ID NO: 2777 - DNA, 25 bp, S. cerevisiae
atcagtttccccagctatagtaatc

SEQ ID NO: 2778 - DNA, 25 bp, S. cerevisiae
ataaattgccccttcatgacaaaga

SEQ ID NO: 2779 - DNA, 25 bp, S. cerevisiae
ataccggccccacatgagatactga

SEQ ID NO: 2780 - DNA, 25 bp, S. cerevisiae
atacgaacttggttgcatggttcaa

SEQ ID NO: 2781 - DNA, 25 bp, S. cerevisiae
atacgtacttgacttggtgtgttac

SEQ ID NO: 2782 - DNA, 25 bp, S. cerevisiae
atagcctcggtgctatcaccagatt

SEQ ID NO: 2783 - DNA, 25 bp, S. cerevisiae
atagttgctgctgatgattcatcca

SEQ ID NO: 2784 - DNA, 25 bp, S. cerevisiae
atactattccattgggtggctccgt

SEQ ID NO: 2785 - DNA, 25 bp, S. cerevisiae
ataccactctcattgggagcaactt

SEQ ID NO: 2786 - DNA, 25 bp, S. cerevisiae
atacgctgcttttggctgaaactcc

SEQ ID NO: 2787 - DNA, 25 bp, S. cerevisiae
atacgctaattctcagtacactcca

SEQ ID NO: 2788 - DNA, 25 bp, S. cerevisiae
atacgccagtgacatccttgaggga

SEQ ID NO: 2789 - DNA, 25 bp, S. cerevisiae
atactcctgtatctccataagtgac

SEQ ID NO: 2790 - DNA, 25 bp, S. cerevisiae
atacccatcatttatcggactctac

SEQ ID NO: 2791 - DNA, 25 bp, S. cerevisiae
ataccagtacagttcgcagactcta

SEQ ID NO: 2792 - DNA, 25 bp, S. cerevisiae
ataccgtaacgatttgactgcctct

SEQ ID NO: 2793 - DNA, 25 bp, S. cerevisiae
ataccgacgcacttggctattgaat

SEQ ID NO: 2794 - DNA, 25 bp, S. cerevisiae
ataccgatccatgtgtcagagagaa

SEQ ID NO: 2795 - DNA, 25 bp, S. cerevisiae
atacttcatcaagcgtagccgatat

SEQ ID NO: 2796 - DNA, 25 bp, S. cerevisiae
atagctaccataggcaattcccttt

SEQ ID NO: 2797 - DNA, 25 bp, S. cerevisiae
atagcctctttaatatatttccaag

SEQ ID NO: 2798 - DNA, 25 bp, S. cerevisiae
ataatacttctacatacggccaaac

SEQ ID NO: 2799 - DNA, 25 bp, S. cerevisiae
atagaaacagcacttcttcggccaa

SEQ ID NO: 2800 - DNA, 25 bp, S. cerevisiae
atacgcgaagtttctgggcgtggat

SEQ ID NO: 2801 - DNA, 25 bp, S. cerevisiae
atacggcgccgaatacttgatcaac

SEQ ID NO: 2802 - DNA, 25 bp, S. cerevisiae
atacgctcaccacaacattgacgaa

SEQ ID NO: 2803 - DNA, 25 bp, S. cerevisiae
atcaccatccactccaatagttgaa

SEQ ID NO: 2804 - DNA, 25 bp, S. cerevisiae
atacttggtcttccctatacacatt

SEQ ID NO: 2805 - DNA, 25 bp, S. cerevisiae
atacttactggatgccactgacctt

SEQ ID NO: 2806 - DNA, 25 bp, S. cerevisiae
ataccgtctgaatctgttgactgga

SEQ ID NO: 2807 - DNA, 25 bp, S. cerevisiae
ataccgtctattacgtctactacca

SEQ ID NO: 2808 - DNA, 25 bp, S. cerevisiae
ataccccatcatatcagcattactg

SEQ ID NO: 2809 - DNA, 25 bp, S. cerevisiae
atacgccaactcaacagatccaatt

SEQ ID NO: 2810 - DNA, 25 bp, S. cerevisiae
atacagttccgatcgaatctttaga

SEQ ID NO: 2811 - DNA, 25 bp, S. cerevisiae
ataagggacgcttgagggcatctaa

SEQ ID NO: 2812 - DNA, 25 bp, S. cerevisiae
atcaaagctggcgtcgaggctatca

SEQ ID NO: 2813 - DNA, 25 bp, S. cerevisiae
atacgagatgctcacaggtcttcct

SEQ ID NO: 2814 - DNA, 25 bp, S. cerevisiae
acgacggcagacgatgcgtttccat

SEQ ID NO: 2815 - DNA, 25 bp, S. cerevisiae
atagccggctgtcatggattatctc

SEQ ID NO: 2816 - DNA, 25 bp, S. cerevisiae
atagcacggtggctgagttcttcag

SEQ ID NO: 2817 - DNA, 25 bp, S. cerevisiae
atagctatcgtccttggttctcaag

SEQ ID NO: 2818 - DNA, 25 bp, S. cerevisiae
atacttgcgtggtggatagccctgc

SEQ ID NO: 2819 - DNA, 25 bp, S. cerevisiae
atacttcgtggaacttcaccagtgc

SEQ ID NO: 2820 - DNA, 25 bp, S. cerevisiae
atactttacagacctggcatccagc

SEQ ID NO: 2821 - DNA, 25 bp, S. cerevisiae
atacttaggccagctgcgcacgcag

SEQ ID NO: 2822 - DNA, 25 bp, S. cerevisiae
atactgtacgcatgcttgagctagc

SEQ ID NO: 2823 - DNA, 25 bp, S. cerevisiae
atacgctcatgacatactaccacga

SEQ ID NO: 2824 - DNA, 25 bp, S. cerevisiae
atacctctaatatcatcacatccgg

SEQ ID NO: 2825 - DNA, 25 bp, S. cerevisiae
atactccctcctctaatcatagaag

SEQ ID NO: 2826 - DNA, 25 bp, S. cerevisiae
atactccccgtgactgagatgcaaa

SEQ ID NO: 2827 - DNA, 25 bp, S. cerevisiae
atagctccagaacatctgacccagg

SEQ ID NO: 2828 - DNA, 25 bp, S. cerevisiae
atacggtggcactaaatcagctgat

SEQ ID NO: 2829 - DNA, 25 bp, S. cerevisiae
ataccccagtaaatgccagtgttcc

SEQ ID NO: 2830 - DNA, 25 bp, S. cerevisiae
ataccccagcacgtattgcgatcat

SEQ ID NO: 2831 - DNA, 25 bp, S. cerevisiae
atacagatccgcttgtctcattgat

SEQ ID NO: 2832 - DNA, 25 bp, S. cerevisiae
atagcgcttatggttcattctttaa

SEQ ID NO: 2833 - DNA, 25 bp, S. cerevisiae
ataccgagctttcaatatgttacaa

SEQ ID NO: 2834 - DNA, 25 bp, S. cerevisiae
atgacgggcatttggaattctttcc

SEQ ID NO: 2835 - DNA, 25 bp, S. cerevisiae
atagcatcgttttggacttctctgt

SEQ ID NO: 2836 - DNA, 25 bp, S. cerevisiae
atacgttgacgtggatgacttagaa

SEQ ID NO: 2837 - DNA, 25 bp, S. cerevisiae
atacgttgctggataccgtgctgta

SEQ ID NO: 2838 - DNA, 25 bp, S. cerevisiae
atacctagctcttctaacttctttg

SEQ ID NO: 2839 - DNA, 25 bp, S. cerevisiae
atacctcaggattctcaagtttttg

SEQ ID NO: 2840 - DNA, 25 bp, S. cerevisiae
atcatcccacgatccaaatcatgtt

SEQ ID NO: 2841 - DNA, 25 bp, S. cerevisiae
ataccagcgctatcctacatatgta

SEQ ID NO: 2842 - DNA, 25 bp, S. cerevisiae
ataacggcttgttctaactgtagag

SEQ ID NO: 2843 - DNA, 25 bp, S. cerevisiae
ataaggaccctgatgtaccgcttgt

SEQ ID NO: 2844 - DNA, 25 bp, S. cerevisiae
ataaattcgacttatccaccatcac

SEQ ID NO: 2845 - DNA, 25 bp, S. cerevisiae
ataacgactagcgagatccggaagc

SEQ ID NO: 2846 - DNA, 25 bp, S. cerevisiae
atccacaacccttcaaagcgaaatt

SEQ ID NO: 2847 - DNA, 25 bp, S. cerevisiae
accaaaggccttatatcgatacagt

SEQ ID NO: 2848 - DNA, 25 bp, S. cerevisiae
atagctctattcaacgcattggccc

SEQ ID NO: 2849 - DNA, 25 bp, S. cerevisiae
atacggtttcacgactggttcatca

SEQ ID NO: 2850 - DNA, 25 bp, S. cerevisiae
ataccagttatggtgtgtggcgagt

SEQ ID NO: 2851 - DNA, 25 bp, S. cerevisiae
ataccgcaattgcttatggcagatt

SEQ ID NO: 2852 - DNA, 25 bp, S. cerevisiae
atagcggcacaatgctgtcacgcag

SEQ ID NO: 2853 - DNA, 25 bp, S. cerevisiae
atagcgagcttcaagcttcacctga

SEQ ID NO: 2854 - DNA, 25 bp, S. cerevisiae
atagctggtttacgtgcatctcaaa

SEQ ID NO: 2855 - DNA, 25 bp, S. cerevisiae
atactggagatgtcggagaatccga

SEQ ID NO: 2856 - DNA, 25 bp, S. cerevisiae
atactgctttgctgctgaggacacg

SEQ ID NO: 2857 - DNA, 25 bp, S. cerevisiae
atacgctttccatggaggtgctgtc

SEQ ID NO: 2858 - DNA, 25 bp, S. cerevisiae
atacttgattccagggctatgtgtc

SEQ ID NO: 2859 - DNA, 25 bp, S. cerevisiae
atacttatttgctgggaggatgccc

SEQ ID NO: 2860 - DNA, 25 bp, S. cerevisiae
atacgttaattctgcgattgaccac

SEQ ID NO: 2861 - DNA, 25 bp, S. cerevisiae
atacctcgaatgttacttggactca

SEQ ID NO: 2862 - DNA, 25 bp, S. cerevisiae
ataagtcgttcgcacacgggtcaaa

SEQ ID NO: 2863 - DNA, 25 bp, S. cerevisiae
agaagtccgaacaccaggtcgagtt

SEQ ID NO: 2864 - DNA, 25 bp, S. cerevisiae
acgagccaggcagcaacgaggtcaa

SEQ ID NO: 2865 - DNA, 25 bp, S. cerevisiae
ataagtcaagcatccattggttcag

SEQ ID NO: 2866 - DNA, 25 bp, S. cerevisiae
ataccgccggttccaattctgataa

SEQ ID NO: 2867 - DNA, 25 bp, S. cerevisiae
ataccccgttgcaccatgtggagga

SEQ ID NO: 2868 - DNA, 25 bp, S. cerevisiae
ataaaactcttgagccaggcgagga

SEQ ID NO: 2869 - DNA, 25 bp, S. cerevisiae
aaaaatccaatgaggagggcggtgc

SEQ ID NO: 2870 - DNA, 25 bp, S. cerevisiae
atcatccctacgaccctgaaaagga

SEQ ID NO: 2871 - DNA, 25 bp, S. cerevisiae
atcaccacaaccacgtttcaaggac

SEQ ID NO: 2872 - DNA, 25 bp, S. cerevisiae
atcgtattcaccacgttctaacgtt

SEQ ID NO: 2873 - DNA, 25 bp, S. cerevisiae
atcgtactcctcatcgtttatggct

SEQ ID NO: 2874 - DNA, 25 bp, S. cerevisiae
atacgtccgagatttttgtctagta

SEQ ID NO: 2875 - DNA, 25 bp, S. cerevisiae
atacgcagctcattcttactggctt

SEQ ID NO: 2876 - DNA, 25 bp, S. cerevisiae
atacgcttctaaacacgtttcgccg

SEQ ID NO: 2877 - DNA, 25 bp, S. cerevisiae
ataatccttcaaacggttctcgcaa

SEQ ID NO: 2878 - DNA, 25 bp, S. cerevisiae
atacctgttcaagtgcggcttcgaa

SEQ ID NO: 2879 - DNA, 25 bp, S. cerevisiae
atacctgtattagtctgctgcgaaa

SEQ ID NO: 2880 - DNA, 25 bp, S. cerevisiae
atactcacgtgggttttatgtcctc

SEQ ID NO: 2881 - DNA, 25 bp, S. cerevisiae
atgagcaaacggctactggtctctt

SEQ ID NO: 2882 - DNA, 25 bp, S. cerevisiae
atgggaaacggctatcggacctctt

SEQ ID NO: 2883 - DNA, 25 bp, S. cerevisiae
atgacgaaacggtacctgtcccatt

SEQ ID NO: 2884 - DNA, 25 bp, S. cerevisiae
ataagacccggagacatgtcacctt

SEQ ID NO: 2885 - DNA, 25 bp, S. cerevisiae
atacaactggcgctttggacaccct

SEQ ID NO: 2886 - DNA, 25 bp, S. cerevisiae
ataaatagcgctgagattgccttca

SEQ ID NO: 2887 - DNA, 25 bp, S. cerevisiae
ataccacatgcgttgaggctctcca

SEQ ID NO: 2888 - DNA, 25 bp, S. cerevisiae
atacctatgaatacaggccatccaa

SEQ ID NO: 2889 - DNA, 25 bp, S. cerevisiae
atacgcagtcaaacacaccagcaaa

SEQ ID NO: 2890 - DNA, 25 bp, S. cerevisiae
ataccatctgtttcgttgatgcatt

SEQ ID NO: 2891 - DNA, 25 bp, S. cerevisiae
ataccactggagagctgctgcgatt

SEQ ID NO: 2892 - DNA, 25 bp, S. cerevisiae
atacctctgtgatcctgcagggcat

SEQ ID NO: 2893 - DNA, 25 bp, S. cerevisiae
atacctctcatattcacgctgtgga

SEQ ID NO: 2894 - DNA, 25 bp, S. cerevisiae
atacctccaacagcgcgttgttgaa

SEQ ID NO: 2895 - DNA, 25 bp, S. cerevisiae
ataccccatgatttcggattgatta

SEQ ID NO: 2896 - DNA, 25 bp, S. cerevisiae
atacgcccacgtttatgggatttcg

SEQ ID NO: 2897 - DNA, 25 bp, S. cerevisiae
ataccaaccttttacggtgctgtca

SEQ ID NO: 2898 - DNA, 25 bp, S. cerevisiae
ataccaacacatctatacggccttg

SEQ ID NO: 2899 - DNA, 25 bp, S. cerevisiae
ataccattgactttatagggccgga

SEQ ID NO: 2900 - DNA, 25 bp, S. cerevisiae
atagccattggcgtttctggtgcag

SEQ ID NO: 2901 - DNA, 25 bp, S. cerevisiae
atacttgttgtcctatgggtccttc

SEQ ID NO: 2902 - DNA, 25 bp, S. cerevisiae
ataccattttgcctcaattgaccca

SEQ ID NO: 2903 - DNA, 25 bp, S. cerevisiae
ataacttttcgtctttcggcattgg

SEQ ID NO: 2904 - DNA, 25 bp, S. cerevisiae
ataactatttccacgactcaggtat

SEQ ID NO: 2905 - DNA, 25 bp, S. cerevisiae
atacgcgcttgtaacataccactgg

SEQ ID NO: 2906 - DNA, 25 bp, S. cerevisiae
ataccagatttcttcaagacgcaag

SEQ ID NO: 2907 - DNA, 25 bp, S. cerevisiae
ataccagattccattcaacgacgtc

SEQ ID NO: 2908 - DNA, 25 bp, S. cerevisiae
atacatggttccattgaccaccgtc

SEQ ID NO: 2909 - DNA, 25 bp, S. cerevisiae
ataagcaaactctatccaaatcccc

SEQ ID NO: 2910 - DNA, 25 bp, S. cerevisiae
ataatgaaccctacagtgcaaccgc

SEQ ID NO: 2911 - DNA, 25 bp, S. cerevisiae
ataatttacctgaactaatggctgg

SEQ ID NO: 2912 - DNA, 25 bp, S. cerevisiae
ataccttacgcatttctactgttgg

SEQ ID NO: 2913 - DNA, 25 bp, S. cerevisiae
ataccatggtgtttcctcagactac

SEQ ID NO: 2914 - DNA, 25 bp, S. cerevisiae
atacctgctagagtttgccgacgac

SEQ ID NO: 2915 - DNA, 25 bp, S. cerevisiae
atacgtctctggatctacagtgcaa

SEQ ID NO: 2916 - DNA, 25 bp, S. cerevisiae
acactgaaggtttcggcgatggtta

SEQ ID NO: 2917 - DNA, 25 bp, S. cerevisiae
atctcgaaggttgctttggtttgac

SEQ ID NO: 2918 - DNA, 25 bp, S. cerevisiae
atccgaacggttgctatgtgtttac

SEQ ID NO: 2919 - DNA, 25 bp, S. cerevisiae
atacgatccgcgtctggtagattgt

SEQ ID NO: 2920 - DNA, 25 bp, S. cerevisiae
atacgtatacttttttccattggca

SEQ ID NO: 2921 - DNA, 25 bp, S. cerevisiae
atacctatgcagtcacttctttttt

SEQ ID NO: 2922 - DNA, 25 bp, S. cerevisiae
atacccctatgaatgaacttccctc

SEQ ID NO: 2923 - DNA, 25 bp, S. cerevisiae
atacctgtatccattttatgctatt

SEQ ID NO: 2924 - DNA, 25 bp, S. cerevisiae
ataccattatttcctcttctgttta

SEQ ID NO: 2925 - DNA, 25 bp, S. cerevisiae
atacctgccatattaacgtttctaa

SEQ ID NO: 2926 - DNA, 25 bp, S. cerevisiae
ataaccggcttgtggatgattcctt

SEQ ID NO: 2927 - DNA, 25 bp, S. cerevisiae
ataacaacgttctggcattgccttt

SEQ ID NO: 2928 - DNA, 25 bp, S. cerevisiae
ataccgtgatattgtgttggctcgt

SEQ ID NO: 2929 - DNA, 25 bp, S. cerevisiae
atacgctccatctacatatgctgac

SEQ ID NO: 2930 - DNA, 25 bp, S. cerevisiae
atacctctctatacagcttattctg

SEQ ID NO: 2931 - DNA, 25 bp, S. cerevisiae
ataagacccataggccttgtggatt

SEQ ID NO: 2932 - DNA, 25 bp, S. cerevisiae
ataaagcctcctgctcttttacata

SEQ ID NO: 2933 - DNA, 25 bp, S. cerevisiae
atacaaccagttgccattcttgaaa

SEQ ID NO: 2934 - DNA, 25 bp, S. cerevisiae
atacaaccgtcattttcctcgaaag

SEQ ID NO: 2935 - DNA, 25 bp, S. cerevisiae
atggcccaactcatttatgtccgag

SEQ ID NO: 2936 - DNA, 25 bp, S. cerevisiae
ataccgagtatcaaggaccaaccga

SEQ ID NO: 2937 - DNA, 25 bp, S. cerevisiae
ataacggcctctcagagtcgaccaa

SEQ ID NO: 2938 - DNA, 25 bp, S. cerevisiae
ataacgttgcgctctagattactgc

SEQ ID NO: 2939 - DNA, 25 bp, S. cerevisiae
atacacggtggctatttggtttcta

SEQ ID NO: 2940 - DNA, 25 bp, S. cerevisiae
ataagtctttgcctcaaggaccagc

SEQ ID NO: 2941 - DNA, 25 bp, S. cerevisiae
atacgcgggctccaaagactgtcaa

SEQ ID NO: 2942 - DNA, 25 bp, S. cerevisiae
atacgtccccttacagatttcaaag

SEQ ID NO: 2943 - DNA, 25 bp, S. cerevisiae
atacagtcccgttatcttttcaatc

SEQ ID NO: 2944 - DNA, 25 bp, S. cerevisiae
atactgttctgttgcttctattggc

SEQ ID NO: 2945 - DNA, 25 bp, S. cerevisiae
atacgtgccatatgcttacggtgct

SEQ ID NO: 2946 - DNA, 25 bp, S. cerevisiae
atacactgtgtctgaagctttggaa

SEQ ID NO: 2947 - DNA, 25 bp, S. cerevisiae
atactggcgctggtgaattatccgt

SEQ ID NO: 2948 - DNA, 25 bp, S. cerevisiae
ataatcaagggcctcttctgggatc

SEQ ID NO: 2949 - DNA, 25 bp, S. cerevisiae
ataagggcgggttggctatgccata

SEQ ID NO: 2950 - DNA, 25 bp, S. cerevisiae
atacggatgaggtcggttcagaact

SEQ ID NO: 2951 - DNA, 25 bp, S. cerevisiae
atacgtcaaggtcggctataaagcc

SEQ ID NO: 2952 - DNA, 25 bp, S. cerevisiae
atacttgcaacgtctgtcgtaacgc

SEQ ID NO: 2953 - DNA, 25 bp, S. cerevisiae
atactggccattttgcgcttgaaac

SEQ ID NO: 2954 - DNA, 25 bp, S. cerevisiae
atacaggatcctctcaccgatgaga

SEQ ID NO: 2955 - DNA, 25 bp, S. cerevisiae
atacgtgggcaggacatttatcatg

SEQ ID NO: 2956 - DNA, 25 bp, S. cerevisiae
atacagttgcgagggccgtatcatc

SEQ ID NO: 2957 - DNA, 25 bp, S. cerevisiae
atacgtttctgtctctgttttggtc

SEQ ID NO: 2958 - DNA, 25 bp, S. cerevisiae
atacttttgggcagctctttcaaga

SEQ ID NO: 2959 - DNA, 25 bp, S. cerevisiae
atacttgttgtgtacgccatcttta

SEQ ID NO: 2960 - DNA, 25 bp, S. cerevisiae
atcatcacttagagacccctttttc

SEQ ID NO: 2961 - DNA, 25 bp, S. cerevisiae
aaacctaaaggcaggcttggtagat

SEQ ID NO: 2962 - DNA, 25 bp, S. cerevisiae
aaatgccaaacagcgtacctttaga

SEQ ID NO: 2963 - DNA, 25 bp, S. cerevisiae
ataactcatcaagccgtacttcggt

SEQ ID NO: 2964 - DNA, 25 bp, S. cerevisiae
ataactcatagaccatcgatagctg

SEQ ID NO: 2965 - DNA, 25 bp, S. cerevisiae
ataattcgagctcaccatcaggatc

SEQ ID NO: 2966 - DNA, 25 bp, S. cerevisiae
atacatgcccctaggaaccgagatt

SEQ ID NO: 2967 - DNA, 25 bp, S. cerevisiae
ataagccaagctcctgacaatgcac

SEQ ID NO: 2968 - DNA, 25 bp, S. cerevisiae
ataactcagagctagcttacgaaat

SEQ ID NO: 2969 - DNA, 25 bp, S. cerevisiae
atacagccaactttgttcccagatc

SEQ ID NO: 2970 - DNA, 25 bp, S. cerevisiae
ataaccaactccaatgcgccaaagt

SEQ ID NO: 2971 - DNA, 25 bp, S. cerevisiae
ataacttactcccatgcagctaaag

SEQ ID NO: 2972 - DNA, 25 bp, S. cerevisiae
ataagtattgttgcccacactgtgg

SEQ ID NO: 2973 - DNA, 25 bp, S. cerevisiae
atcactactttggatgcgcaacctg

SEQ ID NO: 2974 - DNA, 25 bp, S. cerevisiae
atcatctcctacaggcgcaatggat

SEQ ID NO: 2975 - DNA, 25 bp, S. cerevisiae
atacatcactgacaaggccgacaag

SEQ ID NO: 2976 - DNA, 25 bp, S. cerevisiae
atacatgcacttcctgtggttacaa

SEQ ID NO: 2977 - DNA, 25 bp, S. cerevisiae
ataccctgtcttagtgttccatcaa

SEQ ID NO: 2978 - DNA, 25 bp, S. cerevisiae
atacccgccattgttgcactataag

SEQ ID NO: 2979 - DNA, 25 bp, S. cerevisiae
atactcacgttatccagctgcaata

SEQ ID NO: 2980 - DNA, 25 bp, S. cerevisiae
atactattgttattgctcatcagca

SEQ ID NO: 2981 - DNA, 25 bp, S. cerevisiae
atactaccttgcagttccattctga

SEQ ID NO: 2982 - DNA, 25 bp, S. cerevisiae
atactaccctcattgtgtgcagcag

SEQ ID NO: 2983 - DNA, 25 bp, S. cerevisiae
atacgaacctcaatgatggcactgt

SEQ ID NO: 2984 - DNA, 25 bp, S. cerevisiae
atacgccgaaggttcactagtcaag

SEQ ID NO: 2985 - DNA, 25 bp, S. cerevisiae
atcaaataccggtcatagcgagatt

SEQ ID NO: 2986 - DNA, 25 bp, S. cerevisiae
ataaactccttggttatgccatcca

SEQ ID NO: 2987 - DNA, 25 bp, S. cerevisiae
atcaaccttcattggtccgtattcg

SEQ ID NO: 2988 - DNA, 25 bp, S. cerevisiae
agcaagaaatctctaccgcgttttg

SEQ ID NO: 2989 - DNA, 25 bp, S. cerevisiae
atactggatgagttcgtctctcctt

SEQ ID NO: 2990 - DNA, 25 bp, S. cerevisiae
atacatgagaacttcgtgcccgcaa

SEQ ID NO: 2991 - DNA, 25 bp, S. cerevisiae
atacgcagaggctggtgcatccgca

SEQ ID NO: 2992 - DNA, 25 bp, S. cerevisiae
atacgcgcaggatgatatgcattac

SEQ ID NO: 2993 - DNA, 25 bp, S. cerevisiae
atcacgtcatgtccttcagtattgt

SEQ ID NO: 2994 - DNA, 25 bp, S. cerevisiae
acacagtctgtctttaaccttggtt

SEQ ID NO: 2995 - DNA, 25 bp, S. cerevisiae
atactacttgtttcaagcagctcat

SEQ ID NO: 2996 - DNA, 25 bp, S. cerevisiae
atacatttgggcctcatattctcgt

SEQ ID NO: 2997 - DNA, 25 bp, S. cerevisiae
ataattaaagcgctatcccgtacaa

SEQ ID NO: 2998 - DNA, 25 bp, S. cerevisiae
ataactcaaggccaataacgcgtaa

SEQ ID NO: 2999 - DNA, 25 bp, S. cerevisiae
ataaacataggcctttccatagtaa

SEQ ID NO: 3000 - DNA, 25 bp, S. cerevisiae
ataaagcaacgtcttcatccgcgaa

SEQ ID NO: 3001 - DNA, 25 bp, S. cerevisiae
ataaagaagccttagccaccggagc

SEQ ID NO: 3002 - DNA, 25 bp, S. cerevisiae
ataaagaacgaaacgcccggcagcg

SEQ ID NO: 3003 - DNA, 25 bp, S. cerevisiae
ataaagacttacagcgcccagtggc

SEQ ID NO: 3004 - DNA, 25 bp, S. cerevisiae
ataaagactgtcgatatcaacggta

SEQ ID NO: 3005 - DNA, 25 bp, S. cerevisiae
ataaatccttccatcacatatgcct

SEQ ID NO: 3006 - DNA, 25 bp, S. cerevisiae
atcacccagtaccatgctagttgta

SEQ ID NO: 3007 - DNA, 25 bp, S. cerevisiae
atcaagccgtacattattttcccca

SEQ ID NO: 3008 - DNA, 25 bp, S. cerevisiae
atcatagggcaagcctgattactcc

SEQ ID NO: 3009 - DNA, 25 bp, S. cerevisiae
ataatgggcagttccaacgcacttc

SEQ ID NO: 3010 - DNA, 25 bp, S. cerevisiae
atacggctatgttgctgtggaacac

SEQ ID NO: 3011 - DNA, 25 bp, S. cerevisiae
atacgagcttgtttggtggatccat

SEQ ID NO: 3012 - DNA, 25 bp, S. cerevisiae
atacatggcattactgggctcaccg

SEQ ID NO: 3013 - DNA, 25 bp, S. cerevisiae
ataatgccattgttgggttccacga

SEQ ID NO: 3014 - DNA, 25 bp, S. cerevisiae
atacactgccagttagcgtggaatt

SEQ ID NO: 3015 - DNA, 25 bp, S. cerevisiae
atacggcttgccattgcagcgagaa

SEQ ID NO: 3016 - DNA, 25 bp, S. cerevisiae
atacggtgtcatcatggcaggcgcc

SEQ ID NO: 3017 - DNA, 25 bp, S. cerevisiae
atcacgggacgtagagcttttatgt

SEQ ID NO: 3018 - DNA, 25 bp, S. cerevisiae
atacaggaaccaagcgtcgtcatct

SEQ ID NO: 3019 - DNA, 25 bp, S. cerevisiae
atactgaaatctacacctcgtgctc

SEQ ID NO: 3020 - DNA, 25 bp, S. cerevisiae
atactgtcattaacacggttgctag

SEQ ID NO: 3021 - DNA, 25 bp, S. cerevisiae
atcgatgggaattgctacgtatgga

SEQ ID NO: 3022 - DNA, 25 bp, S. cerevisiae
atcaaggctgatgaccacgcatctg

SEQ ID NO: 3023 - DNA, 25 bp, S. cerevisiae
cccatttcagtttcggttacaggag

SEQ ID NO: 3024 - DNA, 25 bp, S. cerevisiae
atcacgttagtttcggttattgcca

SEQ ID NO: 3025 - DNA, 25 bp, S. cerevisiae
atcaaagtcattacccttcaacctg

SEQ ID NO: 3026 - DNA, 25 bp, S. cerevisiae
ataacacattaattcagccctcatc

SEQ ID NO: 3027 - DNA, 25 bp, S. cerevisiae
atactcaattgcattagccgtcacc

SEQ ID NO: 3028 - DNA, 25 bp, S. cerevisiae
atactacatgttccaagccgcacac

SEQ ID NO: 3029 - DNA, 25 bp, S. cerevisiae
atactatatgttccaagccgctcat

SEQ ID NO: 3030 - DNA, 25 bp, S. cerevisiae
ataacttcgtctacatgtccgatgt

SEQ ID NO: 3031 - DNA, 25 bp, S. cerevisiae
ataaacgccatcgagcaggatcctg

SEQ ID NO: 3032 - DNA, 25 bp, S. cerevisiae
ataacccagcatatcaggacacttt

SEQ ID NO: 3033 - DNA, 25 bp, S. cerevisiae
atactgtttcaaattggtccctccg

SEQ ID NO: 3034 - DNA, 25 bp, S. cerevisiae
atcaggttaatttctcccaacgagt

SEQ ID NO: 3035 - DNA, 25 bp, S. cerevisiae
ataaggtaaatttcaccggctggat

SEQ ID NO: 3036 - DNA, 25 bp, S. cerevisiae
atacgtgttcttcctgtgcaagcaa

SEQ ID NO: 3037 - DNA, 25 bp, S. cerevisiae
atcatcgtcgtcatggcagtcagga

SEQ ID NO: 3038 - DNA, 25 bp, S. cerevisiae
atacatccattactacctcaagacg

SEQ ID NO: 3039 - DNA, 25 bp, S. cerevisiae
atacttactatgtaccatcctcaca

SEQ ID NO: 3040 - DNA, 25 bp, S. cerevisiae
atactgtattcgatactcccatcac

SEQ ID NO: 3041 - DNA, 25 bp, S. cerevisiae
atactctatcctaatgttcccttta

SEQ ID NO: 3042 - DNA, 25 bp, S. cerevisiae
atactctgtttattaatgccctgga

SEQ ID NO: 3043 - DNA, 25 bp, S. cerevisiae
ataagttggcactgcgttatggagt

SEQ ID NO: 3044 - DNA, 25 bp, S. cerevisiae
atacagttgccactgtcgttggcag

SEQ ID NO: 3045 - DNA, 25 bp, S. cerevisiae
atacatcttccagtgtcagtacgat

SEQ ID NO: 3046 - DNA, 25 bp, S. cerevisiae
atactgcacctccagtagttggtgg

SEQ ID NO: 3047 - DNA, 25 bp, S. cerevisiae
atacatccctaggtatctgggcgga

SEQ ID NO: 3048 - DNA, 25 bp, S. cerevisiae
atacaccgatctgttctcgtgctgg

SEQ ID NO: 3049 - DNA, 25 bp, S. cerevisiae
ataacccctgtattgcaagtgctgc

SEQ ID NO: 3050 - DNA, 25 bp, S. cerevisiae
atacggactcggttatttcaattat

SEQ ID NO: 3051 - DNA, 25 bp, S. cerevisiae
atactgctcatcgtcaatttaaggg

SEQ ID NO: 3052 - DNA, 25 bp, S. cerevisiae
ataaattcattatcacagcctgttg

SEQ ID NO: 3053 - DNA, 25 bp, S. cerevisiae
atactcgctgttttcataatatctt

SEQ ID NO: 3054 - DNA, 25 bp, S. cerevisiae
atacatgcccaatttctacgactta

SEQ ID NO: 3055 - DNA, 25 bp, S. cerevisiae
atacatctacatatgttcccattaa

SEQ ID NO: 3056 - DNA, 25 bp, S. cerevisiae
accagatagcagtgtcgccggagga

SEQ ID NO: 3057 - DNA, 25 bp, S. cerevisiae
atccgtaagggcagccagggcgtta

SEQ ID NO: 3058 - DNA, 25 bp, S. cerevisiae
atccttacaagcgataacgggcgtt

SEQ ID NO: 3059 - DNA, 25 bp, S. cerevisiae
aggctgtggcaactaaacgttcgtt

SEQ ID NO: 3060 - DNA, 25 bp, S. cerevisiae
atcatcttgtgggttttttcagtgg

SEQ ID NO: 3061 - DNA, 25 bp, S. cerevisiae
atacatttccttctgttcttggaga

SEQ ID NO: 3062 - DNA, 25 bp, S. cerevisiae
atcatgccgatctttggtgtcttgt

SEQ ID NO: 3063 - DNA, 25 bp, S. cerevisiae
atacactgtgtcatggctggttctt

SEQ ID NO: 3064 - DNA, 25 bp, S. cerevisiae
ataaccgtccggcaattcagcttta

SEQ ID NO: 3065 - DNA, 25 bp, S. cerevisiae
ataacttgaaggcagagaactctaa

SEQ ID NO: 3066 - DNA, 25 bp, S. cerevisiae
ataactccaacccagataccattaa

SEQ ID NO: 3067 - DNA, 25 bp, S. cerevisiae
ataacccgaattctcatcacttaca

SEQ ID NO: 3068 - DNA, 25 bp, S. cerevisiae
ataaccaaaattactcccgtcgctg

SEQ ID NO: 3069 - DNA, 25 bp, S. cerevisiae
ataacacaaccaaagatcctctgag

SEQ ID NO: 3070 - DNA, 25 bp, S. cerevisiae
atcactggtacttttggtttcgaca

SEQ ID NO: 3071 - DNA, 25 bp, S. cerevisiae
atgaagacgggttacgcctggccaa

SEQ ID NO: 3072 - DNA, 25 bp, S. cerevisiae
ataagagcggctatgaacctggaaa

SEQ ID NO: 3073 - DNA, 25 bp, S. cerevisiae
atactcttgcatttagggctctgcc

SEQ ID NO: 3074 - DNA, 25 bp, S. cerevisiae
ataaccatgcaacaagcgtcgcgct

SEQ ID NO: 3075 - DNA, 25 bp, S. cerevisiae
ataacgaacacaaatggtccgcatt

SEQ ID NO: 3076 - DNA, 25 bp, S. cerevisiae
atacatgccagagcacgtggtccaa

SEQ ID NO: 3077 - DNA, 25 bp, S. cerevisiae
atacacgagatagcggtgctgccca

SEQ ID NO: 3078 - DNA, 25 bp, S. cerevisiae
atactacgcttatctttctcttgta

SEQ ID NO: 3079 - DNA, 25 bp, S. cerevisiae
atactaagcataccacttctcatca

SEQ ID NO: 3080 - DNA, 25 bp, S. cerevisiae
ataagtacagctagcgcatatccgc

SEQ ID NO: 3081 - DNA, 25 bp, S. cerevisiae
ataagagatcatgagcccacggcag

SEQ ID NO: 3082 - DNA, 25 bp, S. cerevisiae
ataactccattgatgctgaagcgat

SEQ ID NO: 3083 - DNA, 25 bp, S. cerevisiae
atactccacgtgaagtgacgccttg

SEQ ID NO: 3084 - DNA, 25 bp, S. cerevisiae
ataacgagatgtgcagtaccctctg

SEQ ID NO: 3085 - DNA, 25 bp, S. cerevisiae
ataacctacatggacctcactgtgg

SEQ ID NO: 3086 - DNA, 25 bp, S. cerevisiae
atacaccaacccattgttcatgcaa

SEQ ID NO: 3087 - DNA, 25 bp, S. cerevisiae
ataacgctacctccagcagatttga

SEQ ID NO: 3088 - DNA, 25 bp, S. cerevisiae
ataactattctcttccgatttgcac

SEQ ID NO: 3089 - DNA, 25 bp, S. cerevisiae
ataaccttcttgactcttctgatga

SEQ ID NO: 3090 - DNA, 25 bp, S. cerevisiae
atacagtgttgttgctcctattata

SEQ ID NO: 3091 - DNA, 25 bp, S. cerevisiae
ataaaaatattctatccttcaacga

SEQ ID NO: 3092 - DNA, 25 bp, S. cerevisiae
ataaagactatcatacctccttccg

SEQ ID NO: 3093 - DNA, 25 bp, S. cerevisiae
ataatcggtctggaacttcgttcaa

SEQ ID NO: 3094 - DNA, 25 bp, S. cerevisiae
atacacgagttttacctacatggaa

SEQ ID NO: 3095 - DNA, 25 bp, S. cerevisiae
ataacactcagtatcacagcgggcc

SEQ ID NO: 3096 - DNA, 25 bp, S. cerevisiae
ataacttattcgaccttcatcctat

SEQ ID NO: 3097 - DNA, 25 bp, S. cerevisiae
ataacgccatttcgatcttcaatct

SEQ ID NO: 3098 - DNA, 25 bp, S. cerevisiae
ataagtgccctatctgtcaacgcgg

SEQ ID NO: 3099 - DNA, 25 bp, S. cerevisiae
atcaagggcctcttctgggatcccg

SEQ ID NO: 3100 - DNA, 25 bp, S. cerevisiae
atcaagtacccactagacgtcatca

SEQ ID NO: 3101 - DNA, 25 bp, S. cerevisiae
atcagagtgacgacaaatgggccaa

SEQ ID NO: 3102 - DNA, 25 bp, S. cerevisiae
ataacaacgattttgcggccaagca

SEQ ID NO: 3103 - DNA, 25 bp, S. cerevisiae
atacaacaatatgtcgccgccaaca

SEQ ID NO: 3104 - DNA, 25 bp, S. cerevisiae
atacaaaatgtctacgccccagatc

SEQ ID NO: 3105 - DNA, 25 bp, S. cerevisiae
atacaaacctgagagctccgatgat

SEQ ID NO: 3106 - DNA, 25 bp, S. cerevisiae
atactcaagttacctatggctccat

SEQ ID NO: 3107 - DNA, 25 bp, S. cerevisiae
atactactctttccaagtcgctcat

SEQ ID NO: 3108 - DNA, 25 bp, S. cerevisiae
atactactctttccaagctgctcac

SEQ ID NO: 3109 - DNA, 25 bp, S. cerevisiae
atacagatactttgtccactctcac

SEQ ID NO: 3110 - DNA, 25 bp, S. cerevisiae
ataagtattctcttcatcctcaatc

SEQ ID NO: 3111 - DNA, 25 bp, S. cerevisiae
atcaaatttccggatcattcacacg

SEQ ID NO: 3112 - DNA, 25 bp, S. cerevisiae
ataaagaccggtgcatcgcaactgc

SEQ ID NO: 3113 - DNA, 25 bp, S. cerevisiae
ataacgacgggtgcactgtgatctt

SEQ ID NO: 3114 - DNA, 25 bp, S. cerevisiae
atacagcgtctgaggtccgtgatgt

SEQ ID NO: 3115 - DNA, 25 bp, S. cerevisiae
atacttggaatcctggctggtctgt

SEQ ID NO: 3116 - DNA, 25 bp, S. cerevisiae
atacatttaatactggaggcgccat

SEQ ID NO: 3117 - DNA, 25 bp, S. cerevisiae
ataattccaatcctggtgctgctgc

SEQ ID NO: 3118 - DNA, 25 bp, S. cerevisiae
atacatgtccattatgccgtagtga

SEQ ID NO: 3119 - DNA, 25 bp, S. cerevisiae
atacttcatattaacgtcatcgcac

SEQ ID NO: 3120 - DNA, 25 bp, S. cerevisiae
ataaatcctttactcgatgcgtctt

SEQ ID NO: 3121 - DNA, 25 bp, S. cerevisiae
atcaagatcaggtaccggcaggcgc

SEQ ID NO: 3122 - DNA, 25 bp, S. cerevisiae
atacaggccgtgtccaaatacatca

SEQ ID NO: 3123 - DNA, 25 bp, S. cerevisiae
ataactgtccatggcgagcagatca

SEQ ID NO: 3124 - DNA, 25 bp, S. cerevisiae
ataagattttatcggcaatgccagg

SEQ ID NO: 3125 - DNA, 25 bp, S. cerevisiae
ataagagtcagaattggcgcaggga

SEQ ID NO: 3126 - DNA, 25 bp, S. cerevisiae
atcacgcaatcggtgggtccggaga

SEQ ID NO: 3127 - DNA, 25 bp, S. cerevisiae
atcgtcaatcagttatgcggtagca

SEQ ID NO: 3128 - DNA, 25 bp, S. cerevisiae
atcagtagtgtgttgttccttgcca

SEQ ID NO: 3129 - DNA, 25 bp, S. cerevisiae
atcaaatgttcacctatccttgtcc

SEQ ID NO: 3130 - DNA, 25 bp, S. cerevisiae
ataaaacccttttctgtgcctgtga

SEQ ID NO: 3131 - DNA, 25 bp, S. cerevisiae
atacaatccaccagttagctcctat

SEQ ID NO: 3132 - DNA, 25 bp, S. cerevisiae
ataatttcggcatgtcatcaccagc

SEQ ID NO: 3133 - DNA, 25 bp, S. cerevisiae
ataagttggccgtttctttgcaatc

SEQ ID NO: 3134 - DNA, 25 bp, S. cerevisiae
ataacttgtcgttggtctttgcacc

SEQ ID NO: 3135 - DNA, 25 bp, S. cerevisiae
ataatgatgttcaccgctggtaccg

SEQ ID NO: 3136 - DNA, 25 bp, S. cerevisiae
ataaaatatcacgtctttccttcat

SEQ ID NO: 3137 - DNA, 25 bp, S. cerevisiae
atcaacaaggatgtcttctcctcca

SEQ ID NO: 3138 - DNA, 25 bp, S. cerevisiae
ataatgaagacccttgtgccctgga

SEQ ID NO: 3139 - DNA, 25 bp, S. cerevisiae
ataataggccgcatagtcccaggct

SEQ ID NO: 3140 - DNA, 25 bp, S. cerevisiae
atacaagagttgcagaccccgtgct

SEQ ID NO: 3141 - DNA, 25 bp, S. cerevisiae
atccaacttacacaatcccagaatt

SEQ ID NO: 3142 - DNA, 25 bp, S. cerevisiae
aagcaacttaacattatccggtatc

SEQ ID NO: 3143 - DNA, 25 bp, S. cerevisiae
atacatcacttacgctttgtccggt

SEQ ID NO: 3144 - DNA, 25 bp, S. cerevisiae
ataaactggctgacttatctgcccg

SEQ ID NO: 3145 - DNA, 25 bp, S. cerevisiae
ataagatttttcaagccagccacaa

SEQ ID NO: 3146 - DNA, 25 bp, S. cerevisiae
ataatagcactgcagctgcaccgat

SEQ ID NO: 3147 - DNA, 25 bp, S. cerevisiae
ataagcccatgccagctgatgcgta

SEQ ID NO: 3148 - DNA, 25 bp, S. cerevisiae
atcaaacttctgcagatgctgtcga

SEQ ID NO: 3149 - DNA, 25 bp, S. cerevisiae
ataatgagctctggtcacactttga

SEQ ID NO: 3150 - DNA, 25 bp, S. cerevisiae
ataaacctctggaactattgccgaa

SEQ ID NO: 3151 - DNA, 25 bp, S. cerevisiae
ataacttctctcgtgactttgccaa

SEQ ID NO: 3152 - DNA, 25 bp, S. cerevisiae
atcaacgactgcaccaatttcacaa

SEQ ID NO: 3153 - DNA, 25 bp, S. cerevisiae
ataatcatcctcagaccctggaaac

SEQ ID NO: 3154 - DNA, 25 bp, S. cerevisiae
atacagcacgctattttcttgagaa

SEQ ID NO: 3155 - DNA, 25 bp, S. cerevisiae
ataagcccataatgtccctgacagg

SEQ ID NO: 3156 - DNA, 25 bp, S. cerevisiae
ataaatcccatgagaccctacgaga

SEQ ID NO: 3157 - DNA, 25 bp, S. cerevisiae
atacaatcttatcctattccctgaa

SEQ ID NO: 3158 - DNA, 25 bp, S. cerevisiae
atcatctctgtatccatatgctcgt

SEQ ID NO: 3159 - DNA, 25 bp, S. cerevisiae
atcacctggcgtacatgtccgggaa

SEQ ID NO: 3160 - DNA, 25 bp, S. cerevisiae
atacacttggtctgtttctgctacg

SEQ ID NO: 3161 - DNA, 25 bp, S. cerevisiae
ataacgtcctatgtcatgggctggc

SEQ ID NO: 3162 - DNA, 25 bp, S. cerevisiae
atacacgtttatgttggccgagcaa

SEQ ID NO: 3163 - DNA, 25 bp, S. cerevisiae
ataacgttgtttctgcaccgacata

SEQ ID NO: 3164 - DNA, 25 bp, S. cerevisiae
ataacgctttttagctcgagaagat

SEQ ID NO: 3165 - DNA, 25 bp, S. cerevisiae
ataacctttctcatcaagagcagga

SEQ ID NO: 3166 - DNA, 25 bp, S. cerevisiae
ataacgtaatctactctagcgagga

SEQ ID NO: 3167 - DNA, 25 bp, S. cerevisiae
ataatcgtaatctttttgtggtgaa

SEQ ID NO: 3168 - DNA, 25 bp, S. cerevisiae
atcacttgataactttggttgggca

SEQ ID NO: 3169 - DNA, 25 bp, S. cerevisiae
ataacgcgactttcttcaatgacat

SEQ ID NO: 3170 - DNA, 25 bp, S. cerevisiae
ataagcagcaactcttctcaatcac

SEQ ID NO: 3171 - DNA, 25 bp, S. cerevisiae
ataagtgtcagtatttccactcccc

SEQ ID NO: 3172 - DNA, 25 bp, S. cerevisiae
atcaagacctgtatggtccgtccac

SEQ ID NO: 3173 - DNA, 25 bp, S. cerevisiae
ataactcacatttcgtctgaccaac

SEQ ID NO: 3174 - DNA, 25 bp, S. cerevisiae
atacactctcatttctgttactctg

SEQ ID NO: 3175 - DNA, 25 bp, S. cerevisiae
atcacccttttgttatccatttacg

SEQ ID NO: 3176 - DNA, 25 bp, S. cerevisiae
acaacggtttttcacacttcatgga

SEQ ID NO: 3177 - DNA, 25 bp, S. cerevisiae
ataatcctgcatgccctttgcaata

SEQ ID NO: 3178 - DNA, 25 bp, S. cerevisiae
ataacctattgccactacgacagac

SEQ ID NO: 3179 - DNA, 25 bp, S. cerevisiae
ataacggctcattgcattacgataa

SEQ ID NO: 3180 - DNA, 25 bp, S. cerevisiae
ataatggtgctgacctagacgataa

SEQ ID NO: 3181 - DNA, 25 bp, S. cerevisiae
ataatcgctcgtcgtccgagatgaa

SEQ ID NO: 3182 - DNA, 25 bp, S. cerevisiae
atacacaacaggcatctccattact

SEQ ID NO: 3183 - DNA, 25 bp, S. cerevisiae
atacaaacagctttctttagatcta

SEQ ID NO: 3184 - DNA, 25 bp, S. cerevisiae
atcagtaacctttcgtaatgtcatg

SEQ ID NO: 3185 - DNA, 25 bp, S. cerevisiae
atacaacgccagttgcgacacctaa

SEQ ID NO: 3186 - DNA, 25 bp, S. cerevisiae
ataattctctggtatggccccataa

SEQ ID NO: 3187 - DNA, 25 bp, S. cerevisiae
ataagctgctacctggtccccaaag

SEQ ID NO: 3188 - DNA, 25 bp, S. cerevisiae
ataagttactcaatccatctccaaa

SEQ ID NO: 3189 - DNA, 25 bp, S. cerevisiae
ataaattactcaatgcctctctcca

SEQ ID NO: 3190 - DNA, 25 bp, S. cerevisiae
ataaatccaatcaaccttcttcaca

SEQ ID NO: 3191 - DNA, 25 bp, S. cerevisiae
ataaatctgtatcagcacctgctcc

SEQ ID NO: 3192 - DNA, 25 bp, S. cerevisiae
ataacagcatttccaactcttccaa

SEQ ID NO: 3193 - DNA, 25 bp, S. cerevisiae
atcaatctgatgatggcggtttcca

SEQ ID NO: 3194 - DNA, 25 bp, S. cerevisiae
atcaatgctgctaagggttcctcta

SEQ ID NO: 3195 - DNA, 25 bp, S. cerevisiae
ataaatcggataactatggcgccta

SEQ ID NO: 3196 - DNA, 25 bp, S. cerevisiae
ataactggtatatcgcatggcactc

SEQ ID NO: 3197 - DNA, 25 bp, S. cerevisiae
ataagggctcgagcgatgaagcact

SEQ ID NO: 3198 - DNA, 25 bp, S. cerevisiae
atcaacggccgattgcgacaacatt

SEQ ID NO: 3199 - DNA, 25 bp, S. cerevisiae
atgccaagagctccaagaacttact

SEQ ID NO: 3200 - DNA, 25 bp, S. cerevisiae
atgcgaacaccttaaacgtatcttt

SEQ ID NO: 3201 - DNA, 25 bp, S. cerevisiae
ataaccgctagaactgttgcatcag

SEQ ID NO: 3202 - DNA, 25 bp, S. cerevisiae
ataacatcgatctaatcacggcaag

SEQ ID NO: 3203 - DNA, 25 bp, S. cerevisiae
ataaacgatatccaacattcccgcc

SEQ ID NO: 3204 - DNA, 25 bp, S. cerevisiae
ataatgcttgttgtctttgctctaa

SEQ ID NO: 3205 - DNA, 25 bp, S. cerevisiae
atcaaggctcgtgttgtttctctac

SEQ ID NO: 3206 - DNA, 25 bp, S. cerevisiae
atcaaggattccgttgttgctgctt

SEQ ID NO: 3207 - DNA, 25 bp, S. cerevisiae
ataaggaatcatctggtgtgcaaaa

SEQ ID NO: 3208 - DNA, 25 bp, S. cerevisiae
ataacgatattattgaggctcacag

SEQ ID NO: 3209 - DNA, 25 bp, S. cerevisiae
atcaacgttggaatggactccgccg

SEQ ID NO: 3210 - DNA, 25 bp, S. cerevisiae
ataacgccggcaatgatatctcact

SEQ ID NO: 3211 - DNA, 25 bp, S. cerevisiae
ataagcccgtgctagacaatccgtt

SEQ ID NO: 3212 - DNA, 25 bp, S. cerevisiae
ataacgcctgaatgtgaaccgctta

SEQ ID NO: 3213 - DNA, 25 bp, S. cerevisiae
ataagcgctcatctggtgaacaagt

SEQ ID NO: 3214 - DNA, 25 bp, S. cerevisiae
ataagactctttttgacatcactgt

SEQ ID NO: 3215 - DNA, 25 bp, S. cerevisiae
ataaatcacctttatccgcagctgc

SEQ ID NO: 3216 - DNA, 25 bp, S. cerevisiae
ataaaatcgtctttgccctatcttg

SEQ ID NO: 3217 - DNA, 25 bp, S. cerevisiae
ataagaacttcgtttcctctctgga

SEQ ID NO: 3218 - DNA, 25 bp, S. cerevisiae
atgaacggttcgtgatcactctcga

SEQ ID NO: 3219 - DNA, 25 bp, S. cerevisiae
ataacgctttggtgccagatccaga

SEQ ID NO: 3220 - DNA, 25 bp, S. cerevisiae
ataaatgctaccagaccgtgtcaga

SEQ ID NO: 3221 - DNA, 25 bp, S. cerevisiae
ataatttatgcttcgaccgtccaga

SEQ ID NO: 3222 - DNA, 25 bp, S. cerevisiae
ataattattgcttgtggcggctcct

SEQ ID NO: 3223 - DNA, 25 bp, S. cerevisiae
ataactttgaaaggcgctggagcta

SEQ ID NO: 3224 - DNA, 25 bp, S. cerevisiae
atcaaatattcgtacgtgggtcaca

SEQ ID NO: 3225 - DNA, 25 bp, S. cerevisiae
atcagaacgtcgtgtcattggccct

SEQ ID NO: 3226 - DNA, 25 bp, S. cerevisiae
atcaacttgaagctgactcgcgttc

SEQ ID NO: 3227 - DNA, 25 bp, S. cerevisiae
atcacgcatgtggaggtttgtcagt

SEQ ID NO: 3228 - DNA, 25 bp, S. cerevisiae
atcacaggtgcacgagttggctcaa

SEQ ID NO: 3229 - DNA, 25 bp, S. cerevisiae
ataatgctgcaattttcgcctatcc

SEQ ID NO: 3230 - DNA, 25 bp, S. cerevisiae
ataatctaagttacctgatacaaga

SEQ ID NO: 3231 - DNA, 25 bp, S. cerevisiae
ataatgttgtcccatctgcgattca

SEQ ID NO: 3232 - DNA, 25 bp, S. cerevisiae
atcaatattttctttcccttatgtt

SEQ ID NO: 3233 - DNA, 25 bp, S. cerevisiae
ataactacactgtgcatctgccttt

SEQ ID NO: 3234 - DNA, 25 bp, S. cerevisiae
ataattggctcgtttcatccttcct

SEQ ID NO: 3235 - DNA, 25 bp, S. cerevisiae
ataattggtcccatactttctcacc

SEQ ID NO: 3236 - DNA, 25 bp, S. cerevisiae
atcaatgttggttcttcgctgttta

SEQ ID NO: 3237 - DNA, 25 bp, S. cerevisiae
ataatgtcaatactgccgctaccaa

SEQ ID NO: 3238 - DNA, 25 bp, S. cerevisiae
ataaacaacttccagctaccaagct

SEQ ID NO: 3239 - DNA, 25 bp, S. cerevisiae
ataatcacccttccaacgatagcgg

SEQ ID NO: 3240 - DNA, 25 bp, S. cerevisiae
ataacctccttcaattcagtagcgc

SEQ ID NO: 3241 - DNA, 25 bp, S. cerevisiae
ataacctcgctcaagtaagaactca

SEQ ID NO: 3242 - DNA, 25 bp, S. cerevisiae
ataacctcagcgatttctataagac

SEQ ID NO: 3243 - DNA, 25 bp, S. cerevisiae
ataacaagatcccaccgtacgagag

SEQ ID NO: 3244 - DNA, 25 bp, S. cerevisiae
agataatactcgcaccgacgcggag

SEQ ID NO: 3245 - DNA, 25 bp, S. cerevisiae
acacttaatggccaccgactcggga

SEQ ID NO: 3246 - DNA, 25 bp, S. cerevisiae
atcagcttttccaccaattgcagag

SEQ ID NO: 3247 - DNA, 25 bp, S. cerevisiae
atcaatcttttattcacgcctggat

SEQ ID NO: 3248 - DNA, 25 bp, S. cerevisiae
ataagcgtataatctactccgatga

SEQ ID NO: 3249 - DNA, 25 bp, S. cerevisiae
atcacaacgcaatccttactcaaag

SEQ ID NO: 3250 - DNA, 25 bp, S. cerevisiae
ataataccagccgactaccatgcaa

SEQ ID NO: 3251 - DNA, 25 bp, S. cerevisiae
ataacacataagcagtccatagacg

SEQ ID NO: 3252 - DNA, 25 bp, S. cerevisiae
ataagatccaattgtattccgtcga

SEQ ID NO: 3253 - DNA, 25 bp, S. cerevisiae
ataagccacctattgattccgtcta

SEQ ID NO: 3254 - DNA, 25 bp, S. cerevisiae
ataattcctgccaaaatgccgagtt

SEQ ID NO: 3255 - DNA, 25 bp, S. cerevisiae
ataactgtcccctaaacgatgatat

SEQ ID NO: 3256 - DNA, 25 bp, S. cerevisiae
ataagctctcccaatactagcgtaa

SEQ ID NO: 3257 - DNA, 25 bp, S. cerevisiae
ataagaccgatctaattgctccaga

SEQ ID NO: 3258 - DNA, 25 bp, S. cerevisiae
ataatgcccatgttatgcaagacgt

SEQ ID NO: 3259 - DNA, 25 bp, S. cerevisiae
ataacgttgtttgccacgcttgtaa

SEQ ID NO: 3260 - DNA, 25 bp, S. cerevisiae
atcaacacatttatccgcccattta

SEQ ID NO: 3261 - DNA, 25 bp, S. cerevisiae
atcaacgatttattcccgcttttat

SEQ ID NO: 3262 - DNA, 25 bp, S. cerevisiae
ataatgtccttcttccagcttatgg

SEQ ID NO: 3263 - DNA, 25 bp, S. cerevisiae
ataagatccttcttcaaccttccat

SEQ ID NO: 3264 - DNA, 25 bp, S. cerevisiae
ataactactacatttcaccttccat

SEQ ID NO: 3265 - DNA, 25 bp, S. cerevisiae
agggccaggaaattattgaccaaca

SEQ ID NO: 3266 - DNA, 25 bp, S. cerevisiae
atcaacctgcaatattatcgccctt

SEQ ID NO: 3267 - DNA, 25 bp, S. cerevisiae
ataaccatcttgattcattctcccc

SEQ ID NO: 3268 - DNA, 25 bp, S. cerevisiae
ataactcttagcattatgtgtggct

SEQ ID NO: 3269 - DNA, 25 bp, S. cerevisiae
ataatccgctgtggaatcctagcag

SEQ ID NO: 3270 - DNA, 25 bp, S. cerevisiae
atcaaggatgtcatgttctgcttag

SEQ ID NO: 3271 - DNA, 25 bp, S. cerevisiae
ataacagcaatagcgctagcggcag

SEQ ID NO: 3272 - DNA, 25 bp, S. cerevisiae
ataactgcacaaggccccagagagt

SEQ ID NO: 3273 - DNA, 25 bp, S. cerevisiae
ataatgagcccaagcctgttagatt

SEQ ID NO: 3274 - DNA, 25 bp, S. cerevisiae
atcacgataccacgccgtttgtttg

SEQ ID NO: 3275 - DNA, 25 bp, S. cerevisiae
atcacgctaatactgccttttggac

SEQ ID NO: 3276 - DNA, 25 bp, S. cerevisiae
atcacagcgaaatctctcacgaatt

SEQ ID NO: 3277 - DNA, 25 bp, S. cerevisiae
atcaagggtgtcaagagcgtcgttt

SEQ ID NO: 3278 - DNA, 25 bp, S. cerevisiae
ataagtggtatatccgtcgggctgt

SEQ ID NO: 3279 - DNA, 25 bp, S. cerevisiae
ataagttgtgatgacgctggcgccc

SEQ ID NO: 3280 - DNA, 25 bp, S. cerevisiae
atcaagtagctttggcagcggcagc

SEQ ID NO: 3281 - DNA, 25 bp, S. cerevisiae
ataactgatggcactcttctgaggg

SEQ ID NO: 3282 - DNA, 25 bp, S. cerevisiae
ataacgctggccctgttgctggtgc

SEQ ID NO: 3283 - DNA, 25 bp, S. cerevisiae
atcacgggtcctaacagcaataacg

SEQ ID NO: 3284 - DNA, 25 bp, S. cerevisiae
ataaggttcctattcagcagcaaca

SEQ ID NO: 3285 - DNA, 25 bp, S. cerevisiae
ataaggctgctttcatcgagagatg

SEQ ID NO: 3286 - DNA, 25 bp, S. cerevisiae
atcatggaccacatatacccagttt

SEQ ID NO: 3287 - DNA, 25 bp, S. cerevisiae
atcaaaaaaggatgccgcgctagta

SEQ ID NO: 3288 - DNA, 25 bp, S. cerevisiae
atcaataacacatacaccgtctgcg

SEQ ID NO: 3289 - DNA, 25 bp, S. cerevisiae
ataaggaacgtgtagcagctgcatg

SEQ ID NO: 3290 - DNA, 25 bp, S. cerevisiae
ataatgccaatccataatgccgtgg

SEQ ID NO: 3291 - DNA, 25 bp, S. cerevisiae
atcaagggaccaggcttactagcgc

SEQ ID NO: 3292 - DNA, 25 bp, S. cerevisiae
atcaaggtttgctgttggctggctc

SEQ ID NO: 3293 - DNA, 25 bp, S. cerevisiae
atcaggaagattctgtggcgttgca

SEQ ID NO: 3294 - DNA, 25 bp, S. cerevisiae
atcactcaaagttgtctcggcttct

SEQ ID NO: 3295 - DNA, 25 bp, S. cerevisiae
atcatcgatatcatcctaagggttt

SEQ ID NO: 3296 - DNA, 25 bp, S. cerevisiae
atcatggacatcgtcctcgggttct

SEQ ID NO: 3297 - DNA, 25 bp, S. cerevisiae
ataataacgctttcattggctcata

SEQ ID NO: 3298 - DNA, 25 bp, S. cerevisiae
ataagagagccaatacactgtgtat

SEQ ID NO: 3299 - DNA, 25 bp, S. cerevisiae
ataagatcccatccacgctgttaat

SEQ ID NO: 3300 - DNA, 25 bp, S. cerevisiae
ataagaccactgtcctgctggatta

SEQ ID NO: 3301 - DNA, 25 bp, S. cerevisiae
atcaacgtatctgccgctgagaaaa

SEQ ID NO: 3302 - DNA, 25 bp, S. cerevisiae
atcgtcgttgcttctcgtaaacatg

SEQ ID NO: 3303 - DNA, 25 bp, S. cerevisiae
atcagtccttccgatcagatcaaag

SEQ ID NO: 3304 - DNA, 25 bp, S. cerevisiae
atcagtctgctgaggccgaaataac

SEQ ID NO: 3305 - DNA, 25 bp, S. cerevisiae
atcacagcagcgatacggacggcat

SEQ ID NO: 3306 - DNA, 25 bp, S. cerevisiae
atcacctgccgttatcgacgaatgc

SEQ ID NO: 3307 - DNA, 25 bp, S. cerevisiae
atcagcagtagcgttttcatcgttg

SEQ ID NO: 3308 - DNA, 25 bp, S. cerevisiae
atcagcttaggcatgataaatactg

SEQ ID NO: 3309 - DNA, 25 bp, S. cerevisiae
atgccctagagctaaacgtgacgtt

SEQ ID NO: 3310 - DNA, 25 bp, S. cerevisiae
atctcgattaagaaaggtgcacctt

SEQ ID NO: 3311 - DNA, 25 bp, S. cerevisiae
gcctcagtaatcaaaatagtccact

SEQ ID NO: 3312 - DNA, 25 bp, S. cerevisiae
atcgtttaagcaagccgtccagttg

SEQ ID NO: 3313 - DNA, 25 bp, S. cerevisiae
atcaagattactagcacacccaatg

SEQ ID NO: 3314 - DNA, 25 bp, S. cerevisiae
atcaaattcctcaacgtccaatcaa

SEQ ID NO: 3315 - DNA, 25 bp, S. cerevisiae
atcaaatcctttgcgtccagaacag

SEQ ID NO: 3316 - DNA, 25 bp, S. cerevisiae
atcagttcctatacaacacctacgg

SEQ ID NO: 3317 - DNA, 25 bp, S. cerevisiae
atcgattcagtagcacccaaacgtg

SEQ ID NO: 3318 - DNA, 25 bp, S. cerevisiae
atcaagatcagtttccaccacatac

SEQ ID NO: 3319 - DNA, 25 bp, S. cerevisiae
atcagagtctgtgaattctcgcgca

SEQ ID NO: 3320 - DNA, 25 bp, S. cerevisiae
atcaagatagctggctgttctccca

SEQ ID NO: 3321 - DNA, 25 bp, S. cerevisiae
atcaaatagcccttggtcagccaat

SEQ ID NO: 3322 - DNA, 25 bp, S. cerevisiae
ataagcgacgctatatccaggcctt

SEQ ID NO: 3323 - DNA, 25 bp, S. cerevisiae
atcaacgacgtggattaggcctttt

SEQ ID NO: 3324 - DNA, 25 bp, S. cerevisiae
atcccgatcactgaaagagcccgta

SEQ ID NO: 3325 - DNA, 25 bp, S. cerevisiae
atcacatccggaagaagaacacgcg

SEQ ID NO: 3326 - DNA, 25 bp, S. cerevisiae
atcacatccggatacaaatggtcag

SEQ ID NO: 3327 - DNA, 25 bp, S. cerevisiae
atccatgccatccatcgaagtaggt

SEQ ID NO: 3328 - DNA, 25 bp, S. cerevisiae
atcagcttgcacacgaacttagaga

SEQ ID NO: 3329 - DNA, 25 bp, S. cerevisiae
atcactctgcgataaatgcgtacaa

SEQ ID NO: 3330 - DNA, 25 bp, S. cerevisiae
atcactctcgaaaactgtgccctga

SEQ ID NO: 3331 - DNA, 25 bp, S. cerevisiae
atcagacctgaaacactacccaaga

SEQ ID NO: 3332 - DNA, 25 bp, S. cerevisiae
atcaccacgaggacactttccaaaa

SEQ ID NO: 3333 - DNA, 25 bp, S. cerevisiae
ataagaccagccatcttggaggacg

SEQ ID NO: 3334 - DNA, 25 bp, S. cerevisiae
atcacatccgaactatcccaatatt

SEQ ID NO: 3335 - DNA, 25 bp, S. cerevisiae
ataatcatacaagctcctctagcgc

SEQ ID NO: 3336 - DNA, 25 bp, S. cerevisiae
atcaatcttctgttcattcggacgt

SEQ ID NO: 3337 - DNA, 25 bp, S. cerevisiae
atgaatttcgacgttccattcgctg

SEQ ID NO: 3338 - DNA, 25 bp, S. cerevisiae
atggtttctaccacgcaatcgaggt

SEQ ID NO: 3339 - DNA, 25 bp, S. cerevisiae
atggtggtccatcttccaattgggc

SEQ ID NO: 3340 - DNA, 25 bp, S. cerevisiae
atcgggtccactttccatagggtga

SEQ ID NO: 3341 - DNA, 25 bp, S. cerevisiae
atcgtcggtattttcttttggctgt

SEQ ID NO: 3342 - DNA, 25 bp, S. cerevisiae
atcggtatcttctgtgttttgggtg

SEQ ID NO: 3343 - DNA, 25 bp, S. cerevisiae
atccggtactacagatttggtggta

SEQ ID NO: 3344 - DNA, 25 bp, S. cerevisiae
atcccttactccttgtttgatgggt

SEQ ID NO: 3345 - DNA, 25 bp, S. cerevisiae
atctccagaatctcacggttcatgg

SEQ ID NO: 3346 - DNA, 25 bp, S. cerevisiae
atctcacgcagcaaagcaaggttca

SEQ ID NO: 3347 - DNA, 25 bp, S. cerevisiae
atctgtccgctttgagggatgccac

SEQ ID NO: 3348 - DNA, 25 bp, S. cerevisiae
atcttccaataacgacgactcttac

SEQ ID NO: 3349 - DNA, 25 bp, S. cerevisiae
atcttctgcatttgatcgggaccga

SEQ ID NO: 3350 - DNA, 25 bp, S. cerevisiae
atgcatcgttaaactgggactggcc

SEQ ID NO: 3351 - DNA, 25 bp, S. cerevisiae
atcagctggtaagttggcttccacc

SEQ ID NO: 3352 - DNA, 25 bp, S. cerevisiae
atcacggtattcttggctaccttaa

SEQ ID NO: 3353 - DNA, 25 bp, S. cerevisiae
atcaccgtatgttctgggatcctga

SEQ ID NO: 3354 - DNA, 25 bp, S. cerevisiae
atcactccgagttcaacgtcggtgt

SEQ ID NO: 3355 - DNA, 25 bp, S. cerevisiae
atcagacagcgggtcgaccagggtt

SEQ ID NO: 3356 - DNA, 25 bp, S. cerevisiae
atcagacacaccgtcgaacgagcaa

SEQ ID NO: 3357 - DNA, 25 bp, S. cerevisiae
atcaattccaataccaaaacgctag

SEQ ID NO: 3358 - DNA, 25 bp, S. cerevisiae
ataattccatacacgcaaaggcatt

SEQ ID NO: 3359 - DNA, 25 bp, S. cerevisiae
atctgctacatatgccggttacgtc

SEQ ID NO: 3360 - DNA, 25 bp, S. cerevisiae
atcactagatttcctcgttataacg

SEQ ID NO: 3361 - DNA, 25 bp, S. cerevisiae
atcaccaagtctgcgtttcaacgcg

SEQ ID NO: 3362 - DNA, 25 bp, S. cerevisiae
atcattcaacagtcccgcttattct

SEQ ID NO: 3363 - DNA, 25 bp, S. cerevisiae
atcactctagatgccaccaatgaaa

SEQ ID NO: 3364 - DNA, 25 bp, S. cerevisiae
atcaagattatagctgtcccaccaa

SEQ ID NO: 3365 - DNA, 25 bp, S. cerevisiae
atctgaagcttagcgatcccgggag

SEQ ID NO: 3366 - DNA, 25 bp, S. cerevisiae
atcagacctttcttgtgcaacgttg

SEQ ID NO: 3367 - DNA, 25 bp, S. cerevisiae
atcaaccacagtttggacaccttgg

SEQ ID NO: 3368 - DNA, 25 bp, S. cerevisiae
atcaactcagatgtggaacctatag

SEQ ID NO: 3369 - DNA, 25 bp, S. cerevisiae
atcctcccaacgtcgtgttttgcta

SEQ ID NO: 3370 - DNA, 25 bp, S. cerevisiae
atctaactccggtgttgttgtgtaa

SEQ ID NO: 3371 - DNA, 25 bp, S. cerevisiae
atcactaccaagtctttgcttctga

SEQ ID NO: 3372 - DNA, 25 bp, S. cerevisiae
ataattctccatcttctgctttgag

SEQ ID NO: 3373 - DNA, 25 bp, S. cerevisiae
ataagtatgattcgccagtctcctc

SEQ ID NO: 3374 - DNA, 25 bp, S. cerevisiae
atcaaaacatatcccttgccatctt

SEQ ID NO: 3375 - DNA, 25 bp, S. cerevisiae
atgctaaggcttcccattgttttga

SEQ ID NO: 3376 - DNA, 25 bp, S. cerevisiae
atcaacaggcttagcgatcatcgtt

SEQ ID NO: 3377 - DNA, 25 bp, S. cerevisiae
atcaacacgctattggacatcttcc

SEQ ID NO: 3378 - DNA, 25 bp, S. cerevisiae
atcaggtcgcagatagaccatttca

SEQ ID NO: 3379 - DNA, 25 bp, S. cerevisiae
atcaaatatggtttgttcggtcacc

SEQ ID NO: 3380 - DNA, 25 bp, S. cerevisiae
ataatgctggtgttgctcacatcaa

SEQ ID NO: 3381 - DNA, 25 bp, S. cerevisiae
atcagtgcgatccaatggctgtgca

SEQ ID NO: 3382 - DNA, 25 bp, S. cerevisiae
atcatcaataccagagcctcttaaa

SEQ ID NO: 3383 - DNA, 25 bp, S. cerevisiae
atcatccaagtcaggcctcgtgaaa

SEQ ID NO: 3384 - DNA, 25 bp, S. cerevisiae
atcacacatagagagccccaggaat

SEQ ID NO: 3385 - DNA, 25 bp, S. cerevisiae
atcagcaatagacggccacacggaa

SEQ ID NO: 3386 - DNA, 25 bp, S. cerevisiae
atcaagccttctgctgaagtccata

SEQ ID NO: 3387 - DNA, 25 bp, S. cerevisiae
atcagagccctcatcgaagtcgaac

SEQ ID NO: 3388 - DNA, 25 bp, S. cerevisiae
atcaggattgtgaacgggttgcaaa

SEQ ID NO: 3389 - DNA, 25 bp, S. cerevisiae
atcaatattcatcacccgatcatca

SEQ ID NO: 3390 - DNA, 25 bp, S. cerevisiae
atcagtttcttctccaagcacatat

SEQ ID NO: 3391 - DNA, 25 bp, S. cerevisiae
atcaggctttgattgcttcaagatg

SEQ ID NO: 3392 - DNA, 25 bp, S. cerevisiae
atcagtggccatcggttctgtgctg

SEQ ID NO: 3393 - DNA, 25 bp, S. cerevisiae
atcactggcaagcatccatcatggg

SEQ ID NO: 3394 - DNA, 25 bp, S. cerevisiae
atcactggtagacggccatgggcta

SEQ ID NO: 3395 - DNA, 25 bp, S. cerevisiae
atcaagaatttctggcggactcatt

SEQ ID NO: 3396 - DNA, 25 bp, S. cerevisiae
atcatgttttgctacggtggtggac

SEQ ID NO: 3397 - DNA, 25 bp, S. cerevisiae
atcatttgttgggtcgtttggcctc

SEQ ID NO: 3398 - DNA, 25 bp, S. cerevisiae
atccgatttcactctttggtggcac

SEQ ID NO: 3399 - DNA, 25 bp, S. cerevisiae
atcggttcgcctttgggagctccaa

SEQ ID NO: 3400 - DNA, 25 bp, S. cerevisiae
atcaattaggccacttgtttcaaat

SEQ ID NO: 3401 - DNA, 25 bp, S. cerevisiae
atctttacttcccattgtatgctgc

SEQ ID NO: 3402 - DNA, 25 bp, S. cerevisiae
atcattgatcttgctaggaaccgaa

SEQ ID NO: 3403 - DNA, 25 bp, S. cerevisiae
atcaagcgattcagagctgggctcg

SEQ ID NO: 3404 - DNA, 25 bp, S. cerevisiae
atcacggatggcatagcgctggcta

SEQ ID NO: 3405 - DNA, 25 bp, S. cerevisiae
atcacttgatctgtcagctctggca

SEQ ID NO: 3406 - DNA, 25 bp, S. cerevisiae
atcactgatgactttagcgcgcgaa

SEQ ID NO: 3407 - DNA, 25 bp, S. cerevisiae
actttacaaaagctcaacaccgact

SEQ ID NO: 3408 - DNA, 25 bp, S. cerevisiae
atgttaatataaccccaccaccgat

SEQ ID NO: 3409 - DNA, 25 bp, S. cerevisiae
atcggaggtaacaaacgtagcagct

SEQ ID NO: 3410 - DNA, 25 bp, S. cerevisiae
accaaggttatcatacgggcccaat

SEQ ID NO: 3411 - DNA, 25 bp, S. cerevisiae
atcccgtcttttcagatttgccaaa

SEQ ID NO: 3412 - DNA, 25 bp, S. cerevisiae
acctttctttttcatgctacacttg

SEQ ID NO: 3413 - DNA, 25 bp, S. cerevisiae
atcccttcaaagtatcttgttccca

SEQ ID NO: 3414 - DNA, 25 bp, S. cerevisiae
atctcctacgagcaattgtttccaa

SEQ ID NO: 3415 - DNA, 25 bp, S. cerevisiae
atcatcccgcttgtgaattgtttca

SEQ ID NO: 3416 - DNA, 25 bp, S. cerevisiae
atcacgcacgttatgaaagccttaa

SEQ ID NO: 3417 - DNA, 25 bp, S. cerevisiae
atcagccactggtgctaaacgtgct

SEQ ID NO: 3418 - DNA, 25 bp, S. cerevisiae
ataatatcgttggttatgcccatgt

SEQ ID NO: 3419 - DNA, 25 bp, S. cerevisiae
atcagcaatcggatcctgttcaggg

SEQ ID NO: 3420 - DNA, 25 bp, S. cerevisiae
atcaaacactgactctggttcaccg

SEQ ID NO: 3421 - DNA, 25 bp, S. cerevisiae
atcaatacagtatcatggcatatcg

SEQ ID NO: 3422 - DNA, 25 bp, S. cerevisiae
atcagatcaagtctttaaccgtcaa

SEQ ID NO: 3423 - DNA, 25 bp, S. cerevisiae
atcaactgcgtcagcttcaaccaat

SEQ ID NO: 3424 - DNA, 25 bp, S. cerevisiae
atcaaccgggtttcatcatgccgat

SEQ ID NO: 3425 - DNA, 25 bp, S. cerevisiae
atctattgcggcgataattctgggt

SEQ ID NO: 3426 - DNA, 25 bp, S. cerevisiae
atcagattccgataattccgtattt

SEQ ID NO: 3427 - DNA, 25 bp, S. cerevisiae
atcaaccttgactatataccggatt

SEQ ID NO: 3428 - DNA, 25 bp, S. cerevisiae
atcaatctggtgtcaagtccctaga

SEQ ID NO: 3429 - DNA, 25 bp, S. cerevisiae
atcaatacaggcctagtgcccttga

SEQ ID NO: 3430 - DNA, 25 bp, S. cerevisiae
atcaattcaatgtccatggccgctt

SEQ ID NO: 3431 - DNA, 25 bp, S. cerevisiae
atcaatgtccagattcctctctgaa

SEQ ID NO: 3432 - DNA, 25 bp, S. cerevisiae
atcaatgatcaactggtccctctgt

SEQ ID NO: 3433 - DNA, 25 bp, S. cerevisiae
atcaaagaactactcctgctggtcc

SEQ ID NO: 3434 - DNA, 25 bp, S. cerevisiae
atcaagatctcattccatccaaagc

SEQ ID NO: 3435 - DNA, 25 bp, S. cerevisiae
atcatcccaaacttcgtccgaaaag

SEQ ID NO: 3436 - DNA, 25 bp, S. cerevisiae
atcagttcaaaactctccacgctta

SEQ ID NO: 3437 - DNA, 25 bp, S. cerevisiae
ataattggatttccatcccgtcctg

SEQ ID NO: 3438 - DNA, 25 bp, S. cerevisiae
atcaattgaacagtgactctccgcc

SEQ ID NO: 3439 - DNA, 25 bp, S. cerevisiae
atccgtgggtgaaatttgcctcaaa

SEQ ID NO: 3440 - DNA, 25 bp, S. cerevisiae
atcccggagaagattttcaaaattg

SEQ ID NO: 3441 - DNA, 25 bp, S. cerevisiae
atgccgtgaaaaatttttcccatat

SEQ ID NO: 3442 - DNA, 25 bp, S. cerevisiae
atcacgggaaaagttcgagcctcat

SEQ ID NO: 3443 - DNA, 25 bp, S. cerevisiae
atcattcttgaatggttcaccccaa

SEQ ID NO: 3444 - DNA, 25 bp, S. cerevisiae
atctctccattcactttcggtttga

SEQ ID NO: 3445 - DNA, 25 bp, S. cerevisiae
atctcctcaggaagcttacggtgat

SEQ ID NO: 3446 - DNA, 25 bp, S. cerevisiae
atcttccgcttcttctagtggtgat

SEQ ID NO: 3447 - DNA, 25 bp, S. cerevisiae
atcatttctcgcgaactgggacgta

SEQ ID NO: 3448 - DNA, 25 bp, S. cerevisiae
atctcttgtccgcactgcaaagtga

SEQ ID NO: 3449 - DNA, 25 bp, S. cerevisiae
atcgaacacgttattatcccaagaa

SEQ ID NO: 3450 - DNA, 25 bp, S. cerevisiae
atgaatctacgaactttacccaaat

SEQ ID NO: 3451 - DNA, 25 bp, S. cerevisiae
atcaatcatccttactatttccctt

SEQ ID NO: 3452 - DNA, 25 bp, S. cerevisiae
atcactggtgtatcttttctatcta

SEQ ID NO: 3453 - DNA, 25 bp, S. cerevisiae
atcttcgagttctgtttcactggaa

SEQ ID NO: 3454 - DNA, 25 bp, S. cerevisiae
atcaatttgtagcacctccatcgaa

SEQ ID NO: 3455 - DNA, 25 bp, S. cerevisiae
atcagatggcgtttcattttgcaac

SEQ ID NO: 3456 - DNA, 25 bp, S. cerevisiae
atcaatgctgcttttgtcttggaag

SEQ ID NO: 3457 - DNA, 25 bp, S. cerevisiae
atcagactctgacttgccggtaatg

SEQ ID NO: 3458 - DNA, 25 bp, S. cerevisiae
atcatgactatgaatacccgcttag

SEQ ID NO: 3459 - DNA, 25 bp, S. cerevisiae
atcatcctaatgtagccacgttggc

SEQ ID NO: 3460 - DNA, 25 bp, S. cerevisiae
atcttctgattcctccgattcggat

SEQ ID NO: 3461 - DNA, 25 bp, S. cerevisiae
atcttcgatgtcgttggtcctctag

SEQ ID NO: 3462 - DNA, 25 bp, S. cerevisiae
atctattatgtccagaagctccgct

SEQ ID NO: 3463 - DNA, 25 bp, S. cerevisiae
atcttttgcactcatttgtcgggaa

SEQ ID NO: 3464 - DNA, 25 bp, S. cerevisiae
atctcttccgtttatcttaggcgac

SEQ ID NO: 3465 - DNA, 25 bp, S. cerevisiae
atctgtcctaagtccgatttgtcga

SEQ ID NO: 3466 - DNA, 25 bp, S. cerevisiae
atcaggctggtatcatggttcgtat

SEQ ID NO: 3467 - DNA, 25 bp, S. cerevisiae
atcaggtccatatcagcgagtccga

SEQ ID NO: 3468 - DNA, 25 bp, S. cerevisiae
atcagttcatgtacaagcgcacccg

SEQ ID NO: 3469 - DNA, 25 bp, S. cerevisiae
actcttttccaatacactacttacg

SEQ ID NO: 3470 - DNA, 25 bp, S. cerevisiae
atcatccgggttaaccttcttagtg

SEQ ID NO: 3471 - DNA, 25 bp, S. cerevisiae
atcccggagttgaaccaagctttag

SEQ ID NO: 3472 - DNA, 25 bp, S. cerevisiae
atcgtccttgtccaaaaagtcttga

SEQ ID NO: 3473 - DNA, 25 bp, S. cerevisiae
atgcggcgccctgagtgaaaagtta

SEQ ID NO: 3474 - DNA, 25 bp, S. cerevisiae
atgcggcccgcaaaccaagagattt

SEQ ID NO: 3475 - DNA, 25 bp, S. cerevisiae
atcttcctcccttcttgataatttg

SEQ ID NO: 3476 - DNA, 25 bp, S. cerevisiae
atcttgccagttcttttcatgccat

SEQ ID NO: 3477 - DNA, 25 bp, S. cerevisiae
atcatctggcacacatccgttatca

SEQ ID NO: 3478 - DNA, 25 bp, S. cerevisiae
atcacaatcagcagaccgttacaag

SEQ ID NO: 3479 - DNA, 25 bp, S. cerevisiae
atcaagctgatgttcgaagatttca

SEQ ID NO: 3480 - DNA, 25 bp, S. cerevisiae
atcaagttgggctcgcatttcaaaa

SEQ ID NO: 3481 - DNA, 25 bp, S. cerevisiae
atcataaggttatcgcagttggcag

SEQ ID NO: 3482 - DNA, 25 bp, S. cerevisiae
atcacgggtggattcggtcgcatca

SEQ ID NO: 3483 - DNA, 25 bp, S. cerevisiae
atcagggcggctatgcgaacagcaa

SEQ ID NO: 3484 - DNA, 25 bp, S. cerevisiae
atcaacggtatcttcgtcttcatgc

SEQ ID NO: 3485 - DNA, 25 bp, S. cerevisiae
atcaggcagtttcacatgtctccgc

SEQ ID NO: 3486 - DNA, 25 bp, S. cerevisiae
atcaggcgcatttttggtctacttc

SEQ ID NO: 3487 - DNA, 25 bp, S. cerevisiae
atcagacagtgttttggtcgcacaa

SEQ ID NO: 3488 - DNA, 25 bp, S. cerevisiae
atcaacacttgccttgatctcgaag

SEQ ID NO: 3489 - DNA, 25 bp, S. cerevisiae
atcacacatctgacttcatgtccga

SEQ ID NO: 3490 - DNA, 25 bp, S. cerevisiae
atcatactctcctacgtcaccaagt

SEQ ID NO: 3491 - DNA, 25 bp, S. cerevisiae
atctagtcctcttaatgtccaactc

SEQ ID NO: 3492 - DNA, 25 bp, S. cerevisiae
atcacttctgcattattcgttctta

SEQ ID NO: 3493 - DNA, 25 bp, S. cerevisiae
atctaatacactatagcggcgggta

SEQ ID NO: 3494 - DNA, 25 bp, S. cerevisiae
atcaaatccaaccattggtcgcgat

SEQ ID NO: 3495 - DNA, 25 bp, S. cerevisiae
atcattaacaagcttggcgccctga

SEQ ID NO: 3496 - DNA, 25 bp, S. cerevisiae
atcatttgaggttttgtccgtggat

SEQ ID NO: 3497 - DNA, 25 bp, S. cerevisiae
atcatttgcagaggtctaacgcccg

SEQ ID NO: 3498 - DNA, 25 bp, S. cerevisiae
atcaggatttacgttggcagtcaat

SEQ ID NO: 3499 - DNA, 25 bp, S. cerevisiae
atcaggattccctataggccacaag

SEQ ID NO: 3500 - DNA, 25 bp, S. cerevisiae
atcagtgttctttatcagctgtcca

SEQ ID NO: 3501 - DNA, 25 bp, S. cerevisiae
atcagcttcttctttgtccgcctat

SEQ ID NO: 3502 - DNA, 25 bp, S. cerevisiae
atcacagttccattggtcgttgcct

SEQ ID NO: 3503 - DNA, 25 bp, S. cerevisiae
atctatcgctcgcattcttgagttt

SEQ ID NO: 3504 - DNA, 25 bp, S. cerevisiae
atctatgtccatgttaggcgttcaa

SEQ ID NO: 3505 - DNA, 25 bp, S. cerevisiae
atctacctttactctcgctgtcaca

SEQ ID NO: 3506 - DNA, 25 bp, S. cerevisiae
atctgtccttgaacaacctttacac

SEQ ID NO: 3507 - DNA, 25 bp, S. cerevisiae
atcttcccatatgatcccttgaaac

SEQ ID NO: 3508 - DNA, 25 bp, S. cerevisiae
atcttacgtggcctcgctattacaa

SEQ ID NO: 3509 - DNA, 25 bp, S. cerevisiae
atcttgaccacctctgctggtatca

SEQ ID NO: 3510 - DNA, 25 bp, S. cerevisiae
atctttaagctctgcgattgataac

SEQ ID NO: 3511 - DNA, 25 bp, S. cerevisiae
atcacttatccctttgatctgctaa

SEQ ID NO: 3512 - DNA, 25 bp, S. cerevisiae
atcacccttggtttgcagagtacta

SEQ ID NO: 3513 - DNA, 25 bp, S. cerevisiae
atcaacatttggactgtcgcctgtt

SEQ ID NO: 3514 - DNA, 25 bp, S. cerevisiae
atcaacatttggaccagcgtcgcgt

SEQ ID NO: 3515 - DNA, 25 bp, S. cerevisiae
atcaccatttgcatccaggtcgtag

SEQ ID NO: 3516 - DNA, 25 bp, S. cerevisiae
atcaccatattcatcgactcatcag

SEQ ID NO: 3517 - DNA, 25 bp, S. cerevisiae
atcatgcctgttcatcgcatctaag

SEQ ID NO: 3518 - DNA, 25 bp, S. cerevisiae
atctcttacatctccaaagggcttg

SEQ ID NO: 3519 - DNA, 25 bp, S. cerevisiae
atcacttcatcttactaccgtggtt

SEQ ID NO: 3520 - DNA, 25 bp, S. cerevisiae
atcagatttgataagtccaccggta

SEQ ID NO: 3521 - DNA, 25 bp, S. cerevisiae
atccaatttgtctacgacgaagctg

SEQ ID NO: 3522 - DNA, 25 bp, S. cerevisiae
atctactcagggtgctggcgaactg

SEQ ID NO: 3523 - DNA, 25 bp, S. cerevisiae
atccttcctcagttcgtgggactga

SEQ ID NO: 3524 - DNA, 25 bp, S. cerevisiae
atcgattaccgtgggtgggatccaa

SEQ ID NO: 3525 - DNA, 25 bp, S. cerevisiae
atcaaaaccctgtttcgtcagaaga

SEQ ID NO: 3526 - DNA, 25 bp, S. cerevisiae
atcaaaactcactctccagtagagt

SEQ ID NO: 3527 - DNA, 25 bp, S. cerevisiae
atcagattcctcatactactttgca

SEQ ID NO: 3528 - DNA, 25 bp, S. cerevisiae
atcacattccttaccatttgcgaga

SEQ ID NO: 3529 - DNA, 25 bp, S. cerevisiae
atcaaatccattccatcctactaag

SEQ ID NO: 3530 - DNA, 25 bp, S. cerevisiae
atcaccttcagtacaatcttcctct

SEQ ID NO: 3531 - DNA, 25 bp, S. cerevisiae
atcagcgtcatatcggattgcagtt

SEQ ID NO: 3532 - DNA, 25 bp, S. cerevisiae
atcagcccagggtacagtgagttat

SEQ ID NO: 3533 - DNA, 25 bp, S. cerevisiae
atccccggcgttgatgcgtatatta

SEQ ID NO: 3534 - DNA, 25 bp, S. cerevisiae
atcaccgggtgaacaacgctcattt

SEQ ID NO: 3535 - DNA, 25 bp, S. cerevisiae
atcacgctataaccaacatgcctat

SEQ ID NO: 3536 - DNA, 25 bp, S. cerevisiae
atcacatttattctcatctcctagg

SEQ ID NO: 3537 - DNA, 25 bp, S. cerevisiae
atcacttatcattccttatgcctgg

SEQ ID NO: 3538 - DNA, 25 bp, S. cerevisiae
atctccaatgctgctttagccaagg

SEQ ID NO: 3539 - DNA, 25 bp, S. cerevisiae
atcaccacactaccataacaaacga

SEQ ID NO: 3540 - DNA, 25 bp, S. cerevisiae
atcaccctctagtactcataacaag

SEQ ID NO: 3541 - DNA, 25 bp, S. cerevisiae
atctacctctactctcgctgtcata

SEQ ID NO: 3542 - DNA, 25 bp, S. cerevisiae
atcacctcatgaacttcaacgtcgg

SEQ ID NO: 3543 - DNA, 25 bp, S. cerevisiae
atcattcctgatatcgacctacgtg

SEQ ID NO: 3544 - DNA, 25 bp, S. cerevisiae
atctacgtattccttgactgcaggc

SEQ ID NO: 3545 - DNA, 25 bp, S. cerevisiae
atcttggagacggacttgctgctat

SEQ ID NO: 3546 - DNA, 25 bp, S. cerevisiae
atcttggcagacatctatcggcgat

SEQ ID NO: 3547 - DNA, 25 bp, S. cerevisiae
acggtattctcgtggcatgggttgc

SEQ ID NO: 3548 - DNA, 25 bp, S. cerevisiae
atccttgtttagaggcggcgcctaa

SEQ ID NO: 3549 - DNA, 25 bp, S. cerevisiae
atcaccattttgatttctcgtgccg

SEQ ID NO: 3550 - DNA, 25 bp, S. cerevisiae
atcatcacattcctcatataccaaa

SEQ ID NO: 3551 - DNA, 25 bp, S. cerevisiae
atcatcctctgcgatcaagacggga

SEQ ID NO: 3552 - DNA, 25 bp, S. cerevisiae
atctgccgctgctacaagcacgaag

SEQ ID NO: 3553 - DNA, 25 bp, S. cerevisiae
atcacctgtgaaactcgaagctgtc

SEQ ID NO: 3554 - DNA, 25 bp, S. cerevisiae
acgcacaagatacagtcgaccggtt

SEQ ID NO: 3555 - DNA, 25 bp, S. cerevisiae
atctacaatatatcaccgagccggg

SEQ ID NO: 3556 - DNA, 25 bp, S. cerevisiae
atctaaataccaggccacctcggtt

SEQ ID NO: 3557 - DNA, 25 bp, S. cerevisiae
atctatcaagtctgttgtttccggg

SEQ ID NO: 3558 - DNA, 25 bp, S. cerevisiae
atctcactcccctattcaattggaa

SEQ ID NO: 3559 - DNA, 25 bp, S. cerevisiae
atcatttgccccattctacaggaaa

SEQ ID NO: 3560 - DNA, 25 bp, S. cerevisiae
atctcaacctacgttggtattgcca

SEQ ID NO: 3561 - DNA, 25 bp, S. cerevisiae
atctgtaccgacgttttagctcgtg

SEQ ID NO: 3562 - DNA, 25 bp, S. cerevisiae
atctaaaggcttccaaggtcccatt

SEQ ID NO: 3563 - DNA, 25 bp, S. cerevisiae
atgcgagaaggctccaagttcaaga

SEQ ID NO: 3564 - DNA, 25 bp, S. cerevisiae
atcaggtgggtctaccatgttcaaa

SEQ ID NO: 3565 - DNA, 25 bp, S. cerevisiae
atcactgcttcgaatgctgttggta

SEQ ID NO: 3566 - DNA, 25 bp, S. cerevisiae
atcagtttcatgcactctggacaaa

SEQ ID NO: 3567 - DNA, 25 bp, S. cerevisiae
atcatcacaagcagactccattttc

SEQ ID NO: 3568 - DNA, 25 bp, S. cerevisiae
atcaccaccatctacatctttaata

SEQ ID NO: 3569 - DNA, 25 bp, S. cerevisiae
atcacgcagtggtacaatgttcagc

SEQ ID NO: 3570 - DNA, 25 bp, S. cerevisiae
atcaccgctgcgttacaattacaac

SEQ ID NO: 3571 - DNA, 25 bp, S. cerevisiae
atcatcgtgctgcttacttcagaca

SEQ ID NO: 3572 - DNA, 25 bp, S. cerevisiae
atcagggagcgtttcttgcaacagc

SEQ ID NO: 3573 - DNA, 25 bp, S. cerevisiae
atcacctacaatcgacttcaactcg

SEQ ID NO: 3574 - DNA, 25 bp, S. cerevisiae
atcatcctaatactacacatctacc

SEQ ID NO: 3575 - DNA, 25 bp, S. cerevisiae
atcatcgtaaacagcatcctcaggg

SEQ ID NO: 3576 - DNA, 25 bp, S. cerevisiae
atcgatgctactacaagtcactctc

SEQ ID NO: 3577 - DNA, 25 bp, S. cerevisiae
atcgttacagaatcccaactactaa

SEQ ID NO: 3578 - DNA, 25 bp, S. cerevisiae
atcagtacaaatgcactcacatcat

SEQ ID NO: 3579 - DNA, 25 bp, S. cerevisiae
atcagtgactaagccaatctcgtta

SEQ ID NO: 3580 - DNA, 25 bp, S. cerevisiae
atcatagcccattgtactaccgtta

SEQ ID NO: 3581 - DNA, 25 bp, S. cerevisiae
atcttggatatctccgccagagaga

SEQ ID NO: 3582 - DNA, 25 bp, S. cerevisiae
atcgtatgccgaatccaccaagaga

SEQ ID NO: 3583 - DNA, 25 bp, S. cerevisiae
atcagtatcgtgaatccatcctcaa

SEQ ID NO: 3584 - DNA, 25 bp, S. cerevisiae
atctaagttacctgatacaagaact

SEQ ID NO: 3585 - DNA, 25 bp, S. cerevisiae
atctactttccaaggtgcacaaacc

SEQ ID NO: 3586 - DNA, 25 bp, S. cerevisiae
atctcacaccttgtgtaacagatgt

SEQ ID NO: 3587 - DNA, 25 bp, S. cerevisiae
atcacctgctaatgcggacacggat

SEQ ID NO: 3588 - DNA, 25 bp, S. cerevisiae
atctatctgcgccatgtcgtgaata

SEQ ID NO: 3589 - DNA, 25 bp, S. cerevisiae
atcatcgccctaactgttgcattta

SEQ ID NO: 3590 - DNA, 25 bp, S. cerevisiae
atcagccgattacttcattgtcaga

SEQ ID NO: 3591 - DNA, 25 bp, S. cerevisiae
atcagcgctacttctacatcttcta

SEQ ID NO: 3592 - DNA, 25 bp, S. cerevisiae
atcatcgtacctagagcattgttcg

SEQ ID NO: 3593 - DNA, 25 bp, S. cerevisiae
atgcaccaaccaaggctttttgtcg

SEQ ID NO: 3594 - DNA, 25 bp, S. cerevisiae
atcttcttcagagctttccaggtga

SEQ ID NO: 3595 - DNA, 25 bp, S. cerevisiae
atcagccaccggtagtagagattac

SEQ ID NO: 3596 - DNA, 25 bp, S. cerevisiae
atctgaaagcgtccctaaagccatt

SEQ ID NO: 3597 - DNA, 25 bp, S. cerevisiae
atcttcttttatctcatggaccctg

SEQ ID NO: 3598 - DNA, 25 bp, S. cerevisiae
atctttctaccattttacctctcaa

SEQ ID NO: 3599 - DNA, 25 bp, S. cerevisiae
atctctttacgctattccatattcg

SEQ ID NO: 3600 - DNA, 25 bp, S. cerevisiae
atcgattactcatattccaggccac

SEQ ID NO: 3601 - DNA, 25 bp, S. cerevisiae
atctgactcaaacatggacggcccc

SEQ ID NO: 3602 - DNA, 25 bp, S. cerevisiae
atctacttcgataaagcctgccgtg

SEQ ID NO: 3603 - DNA, 25 bp, S. cerevisiae
atctgacgtagcatcgaggaccggg

SEQ ID NO: 3604 - DNA, 25 bp, S. cerevisiae
atcccacttttggaggacctttcat

SEQ ID NO: 3605 - DNA, 25 bp, S. cerevisiae
atctcctgggtccaaccaagaatca

SEQ ID NO: 3606 - DNA, 25 bp, S. cerevisiae
atctccaaggctctatccaaagatg

SEQ ID NO: 3607 - DNA, 25 bp, S. cerevisiae
atgccttagattctttagtacccag

SEQ ID NO: 3608 - DNA, 25 bp, S. cerevisiae
atcttattaacccaatgaggccgta

SEQ ID NO: 3609 - DNA, 25 bp, S. cerevisiae
atctctgatccaagccgtcaaggcc

SEQ ID NO: 3610 - DNA, 25 bp, S. cerevisiae
atcatctatctttggcggcggtgca

SEQ ID NO: 3611 - DNA, 25 bp, S. cerevisiae
atcatcttagataattcgccggcct

SEQ ID NO: 3612 - DNA, 25 bp, S. cerevisiae
atcttcactgatgtaccagaaacat

SEQ ID NO: 3613 - DNA, 25 bp, S. cerevisiae
atcttcactgatgtcccgcaaacat

SEQ ID NO: 3614 - DNA, 25 bp, S. cerevisiae
atcatggaagttgcccgcagacaca

SEQ ID NO: 3615 - DNA, 25 bp, S. cerevisiae
atctggcacagtagcctacgttaca

SEQ ID NO: 3616 - DNA, 25 bp, S. cerevisiae
atcatctgcacgtatgctatatcga

SEQ ID NO: 3617 - DNA, 25 bp, S. cerevisiae
atcatctgccgaatcatcttctaag

SEQ ID NO: 3618 - DNA, 25 bp, S. cerevisiae
atcagtcgaaattcttggtccacag

SEQ ID NO: 3619 - DNA, 25 bp, S. cerevisiae
atcattcgagaatgcagccgtcctc

SEQ ID NO: 3620 - DNA, 25 bp, S. cerevisiae
atcattcctgcggtatggacttctt

SEQ ID NO: 3621 - DNA, 25 bp, S. cerevisiae
atcatagctctattgttgcaactac

SEQ ID NO: 3622 - DNA, 25 bp, S. cerevisiae
atcagagttgacatcatgcgtgcaa

SEQ ID NO: 3623 - DNA, 25 bp, S. cerevisiae
atcatcgttgtcgttgcgctgcata

SEQ ID NO: 3624 - DNA, 25 bp, S. cerevisiae
atcatcgatgtctgttgtgctccca

SEQ ID NO: 3625 - DNA, 25 bp, S. cerevisiae
atcattatcccaaagtttcgcgcaa

SEQ ID NO: 3626 - DNA, 25 bp, S. cerevisiae
atcatcattctcgataactctccgg

SEQ ID NO: 3627 - DNA, 25 bp, S. cerevisiae
atcatgtcttgctttaccccaggat

SEQ ID NO: 3628 - DNA, 25 bp, S. cerevisiae
atcaggcttcgcattgtcagtttag

SEQ ID NO: 3629 - DNA, 25 bp, S. cerevisiae
atcgtagccggtggttctggtatca

SEQ ID NO: 3630 - DNA, 25 bp, S. cerevisiae
atcaggaagcgctggtcttgcaaaa

SEQ ID NO: 3631 - DNA, 25 bp, S. cerevisiae
acgagccagataccacaacgggact

SEQ ID NO: 3632 - DNA, 25 bp, S. cerevisiae
agcgtctcaggatccaattggcggc

SEQ ID NO: 3633 - DNA, 25 bp, S. cerevisiae
atcggcactgttgttggcatttgta

SEQ ID NO: 3634 - DNA, 25 bp, S. cerevisiae
atctggccatttgagaccttggtca

SEQ ID NO: 3635 - DNA, 25 bp, S. cerevisiae
atcatggaccatgaagaagccagaa

SEQ ID NO: 3636 - DNA, 25 bp, S. cerevisiae
atcatgcgacctcactgggtggaat

SEQ ID NO: 3637 - DNA, 25 bp, S. cerevisiae
atcatgcccatttggtcatccaaca

SEQ ID NO: 3638 - DNA, 25 bp, S. cerevisiae
atcatgggcaatggcatactccgta

SEQ ID NO: 3639 - DNA, 25 bp, S. cerevisiae
atcagtggtgtgatcctcgagtttt

SEQ ID NO: 3640 - DNA, 25 bp, S. cerevisiae
atcagggtgctaacttcacagttta

SEQ ID NO: 3641 - DNA, 25 bp, S. cerevisiae
atcatggtgtttccgcaagagcttt

SEQ ID NO: 3642 - DNA, 25 bp, S. cerevisiae
atctgctgatgaattgagaaaggct

SEQ ID NO: 3643 - DNA, 25 bp, S. cerevisiae
atcatcttttccttctttaccatga

SEQ ID NO: 3644 - DNA, 25 bp, S. cerevisiae
atctttggtctttgggtgtcattac

SEQ ID NO: 3645 - DNA, 25 bp, S. cerevisiae
atctttgggccatctacttatccat

SEQ ID NO: 3646 - DNA, 25 bp, S. cerevisiae
atcaggtagtgcatctccaacttta

SEQ ID NO: 3647 - DNA, 25 bp, S. cerevisiae
atcggacctcttgctacgaatggta

SEQ ID NO: 3648 - DNA, 25 bp, S. cerevisiae
atcatcactcacttctgttacgtat

SEQ ID NO: 3649 - DNA, 25 bp, S. cerevisiae
atcatgcgccatttgttaagtctag

SEQ ID NO: 3650 - DNA, 25 bp, S. cerevisiae
atcttcaaaggttgcgtagagcgcc

SEQ ID NO: 3651 - DNA, 25 bp, S. cerevisiae
atcttctcagaatcagcgtaggcct

SEQ ID NO: 3652 - DNA, 25 bp, S. cerevisiae
atggtcgcaaaatcccagtcaacga

SEQ ID NO: 3653 - DNA, 25 bp, S. cerevisiae
atctgatggtgttgctggtctttac

SEQ ID NO: 3654 - DNA, 25 bp, S. cerevisiae
atccgttgctcaaggttattgcgcc

SEQ ID NO: 3655 - DNA, 25 bp, S. cerevisiae
atcggtacatggaacatcatcggaa

SEQ ID NO: 3656 - DNA, 25 bp, S. cerevisiae
atcgctgcgggtgaaaagcccttga

SEQ ID NO: 3657 - DNA, 25 bp, S. cerevisiae
atgggcagtggatcgcaaacgcgtt

SEQ ID NO: 3658 - DNA, 25 bp, S. cerevisiae
atcggcgggatctggttctggctat

SEQ ID NO: 3659 - DNA, 25 bp, S. cerevisiae
gttgggcgacctaacttcgagtagt

SEQ ID NO: 3660 - DNA, 25 bp, S. cerevisiae
atctataatgtcagctttaagcggc

SEQ ID NO: 3661 - DNA, 25 bp, S. cerevisiae
atcatatagttccatctttacccct

SEQ ID NO: 3662 - DNA, 25 bp, S. cerevisiae
atcattaattcaacggctaccacca

SEQ ID NO: 3663 - DNA, 25 bp, S. cerevisiae
atcttccagttatgcaccagttgct

SEQ ID NO: 3664 - DNA, 25 bp, S. cerevisiae
atcttgtccgacttgaactctggtt

SEQ ID NO: 3665 - DNA, 25 bp, S. cerevisiae
atctttagtcaattgcacaccttcc

SEQ ID NO: 3666 - DNA, 25 bp, S. cerevisiae
atcttagacagtgcttcacctctga

SEQ ID NO: 3667 - DNA, 25 bp, S. cerevisiae
atcttcacaatgagtccacacttca

SEQ ID NO: 3668 - DNA, 25 bp, S. cerevisiae
atcttcaaattactatcgcgtgtca

SEQ ID NO: 3669 - DNA, 25 bp, S. cerevisiae
atcggcagctgcatctcaacaagat

SEQ ID NO: 3670 - DNA, 25 bp, S. cerevisiae
atcatccagcatatctcttcaaagg

SEQ ID NO: 3671 - DNA, 25 bp, S. cerevisiae
atcatcctcatcattttcaacatca

SEQ ID NO: 3672 - DNA, 25 bp, S. cerevisiae
atctggaaaagttctcccgtcattc

SEQ ID NO: 3673 - DNA, 25 bp, S. cerevisiae
atctattgtggtttttccttcctcg

SEQ ID NO: 3674 - DNA, 25 bp, S. cerevisiae
atgtatttggctcatttcaaagaat

SEQ ID NO: 3675 - DNA, 25 bp, S. cerevisiae
atctttggtgctctttaatctggaa

SEQ ID NO: 3676 - DNA, 25 bp, S. cerevisiae
atcttgtgggctcagcactatcatc

SEQ ID NO: 3677 - DNA, 25 bp, S. cerevisiae
atctggtggcgctggtcaatatggt

SEQ ID NO: 3678 - DNA, 25 bp, S. cerevisiae
atcgccatgggctgtattttgctgt

SEQ ID NO: 3679 - DNA, 25 bp, S. cerevisiae
atgccaagggcggattttactacga

SEQ ID NO: 3680 - DNA, 25 bp, S. cerevisiae
atccaagggctcgtgctttacaaaa

SEQ ID NO: 3681 - DNA, 25 bp, S. cerevisiae
atcccaggccatggtggtatcacag

SEQ ID NO: 3682 - DNA, 25 bp, S. cerevisiae
atcccagggcagtatgttccacctt

SEQ ID NO: 3683 - DNA, 25 bp, S. cerevisiae
atctcaagttgttgtttccgccgtc

SEQ ID NO: 3684 - DNA, 25 bp, S. cerevisiae
atcattctagccttaagttcttcag

SEQ ID NO: 3685 - DNA, 25 bp, S. cerevisiae
atctttagcccattcaggtgttata

SEQ ID NO: 3686 - DNA, 25 bp, S. cerevisiae
atcattatcacgttgtttgccacaa

SEQ ID NO: 3687 - DNA, 25 bp, S. cerevisiae
atcatttgggatcgtatgctcctaa

SEQ ID NO: 3688 - DNA, 25 bp, S. cerevisiae
atctttcttggattgggctctttca

SEQ ID NO: 3689 - DNA, 25 bp, S. cerevisiae
atctttctaggatttctgtctggcc

SEQ ID NO: 3690 - DNA, 25 bp, S. cerevisiae
atcatcactgatttccatatcctgg

SEQ ID NO: 3691 - DNA, 25 bp, S. cerevisiae
atctttataagccaactccacgaca

SEQ ID NO: 3692 - DNA, 25 bp, S. cerevisiae
atctgttcatatggcaacttctgca

SEQ ID NO: 3693 - DNA, 25 bp, S. cerevisiae
atctgcctaaactatgcctgccaag

SEQ ID NO: 3694 - DNA, 25 bp, S. cerevisiae
atctgcagcctacctatacttagta

SEQ ID NO: 3695 - DNA, 25 bp, S. cerevisiae
atcttctctggtactctatcttata

SEQ ID NO: 3696 - DNA, 25 bp, S. cerevisiae
atctttgcaggctttttattcgttg

SEQ ID NO: 3697 - DNA, 25 bp, S. cerevisiae
atcttttggaatgccttgatcgttg

SEQ ID NO: 3698 - DNA, 25 bp, S. cerevisiae
atcttgaacgtgtgtcttgctggtg

SEQ ID NO: 3699 - DNA, 25 bp, S. cerevisiae
atctttttggattctgcttgggctc

SEQ ID NO: 3700 - DNA, 25 bp, S. cerevisiae
atcttcctcatcatcagcatgttca

SEQ ID NO: 3701 - DNA, 25 bp, S. cerevisiae
atcattcattgcatcatcctctgca

SEQ ID NO: 3702 - DNA, 25 bp, S. cerevisiae
atctggcgaaggttccatcgactta

SEQ ID NO: 3703 - DNA, 25 bp, S. cerevisiae
atctgtaacaggttccattgcctct

SEQ ID NO: 3704 - DNA, 25 bp, S. cerevisiae
atcggattcacttttcaagaacttt

SEQ ID NO: 3705 - DNA, 25 bp, S. cerevisiae
atcgtcacctcctttgaaaactttg

SEQ ID NO: 3706 - DNA, 25 bp, S. cerevisiae
atctaatcctacttctgcatcttca

SEQ ID NO: 3707 - DNA, 25 bp, S. cerevisiae
atcggttacaccattcattacacta

SEQ ID NO: 3708 - DNA, 25 bp, S. cerevisiae
atctagttgaacctcgtgtcaccaa

SEQ ID NO: 3709 - DNA, 25 bp, S. cerevisiae
atctagggccatgtcgatttcgact

SEQ ID NO: 3710 - DNA, 25 bp, S. cerevisiae
atcgaggcggaaacgttctccagct

SEQ ID NO: 3711 - DNA, 25 bp, S. cerevisiae
tacggcggaaaccagaactccaatg

SEQ ID NO: 3712 - DNA, 25 bp, S. cerevisiae
atctccagcttctttcaagtcatct

SEQ ID NO: 3713 - DNA, 25 bp, S. cerevisiae
atcgtatattgtttcggtgccgtgg

SEQ ID NO: 3714 - DNA, 25 bp, S. cerevisiae
atcttgatcttggttttgtacgttg

SEQ ID NO: 3715 - DNA, 25 bp, S. cerevisiae
atctacctgtgatgattcccaatag

SEQ ID NO: 3716 - DNA, 25 bp, S. cerevisiae
atcttctctctaccttcaacaaaaa

SEQ ID NO: 3717 - DNA, 25 bp, S. cerevisiae
atcgggtcaggccatatcagtcaag

SEQ ID NO: 3718 - DNA, 25 bp, S. cerevisiae
atcggagtcgaaatatgcagtggtg

SEQ ID NO: 3719 - DNA, 25 bp, S. cerevisiae
atcttttcccagatcgtcgattgac

SEQ ID NO: 3720 - DNA, 25 bp, S. cerevisiae
atcttttccaatctgctgcatgcaa

SEQ ID NO: 3721 - DNA, 25 bp, S. cerevisiae
atcttgtgtgacttgccattggcaa

SEQ ID NO: 3722 - DNA, 25 bp, S. cerevisiae
atcttggctatctaccataggcgta

SEQ ID NO: 3723 - DNA, 25 bp, S. cerevisiae
atctgtggctgtggcaaacgggtct

SEQ ID NO: 3724 - DNA, 25 bp, S. cerevisiae
atctgtagggtttatcggctatcca

SEQ ID NO: 3725 - DNA, 25 bp, S. cerevisiae
atcgatagggctgttggtgctccaa

SEQ ID NO: 3726 - DNA, 25 bp, S. cerevisiae
atctacatcgcaatcgttggctcaa

SEQ ID NO: 3727 - DNA, 25 bp, S. cerevisiae
atctaatcggattttggcactgggt

SEQ ID NO: 3728 - DNA, 25 bp, S. cerevisiae
atcttgagacaaaagcaggccgccg

SEQ ID NO: 3729 - DNA, 25 bp, S. cerevisiae
atcttttctatttggtctgtacttg

SEQ ID NO: 3730 - DNA, 25 bp, S. cerevisiae
atctcttctgaaaagttgttgactt

SEQ ID NO: 3731 - DNA, 25 bp, S. cerevisiae
atcgacgtacaacttaattgcccat

SEQ ID NO: 3732 - DNA, 25 bp, S. cerevisiae
atctctctacacttcaattcaccag

SEQ ID NO: 3733 - DNA, 25 bp, S. cerevisiae
atctgcctcaacagcaatacatgcc

SEQ ID NO: 3734 - DNA, 25 bp, S. cerevisiae
atctgtcctcactgtaaccacaaaa

SEQ ID NO: 3735 - DNA, 25 bp, S. cerevisiae
atctatgtttatttcacccaccgaa

SEQ ID NO: 3736 - DNA, 25 bp, S. cerevisiae
atcttaccaattgccattccgcaaa

SEQ ID NO: 3737 - DNA, 25 bp, S. cerevisiae
atctactcaaacaactattcctcta

SEQ ID NO: 3738 - DNA, 25 bp, S. cerevisiae
atctatctaaacatcctgctctttc

SEQ ID NO: 3739 - DNA, 25 bp, S. cerevisiae
atcttctaagtcattatgcctctcc

SEQ ID NO: 3740 - DNA, 25 bp, S. cerevisiae
atctacgctgctggttggtctataa

SEQ ID NO: 3741 - DNA, 25 bp, S. cerevisiae
atcttctgttcaaagctcgccaaag

SEQ ID NO: 3742 - DNA, 25 bp, S. cerevisiae
atctcagttatctgcgtcggcatca

SEQ ID NO: 3743 - DNA, 25 bp, S. cerevisiae
atctagttatcatccatccagcgag

SEQ ID NO: 3744 - DNA, 25 bp, S. cerevisiae
atcttcttcctgaagccgatgagga

SEQ ID NO: 3745 - DNA, 25 bp, S. cerevisiae
atgcggcttccgatgcaaagaggta

SEQ ID NO: 3746 - DNA, 25 bp, S. cerevisiae
atcgaagccgctcccaaaaggaaag

SEQ ID NO: 3747 - DNA, 25 bp, S. cerevisiae
atcgaaactcccgtacatggtgaaa

SEQ ID NO: 3748 - DNA, 25 bp, S. cerevisiae
accacatcaaggtcgaaggtgctgt

SEQ ID NO: 3749 - DNA, 25 bp, S. cerevisiae
atcctcagccaaaatgaaggtggta

SEQ ID NO: 3750 - DNA, 25 bp, S. cerevisiae
atcttaccatcatcgctgggtgagg

SEQ ID NO: 3751 - DNA, 25 bp, S. cerevisiae
atcttcaactgaaagtccgatcggg

SEQ ID NO: 3752 - DNA, 25 bp, S. cerevisiae
atgctaatcccgacgatcctttggt

SEQ ID NO: 3753 - DNA, 25 bp, S. cerevisiae
atctactcccctcatctttatatgt

SEQ ID NO: 3754 - DNA, 25 bp, S. cerevisiae
atctacctctgtggaatcgactatt

SEQ ID NO: 3755 - DNA, 25 bp, S. cerevisiae
atctttctcttgtagtattgttaat

SEQ ID NO: 3756 - DNA, 25 bp, S. cerevisiae
atctagcgtacactcaggttctttg

SEQ ID NO: 3757 - DNA, 25 bp, S. cerevisiae
atccagcgctaccaggttgtttcga

SEQ ID NO: 3758 - DNA, 25 bp, S. cerevisiae
atctcagccgctagggttgccttaa

SEQ ID NO: 3759 - DNA, 25 bp, S. cerevisiae
atctcggcgtcggttctgaattatg

SEQ ID NO: 3760 - DNA, 25 bp, S. cerevisiae
atctccggctcaggatcaacagttt

SEQ ID NO: 3761 - DNA, 25 bp, S. cerevisiae
atcgaccgatggcaaacacttctga

SEQ ID NO: 3762 - DNA, 25 bp, S. cerevisiae
atcgccatcgaaccaacagtactta

SEQ ID NO: 3763 - DNA, 25 bp, S. cerevisiae
atctgccttgggtaacgtcatctgt

SEQ ID NO: 3764 - DNA, 25 bp, S. cerevisiae
atctcctcgggtgatctgttcagtc

SEQ ID NO: 3765 - DNA, 25 bp, S. cerevisiae
atcttagctgctcaatctcataacc

SEQ ID NO: 3766 - DNA, 25 bp, S. cerevisiae
atctcccttcaattcaataacctac

SEQ ID NO: 3767 - DNA, 25 bp, S. cerevisiae
atctcccttggatgcattcagatct

SEQ ID NO: 3768 - DNA, 25 bp, S. cerevisiae
atcccgagtttcattgatgtccaag

SEQ ID NO: 3769 - DNA, 25 bp, S. cerevisiae
atctccagaaagtcatccggtcact

SEQ ID NO: 3770 - DNA, 25 bp, S. cerevisiae
atctccagagaatgccctgaaccaa

SEQ ID NO: 3771 - DNA, 25 bp, S. cerevisiae
atctacttcattctcgagcgcagct

SEQ ID NO: 3772 - DNA, 25 bp, S. cerevisiae
atctcatccattcggtcacgctttg

SEQ ID NO: 3773 - DNA, 25 bp, S. cerevisiae
atctcatgcgatacggtcaccgaag

SEQ ID NO: 3774 - DNA, 25 bp, S. cerevisiae
atcgagcctcctactgatagtgcag

SEQ ID NO: 3775 - DNA, 25 bp, S. cerevisiae
atcccatttgtatcgtattgcagaa

SEQ ID NO: 3776 - DNA, 25 bp, S. cerevisiae
atgctcagcaggtccccaaagtgtc

SEQ ID NO: 3777 - DNA, 25 bp, S. cerevisiae
atctccatatgaataccaacaggtt

SEQ ID NO: 3778 - DNA, 25 bp, S. cerevisiae
atctgccagtgggatcatcaagagg

SEQ ID NO: 3779 - DNA, 25 bp, S. cerevisiae
atctcatcagacgtatattcagcag

SEQ ID NO: 3780 - DNA, 25 bp, S. cerevisiae
atctgcatcagagttaatccaagga

SEQ ID NO: 3781 - DNA, 25 bp, S. cerevisiae
atctctctggaagattatgaggtac

SEQ ID NO: 3782 - DNA, 25 bp, S. cerevisiae
atctaacgaatcaactccatctgct

SEQ ID NO: 3783 - DNA, 25 bp, S. cerevisiae
atctcaaaattcaccaactcttcac

SEQ ID NO: 3784 - DNA, 25 bp, S. cerevisiae
atctcaaatttctcctgattccaca

SEQ ID NO: 3785 - DNA, 25 bp, S. cerevisiae
atcgatactgtcaaggctgctgcaa

SEQ ID NO: 3786 - DNA, 25 bp, S. cerevisiae
atcgatgactggttgctgttgcaga

SEQ ID NO: 3787 - DNA, 25 bp, S. cerevisiae
atcgtcttggcattgggtatcccag

SEQ ID NO: 3788 - DNA, 25 bp, S. cerevisiae
atctattgaagatccgcgctaccaa

SEQ ID NO: 3789 - DNA, 25 bp, S. cerevisiae
atctcgctgttgatcgatgagctta

SEQ ID NO: 3790 - DNA, 25 bp, S. cerevisiae
atcgctgatttggtcgttggtttaa

SEQ ID NO: 3791 - DNA, 25 bp, S. cerevisiae
atctcttttgctgcttcagatggtg

SEQ ID NO: 3792 - DNA, 25 bp, S. cerevisiae
atctacgacatctacttctctgaaa

SEQ ID NO: 3793 - DNA, 25 bp, S. cerevisiae
atctatgcgggctctatcattgaat

SEQ ID NO: 3794 - DNA, 25 bp, S. cerevisiae
atcgggcagcgaattggtctccaat

SEQ ID NO: 3795 - DNA, 25 bp, S. cerevisiae
atctggtaagattgtcgtccaactg

SEQ ID NO: 3796 - DNA, 25 bp, S. cerevisiae
atcggtaacaataacagccatagcg

SEQ ID NO: 3797 - DNA, 25 bp, S. cerevisiae
atcgagtagcacaaattcagtcatt

SEQ ID NO: 3798 - DNA, 25 bp, S. cerevisiae
atctgatggagccaaatccgcttta

SEQ ID NO: 3799 - DNA, 25 bp, S. cerevisiae
atctgtactggatacaccacttggt

SEQ ID NO: 3800 - DNA, 25 bp, S. cerevisiae
atcgtacgagaaacttgccaaggct

SEQ ID NO: 3801 - DNA, 25 bp, S. cerevisiae
atcgatacgaactcttcggcattgc

SEQ ID NO: 3802 - DNA, 25 bp, S. cerevisiae
atcgggtcagaacgctacaatttat

SEQ ID NO: 3803 - DNA, 25 bp, S. cerevisiae
atctgaggtcaacaaggcaagcgta

SEQ ID NO: 3804 - DNA, 25 bp, S. cerevisiae
atccgtctatgctgccattcaaaag

SEQ ID NO: 3805 - DNA, 25 bp, S. cerevisiae
atctctcaatcattatctcccatta

SEQ ID NO: 3806 - DNA, 25 bp, S. cerevisiae
atctccactcatggacatgttggcc

SEQ ID NO: 3807 - DNA, 25 bp, S. cerevisiae
atcccatcctggcaattggctggtg

SEQ ID NO: 3808 - DNA, 25 bp, S. cerevisiae
agaaacgttagtgcccaatcttgaa

SEQ ID NO: 3809 - DNA, 25 bp, S. cerevisiae
aaaacgccggactcaaattctaatg

SEQ ID NO: 3810 - DNA, 25 bp, S. cerevisiae
aaagaccggtactgcaatttcattc

SEQ ID NO: 3811 - DNA, 25 bp, S. cerevisiae
atcgcccctaatgttggtatttata

SEQ ID NO: 3812 - DNA, 25 bp, S. cerevisiae
atcctccgattatctttgttacctt

SEQ ID NO: 3813 - DNA, 25 bp, S. cerevisiae
atcgattgcattgttcctactttac

SEQ ID NO: 3814 - DNA, 25 bp, S. cerevisiae
atcgtatatatcctcttaacttgtg

SEQ ID NO: 3815 - DNA, 25 bp, S. cerevisiae
atcgagattgattgccactttggtt

SEQ ID NO: 3816 - DNA, 25 bp, S. cerevisiae
atcggcttaatatcgagtctgtatt

SEQ ID NO: 3817 - DNA, 25 bp, S. cerevisiae
atcggcgtcccaatctttttgacga

SEQ ID NO: 3818 - DNA, 25 bp, S. cerevisiae
atcccctcaccaactttagaatcga

SEQ ID NO: 3819 - DNA, 25 bp, S. cerevisiae
atctcaggtgcgatttctatgggcc

SEQ ID NO: 3820 - DNA, 25 bp, S. cerevisiae
atctggacttggaatctcctgggac

SEQ ID NO: 3821 - DNA, 25 bp, S. cerevisiae
atcgtcatctttatcatcatcattg

SEQ ID NO: 3822 - DNA, 25 bp, S. cerevisiae
atctggattcccattcatcaggtta

SEQ ID NO: 3823 - DNA, 25 bp, S. cerevisiae
atctgttatcaacgtttctgcccaa

SEQ ID NO: 3824 - DNA, 25 bp, S. cerevisiae
atctgtttcatatgccgtctctaaa

SEQ ID NO: 3825 - DNA, 25 bp, S. cerevisiae
atctggtgtcattattttgtcctac

SEQ ID NO: 3826 - DNA, 25 bp, S. cerevisiae
atctgcattgttgttggtggcgcta

SEQ ID NO: 3827 - DNA, 25 bp, S. cerevisiae
atctcttctttggtggatgcgctat

SEQ ID NO: 3828 - DNA, 25 bp, S. cerevisiae
atcgccctttcgagatacctaagat

SEQ ID NO: 3829 - DNA, 25 bp, S. cerevisiae
atcctccttcggcacagaaatatca

SEQ ID NO: 3830 - DNA, 25 bp, S. cerevisiae
atctgcgcccggagatgcaacaata

SEQ ID NO: 3831 - DNA, 25 bp, S. cerevisiae
atctgctagggaagttgcaacgcta

SEQ ID NO: 3832 - DNA, 25 bp, S. cerevisiae
atctgttggtggtttcaacgcgcac

SEQ ID NO: 3833 - DNA, 25 bp, S. cerevisiae
atctccttgattcttttagccgttg

SEQ ID NO: 3834 - DNA, 25 bp, S. cerevisiae
atctccacagaaacctattgcacct

SEQ ID NO: 3835 - DNA, 25 bp, S. cerevisiae
atctgcttcagtttccctggttaaa

SEQ ID NO: 3836 - DNA, 25 bp, S. cerevisiae
atctcttgcagttccaaaggctttg

SEQ ID NO: 3837 - DNA, 25 bp, S. cerevisiae
atcgcattgcattccccaagatgaa

SEQ ID NO: 3838 - DNA, 25 bp, S. cerevisiae
atcgctggcatttctgggcaaaaag

SEQ ID NO: 3839 - DNA, 25 bp, S. cerevisiae
atcctttgttgagggcagaatacac

SEQ ID NO: 3840 - DNA, 25 bp, S. cerevisiae
atctcttgtggtgctgccgaataca

SEQ ID NO: 3841 - DNA, 25 bp, S. cerevisiae
atctgatgccactccattcaatgga

SEQ ID NO: 3842 - DNA, 25 bp, S. cerevisiae
atctggctcacttccttacaggaat

SEQ ID NO: 3843 - DNA, 25 bp, S. cerevisiae
atctgctgctcaaaattttacaatg

SEQ ID NO: 3844 - DNA, 25 bp, S. cerevisiae
atctgtatcccaactgtcatgtcta

SEQ ID NO: 3845 - DNA, 25 bp, S. cerevisiae
atctgtatgggctcatgacgtccac

SEQ ID NO: 3846 - DNA, 25 bp, S. cerevisiae
atctgtcatggaacataacttcggg

SEQ ID NO: 3847 - DNA, 25 bp, S. cerevisiae
atcgctgattcctttggcgtttttt

SEQ ID NO: 3848 - DNA, 25 bp, S. cerevisiae
atcgaggctcaattagatgcttttg

SEQ ID NO: 3849 - DNA, 25 bp, S. cerevisiae
atctgttttttggatacgcgttgag

SEQ ID NO: 3850 - DNA, 25 bp, S. cerevisiae
atctgattttttgtcgcctatgtta

SEQ ID NO: 3851 - DNA, 25 bp, S. cerevisiae
atcgaattctttgcatctccggtca

SEQ ID NO: 3852 - DNA, 25 bp, S. cerevisiae
atctgtgggctgtgaatccgctaat

SEQ ID NO: 3853 - DNA, 25 bp, S. cerevisiae
atctgtcggtgctgaagtcgatgaa

SEQ ID NO: 3854 - DNA, 25 bp, S. cerevisiae
atcggtggtggtactgttctagaac

SEQ ID NO: 3855 - DNA, 25 bp, S. cerevisiae
atcggccagtggaatctatgtagaa

SEQ ID NO: 3856 - DNA, 25 bp, S. cerevisiae
atcgcccggcttccatatgtacggc

SEQ ID NO: 3857 - DNA, 25 bp, S. cerevisiae
atcggcatcgtcttacgtgacaggg

SEQ ID NO: 3858 - DNA, 25 bp, S. cerevisiae
atcgaacgcgatacagaaagctatg

SEQ ID NO: 3859 - DNA, 25 bp, S. cerevisiae
atcggagtacgaccagacgctgatg

SEQ ID NO: 3860 - DNA, 25 bp, S. cerevisiae
atctgtcccttgagagccgctgatg

SEQ ID NO: 3861 - DNA, 25 bp, S. cerevisiae
atctgtcccttgcatcaggtttgaa

SEQ ID NO: 3862 - DNA, 25 bp, S. cerevisiae
atctgtccgatcgtattggtcgtaa

SEQ ID NO: 3863 - DNA, 25 bp, S. cerevisiae
atctggcacaatactggcggacctg

SEQ ID NO: 3864 - DNA, 25 bp, S. cerevisiae
atcggactattctgcgctgatgtat

SEQ ID NO: 3865 - DNA, 25 bp, S. cerevisiae
atcgacgagtgcttggacctatttc

SEQ ID NO: 3866 - DNA, 25 bp, S. cerevisiae
atctgactgtagcttcagcggttct

SEQ ID NO: 3867 - DNA, 25 bp, S. cerevisiae
atctctcattaaaacagcgggacat

SEQ ID NO: 3868 - DNA, 25 bp, S. cerevisiae
atctgacaggtctcttagggtgcaa

SEQ ID NO: 3869 - DNA, 25 bp, S. cerevisiae
atcgaagcctcgttctaggcaggaa

SEQ ID NO: 3870 - DNA, 25 bp, S. cerevisiae
atcggcatcgcaggtgctcataggg

SEQ ID NO: 3871 - DNA, 25 bp, S. cerevisiae
atctgcgactcttatgtaaggccca

SEQ ID NO: 3872 - DNA, 25 bp, S. cerevisiae
atcggagctttggtagcgtgtatat

SEQ ID NO: 3873 - DNA, 25 bp, S. cerevisiae
atctcgattttgttacttgcattga

SEQ ID NO: 3874 - DNA, 25 bp, S. cerevisiae
atcgctagttgctctttgtgacatt

SEQ ID NO: 3875 - DNA, 25 bp, S. cerevisiae
atctcctttgccgtgggttaccagt

SEQ ID NO: 3876 - DNA, 25 bp, S. cerevisiae
atccaattcctagtgcgtttaccaa

SEQ ID NO: 3877 - DNA, 25 bp, S. cerevisiae
atcgttcggtgcgtcgttccaaaat

SEQ ID NO: 3878 - DNA, 25 bp, S. cerevisiae
atggtgccgttcacatgtccaccta

SEQ ID NO: 3879 - DNA, 25 bp, S. cerevisiae
atcgcccaattgaaagctctccaag

SEQ ID NO: 3880 - DNA, 25 bp, S. cerevisiae
atctgctcctattttttccatattg

SEQ ID NO: 3881 - DNA, 25 bp, S. cerevisiae
atccccttcttgatcattggtgagc

SEQ ID NO: 3882 - DNA, 25 bp, S. cerevisiae
atcgcccattagttctaagattgtg

SEQ ID NO: 3883 - DNA, 25 bp, S. cerevisiae
atgacttcatggtgggtattgcgcc

SEQ ID NO: 3884 - DNA, 25 bp, S. cerevisiae
atgcctttgtaccaggtatggccaa

SEQ ID NO: 3885 - DNA, 25 bp, S. cerevisiae
atccctttcatccaggatatgctag

SEQ ID NO: 3886 - DNA, 25 bp, S. cerevisiae
atcggtcagccattgagcagagaac

SEQ ID NO: 3887 - DNA, 25 bp, S. cerevisiae
atctgggccttgttcatctgatttc

SEQ ID NO: 3888 - DNA, 25 bp, S. cerevisiae
atctgggacttgactatgtgcgtgc

SEQ ID NO: 3889 - DNA, 25 bp, S. cerevisiae
atctgcggatgataccattggtaca

SEQ ID NO: 3890 - DNA, 25 bp, S. cerevisiae
atcgctgagagaatcgccgtgttac

SEQ ID NO: 3891 - DNA, 25 bp, S. cerevisiae
atcggttgttgtggccatttggtac

SEQ ID NO: 3892 - DNA, 25 bp, S. cerevisiae
atcgagtttgttctcttcacagact

SEQ ID NO: 3893 - DNA, 25 bp, S. cerevisiae
atcgtcgtacactgaaatctccttt

SEQ ID NO: 3894 - DNA, 25 bp, S. cerevisiae
atctgggaacacttacaacctcatt

SEQ ID NO: 3895 - DNA, 25 bp, S. cerevisiae
atctggatcaactgctcgacggtaa

SEQ ID NO: 3896 - DNA, 25 bp, S. cerevisiae
atctgtgataactttctgatcagga

SEQ ID NO: 3897 - DNA, 25 bp, S. cerevisiae
atctccaccttttgcaagcacgaag

SEQ ID NO: 3898 - DNA, 25 bp, S. cerevisiae
atccccgctggttgcaagagctaga

SEQ ID NO: 3899 - DNA, 25 bp, S. cerevisiae
atccgcggatggttacaatgttgca

SEQ ID NO: 3900 - DNA, 25 bp, S. cerevisiae
atcccaaatggctgctatggctgaa

SEQ ID NO: 3901 - DNA, 25 bp, S. cerevisiae
atcgtccaagatacagtgcggcatt

SEQ ID NO: 3902 - DNA, 25 bp, S. cerevisiae
atcgtgagaattgcggcaccaccaa

SEQ ID NO: 3903 - DNA, 25 bp, S. cerevisiae
atcggtttgacccatatgagaattc

SEQ ID NO: 3904 - DNA, 25 bp, S. cerevisiae
atctgccgtttcaacagcgaacaca

SEQ ID NO: 3905 - DNA, 25 bp, S. cerevisiae
atctgcaaacaaaacatgacgccca

SEQ ID NO: 3906 - DNA, 25 bp, S. cerevisiae
atctgcataatcttttcagcccttc

SEQ ID NO: 3907 - DNA, 25 bp, S. cerevisiae
atctgcattatgttgtgtcgtcact

SEQ ID NO: 3908 - DNA, 25 bp, S. cerevisiae
atcgcattcaaattatctggcacaa

SEQ ID NO: 3909 - DNA, 25 bp, S. cerevisiae
atccgtgaggcgtggagactctacc

SEQ ID NO: 3910 - DNA, 25 bp, S. cerevisiae
ctcactggagggacaagacttaact

SEQ ID NO: 3911 - DNA, 25 bp, S. cerevisiae
accggcagcggcgtatactaatact

SEQ ID NO: 3912 - DNA, 25 bp, S. cerevisiae
atccgcatccgggtatggtaaatat

SEQ ID NO: 3913 - DNA, 25 bp, S. cerevisiae
atccgcaactacattctgggcatta

SEQ ID NO: 3914 - DNA, 25 bp, S. cerevisiae
atcccgtaaatcgatttcatcctga

SEQ ID NO: 3915 - DNA, 25 bp, S. cerevisiae
atcccttcaacaagatttatcgtac

SEQ ID NO: 3916 - DNA, 25 bp, S. cerevisiae
atcccttcaaacaaaccacgtgatg

SEQ ID NO: 3917 - DNA, 25 bp, S. cerevisiae
atctgtttgccgtaagtgttatgct

SEQ ID NO: 3918 - DNA, 25 bp, S. cerevisiae
atcgtcttgtggaaatgcttcttct

SEQ ID NO: 3919 - DNA, 25 bp, S. cerevisiae
atcgtgttaaattccttgactcaaa

SEQ ID NO: 3920 - DNA, 25 bp, S. cerevisiae
atctgggaacgtgtatgtgtggtct

SEQ ID NO: 3921 - DNA, 25 bp, S. cerevisiae
atgccaattttgtgagaagtctttc

SEQ ID NO: 3922 - DNA, 25 bp, S. cerevisiae
atccattttcagtgggcgtgggtcc

SEQ ID NO: 3923 - DNA, 25 bp, S. cerevisiae
atctggtcacagaactgctccaaag

SEQ ID NO: 3924 - DNA, 25 bp, S. cerevisiae
atcgagatcgagacctactcagaca

SEQ ID NO: 3925 - DNA, 25 bp, S. cerevisiae
atcgagatccatgtccttgagcaag

SEQ ID NO: 3926 - DNA, 25 bp, S. cerevisiae
atctgttcagtttgcctatgtgtct

SEQ ID NO: 3927 - DNA, 25 bp, S. cerevisiae
atcgctccacatttgcctgttgatt

SEQ ID NO: 3928 - DNA, 25 bp, S. cerevisiae
atcggacattcagtacaatcccctg

SEQ ID NO: 3929 - DNA, 25 bp, S. cerevisiae
atcgcaagtttcatcaaggtctctg

SEQ ID NO: 3930 - DNA, 25 bp, S. cerevisiae
atcgatgtgttgacttatttggccg

SEQ ID NO: 3931 - DNA, 25 bp, S. cerevisiae
atcgaggttgctatcgctttgggaa

SEQ ID NO: 3932 - DNA, 25 bp, S. cerevisiae
atcgtcgcctttacttgacattaca

SEQ ID NO: 3933 - DNA, 25 bp, S. cerevisiae
atcgctatcggagctattgcaaata

SEQ ID NO: 3934 - DNA, 25 bp, S. cerevisiae
accacttatggccactaatacttct

SEQ ID NO: 3935 - DNA, 25 bp, S. cerevisiae
atcctctcatttcgaatccatgact

SEQ ID NO: 3936 - DNA, 25 bp, S. cerevisiae
atccctgatcatcggtatccaatct

SEQ ID NO: 3937 - DNA, 25 bp, S. cerevisiae
atcgtcgacatctaatacaccatcc

SEQ ID NO: 3938 - DNA, 25 bp, S. cerevisiae
atcgtggtgctatgggtatcattct

SEQ ID NO: 3939 - DNA, 25 bp, S. cerevisiae
atcggttcttactgccaagtgatac

SEQ ID NO: 3940 - DNA, 25 bp, S. cerevisiae
atgcggccctaagagccaaggctga

SEQ ID NO: 3941 - DNA, 25 bp, S. cerevisiae
atcgtcaccaaagcttcacaggtta

SEQ ID NO: 3942 - DNA, 25 bp, S. cerevisiae
atcggagttccattttatctttttg

SEQ ID NO: 3943 - DNA, 25 bp, S. cerevisiae
atcggtgatgatccggctgttacca

SEQ ID NO: 3944 - DNA, 25 bp, S. cerevisiae
atcgagcgtccactctcaaatatgt

SEQ ID NO: 3945 - DNA, 25 bp, S. cerevisiae
atctggcgcaccactcagaattaga

SEQ ID NO: 3946 - DNA, 25 bp, S. cerevisiae
atcgtcgctgccttcgctactgttg

SEQ ID NO: 3947 - DNA, 25 bp, S. cerevisiae
atcgtctctgacttctgtgccaggt

SEQ ID NO: 3948 - DNA, 25 bp, S. cerevisiae
atcgaattttctagcgccgttcaag

SEQ ID NO: 3949 - DNA, 25 bp, S. cerevisiae
atcgcttttgaacttggcgttggca

SEQ ID NO: 3950 - DNA, 25 bp, S. cerevisiae
atcgttgttgaactttcaggcgcac

SEQ ID NO: 3951 - DNA, 25 bp, S. cerevisiae
atcgggcttgaatttgtagaaccat

SEQ ID NO: 3952 - DNA, 25 bp, S. cerevisiae
atcggtatcgccgttgaccacagac

SEQ ID NO: 3953 - DNA, 25 bp, S. cerevisiae
atccggtgccgcattacaagcaaga

SEQ ID NO: 3954 - DNA, 25 bp, S. cerevisiae
atcggactatctatctgtggaccag

SEQ ID NO: 3955 - DNA, 25 bp, S. cerevisiae
atcgaacttctatctgggacagcag

SEQ ID NO: 3956 - DNA, 25 bp, S. cerevisiae
atcgaccatgtgttcttcgtacata

SEQ ID NO: 3957 - DNA, 25 bp, S. cerevisiae
atcggcggatgggttggtatttaat

SEQ ID NO: 3958 - DNA, 25 bp, S. cerevisiae
atcgtcggctgcaagattggctatt

SEQ ID NO: 3959 - DNA, 25 bp, S. cerevisiae
atcgttgagcataagcaatcctttt

SEQ ID NO: 3960 - DNA, 25 bp, S. cerevisiae
atcgaaggtgatttgcctccaatcc

SEQ ID NO: 3961 - DNA, 25 bp, S. cerevisiae
atcgatcaacgatacgcccacattg

SEQ ID NO: 3962 - DNA, 25 bp, S. cerevisiae
atcggctctttctacagtgggttca

SEQ ID NO: 3963 - DNA, 25 bp, S. cerevisiae
atgccttccggtacgagtcattgga

SEQ ID NO: 3964 - DNA, 25 bp, S. cerevisiae
atcgtcacgtatgaatcctccatta

SEQ ID NO: 3965 - DNA, 25 bp, S. cerevisiae
atgcccgtgggtctggacaagttta

SEQ ID NO: 3966 - DNA, 25 bp, S. cerevisiae
atcctccaaggtcattatcaagttt

SEQ ID NO: 3967 - DNA, 25 bp, S. cerevisiae
atcggccccgtgaaatatcatcgtg

SEQ ID NO: 3968 - DNA, 25 bp, S. cerevisiae
atcgaccaccgtgatggacattctg

SEQ ID NO: 3969 - DNA, 25 bp, S. cerevisiae
atcgaccatacttttgaaccattga

SEQ ID NO: 3970 - DNA, 25 bp, S. cerevisiae
atcgaggatcctagtgtgtaccatg

SEQ ID NO: 3971 - DNA, 25 bp, S. cerevisiae
atcgtaactttgtctcacctggaaa

SEQ ID NO: 3972 - DNA, 25 bp, S. cerevisiae
aaattaccgtgggatcctcgaccag

SEQ ID NO: 3973 - DNA, 25 bp, S. cerevisiae
aagtctatggtgtggaccctaccaa

SEQ ID NO: 3974 - DNA, 25 bp, S. cerevisiae
atcgtttggctggtttatcactcta

SEQ ID NO: 3975 - DNA, 25 bp, S. cerevisiae
atcctcctagcacattttattctca

SEQ ID NO: 3976 - DNA, 25 bp, S. cerevisiae
atcgtcacaactactaccgaactgt

SEQ ID NO: 3977 - DNA, 25 bp, S. cerevisiae
atcgtgcctacaaagagctacatat

SEQ ID NO: 3978 - DNA, 25 bp, S. cerevisiae
atcggcttacaaaccttcaattact

SEQ ID NO: 3979 - DNA, 25 bp, S. cerevisiae
atcggctttatttattgctgccaag

SEQ ID NO: 3980 - DNA, 25 bp, S. cerevisiae
atcgtgcttctatctatactgctca

SEQ ID NO: 3981 - DNA, 25 bp, S. cerevisiae
atcggtgtcgagtgccatgtcaaat

SEQ ID NO: 3982 - DNA, 25 bp, S. cerevisiae
atcggttctgtgctgccatgtccag

SEQ ID NO: 3983 - DNA, 25 bp, S. cerevisiae
atcggtcatcggctccattgtataa

SEQ ID NO: 3984 - DNA, 25 bp, S. cerevisiae
atcggagggacaacgctagtgctaa

SEQ ID NO: 3985 - DNA, 25 bp, S. cerevisiae
atcgaagacattgcgcctgtgcagg

SEQ ID NO: 3986 - DNA, 25 bp, S. cerevisiae
atccgataacatcctattgtccatg

SEQ ID NO: 3987 - DNA, 25 bp, S. cerevisiae
atgcccaaccactcattgacttaga

SEQ ID NO: 3988 - DNA, 25 bp, S. cerevisiae
atccgtgcattattacatagtatac

SEQ ID NO: 3989 - DNA, 25 bp, S. cerevisiae
atccgtcttggaactagtcgactct

SEQ ID NO: 3990 - DNA, 25 bp, S. cerevisiae
atcccttagtgaagcatgcaactga

SEQ ID NO: 3991 - DNA, 25 bp, S. cerevisiae
atccacccaagatctgtcactgaat

SEQ ID NO: 3992 - DNA, 25 bp, S. cerevisiae
atcccatccatagttctgataccgg

SEQ ID NO: 3993 - DNA, 25 bp, S. cerevisiae
atccagcatgcaatacagtgacata

SEQ ID NO: 3994 - DNA, 25 bp, S. cerevisiae
atccagcatgcaatacagtgacata

SEQ ID NO: 3995 - DNA, 25 bp, S. cerevisiae
atcgaagaagctaccccatttatta

SEQ ID NO: 3996 - DNA, 25 bp, S. cerevisiae
atcgaaagacttggccaatctggtg

SEQ ID NO: 3997 - DNA, 25 bp, S. cerevisiae
atcggtagtatgtccacggtacagc

SEQ ID NO: 3998 - DNA, 25 bp, S. cerevisiae
atccacttctttttgatttcctgca

SEQ ID NO: 3999 - DNA, 25 bp, S. cerevisiae
atgctccccagaaagtacaagcccg

SEQ ID NO: 4000 - DNA, 25 bp, S. cerevisiae
atgcgcccgagaatttagaacccct

SEQ ID NO: 4001 - DNA, 25 bp, S. cerevisiae
atgccatcggttgttatggacccca

SEQ ID NO: 4002 - DNA, 25 bp, S. cerevisiae
acgacaggcttaaacggatctccga

SEQ ID NO: 4003 - DNA, 25 bp, S. cerevisiae
acgagggtttatccaggacacgaat

SEQ ID NO: 4004 - DNA, 25 bp, S. cerevisiae
atcgtggtgttttgccagtttccat

SEQ ID NO: 4005 - DNA, 25 bp, S. cerevisiae
atcctggtgttttcaatgtaggcca

SEQ ID NO: 4006 - DNA, 25 bp, S. cerevisiae
atcctagcatgcatttgaatttggc

SEQ ID NO: 4007 - DNA, 25 bp, S. cerevisiae
atccatcgatgaatttgctaccttg

SEQ ID NO: 4008 - DNA, 25 bp, S. cerevisiae
atcgtgttgaactcagatcgtgctg

SEQ ID NO: 4009 - DNA, 25 bp, S. cerevisiae
atgccaatggcatcttaccaggaag

SEQ ID NO: 4010 - DNA, 25 bp, S. cerevisiae
atccgaggataagacgcagtccagt

SEQ ID NO: 4011 - DNA, 25 bp, S. cerevisiae
atccaaggaagtttcgcgacgagta

SEQ ID NO: 4012 - DNA, 25 bp, S. cerevisiae
atccaagaaggattattccatagat

SEQ ID NO: 4013 - DNA, 25 bp, S. cerevisiae
atcggtcatattttacagtggcatc

SEQ ID NO: 4014 - DNA, 25 bp, S. cerevisiae
atcgttccattgatggaccgtgtcc

SEQ ID NO: 4015 - DNA, 25 bp, S. cerevisiae
atgccgcccttttgcaataacgttg

SEQ ID NO: 4016 - DNA, 25 bp, S. cerevisiae
atcgctggcgatatacaaggcgcta

SEQ ID NO: 4017 - DNA, 25 bp, S. cerevisiae
atcctacgtgaatccagacgcctta

SEQ ID NO: 4018 - DNA, 25 bp, S. cerevisiae
atgctgctagggataacaagaagac

SEQ ID NO: 4019 - DNA, 25 bp, S. cerevisiae
atcgctgaaggtaagtctaagcaag

SEQ ID NO: 4020 - DNA, 25 bp, S. cerevisiae
atcgcagactactaataatcacgtg

SEQ ID NO: 4021 - DNA, 25 bp, S. cerevisiae
atccaaactccaagggcacatgcgg

SEQ ID NO: 4022 - DNA, 25 bp, S. cerevisiae
atgccagaactatcggtatcgccgt

SEQ ID NO: 4023 - DNA, 25 bp, S. cerevisiae
atgcccagtttatttgtacgacgtt

SEQ ID NO: 4024 - DNA, 25 bp, S. cerevisiae
atgctaagtttttggctgacgcagc

SEQ ID NO: 4025 - DNA, 25 bp, S. cerevisiae
atcgtcaattttcgcgctaatgcaa

SEQ ID NO: 4026 - DNA, 25 bp, S. cerevisiae
atcgctaatatcattggtgaggcca

SEQ ID NO: 4027 - DNA, 25 bp, S. cerevisiae
atcgactgattctatggaacgccaa

SEQ ID NO: 4028 - DNA, 25 bp, S. cerevisiae
atcgatatcacctgaatggctccaa

SEQ ID NO: 4029 - DNA, 25 bp, S. cerevisiae
atcgcatgccatgggtataccatta

SEQ ID NO: 4030 - DNA, 25 bp, S. cerevisiae
atcgatgacctgcataagcctttaa

SEQ ID NO: 4031 - DNA, 25 bp, S. cerevisiae
atccaccctggattacctgtgtaat

SEQ ID NO: 4032 - DNA, 25 bp, S. cerevisiae
atccaaacaggataccgcttctaag

SEQ ID NO: 4033 - DNA, 25 bp, S. cerevisiae
atccaagatcggtgcatgggcttcc

SEQ ID NO: 4034 - DNA, 25 bp, S. cerevisiae
atgctcctttgtgcctaagtggtac

SEQ ID NO: 4035 - DNA, 25 bp, S. cerevisiae
atcctttggtccctgaaattgctca

SEQ ID NO: 4036 - DNA, 25 bp, S. cerevisiae
atcgattcgcctggttatggcttta

SEQ ID NO: 4037 - DNA, 25 bp, S. cerevisiae
atccctgggatgactactctattac

SEQ ID NO: 4038 - DNA, 25 bp, S. cerevisiae
atccgcatgggatcttactgaattc

SEQ ID NO: 4039 - DNA, 25 bp, S. cerevisiae
atcgcctgcggatgtgtccataaag

SEQ ID NO: 4040 - DNA, 25 bp, S. cerevisiae
atcgtcaaggaggtgtgcctggtat

SEQ ID NO: 4041 - DNA, 25 bp, S. cerevisiae
atcgtaatgagcgacgtgcctaatt

SEQ ID NO: 4042 - DNA, 25 bp, S. cerevisiae
atcgtacagtgtccatttgtaagca

SEQ ID NO: 4043 - DNA, 25 bp, S. cerevisiae
atcgtttgtgaccattcgtaagcct

SEQ ID NO: 4044 - DNA, 25 bp, S. cerevisiae
atcgctgcccaaacttccagaaaat

SEQ ID NO: 4045 - DNA, 25 bp, S. cerevisiae
atcctggacagcctttcaaattctg

SEQ ID NO: 4046 - DNA, 25 bp, S. cerevisiae
atccgcgaacgcatctgaacttatg

SEQ ID NO: 4047 - DNA, 25 bp, S. cerevisiae
atccagcataattcctcgaacttct

SEQ ID NO: 4048 - DNA, 25 bp, S. cerevisiae
atcctatatatgtcaccgaaccttc

SEQ ID NO: 4049 - DNA, 25 bp, S. cerevisiae
atcctgcaattgtcatcggaaccaa

SEQ ID NO: 4050 - DNA, 25 bp, S. cerevisiae
agattacctggctcgtactacaaga

SEQ ID NO: 4051 - DNA, 25 bp, S. cerevisiae
atgttacgtcgccttggacttcgaa

SEQ ID NO: 4052 - DNA, 25 bp, S. cerevisiae
atgctcccctccattagtttcgatt

SEQ ID NO: 4053 - DNA, 25 bp, S. cerevisiae
atccggagggcaatggttcaatgtt

SEQ ID NO: 4054 - DNA, 25 bp, S. cerevisiae
atcccagtgggtatttcatattcta

SEQ ID NO: 4055 - DNA, 25 bp, S. cerevisiae
atccatttcgaatgccgagtttgcc

SEQ ID NO: 4056 - DNA, 25 bp, S. cerevisiae
atcccaactgttgagcttgtagtga

SEQ ID NO: 4057 - DNA, 25 bp, S. cerevisiae
atcctcctatggacctttgtagtga

SEQ ID NO: 4058 - DNA, 25 bp, S. cerevisiae
atcgaccagtcgtatcttatataat

SEQ ID NO: 4059 - DNA, 25 bp, S. cerevisiae
atcgatctggatactgggtgttccg

SEQ ID NO: 4060 - DNA, 25 bp, S. cerevisiae
atcccgaatctttcaattcctttca

SEQ ID NO: 4061 - DNA, 25 bp, S. cerevisiae
atccatcgtgccattttagggtctg

SEQ ID NO: 4062 - DNA, 25 bp, S. cerevisiae
atcgctcgactcatttttccagaag

SEQ ID NO: 4063 - DNA, 25 bp, S. cerevisiae
atccggtaattgaattcttccacag

SEQ ID NO: 4064 - DNA, 25 bp, S. cerevisiae
atcgcttttattattctatctcctg

SEQ ID NO: 4065 - DNA, 25 bp, S. cerevisiae
atcgttttatcattctctcttgcac

SEQ ID NO: 4066 - DNA, 25 bp, S. cerevisiae
atcgttatctacatcgttggcacat

SEQ ID NO: 4067 - DNA, 25 bp, S. cerevisiae
atgcgttcaggaatgttatgtcccc

SEQ ID NO: 4068 - DNA, 25 bp, S. cerevisiae
atcgctatcgcgatgatgttccgat

SEQ ID NO: 4069 - DNA, 25 bp, S. cerevisiae
atcgaatcgctgcttgatgttcaag

SEQ ID NO: 4070 - DNA, 25 bp, S. cerevisiae
atgcgagaggccctgggttcaattc

SEQ ID NO: 4071 - DNA, 25 bp, S. cerevisiae
atcgatgaagccaacggttcactag

SEQ ID NO: 4072 - DNA, 25 bp, S. cerevisiae
accgccggcagtctacaaaacaatg

SEQ ID NO: 4073 - DNA, 25 bp, S. cerevisiae
atcgctattggtttgaacaagggta

SEQ ID NO: 4074 - DNA, 25 bp, S. cerevisiae
atggccatggttctagacaagggtc

SEQ ID NO: 4075 - DNA, 25 bp, S. cerevisiae
atcgacggattttacaatcaatggt

SEQ ID NO: 4076 - DNA, 25 bp, S. cerevisiae
atgcgatacgttggaaaatcactat

SEQ ID NO: 4077 - DNA, 25 bp, S. cerevisiae
aggcgtagcaatgtcggtgttgtta

SEQ ID NO: 4078 - DNA, 25 bp, S. cerevisiae
atccgaaggtttacagttcttgcaa

SEQ ID NO: 4079 - DNA, 25 bp, S. cerevisiae
atcgttggtatcgtttccggtgaat

SEQ ID NO: 4080 - DNA, 25 bp, S. cerevisiae
atgttgatgagcacgttaccaggtg

SEQ ID NO: 4081 - DNA, 25 bp, S. cerevisiae
atgctcactgactcgttactaggcg

SEQ ID NO: 4082 - DNA, 25 bp, S. cerevisiae
atcgcattcccgtcactgtgaagag

SEQ ID NO: 4083 - DNA, 25 bp, S. cerevisiae
atcgctacttcaccagtacacgaaa

SEQ ID NO: 4084 - DNA, 25 bp, S. cerevisiae
atcgaagtatcaccagaagcccaaa

SEQ ID NO: 4085 - DNA, 25 bp, S. cerevisiae
atcgatcttttcgtcaagtgcaata

SEQ ID NO: 4086 - DNA, 25 bp, S. cerevisiae
atcgatctattcctctacatgtgca

SEQ ID NO: 4087 - DNA, 25 bp, S. cerevisiae
atcgctgccatgtttgctacatatg

SEQ ID NO: 4088 - DNA, 25 bp, S. cerevisiae
atcctgacctaccaattgctgaatt

SEQ ID NO: 4089 - DNA, 25 bp, S. cerevisiae
atcctctgcttttaacttctcgttt

SEQ ID NO: 4090 - DNA, 25 bp, S. cerevisiae
atcctctgtaagtcgttatttttct

SEQ ID NO: 4091 - DNA, 25 bp, S. cerevisiae
atccattgtacaggaccttggctta

SEQ ID NO: 4092 - DNA, 25 bp, S. cerevisiae
atccattgtggatgccgctgttgcg

SEQ ID NO: 4093 - DNA, 25 bp, S. cerevisiae
atccgatcattctaacggctcacta

SEQ ID NO: 4094 - DNA, 25 bp, S. cerevisiae
atccaaagtcatcgattcacctgaa

SEQ ID NO: 4095 - DNA, 25 bp, S. cerevisiae
atccactatgattccttgaccatga

SEQ ID NO: 4096 - DNA, 25 bp, S. cerevisiae
atgctcctaataccaagaccaaacc

SEQ ID NO: 4097 - DNA, 25 bp, S. cerevisiae
atgctcttgccaaaacaaaaaaatc

SEQ ID NO: 4098 - DNA, 25 bp, S. cerevisiae
atgcctctccaaaaaatggccccat

SEQ ID NO: 4099 - DNA, 25 bp, S. cerevisiae
atcctacccattatatttcctgcat

SEQ ID NO: 4100 - DNA, 25 bp, S. cerevisiae
atcccaatatcgatgcgcttcttaa

SEQ ID NO: 4101 - DNA, 25 bp, S. cerevisiae
atccgactacgaatgctcttctgaa

SEQ ID NO: 4102 - DNA, 25 bp, S. cerevisiae
atccgatggcgctaacgttcagggc

SEQ ID NO: 4103 - DNA, 25 bp, S. cerevisiae
atcgaacgtgatccaaatgctccaa

SEQ ID NO: 4104 - DNA, 25 bp, S. cerevisiae
atgcggagtgactgtaagcgtaatt

SEQ ID NO: 4105 - DNA, 25 bp, S. cerevisiae
atgccagcgtgcttgtgtaggcgta

SEQ ID NO: 4106 - DNA, 25 bp, S. cerevisiae
atcgcagcggcaatggtaccattca

SEQ ID NO: 4107 - DNA, 25 bp, S. cerevisiae
atcgcttgctcttttatttgtgcta

SEQ ID NO: 4108 - DNA, 25 bp, S. cerevisiae
atcgcatgccttgtgggagtctaca

SEQ ID NO: 4109 - DNA, 25 bp, S. cerevisiae
atcgacgcattattgtgaggcttta

SEQ ID NO: 4110 - DNA, 25 bp, S. cerevisiae
atcgactctcaaggtgacctgctaa

SEQ ID NO: 4111 - DNA, 25 bp, S. cerevisiae
atgccttttcacgtaagggatccgt

SEQ ID NO: 4112 - DNA, 25 bp, S. cerevisiae
atcgccgtctcctgagcaagatcaa

SEQ ID NO: 4113 - DNA, 25 bp, S. cerevisiae
atccaccgcagctccggttgaagag

SEQ ID NO: 4114 - DNA, 25 bp, S. cerevisiae
atcctgccgtccttattttagatga

SEQ ID NO: 4115 - DNA, 25 bp, S. cerevisiae
atccaccgctactaagtttactcag

SEQ ID NO: 4116 - DNA, 25 bp, S. cerevisiae
atccaccgaacaaagtccttcttat

SEQ ID NO: 4117 - DNA, 25 bp, S. cerevisiae
atccattagataacgctttcttctt

SEQ ID NO: 4118 - DNA, 25 bp, S. cerevisiae
atccttattcttggtaatcttgctg

SEQ ID NO: 4119 - DNA, 25 bp, S. cerevisiae
atcccatatctacctattagctggc

SEQ ID NO: 4120 - DNA, 25 bp, S. cerevisiae
atccttgctgttgttgtcaactgta

SEQ ID NO: 4121 - DNA, 25 bp, S. cerevisiae
atcctctccaggtattggcagttca

SEQ ID NO: 4122 - DNA, 25 bp, S. cerevisiae
atcctgtccgcgtcaagaaattcta

SEQ ID NO: 4123 - DNA, 25 bp, S. cerevisiae
atcctccccatgtgatgtcaaatta

SEQ ID NO: 4124 - DNA, 25 bp, S. cerevisiae
atccggcatgccagatattttcttt

SEQ ID NO: 4125 - DNA, 25 bp, S. cerevisiae
atcctgaagtggctgcgatcatgca

SEQ ID NO: 4126 - DNA, 25 bp, S. cerevisiae
atcgccatcatttctaccattatct

SEQ ID NO: 4127 - DNA, 25 bp, S. cerevisiae
atccgcacttcaatgggcctatcga

SEQ ID NO: 4128 - DNA, 25 bp, S. cerevisiae
atccgcggcctaagacagtacgcag

SEQ ID NO: 4129 - DNA, 25 bp, S. cerevisiae
atccgcagagcgataatccatcatc

SEQ ID NO: 4130 - DNA, 25 bp, S. cerevisiae
atcgctggaccaacataccatctat

SEQ ID NO: 4131 - DNA, 25 bp, S. cerevisiae
atgcaggtgaaaatctatcccagtt

SEQ ID NO: 4132 - DNA, 25 bp, S. cerevisiae
atgcaggtggcttggttaaccatcc

SEQ ID NO: 4133 - DNA, 25 bp, S. cerevisiae
atcctgctattttcttgtactcatt

SEQ ID NO: 4134 - DNA, 25 bp, S. cerevisiae
atcgctgttgtttccatctatctaa

SEQ ID NO: 4135 - DNA, 25 bp, S. cerevisiae
atcgctggtttgtctccatacgaaa

SEQ ID NO: 4136 - DNA, 25 bp, S. cerevisiae
atccggttcttctactggtgtcaag

SEQ ID NO: 4137 - DNA, 25 bp, S. cerevisiae
actgaagaagtctgggccgtcaagg

SEQ ID NO: 4138 - DNA, 25 bp, S. cerevisiae
atccaactattccaagcccattaag

SEQ ID NO: 4139 - DNA, 25 bp, S. cerevisiae
atccagctttattgagacccggtag

SEQ ID NO: 4140 - DNA, 25 bp, S. cerevisiae
atcccagaaatacctgttccagaga

SEQ ID NO: 4141 - DNA, 25 bp, S. cerevisiae
atccggaaattcctgcattcaagta

SEQ ID NO: 4142 - DNA, 25 bp, S. cerevisiae
atccgctgcaataacgtgctgtaca

SEQ ID NO: 4143 - DNA, 25 bp, S. cerevisiae
atccggtatctatggcttaactgaa

SEQ ID NO: 4144 - DNA, 25 bp, S. cerevisiae
atccggttattctgccaaccattat

SEQ ID NO: 4145 - DNA, 25 bp, S. cerevisiae
atccggtttttctaagcaagctttg

SEQ ID NO: 4146 - DNA, 25 bp, S. cerevisiae
atgccgttacctccgatgaaatttt

SEQ ID NO: 4147 - DNA, 25 bp, S. cerevisiae
atcgccttccctcatgatgacaaaa

SEQ ID NO: 4148 - DNA, 25 bp, S. cerevisiae
atgcgcacgggctggcaatcagaaa

SEQ ID NO: 4149 - DNA, 25 bp, S. cerevisiae
atgccattccagtcgctaacaataa

SEQ ID NO: 4150 - DNA, 25 bp, S. cerevisiae
atccaccgtggcaatcagcgaaatt

SEQ ID NO: 4151 - DNA, 25 bp, S. cerevisiae
atgccaagcagtactaccgaatttt

SEQ ID NO: 4152 - DNA, 25 bp, S. cerevisiae
atgcatccacagttagaagctgaac

SEQ ID NO: 4153 - DNA, 25 bp, S. cerevisiae
atgctcccaactgatatcgaatcgc

SEQ ID NO: 4154 - DNA, 25 bp, S. cerevisiae
atgcatgccctactcattatctgag

SEQ ID NO: 4155 - DNA, 25 bp, S. cerevisiae
atgcccctgaggatacgacgtggaa

SEQ ID NO: 4156 - DNA, 25 bp, S. cerevisiae
atcccttggatgatacgaagcttgg

SEQ ID NO: 4157 - DNA, 25 bp, S. cerevisiae
atcctctgtggcagctacgtcagtt

SEQ ID NO: 4158 - DNA, 25 bp, S. cerevisiae
atcgcctgcttactactttgtatca

SEQ ID NO: 4159 - DNA, 25 bp, S. cerevisiae
atcgcgccattctttgctggtgatt

SEQ ID NO: 4160 - DNA, 25 bp, S. cerevisiae
atcgctgcatctgttatcatgggtt

SEQ ID NO: 4161 - DNA, 25 bp, S. cerevisiae
atcgctgcactccaatacagacttt

SEQ ID NO: 4162 - DNA, 25 bp, S. cerevisiae
atgcgtcagatgtcacaaagccttt

SEQ ID NO: 4163 - DNA, 25 bp, S. cerevisiae
atgactgttgggttacttctttgca

SEQ ID NO: 4164 - DNA, 25 bp, S. cerevisiae
atcctaatgtagtaacttctggtga

SEQ ID NO: 4165 - DNA, 25 bp, S. cerevisiae
atcccaatccgatgaattttctgag

SEQ ID NO: 4166 - DNA, 25 bp, S. cerevisiae
atcgccacacacgtatcttttgttg

SEQ ID NO: 4167 - DNA, 25 bp, S. cerevisiae
atcgcggcaagcttcaggtctggta

SEQ ID NO: 4168 - DNA, 25 bp, S. cerevisiae
atccgcgacgataaagactggctta

SEQ ID NO: 4169 - DNA, 25 bp, S. cerevisiae
atccgcttctgaatacgacagtgct

SEQ ID NO: 4170 - DNA, 25 bp, S. cerevisiae
atcgcctgtgggtacgagactgcaa

SEQ ID NO: 4171 - DNA, 25 bp, S. cerevisiae
atccatgctccgtcattagtcgaag

SEQ ID NO: 4172 - DNA, 25 bp, S. cerevisiae
atcctcatattgctcctgattggtt

SEQ ID NO: 4173 - DNA, 25 bp, S. cerevisiae
atccgacatctggtcactaggttgt

SEQ ID NO: 4174 - DNA, 25 bp, S. cerevisiae
atccccttccataatagcactgtgt

SEQ ID NO: 4175 - DNA, 25 bp, S. cerevisiae
atccactcaatttatatacacttat

SEQ ID NO: 4176 - DNA, 25 bp, S. cerevisiae
atccagcagtggaaacagtacccat

SEQ ID NO: 4177 - DNA, 25 bp, S. cerevisiae
atccttcctttgactactctcataa

SEQ ID NO: 4178 - DNA, 25 bp, S. cerevisiae
atccctctgtgtctatcgaatgcaa

SEQ ID NO: 4179 - DNA, 25 bp, S. cerevisiae
atccctctgtggtttaatgtcgtca

SEQ ID NO: 4180 - DNA, 25 bp, S. cerevisiae
atcccatctgattacttcaattcgg

SEQ ID NO: 4181 - DNA, 25 bp, S. cerevisiae
atgccagtgctttgaatacaccagc

SEQ ID NO: 4182 - DNA, 25 bp, S. cerevisiae
atccgtcgactattaactcatgcag

SEQ ID NO: 4183 - DNA, 25 bp, S. cerevisiae
atgccccagcaatcggtgatcaaca

SEQ ID NO: 4184 - DNA, 25 bp, S. cerevisiae
atccccaaaccaagcgatcaggtac

SEQ ID NO: 4185 - DNA, 25 bp, S. cerevisiae
atcgccatcaagattatctgcgctg

SEQ ID NO: 4186 - DNA, 25 bp, S. cerevisiae
atcctaagtcttacagcatggctct

SEQ ID NO: 4187 - DNA, 25 bp, S. cerevisiae
atcccgatgtcgatgttgcatacca

SEQ ID NO: 4188 - DNA, 25 bp, S. cerevisiae
atccgctctcttattcaggcagatg

SEQ ID NO: 4189 - DNA, 25 bp, S. cerevisiae
atccggatatgtttaggtggctcta

SEQ ID NO: 4190 - DNA, 25 bp, S. cerevisiae
atccggtaatgagtatgggcccaca

SEQ ID NO: 4191 - DNA, 25 bp, S. cerevisiae
atccggtcatagaaccgctccaaaa

SEQ ID NO: 4192 - DNA, 25 bp, S. cerevisiae
atccaccattagaccggcgtttaga

SEQ ID NO: 4193 - DNA, 25 bp, S. cerevisiae
atccaattgggtgccggtctatcag

SEQ ID NO: 4194 - DNA, 25 bp, S. cerevisiae
atcctcgctgcagattttcttgatt

SEQ ID NO: 4195 - DNA, 25 bp, S. cerevisiae
atcccattgcagatttgctccgttg

SEQ ID NO: 4196 - DNA, 25 bp, S. cerevisiae
atgttggcgcgcagtttgggttaca

SEQ ID NO: 4197 - DNA, 25 bp, S. cerevisiae
atgacggccgtgattgggaagtaca

SEQ ID NO: 4198 - DNA, 25 bp, S. cerevisiae
atgagcctaccgattgggaatgcac

SEQ ID NO: 4199 - DNA, 25 bp, S. cerevisiae
atcctgtaccgaattccgacaatgg

SEQ ID NO: 4200 - DNA, 25 bp, S. cerevisiae
atccgtgagaagatctgctcagcta

SEQ ID NO: 4201 - DNA, 25 bp, S. cerevisiae
atccgcgacgagaagctgtgccaaa

SEQ ID NO: 4202 - DNA, 25 bp, S. cerevisiae
atcctctaggataacggcgcaaact

SEQ ID NO: 4203 - DNA, 25 bp, S. cerevisiae
atccattatcgtacaagcctcaaca

SEQ ID NO: 4204 - DNA, 25 bp, S. cerevisiae
atcccgtatggcttgtaggagataa

SEQ ID NO: 4205 - DNA, 25 bp, S. cerevisiae
atgccggtaagaccacattgctaca

SEQ ID NO: 4206 - DNA, 25 bp, S. cerevisiae
atccggtaagcgacagatctttgaa

SEQ ID NO: 4207 - DNA, 25 bp, S. cerevisiae
atccgatggcaatgttatccttaag

SEQ ID NO: 4208 - DNA, 25 bp, S. cerevisiae
atccatggcagaacttactcaattg

SEQ ID NO: 4209 - DNA, 25 bp, S. cerevisiae
atgcgtgaagagattccccatatgg

SEQ ID NO: 4210 - DNA, 25 bp, S. cerevisiae
atgctcccggctcaaacgtggatat

SEQ ID NO: 4211 - DNA, 25 bp, S. cerevisiae
atccgagtccacttatatgctggga

SEQ ID NO: 4212 - DNA, 25 bp, S. cerevisiae
atcctggacatcgatgtacgttgga

SEQ ID NO: 4213 - DNA, 25 bp, S. cerevisiae
atcctcagcagcaaccagtctatgt

SEQ ID NO: 4214 - DNA, 25 bp, S. cerevisiae
atgccatcgcagaagacgacattgt

SEQ ID NO: 4215 - DNA, 25 bp, S. cerevisiae
atccacgggcagtcgtttatgttgc

SEQ ID NO: 4216 - DNA, 25 bp, S. cerevisiae
atcccgcagtgaggtgctcttagtg

SEQ ID NO: 4217 - DNA, 25 bp, S. cerevisiae
atcctccacgggtatgttactattg

SEQ ID NO: 4218 - DNA, 25 bp, S. cerevisiae
atccattgacggtattctatttttt

SEQ ID NO: 4219 - DNA, 25 bp, S. cerevisiae
atcctctgaagttaatcttggcgaa

SEQ ID NO: 4220 - DNA, 25 bp, S. cerevisiae
acgccgaattagctactcgcgatta

SEQ ID NO: 4221 - DNA, 25 bp, S. cerevisiae
aggctacaagtacaatcccgattat

SEQ ID NO: 4222 - DNA, 25 bp, S. cerevisiae
agcggtacgctacgaaacccatatt

SEQ ID NO: 4223 - DNA, 25 bp, S. cerevisiae
atgccttacgtgaagaaagcccttt

SEQ ID NO: 4224 - DNA, 25 bp, S. cerevisiae
atgctttggcggcaatcaagtccac

SEQ ID NO: 4225 - DNA, 25 bp, S. cerevisiae
atgcctgtcgctggtaaccagtcaa

SEQ ID NO: 4226 - DNA, 25 bp, S. cerevisiae
atgcctctgctagtttacccaaaca

SEQ ID NO: 4227 - DNA, 25 bp, S. cerevisiae
atgccaagctacaatttccaacgtc

SEQ ID NO: 4228 - DNA, 25 bp, S. cerevisiae
atccacgtcaaaatgctccaatctt

SEQ ID NO: 4229 - DNA, 25 bp, S. cerevisiae
atgccgcctaagaatgtgctagact

SEQ ID NO: 4230 - DNA, 25 bp, S. cerevisiae
atccagctcgaaatcccataactat

SEQ ID NO: 4231 - DNA, 25 bp, S. cerevisiae
atgcgcatgctgatatgggtactca

SEQ ID NO: 4232 - DNA, 25 bp, S. cerevisiae
atgcatcgaatacagtgccttcgcc

SEQ ID NO: 4233 - DNA, 25 bp, S. cerevisiae
atgctgtacagactccaattgggcg

SEQ ID NO: 4234 - DNA, 25 bp, S. cerevisiae
atgcggagacagatcaacaaagtga

SEQ ID NO: 4235 - DNA, 25 bp, S. cerevisiae
atcctgactgcttccgattacggtg

SEQ ID NO: 4236 - DNA, 25 bp, S. cerevisiae
atcctcatgattgggctgccgatat

SEQ ID NO: 4237 - DNA, 25 bp, S. cerevisiae
atgcctcaatccctgtgacgaacta

SEQ ID NO: 4238 - DNA, 25 bp, S. cerevisiae
atgccactaacgtagcagaccggct

SEQ ID NO: 4239 - DNA, 25 bp, S. cerevisiae
atgccactgaacgtagctatgccaa

SEQ ID NO: 4240 - DNA, 25 bp, S. cerevisiae
atccgtttgatgctgtggaacctct

SEQ ID NO: 4241 - DNA, 25 bp, S. cerevisiae
atccagattttgcatcgagacccct

SEQ ID NO: 4242 - DNA, 25 bp, S. cerevisiae
atccggtattgttcagcgaagcctc

SEQ ID NO: 4243 - DNA, 25 bp, S. cerevisiae
atccaggcgaagatccgagagactt

SEQ ID NO: 4244 - DNA, 25 bp, S. cerevisiae
atccatggtgatttgtcccagcaac

SEQ ID NO: 4245 - DNA, 25 bp, S. cerevisiae
atgctaggtcattttccacagttcc

SEQ ID NO: 4246 - DNA, 25 bp, S. cerevisiae
atgcagaaggttttgctcaagttca

SEQ ID NO: 4247 - DNA, 25 bp, S. cerevisiae
atgaatccttgttagatccggccga

SEQ ID NO: 4248 - DNA, 25 bp, S. cerevisiae
atgcttgtaattggagaagggccga

SEQ ID NO: 4249 - DNA, 25 bp, S. cerevisiae
aggatctggttctctagcggcaatg

SEQ ID NO: 4250 - DNA, 25 bp, S. cerevisiae
agtactggttttgactccacagcct

SEQ ID NO: 4251 - DNA, 25 bp, S. cerevisiae
acaaggccatagctacttacaaggt

SEQ ID NO: 4252 - DNA, 25 bp, S. cerevisiae
acaaggtaagctagaagttccaggt

SEQ ID NO: 4253 - DNA, 25 bp, S. cerevisiae
atgccttatcactatttatttttgg

SEQ ID NO: 4254 - DNA, 25 bp, S. cerevisiae
atgatcttccaacgcttgctaacgg

SEQ ID NO: 4255 - DNA, 25 bp, S. cerevisiae
atgctaatccagtggtggcgacgga

SEQ ID NO: 4256 - DNA, 25 bp, S. cerevisiae
atgcaataccgatttcgtcctggtt

SEQ ID NO: 4257 - DNA, 25 bp, S. cerevisiae
atccatacaccattatagtccgttt

SEQ ID NO: 4258 - DNA, 25 bp, S. cerevisiae
atccatcaattggtaagctatctga

SEQ ID NO: 4259 - DNA, 25 bp, S. cerevisiae
atgccaatttgctcatggtcttaat

SEQ ID NO: 4260 - DNA, 25 bp, S. cerevisiae
atgctggttcccatgcataactcac

SEQ ID NO: 4261 - DNA, 25 bp, S. cerevisiae
atgcttgttatttcgatacctgttc

SEQ ID NO: 4262 - DNA, 25 bp, S. cerevisiae
atgccgctagtttgaggaatctttc

SEQ ID NO: 4263 - DNA, 25 bp, S. cerevisiae
atgctcgcatacttagggataactt

SEQ ID NO: 4264 - DNA, 25 bp, S. cerevisiae
atgccatgattgctttactacgttg

SEQ ID NO: 4265 - DNA, 25 bp, S. cerevisiae
atccatttctgacgaactaagccgg

SEQ ID NO: 4266 - DNA, 25 bp, S. cerevisiae
atcctatctggtttccataacgctg

SEQ ID NO: 4267 - DNA, 25 bp, S. cerevisiae
atcctacgcgattcctataacagag

SEQ ID NO: 4268 - DNA, 25 bp, S. cerevisiae
atgccttccagattcactaagacta

SEQ ID NO: 4269 - DNA, 25 bp, S. cerevisiae
atgcgcttcccagttataatgacta

SEQ ID NO: 4270 - DNA, 25 bp, S. cerevisiae
atccgtctcctctgttgatcacgag

SEQ ID NO: 4271 - DNA, 25 bp, S. cerevisiae
atccgtctccattaagtgcaagtag

SEQ ID NO: 4272 - DNA, 25 bp, S. cerevisiae
atgctgcccattcctagtaaaccaa

SEQ ID NO: 4273 - DNA, 25 bp, S. cerevisiae
atgctgtcaactgccaaatctcaag

SEQ ID NO: 4274 - DNA, 25 bp, S. cerevisiae
atgctgtcaccatcattgaaccaaa

SEQ ID NO: 4275 - DNA, 25 bp, S. cerevisiae
atccttctcaaggttctgctggaaa

SEQ ID NO: 4276 - DNA, 25 bp, S. cerevisiae
atcctaacattgatatcgcatcggg

SEQ ID NO: 4277 - DNA, 25 bp, S. cerevisiae
atcctgctacctattgctagtgcta

SEQ ID NO: 4278 - DNA, 25 bp, S. cerevisiae
atccatgtggcctaattgcgaactc

SEQ ID NO: 4279 - DNA, 25 bp, S. cerevisiae
atgccgctagtcaaatggccaagcc

SEQ ID NO: 4280 - DNA, 25 bp, S. cerevisiae
atccattgcttgcttggcttttaca

SEQ ID NO: 4281 - DNA, 25 bp, S. cerevisiae
atccttattgtgctgctttcttaca

SEQ ID NO: 4282 - DNA, 25 bp, S. cerevisiae
atccttgtgtgttgttatgcgagac

SEQ ID NO: 4283 - DNA, 25 bp, S. cerevisiae
atgccttgggtctttatctagctga

SEQ ID NO: 4284 - DNA, 25 bp, S. cerevisiae
atgcctttgaggatttaccagaata

SEQ ID NO: 4285 - DNA, 25 bp, S. cerevisiae
atccttatgctaatcctgtaccgaa

SEQ ID NO: 4286 - DNA, 25 bp, S. cerevisiae
atgcctgccatgaataccgctagaa

SEQ ID NO: 4287 - DNA, 25 bp, S. cerevisiae
atgcctgccagtgggcccgaggaaa

SEQ ID NO: 4288 - DNA, 25 bp, S. cerevisiae
atgccgtatccaccctcacttgtat

SEQ ID NO: 4289 - DNA, 25 bp, S. cerevisiae
atgcctggatacatgtgccactatt

SEQ ID NO: 4290 - DNA, 25 bp, S. cerevisiae
atgccatgggtgaatgtgccctaca

SEQ ID NO: 4291 - DNA, 25 bp, S. cerevisiae
atgcctggatttacagctccaacaa

SEQ ID NO: 4292 - DNA, 25 bp, S. cerevisiae
atgcctctcttgttggtcaagctac

SEQ ID NO: 4293 - DNA, 25 bp, S. cerevisiae
atgcctgatttcattggaagctcaa

SEQ ID NO: 4294 - DNA, 25 bp, S. cerevisiae
atgcatttttccgagtataccaaca

SEQ ID NO: 4295 - DNA, 25 bp, S. cerevisiae
atgcgggacgctgttctgttttata

SEQ ID NO: 4296 - DNA, 25 bp, S. cerevisiae
atgctgctcttctaaggcctggtag

SEQ ID NO: 4297 - DNA, 25 bp, S. cerevisiae
atgtctagtcgccaaggtggtaaga

SEQ ID NO: 4298 - DNA, 25 bp, S. cerevisiae
atgcctaccgcctaaagttaatgcc

SEQ ID NO: 4299 - DNA, 25 bp, S. cerevisiae
atcctcttgtcaaactttgcacagg

SEQ ID NO: 4300 - DNA, 25 bp, S. cerevisiae
atgcagatctggtccaacgtggttt

SEQ ID NO: 4301 - DNA, 25 bp, S. cerevisiae
atgcggatggtctaccgagctggtt

SEQ ID NO: 4302 - DNA, 25 bp, S. cerevisiae
atgcggatggcttaagcggtactac

SEQ ID NO: 4303 - DNA, 25 bp, S. cerevisiae
atgccagctggcagaagactgtact

SEQ ID NO: 4304 - DNA, 25 bp, S. cerevisiae
atccttgcgtttcagtttccactaa

SEQ ID NO: 4305 - DNA, 25 bp, S. cerevisiae
atccattggtttcgaattagccgtc

SEQ ID NO: 4306 - DNA, 25 bp, S. cerevisiae
atgcctagtgattatacttcccatt

SEQ ID NO: 4307 - DNA, 25 bp, S. cerevisiae
atccaagtgttatccagctttgtaa

SEQ ID NO: 4308 - DNA, 25 bp, S. cerevisiae
atgccatactttttcaactttacta

SEQ ID NO: 4309 - DNA, 25 bp, S. cerevisiae
atgcgggatgttctcctttacagga

SEQ ID NO: 4310 - DNA, 25 bp, S. cerevisiae
atgcacagaaggttaccattcccca

SEQ ID NO: 4311 - DNA, 25 bp, S. cerevisiae
atgccattggcgttaactctgcttc

SEQ ID NO: 4312 - DNA, 25 bp, S. cerevisiae
atcctctttttgaagccgattgccc

SEQ ID NO: 4313 - DNA, 25 bp, S. cerevisiae
agcttgcactttgaaaccttgggat

SEQ ID NO: 4314 - DNA, 25 bp, S. cerevisiae
atgctgtggctccaggacagacctg

SEQ ID NO: 4315 - DNA, 25 bp, S. cerevisiae
atgccctcaagagacactgacagat

SEQ ID NO: 4316 - DNA, 25 bp, S. cerevisiae
atgaacgcccgtcctattaagaagg

SEQ ID NO: 4317 - DNA, 25 bp, S. cerevisiae
agaaaataccggtgcatccctgaac

SEQ ID NO: 4318 - DNA, 25 bp, S. cerevisiae
atgtagctattttttccagtcggca

SEQ ID NO: 4319 - DNA, 25 bp, S. cerevisiae
atgccgatattggtttggcaactac

SEQ ID NO: 4320 - DNA, 25 bp, S. cerevisiae
atgccgttatttttggttctgaaag

SEQ ID NO: 4321 - DNA, 25 bp, S. cerevisiae
atgagttactgtattgcgttcggta

SEQ ID NO: 4322 - DNA, 25 bp, S. cerevisiae
atgctttcgttttgtccttcgtgta

SEQ ID NO: 4323 - DNA, 25 bp, S. cerevisiae
atgacttaatttgttcttgcgatgg

SEQ ID NO: 4324 - DNA, 25 bp, S. cerevisiae
atgtctttcttaggtttcggtggtg

SEQ ID NO: 4325 - DNA, 25 bp, S. cerevisiae
atgccgacttattcgaggatcccta

SEQ ID NO: 4326 - DNA, 25 bp, S. cerevisiae
atccatctttcgtcagcatcgagga

SEQ ID NO: 4327 - DNA, 25 bp, S. cerevisiae
atccacatactttcatcacatcagg

SEQ ID NO: 4328 - DNA, 25 bp, S. cerevisiae
atccaattcgtgttgcatcatcatg

SEQ ID NO: 4329 - DNA, 25 bp, S. cerevisiae
atgcccattcgctattcaacatgtt

SEQ ID NO: 4330 - DNA, 25 bp, S. cerevisiae
atcctttctttcaatctggctataa

SEQ ID NO: 4331 - DNA, 25 bp, S. cerevisiae
atcctttcctccacgttaatgttga

SEQ ID NO: 4332 - DNA, 25 bp, S. cerevisiae
atgccttcgagaatatgtctttatt

SEQ ID NO: 4333 - DNA, 25 bp, S. cerevisiae
atgcctctgggaatggactattact

SEQ ID NO: 4334 - DNA, 25 bp, S. cerevisiae
atgcctgaaggcagttccgaagact

SEQ ID NO: 4335 - DNA, 25 bp, S. cerevisiae
atgcctaaccaactctacaagaacc

SEQ ID NO: 4336 - DNA, 25 bp, S. cerevisiae
atgcctaccctaatcttctacaagg

SEQ ID NO: 4337 - DNA, 25 bp, S. cerevisiae
atgccaaaactaccatgctctgcaa

SEQ ID NO: 4338 - DNA, 25 bp, S. cerevisiae
atgccctagccaacttgtgtatcga

SEQ ID NO: 4339 - DNA, 25 bp, S. cerevisiae
atgccgcccaacaaaactacagatt

SEQ ID NO: 4340 - DNA, 25 bp, S. cerevisiae
atgcgccccactaaaactcaaatat

SEQ ID NO: 4341 - DNA, 25 bp, S. cerevisiae
atgcttgatcttctcggcgttcgtg

SEQ ID NO: 4342 - DNA, 25 bp, S. cerevisiae
atgcttcactatcatctgcgctatt

SEQ ID NO: 4343 - DNA, 25 bp, S. cerevisiae
atgctaacggtggtgttgtcgcagc

SEQ ID NO: 4344 - DNA, 25 bp, S. cerevisiae
atccaaatgtcggtagggccatctc

SEQ ID NO: 4345 - DNA, 25 bp, S. cerevisiae
atgccgtatattgctaaggacacca

SEQ ID NO: 4346 - DNA, 25 bp, S. cerevisiae
atgcgtcctttttgagtgtactagc

SEQ ID NO: 4347 - DNA, 25 bp, S. cerevisiae
atgcttccattatctggtctttgcc

SEQ ID NO: 4348 - DNA, 25 bp, S. cerevisiae
atgctatctgcttttatggtggtaa

SEQ ID NO: 4349 - DNA, 25 bp, S. cerevisiae
atgccatccttgcagatcatcggta

SEQ ID NO: 4350 - DNA, 25 bp, S. cerevisiae
atgccacagtagtacctcctgagga

SEQ ID NO: 4351 - DNA, 25 bp, S. cerevisiae
atgcgatgcgaagacctcgtggtga

SEQ ID NO: 4352 - DNA, 25 bp, S. cerevisiae
atgctagggacttctcgctgggtaa

SEQ ID NO: 4353 - DNA, 25 bp, S. cerevisiae
atgctagccctcacggataatcaaa

SEQ ID NO: 4354 - DNA, 25 bp, S. cerevisiae
atgctttgataactgctgatatttc

SEQ ID NO: 4355 - DNA, 25 bp, S. cerevisiae
atgctttatccccttattatccaag

SEQ ID NO: 4356 - DNA, 25 bp, S. cerevisiae
atgccatttccgtcgatattacatc

SEQ ID NO: 4357 - DNA, 25 bp, S. cerevisiae
atgccagtttcttcgattcaatgtg

SEQ ID NO: 4358 - DNA, 25 bp, S. cerevisiae
atgcggatatcctctttgcggtaaa

SEQ ID NO: 4359 - DNA, 25 bp, S. cerevisiae
atccagactggccattttgggtcaa

SEQ ID NO: 4360 - DNA, 25 bp, S. cerevisiae
atccaactaccaattattcgtccac

SEQ ID NO: 4361 - DNA, 25 bp, S. cerevisiae
atccaacttagcaatctttttcgaa

SEQ ID NO: 4362 - DNA, 25 bp, S. cerevisiae
atccaatccatacactttgcttcta

SEQ ID NO: 4363 - DNA, 25 bp, S. cerevisiae
atgcatcaccctgttactaatgtcg

SEQ ID NO: 4364 - DNA, 25 bp, S. cerevisiae
atgacccgctttcattaaggccaaa

SEQ ID NO: 4365 - DNA, 25 bp, S. cerevisiae
agagccggtcggtcattacaggaca

SEQ ID NO: 4366 - DNA, 25 bp, S. cerevisiae
atgccccatggtgtggtcactgtaa

SEQ ID NO: 4367 - DNA, 25 bp, S. cerevisiae
atgccgcccggtaatgaaatgacaa

SEQ ID NO: 4368 - DNA, 25 bp, S. cerevisiae
atgcttccaccgcaataactgagaa

SEQ ID NO: 4369 - DNA, 25 bp, S. cerevisiae
atgcgtccgctccaattatacgagt

SEQ ID NO: 4370 - DNA, 25 bp, S. cerevisiae
atgcgggctctatcattgaatgtgg

SEQ ID NO: 4371 - DNA, 25 bp, S. cerevisiae
atgcgccgcctatatcgtcatcttg

SEQ ID NO: 4372 - DNA, 25 bp, S. cerevisiae
atccacacctattggttcagctttg

SEQ ID NO: 4373 - DNA, 25 bp, S. cerevisiae
atccaacatcgttcatcgtcaagat

SEQ ID NO: 4374 - DNA, 25 bp, S. cerevisiae
atgccacaatgcaccatcttgataa

SEQ ID NO: 4375 - DNA, 25 bp, S. cerevisiae
atgctctgaagttgcgttttgatcg

SEQ ID NO: 4376 - DNA, 25 bp, S. cerevisiae
atgcctgtcttcttttttatcgatc

SEQ ID NO: 4377 - DNA, 25 bp, S. cerevisiae
atgccaaacttctggattcttgaga

SEQ ID NO: 4378 - DNA, 25 bp, S. cerevisiae
atgaggaattcctccttctctgaca

SEQ ID NO: 4379 - DNA, 25 bp, S. cerevisiae
atgcaggcaaaccattccgtcagtt

SEQ ID NO: 4380 - DNA, 25 bp, S. cerevisiae
agggtaaggcccttgtgcaccacta

SEQ ID NO: 4381 - DNA, 25 bp, S. cerevisiae
atgcgtgccatagtttcttccctta

SEQ ID NO: 4382 - DNA, 25 bp, S. cerevisiae
agacggaaggtgagagccagatcca

SEQ ID NO: 4383 - DNA, 25 bp, S. cerevisiae
atgccggtagaggtgtggtcaataa

SEQ ID NO: 4384 - DNA, 25 bp, S. cerevisiae
atgccggtaacgatgcctactatac

SEQ ID NO: 4385 - DNA, 25 bp, S. cerevisiae
atgcctcttcaggtggtttacaaag

SEQ ID NO: 4386 - DNA, 25 bp, S. cerevisiae
atgcgttcatccgtgacgagttcag

SEQ ID NO: 4387 - DNA, 25 bp, S. cerevisiae
atgcttgcgtggatagccgacctag

SEQ ID NO: 4388 - DNA, 25 bp, S. cerevisiae
atgccccagagacagccaactatag

SEQ ID NO: 4389 - DNA, 25 bp, S. cerevisiae
atgcaactccaaccggctactaagg

SEQ ID NO: 4390 - DNA, 25 bp, S. cerevisiae
atgccatcattgttgctggtgtaca

SEQ ID NO: 4391 - DNA, 25 bp, S. cerevisiae
atgcgcataatggactgatcaattc

SEQ ID NO: 4392 - DNA, 25 bp, S. cerevisiae
atgccgagtgctactgctcaagtat

SEQ ID NO: 4393 - DNA, 25 bp, S. cerevisiae
atgctaggatgcctggcatgccaaa

SEQ ID NO: 4394 - DNA, 25 bp, S. cerevisiae
atgatctggcatttggtgaaaaagc

SEQ ID NO: 4395 - DNA, 25 bp, S. cerevisiae
atgcggccacatttatgacgatcat

SEQ ID NO: 4396 - DNA, 25 bp, S. cerevisiae
atgcgtgactcatttgtacgtctga

SEQ ID NO: 4397 - DNA, 25 bp, S. cerevisiae
atgcgatatatctgtcatacggcaa

SEQ ID NO: 4398 - DNA, 25 bp, S. cerevisiae
atgcttaataacatcacggccgaag

SEQ ID NO: 4399 - DNA, 25 bp, S. cerevisiae
atgtcctccaatcttaccgaagaac

SEQ ID NO: 4400 - DNA, 25 bp, S. cerevisiae
atgcggttaattttcattgcgaaaa

SEQ ID NO: 4401 - DNA, 25 bp, S. cerevisiae
atgcgagttattgaacttggtagaa

SEQ ID NO: 4402 - DNA, 25 bp, S. cerevisiae
agggccttagaaaccatgatgtatc

SEQ ID NO: 4403 - DNA, 25 bp, S. cerevisiae
atgcatggtcatttgtggcgattct

SEQ ID NO: 4404 - DNA, 25 bp, S. cerevisiae
atgctggcttaaatgaggctccttt

SEQ ID NO: 4405 - DNA, 25 bp, S. cerevisiae
atgccgttccgaaatctggttctag

SEQ ID NO: 4406 - DNA, 25 bp, S. cerevisiae
atgcggccccgaaagttatattagt

SEQ ID NO: 4407 - DNA, 25 bp, S. cerevisiae
atgccgcgccggtaatgttatttat

SEQ ID NO: 4408 - DNA, 25 bp, S. cerevisiae
atgcgaacgcggacgatttgagtaa

SEQ ID NO: 4409 - DNA, 25 bp, S. cerevisiae
atgccatcaccgctggtactggttt

SEQ ID NO: 4410 - DNA, 25 bp, S. cerevisiae
atgccactatttgcaaggctctgcc

SEQ ID NO: 4411 - DNA, 25 bp, S. cerevisiae
atgcctttagctgcaagtgctacac

SEQ ID NO: 4412 - DNA, 25 bp, S. cerevisiae
atgccgcttttggatctgacgtgaa

SEQ ID NO: 4413 - DNA, 25 bp, S. cerevisiae
atgccgatgatgtttttactggtac

SEQ ID NO: 4414 - DNA, 25 bp, S. cerevisiae
atgttcaccaactgtatcacttctg

SEQ ID NO: 4415 - DNA, 25 bp, S. cerevisiae
atgttccaaagggtgtctactgtac

SEQ ID NO: 4416 - DNA, 25 bp, S. cerevisiae
atgcattattggtcctgctgtagcc

SEQ ID NO: 4417 - DNA, 25 bp, S. cerevisiae
atgctgcagattcgttcatcgtcct

SEQ ID NO: 4418 - DNA, 25 bp, S. cerevisiae
atgctagatcagcttctttctctac

SEQ ID NO: 4419 - DNA, 25 bp, S. cerevisiae
atgcccatcgtctgttgattctcac

SEQ ID NO: 4420 - DNA, 25 bp, S. cerevisiae
atgcccatttcattgctagttctga

SEQ ID NO: 4421 - DNA, 25 bp, S. cerevisiae
atgccactccgcctcttaaaagatt

SEQ ID NO: 4422 - DNA, 25 bp, S. cerevisiae
atgtcaatctcgtttccaaaaatgc

SEQ ID NO: 4423 - DNA, 25 bp, S. cerevisiae
atgccattctcatatgtcctcaaat

SEQ ID NO: 4424 - DNA, 25 bp, S. cerevisiae
atgccatactcaccttcacttatat

SEQ ID NO: 4425 - DNA, 25 bp, S. cerevisiae
atgcctctctaactaccttgatatg

SEQ ID NO: 4426 - DNA, 25 bp, S. cerevisiae
atgcatttgtgccagaatggacact

SEQ ID NO: 4427 - DNA, 25 bp, S. cerevisiae
atgcctggtcttaagcttgttgaag

SEQ ID NO: 4428 - DNA, 25 bp, S. cerevisiae
atgccatggtcttctgttggtggga

SEQ ID NO: 4429 - DNA, 25 bp, S. cerevisiae
atgctagtgctaactttgaacggtc

SEQ ID NO: 4430 - DNA, 25 bp, S. cerevisiae
atgctctggaagacactgtgcgtac

SEQ ID NO: 4431 - DNA, 25 bp, S. cerevisiae
atgcttttcttctcctttttcaaga

SEQ ID NO: 4432 - DNA, 25 bp, S. cerevisiae
atgctacctttatatcttttaacaa

SEQ ID NO: 4433 - DNA, 25 bp, S. cerevisiae
atgcgacgtatgtgctcgttgcaga

SEQ ID NO: 4434 - DNA, 25 bp, S. cerevisiae
atgaatgctttcaaccagatgacag

SEQ ID NO: 4435 - DNA, 25 bp, S. cerevisiae
atgacacttgcctattatggacagc

SEQ ID NO: 4436 - DNA, 25 bp, S. cerevisiae
atgacactaccacttatggtcctgg

SEQ ID NO: 4437 - DNA, 25 bp, S. cerevisiae
atgcctctactattttattcacggg

SEQ ID NO: 4438 - DNA, 25 bp, S. cerevisiae
atgcctccaagaagtatagaagaat

SEQ ID NO: 4439 - DNA, 25 bp, S. cerevisiae
atgcggcgcctatctcagagaacaa

SEQ ID NO: 4440 - DNA, 25 bp, S. cerevisiae
atgcgtgccgtagctcggttagaaa

SEQ ID NO: 4441 - DNA, 25 bp, S. cerevisiae
atgggcggctctgtcgttttaaatc

SEQ ID NO: 4442 - DNA, 25 bp, S. cerevisiae
atgcgctgggatgttatcatcttat

SEQ ID NO: 4443 - DNA, 25 bp, S. cerevisiae
atgcttttgtgcttccatatgtgtc

SEQ ID NO: 4444 - DNA, 25 bp, S. cerevisiae
atgctttcctcttccattggtgaaa

SEQ ID NO: 4445 - DNA, 25 bp, S. cerevisiae
atgctcaacctctctatatgtcgaa

SEQ ID NO: 4446 - DNA, 25 bp, S. cerevisiae
atgctcaaactgctgtcacttgtga

SEQ ID NO: 4447 - DNA, 25 bp, S. cerevisiae
atgacacacgggattctttcgtcca

SEQ ID NO: 4448 - DNA, 25 bp, S. cerevisiae
atgcgccattggattttgattataa

SEQ ID NO: 4449 - DNA, 25 bp, S. cerevisiae
atgcccagattgctgcgtttgtcaa

SEQ ID NO: 4450 - DNA, 25 bp, S. cerevisiae
atgcctctccattcgaatgtgactt

SEQ ID NO: 4451 - DNA, 25 bp, S. cerevisiae
atgcgagttatgtggcaagcgactt

SEQ ID NO: 4452 - DNA, 25 bp, S. cerevisiae
atgacatgttagtaggtaagcctcc

SEQ ID NO: 4453 - DNA, 25 bp, S. cerevisiae
atgacgctccattaggtactacggc

SEQ ID NO: 4454 - DNA, 25 bp, S. cerevisiae
atgaaggccatctggaccatacgct

SEQ ID NO: 4455 - DNA, 25 bp, S. cerevisiae
atgcttagtgactcgatgccacacg

SEQ ID NO: 4456 - DNA, 25 bp, S. cerevisiae
atgccgcagtatttatatccaccag

SEQ ID NO: 4457 - DNA, 25 bp, S. cerevisiae
atgctacagtatatatcatctcaag

SEQ ID NO: 4458 - DNA, 25 bp, S. cerevisiae
atgctagcagctattgtcttcaaaa

SEQ ID NO: 4459 - DNA, 25 bp, S. cerevisiae
atgcgatgagcgatgatgagtcttc

SEQ ID NO: 4460 - DNA, 25 bp, S. cerevisiae
atgcagtgcgcgataactcctagag

SEQ ID NO: 4461 - DNA, 25 bp, S. cerevisiae
atgctgagacaggtgcccatgacaa

SEQ ID NO: 4462 - DNA, 25 bp, S. cerevisiae
atgcgtatgacaatcctctagcgga

SEQ ID NO: 4463 - DNA, 25 bp, S. cerevisiae
atgcgatgcggaatccttctttcaa

SEQ ID NO: 4464 - DNA, 25 bp, S. cerevisiae
atgcaagcgtgcaccgagcttttga

SEQ ID NO: 4465 - DNA, 25 bp, S. cerevisiae
atgaaggcagctactcaacctctat

SEQ ID NO: 4466 - DNA, 25 bp, S. cerevisiae
atgaaacagtcccatagctcaggca

SEQ ID NO: 4467 - DNA, 25 bp, S. cerevisiae
atgcgaacaacagccatcacaggaa

SEQ ID NO: 4468 - DNA, 25 bp, S. cerevisiae
atgctaaccacattccccatggaaa

SEQ ID NO: 4469 - DNA, 25 bp, S. cerevisiae
atgacggcatacttgcggacgggaa

SEQ ID NO: 4470 - DNA, 25 bp, S. cerevisiae
atgagtactttttcagcctacccat

SEQ ID NO: 4471 - DNA, 25 bp, S. cerevisiae
atgcgttattcagggatcgtttcaa

SEQ ID NO: 4472 - DNA, 25 bp, S. cerevisiae
atgcgcttattagattcaggctccc

SEQ ID NO: 4473 - DNA, 25 bp, S. cerevisiae
atgcacaatgcctaactctaaccaa

SEQ ID NO: 4474 - DNA, 25 bp, S. cerevisiae
atgaaactctagatgcccacgaaat

SEQ ID NO: 4475 - DNA, 25 bp, S. cerevisiae
atgaccctcgatacatgaccacaga

SEQ ID NO: 4476 - DNA, 25 bp, S. cerevisiae
atgaacgctacgtgggtcgaccagc

SEQ ID NO: 4477 - DNA, 25 bp, S. cerevisiae
atgaaggttaccacagcaaatcgaa

SEQ ID NO: 4478 - DNA, 25 bp, S. cerevisiae
atgacgacccagatccaatgtttag

SEQ ID NO: 4479 - DNA, 25 bp, S. cerevisiae
atgcgggccacgaccacagtgatat

SEQ ID NO: 4480 - DNA, 25 bp, S. cerevisiae
atgctgataccgcaaaggctgcttc

SEQ ID NO: 4481 - DNA, 25 bp, S. cerevisiae
atgctgtaccgttcacgccgtttaa

SEQ ID NO: 4482 - DNA, 25 bp, S. cerevisiae
atgaatacatgcctgaacccgacgt

SEQ ID NO: 4483 - DNA, 25 bp, S. cerevisiae
atgcaatctcattcagcaggtcttg

SEQ ID NO: 4484 - DNA, 25 bp, S. cerevisiae
atgaactctgaacagctgctgcata

SEQ ID NO: 4485 - DNA, 25 bp, S. cerevisiae
atgaagttgacatcacggtccacgc

SEQ ID NO: 4486 - DNA, 25 bp, S. cerevisiae
atgaaaatcagcatcctttccaggg

SEQ ID NO: 4487 - DNA, 25 bp, S. cerevisiae
atgcgtttctacacaatgccggtaa

SEQ ID NO: 4488 - DNA, 25 bp, S. cerevisiae
atgcgtttgtactctaatctggtag

SEQ ID NO: 4489 - DNA, 25 bp, S. cerevisiae
atgcgtttgtctctctattcatgtt

SEQ ID NO: 4490 - DNA, 25 bp, S. cerevisiae
atgctgttcttctctattccagtag

SEQ ID NO: 4491 - DNA, 25 bp, S. cerevisiae
atgctatacctcatctggattctgt

SEQ ID NO: 4492 - DNA, 25 bp, S. cerevisiae
atgcgaactcatgctatggtcgtaa

SEQ ID NO: 4493 - DNA, 25 bp, S. cerevisiae
atggaacttctatgggcggacccac

SEQ ID NO: 4494 - DNA, 25 bp, S. cerevisiae
atggaacttccttggaggaccctga

SEQ ID NO: 4495 - DNA, 25 bp, S. cerevisiae
atgcgaacacttttggtagagcctc

SEQ ID NO: 4496 - DNA, 25 bp, S. cerevisiae
atgctcttttctgtatatcactttt

SEQ ID NO: 4497 - DNA, 25 bp, S. cerevisiae
atgctctactgtcttatgtactcca

SEQ ID NO: 4498 - DNA, 25 bp, S. cerevisiae
atgcagctacttcgaacatttctaa

SEQ ID NO: 4499 - DNA, 25 bp, S. cerevisiae
atgcttgatatcctacacatcttga

SEQ ID NO: 4500 - DNA, 25 bp, S. cerevisiae
atgctgtgtctccatatgctcaaaa

SEQ ID NO: 4501 - DNA, 25 bp, S. cerevisiae
atgcgcttgctgctagggccaataa

SEQ ID NO: 4502 - DNA, 25 bp, S. cerevisiae
atgacttgcggtatagaaaatagtt

SEQ ID NO: 4503 - DNA, 25 bp, S. cerevisiae
atgtactactcctggacacaactgt

SEQ ID NO: 4504 - DNA, 25 bp, S. cerevisiae
atgatgaccctgtcaagggccccaa

SEQ ID NO: 4505 - DNA, 25 bp, S. cerevisiae
atgagaaaatcatcacgcccttacc

SEQ ID NO: 4506 - DNA, 25 bp, S. cerevisiae
atgaaaaatgctccatcgcctgacg

SEQ ID NO: 4507 - DNA, 25 bp, S. cerevisiae
atgacaccatagaacacgctgctga

SEQ ID NO: 4508 - DNA, 25 bp, S. cerevisiae
atgagggacccatcagtgcgtcaaa

SEQ ID NO: 4509 - DNA, 25 bp, S. cerevisiae
atgcagggtcccaagattccatgga

SEQ ID NO: 4510 - DNA, 25 bp, S. cerevisiae
atgaaaccagaattgtcccagctat

SEQ ID NO: 4511 - DNA, 25 bp, S. cerevisiae
atgaacctaaggattccgctgaaaa

SEQ ID NO: 4512 - DNA, 25 bp, S. cerevisiae
atgaatccgcaggtgctattcaccg

SEQ ID NO: 4513 - DNA, 25 bp, S. cerevisiae
aatgcaacgggtattgccctgggcc

SEQ ID NO: 4514 - DNA, 25 bp, S. cerevisiae
atgacgtgttcaccggatttttgtt

SEQ ID NO: 4515 - DNA, 25 bp, S. cerevisiae
atgctcggtacaactggatctgcaa

SEQ ID NO: 4516 - DNA, 25 bp, S. cerevisiae
atgctcgttacaactggatctgtga

SEQ ID NO: 4517 - DNA, 25 bp, S. cerevisiae
atgactattgctccaattactggta

SEQ ID NO: 4518 - DNA, 25 bp, S. cerevisiae
atgacattcgtcaaagaacagcact

SEQ ID NO: 4519 - DNA, 25 bp, S. cerevisiae
atgaatttttcaagcctatctggga

SEQ ID NO: 4520 - DNA, 25 bp, S. cerevisiae
atgctttagccgctgactctacaga

SEQ ID NO: 4521 - DNA, 25 bp, S. cerevisiae
atgctattttcgtggtcatacaaga

SEQ ID NO: 4522 - DNA, 25 bp, S. cerevisiae
atgcgataattgaatccttgccaaa

SEQ ID NO: 4523 - DNA, 25 bp, S. cerevisiae
atgctggacaggatcctcgacgaaa

SEQ ID NO: 4524 - DNA, 25 bp, S. cerevisiae
atgcgaacactgacccatcgaggaa

SEQ ID NO: 4525 - DNA, 25 bp, S. cerevisiae
atgcgagctacgtcccatcaaggga

SEQ ID NO: 4526 - DNA, 25 bp, S. cerevisiae
atgctgcgcattcttcccaaggaga

SEQ ID NO: 4527 - DNA, 25 bp, S. cerevisiae
atgttgctaagccattccacaaaga

SEQ ID NO: 4528 - DNA, 25 bp, S. cerevisiae
atgcgatcaaagctaccacaacaga

SEQ ID NO: 4529 - DNA, 25 bp, S. cerevisiae
atgctcttgcttccatggtcaatga

SEQ ID NO: 4530 - DNA, 25 bp, S. cerevisiae
atgctttgcattccaagaacgctgt

SEQ ID NO: 4531 - DNA, 25 bp, S. cerevisiae
atgctttgcattttgaagacgccaa

SEQ ID NO: 4532 - DNA, 25 bp, S. cerevisiae
atgcgattcttttcatcactgtggc

SEQ ID NO: 4533 - DNA, 25 bp, S. cerevisiae
atgcagattcattcccttgtgatat

SEQ ID NO: 4534 - DNA, 25 bp, S. cerevisiae
atgctggatgattctttatgcttta

SEQ ID NO: 4535 - DNA, 25 bp, S. cerevisiae
atgacggaactttatctgctgcgaa

SEQ ID NO: 4536 - DNA, 25 bp, S. cerevisiae
atgaattcagtgttttgccgccaga

SEQ ID NO: 4537 - DNA, 25 bp, S. cerevisiae
atgctcaactgtatataccgccatc

SEQ ID NO: 4538 - DNA, 25 bp, S. cerevisiae
atgctgcatctataagtccaactct

SEQ ID NO: 4539 - DNA, 25 bp, S. cerevisiae
atgctgatccaaaaagctcaacttt

SEQ ID NO: 4540 - DNA, 25 bp, S. cerevisiae
atgctactgcatcaaatccgtttgg

SEQ ID NO: 4541 - DNA, 25 bp, S. cerevisiae
atgattcccggaatgccgttagagc

SEQ ID NO: 4542 - DNA, 25 bp, S. cerevisiae
atgttccctgttatattctaggcga

SEQ ID NO: 4543 - DNA, 25 bp, S. cerevisiae
atgagaccgggcacatttaatcagg

SEQ ID NO: 4544 - DNA, 25 bp, S. cerevisiae
atgagcctttggagcgttcagacta

SEQ ID NO: 4545 - DNA, 25 bp, S. cerevisiae
atgactctcctggttgggataggct

SEQ ID NO: 4546 - DNA, 25 bp, S. cerevisiae
atgagctccaccgattgggttacta

SEQ ID NO: 4547 - DNA, 25 bp, S. cerevisiae
atgcatcaatgcttcagacactcct

SEQ ID NO: 4548 - DNA, 25 bp, S. cerevisiae
atgcggctccagtgaagctgaacta

SEQ ID NO: 4549 - DNA, 25 bp, S. cerevisiae
atgcggcccacaagaagttcaccaa

SEQ ID NO: 4550 - DNA, 25 bp, S. cerevisiae
atgcttataacagaggtccaccttc

SEQ ID NO: 4551 - DNA, 25 bp, S. cerevisiae
atgagggatttggaacccactttga

SEQ ID NO: 4552 - DNA, 25 bp, S. cerevisiae
atgacggtcttgtaatggctactac

SEQ ID NO: 4553 - DNA, 25 bp, S. cerevisiae
atgaaaggtgttctcttgcccaagg

SEQ ID NO: 4554 - DNA, 25 bp, S. cerevisiae
atgcttttatttgcgcttgttgcca

SEQ ID NO: 4555 - DNA, 25 bp, S. cerevisiae
atgaagccctgtctacctttgaaag

SEQ ID NO: 4556 - DNA, 25 bp, S. cerevisiae
atgatagcgccgacgacactttgta

SEQ ID NO: 4557 - DNA, 25 bp, S. cerevisiae
atgactttagatcacccaatgaggt

SEQ ID NO: 4558 - DNA, 25 bp, S. cerevisiae
atgcactgtttcctagcccaataga

SEQ ID NO: 4559 - DNA, 25 bp, S. cerevisiae
atgcaatttccttacgtctatggag

SEQ ID NO: 4560 - DNA, 25 bp, S. cerevisiae
atgctacttctttacatcctagtgg

SEQ ID NO: 4561 - DNA, 25 bp, S. cerevisiae
atgctactctctggacccattaaag

SEQ ID NO: 4562 - DNA, 25 bp, S. cerevisiae
atgctgcctctggttccaattcaaa

SEQ ID NO: 4563 - DNA, 25 bp, S. cerevisiae
atgctcactagcgtatcggtattca

SEQ ID NO: 4564 - DNA, 25 bp, S. cerevisiae
accactacgtacgagaatccgcggg

SEQ ID NO: 4565 - DNA, 25 bp, S. cerevisiae
atgaaagacttagcggatcccaaaa

SEQ ID NO: 4566 - DNA, 25 bp, S. cerevisiae
atgagcacaacttaccaaaccacta

SEQ ID NO: 4567 - DNA, 25 bp, S. cerevisiae
atgagagtatcctgtctagaccctt

SEQ ID NO: 4568 - DNA, 25 bp, S. cerevisiae
atgaagaatactctcccaccgagtg

SEQ ID NO: 4569 - DNA, 25 bp, S. cerevisiae
atgactggacttctaccacccaaga

SEQ ID NO: 4570 - DNA, 25 bp, S. cerevisiae
atgctcgatcttgcttacgggctaa

SEQ ID NO: 4571 - DNA, 25 bp, S. cerevisiae
atgctgaaccttattgatgacgtaa

SEQ ID NO: 4572 - DNA, 25 bp, S. cerevisiae
atgctattctgttttgtattcgatg

SEQ ID NO: 4573 - DNA, 25 bp, S. cerevisiae
atgtctgtttatgtggttttcctcc

SEQ ID NO: 4574 - DNA, 25 bp, S. cerevisiae
atgctcatttttgcttttttcacag

SEQ ID NO: 4575 - DNA, 25 bp, S. cerevisiae
atgcagttacttcgctgtttttcaa

SEQ ID NO: 4576 - DNA, 25 bp, S. cerevisiae
atgacatggcatgcgacgttattaa

SEQ ID NO: 4577 - DNA, 25 bp, S. cerevisiae
atgaaggctgaagtcgatatcggat

SEQ ID NO: 4578 - DNA, 25 bp, S. cerevisiae
atgcggcgtgcattgttcatagcgg

SEQ ID NO: 4579 - DNA, 25 bp, S. cerevisiae
atgctgctcttaaatatctcctcta

SEQ ID NO: 4580 - DNA, 25 bp, S. cerevisiae
atgcacggtgtgaggagtcttgtca

SEQ ID NO: 4581 - DNA, 25 bp, S. cerevisiae
atgctatgcccctatttgttaaatt

SEQ ID NO: 4582 - DNA, 25 bp, S. cerevisiae
atgctatccacccattttctgataa

SEQ ID NO: 4583 - DNA, 25 bp, S. cerevisiae
atgctttcactacgtcaatctataa

SEQ ID NO: 4584 - DNA, 25 bp, S. cerevisiae
atgctaataccacggcaactgctgg

SEQ ID NO: 4585 - DNA, 25 bp, S. cerevisiae
aggcgattgccatctcagtgctgaa

SEQ ID NO: 4586 - DNA, 25 bp, S. cerevisiae
atgactccacttttgcaggcggaag

SEQ ID NO: 4587 - DNA, 25 bp, S. cerevisiae
atgacattccatcttgggtggacaa

SEQ ID NO: 4588 - DNA, 25 bp, S. cerevisiae
atgcactatcccaaaggctgtggtt

SEQ ID NO: 4589 - DNA, 25 bp, S. cerevisiae
atgctctttccaacgctgctgtaat

SEQ ID NO: 4590 - DNA, 25 bp, S. cerevisiae
atgcttctatccttctgccaattga

SEQ ID NO: 4591 - DNA, 25 bp, S. cerevisiae
atgagaaccatcgaccaggccagtc

SEQ ID NO: 4592 - DNA, 25 bp, S. cerevisiae
atgaaagctattgccatggaccctc

SEQ ID NO: 4593 - DNA, 25 bp, S. cerevisiae
atgaaaccatatgtggcggctcggg

SEQ ID NO: 4594 - DNA, 25 bp, S. cerevisiae
atgaacacttatgctggcggtccat

SEQ ID NO: 4595 - DNA, 25 bp, S. cerevisiae
atgctaggctcttggatgactggtc

SEQ ID NO: 4596 - DNA, 25 bp, S. cerevisiae
atgctccatcggaaagctatcctgt

SEQ ID NO: 4597 - DNA, 25 bp, S. cerevisiae
atgctcggcggctaatgcttctatt

SEQ ID NO: 4598 - DNA, 25 bp, S. cerevisiae
atgctagcaggatacacgccatttt

SEQ ID NO: 4599 - DNA, 25 bp, S. cerevisiae
atgattgactactctcacggtaact

SEQ ID NO: 4600 - DNA, 25 bp, S. cerevisiae
atgcaatgagtttcccagcggctaa

SEQ ID NO: 4601 - DNA, 25 bp, S. cerevisiae
atggaggttacagcgggatctacta

SEQ ID NO: 4602 - DNA, 25 bp, S. cerevisiae
atgaaggcatgcagtccaacgacaa

SEQ ID NO: 4603 - DNA, 25 bp, S. cerevisiae
atgacgacgatttccatatccaaaa

SEQ ID NO: 4604 - DNA, 25 bp, S. cerevisiae
atgactatggatactgcgcaattaa

SEQ ID NO: 4605 - DNA, 25 bp, S. cerevisiae
atgcatctttccagtacttagccaa

SEQ ID NO: 4606 - DNA, 25 bp, S. cerevisiae
atgcatcttacctcaactacaagct

SEQ ID NO: 4607 - DNA, 25 bp, S. cerevisiae
atgctgcttcaggtgacaacatcaa

SEQ ID NO: 4608 - DNA, 25 bp, S. cerevisiae
atgcatgacatctgggtaatcacca

SEQ ID NO: 4609 - DNA, 25 bp, S. cerevisiae
atgctacagtatataccactctcaa

SEQ ID NO: 4610 - DNA, 25 bp, S. cerevisiae
atgctaccgataattcctcttctga

SEQ ID NO: 4611 - DNA, 25 bp, S. cerevisiae
atgctaatcttcataattcattatc

SEQ ID NO: 4612 - DNA, 25 bp, S. cerevisiae
atgacctaccttcttcggttgcagg

SEQ ID NO: 4613 - DNA, 25 bp, S. cerevisiae
atgacgctaaatttctccacttttg

SEQ ID NO: 4614 - DNA, 25 bp, S. cerevisiae
atgctgcccactgattattctttga

SEQ ID NO: 4615 - DNA, 25 bp, S. cerevisiae
atggcccattttataccggatcaat

SEQ ID NO: 4616 - DNA, 25 bp, S. cerevisiae
atgggcctattaatggacgggtatc

SEQ ID NO: 4617 - DNA, 25 bp, S. cerevisiae
atgaaagtcttctggacggcgtcac

SEQ ID NO: 4618 - DNA, 25 bp, S. cerevisiae
atgctctagtgctatgggtcttcca

SEQ ID NO: 4619 - DNA, 25 bp, S. cerevisiae
atgactcccaaggtgttttggtcct

SEQ ID NO: 4620 - DNA, 25 bp, S. cerevisiae
atgactatactccacgattttcaga

SEQ ID NO: 4621 - DNA, 25 bp, S. cerevisiae
atgagtacatcttgtccggttccaa

SEQ ID NO: 4622 - DNA, 25 bp, S. cerevisiae
atgagctcggtacgcctgcagtgta

SEQ ID NO: 4623 - DNA, 25 bp, S. cerevisiae
atgaggtcggtaccagtcatagact

SEQ ID NO: 4624 - DNA, 25 bp, S. cerevisiae
atgactgaagaacaagccctggcca

SEQ ID NO: 4625 - DNA, 25 bp, S. cerevisiae
atgaaggcaacgtgcaggccctgaa

SEQ ID NO: 4626 - DNA, 25 bp, S. cerevisiae
atgagggcacattaacggaccatga

SEQ ID NO: 4627 - DNA, 25 bp, S. cerevisiae
atgagcaggacatcgcgaaccacaa

SEQ ID NO: 4628 - DNA, 25 bp, S. cerevisiae
atgcatgcaagagctcgtggtccaa

SEQ ID NO: 4629 - DNA, 25 bp, S. cerevisiae
atgagtcctctagtgaagtgcccaa

SEQ ID NO: 4630 - DNA, 25 bp, S. cerevisiae
atgacgtcaacgctgatgatgatga

SEQ ID NO: 4631 - DNA, 25 bp, S. cerevisiae
atgtggtaaccaggccgctattatg

SEQ ID NO: 4632 - DNA, 25 bp, S. cerevisiae
atgaggctgaactggccacttctag

SEQ ID NO: 4633 - DNA, 25 bp, S. cerevisiae
atgaagctatcgtggccgccttgga

SEQ ID NO: 4634 - DNA, 25 bp, S. cerevisiae
agaagttagggtccccattgtggca

SEQ ID NO: 4635 - DNA, 25 bp, S. cerevisiae
atgaagttacggttcctatggtaga

SEQ ID NO: 4636 - DNA, 25 bp, S. cerevisiae
atgcagtccatgatctgctcatctg

SEQ ID NO: 4637 - DNA, 25 bp, S. cerevisiae
atgcagtggctgtcctgtattggaa

SEQ ID NO: 4638 - DNA, 25 bp, S. cerevisiae
atgaagtgtcgtctgctggtatgaa

SEQ ID NO: 4639 - DNA, 25 bp, S. cerevisiae
atgaggcctggacttacgttgatag

SEQ ID NO: 4640 - DNA, 25 bp, S. cerevisiae
atgcaggaccccttgaaggtgatga

SEQ ID NO: 4641 - DNA, 25 bp, S. cerevisiae
atgacaaacctctcgaggcggtcaa

SEQ ID NO: 4642 - DNA, 25 bp, S. cerevisiae
atgacacacaactcttgacctactg

SEQ ID NO: 4643 - DNA, 25 bp, S. cerevisiae
atgactgccaggtgctctattggga

SEQ ID NO: 4644 - DNA, 25 bp, S. cerevisiae
atgaggccaggtgcttttgataaaa

SEQ ID NO: 4645 - DNA, 25 bp, S. cerevisiae
atgctatcgctttattatctttatt

SEQ ID NO: 4646 - DNA, 25 bp, S. cerevisiae
atgctagtcatcattccgttcacat

SEQ ID NO: 4647 - DNA, 25 bp, S. cerevisiae
atgctacatcatattgccggctatc

SEQ ID NO: 4648 - DNA, 25 bp, S. cerevisiae
atgctacattgcacccaggtgtgtc

SEQ ID NO: 4649 - DNA, 25 bp, S. cerevisiae
agtcgattgacccaacggttgcgat

SEQ ID NO: 4650 - DNA, 25 bp, S. cerevisiae
atgacgttaccataggatttgctaa

SEQ ID NO: 4651 - DNA, 25 bp, S. cerevisiae
atgaccgttaagacaggaattgcta

SEQ ID NO: 4652 - DNA, 25 bp, S. cerevisiae
atgacgcgtctagggaggttgtttt

SEQ ID NO: 4653 - DNA, 25 bp, S. cerevisiae
atgaccccataggaaccatttctag

SEQ ID NO: 4654 - DNA, 25 bp, S. cerevisiae
atgacccattcatcaaagatcttga

SEQ ID NO: 4655 - DNA, 25 bp, S. cerevisiae
atgaggcatcatcaaaatatgcatt

SEQ ID NO: 4656 - DNA, 25 bp, S. cerevisiae
atgcattgtacaccgaatacttgaa

SEQ ID NO: 4657 - DNA, 25 bp, S. cerevisiae
atgctatccctttcattgcacgtga

SEQ ID NO: 4658 - DNA, 25 bp, S. cerevisiae
atgcttggtcatttcgcttctaaag

SEQ ID NO: 4659 - DNA, 25 bp, S. cerevisiae
atgactctctttcaggtacgcctga

SEQ ID NO: 4660 - DNA, 25 bp, S. cerevisiae
atgacctatgttacggtaccggtgc

SEQ ID NO: 4661 - DNA, 25 bp, S. cerevisiae
atgacccgtttcttggaccggatga

SEQ ID NO: 4662 - DNA, 25 bp, S. cerevisiae
acctccgccttctgggttagatgga

SEQ ID NO: 4663 - DNA, 25 bp, S. cerevisiae
atgacgacgaccgttgggactggtt

SEQ ID NO: 4664 - DNA, 25 bp, S. cerevisiae
atgaccactgtccactctttgactg

SEQ ID NO: 4665 - DNA, 25 bp, S. cerevisiae
atgacgatcttcagcattttcctac

SEQ ID NO: 4666 - DNA, 25 bp, S. cerevisiae
atgacgaatctctttttccttccaa

SEQ ID NO: 4667 - DNA, 25 bp, S. cerevisiae
atgcatgaatccagttacggctatt

SEQ ID NO: 4668 - DNA, 25 bp, S. cerevisiae
atgatcaatcccgattacgcgcaac

SEQ ID NO: 4669 - DNA, 25 bp, S. cerevisiae
atgaaatcaatttatcgaccgaatc

SEQ ID NO: 4670 - DNA, 25 bp, S. cerevisiae
atgcaattcaagaccatcgtcgctg

SEQ ID NO: 4671 - DNA, 25 bp, S. cerevisiae
atgctatgttgatcactggctgcca

SEQ ID NO: 4672 - DNA, 25 bp, S. cerevisiae
atgcttggtgctgagttcgtcgaac

SEQ ID NO: 4673 - DNA, 25 bp, S. cerevisiae
atgctttcccaactgccaagtatat

SEQ ID NO: 4674 - DNA, 25 bp, S. cerevisiae
atgagatctcatcgagccaggagga

SEQ ID NO: 4675 - DNA, 25 bp, S. cerevisiae
atgaagcgatcattcccacattgac

SEQ ID NO: 4676 - DNA, 25 bp, S. cerevisiae
atgcatgttgttgcacatatcgaga

SEQ ID NO: 4677 - DNA, 25 bp, S. cerevisiae
atgcatgcttgcatttagtcgtgca

SEQ ID NO: 4678 - DNA, 25 bp, S. cerevisiae
atgcacgcagcgattcagtcgacat

SEQ ID NO: 4679 - DNA, 25 bp, S. cerevisiae
atgacgccctatgcagtagcaatta

SEQ ID NO: 4680 - DNA, 25 bp, S. cerevisiae
atgcatgttcggttggttcgcaaat

SEQ ID NO: 4681 - DNA, 25 bp, S. cerevisiae
atgcagtttctattggctccgccaa

SEQ ID NO: 4682 - DNA, 25 bp, S. cerevisiae
atgcagttttgaagagactctccaa

SEQ ID NO: 4683 - DNA, 25 bp, S. cerevisiae
atgcaactgttgtagactccttcaa

SEQ ID NO: 4684 - DNA, 25 bp, S. cerevisiae
atgagacgattgcagaccctacggc

SEQ ID NO: 4685 - DNA, 25 bp, S. cerevisiae
atgcaacagtaatttccagcgacga

SEQ ID NO: 4686 - DNA, 25 bp, S. cerevisiae
atgaaagtattgtctccggcggcaa

SEQ ID NO: 4687 - DNA, 25 bp, S. cerevisiae
atgcatttttgcaggcacagccgct

SEQ ID NO: 4688 - DNA, 25 bp, S. cerevisiae
atgctttattcgttctgtggcgcta

SEQ ID NO: 4689 - DNA, 25 bp, S. cerevisiae
atgcttcttctgctagcggtacaaa

SEQ ID NO: 4690 - DNA, 25 bp, S. cerevisiae
atgcattcgtgataatatgggtaca

SEQ ID NO: 4691 - DNA, 25 bp, S. cerevisiae
atgcttccaagattgtcggtggtac

SEQ ID NO: 4692 - DNA, 25 bp, S. cerevisiae
atgcttcctggatgtcaaattctga

SEQ ID NO: 4693 - DNA, 25 bp, S. cerevisiae
atgcttctttgatgctctagctacc

SEQ ID NO: 4694 - DNA, 25 bp, S. cerevisiae
atgcttggtggacttagaaacctcc

SEQ ID NO: 4695 - DNA, 25 bp, S. cerevisiae
atgcattgggctcttatgacgacga

SEQ ID NO: 4696 - DNA, 25 bp, S. cerevisiae
atgattggcggcactggcacgtcgt

SEQ ID NO: 4697 - DNA, 25 bp, S. cerevisiae
atgataacggctgcgaacttccttt

SEQ ID NO: 4698 - DNA, 25 bp, S. cerevisiae
atgcaagaggctacacagtccggtg

SEQ ID NO: 4699 - DNA, 25 bp, S. cerevisiae
atgacgatggtgactactccttggc

SEQ ID NO: 4700 - DNA, 25 bp, S. cerevisiae
agacagactgtatatttttagggca

SEQ ID NO: 4701 - DNA, 25 bp, S. cerevisiae
atggccccggatgaagctgatactt

SEQ ID NO: 4702 - DNA, 25 bp, S. cerevisiae
atgaccccaagagatgaggatgcct

SEQ ID NO: 4703 - DNA, 25 bp, S. cerevisiae
atgactaccaaagcaatggtccaaa

SEQ ID NO: 4704 - DNA, 25 bp, S. cerevisiae
atggtacccgcacctgggtcacgtg

SEQ ID NO: 4705 - DNA, 25 bp, S. cerevisiae
aggacctaggcatcgggtacttgta

SEQ ID NO: 4706 - DNA, 25 bp, S. cerevisiae
accggtcaattctgaggtctttaca

SEQ ID NO: 4707 - DNA, 25 bp, S. cerevisiae
atgcaagttacagcggaggatttta

SEQ ID NO: 4708 - DNA, 25 bp, S. cerevisiae
atgaacctacagacgacgcggttta

SEQ ID NO: 4709 - DNA, 25 bp, S. cerevisiae
atgacacacaactctgcatcagcgg

SEQ ID NO: 4710 - DNA, 25 bp, S. cerevisiae
atgaatccaccattgtatccgagtg

SEQ ID NO: 4711 - DNA, 25 bp, S. cerevisiae
atgaacgaccagttagcccaggagt

SEQ ID NO: 4712 - DNA, 25 bp, S. cerevisiae
atgaccacttggttatcacctggaa

SEQ ID NO: 4713 - DNA, 25 bp, S. cerevisiae
atgaagcagctcactgtacaccggt

SEQ ID NO: 4714 - DNA, 25 bp, S. cerevisiae
atgatgacactttcttaccaagagg

SEQ ID NO: 4715 - DNA, 25 bp, S. cerevisiae
atgagtgcccaaaaagctccaaagt

SEQ ID NO: 4716 - DNA, 25 bp, S. cerevisiae
atggagtcctttccggaaatgtctc

SEQ ID NO: 4717 - DNA, 25 bp, S. cerevisiae
atgacacggtttgctatcgtagctg

SEQ ID NO: 4718 - DNA, 25 bp, S. cerevisiae
atgatctcccaactgggattgcaaa

SEQ ID NO: 4719 - DNA, 25 bp, S. cerevisiae
atggacgcacaactggaatgggcaa

SEQ ID NO: 4720 - DNA, 25 bp, S. cerevisiae
atgcagacgccgatggtgatgacca

SEQ ID NO: 4721 - DNA, 25 bp, S. cerevisiae
atgaataccatcagcggcaacgccg

SEQ ID NO: 4722 - DNA, 25 bp, S. cerevisiae
atgaatacttgattgggcgagcacc

SEQ ID NO: 4723 - DNA, 25 bp, S. cerevisiae
atgattggaatcttgcaccgggacc

SEQ ID NO: 4724 - DNA, 25 bp, S. cerevisiae
atgcatcgaaatttggctccgctga

SEQ ID NO: 4725 - DNA, 25 bp, S. cerevisiae
atgcattttgtaatgtccacgactt

SEQ ID NO: 4726 - DNA, 25 bp, S. cerevisiae
atgcacagtttattgttatttcgct

SEQ ID NO: 4727 - DNA, 25 bp, S. cerevisiae
atgagaattttttcgagtcttacag

SEQ ID NO: 4728 - DNA, 25 bp, S. cerevisiae
atgagccagttagttctagacttaa

SEQ ID NO: 4729 - DNA, 25 bp, S. cerevisiae
atgatgacagtctagctcctataga

SEQ ID NO: 4730 - DNA, 25 bp, S. cerevisiae
atgaccacccctgctatgatgatat

SEQ ID NO: 4731 - DNA, 25 bp, S. cerevisiae
atgcacaaccacatcctcaatataa

SEQ ID NO: 4732 - DNA, 25 bp, S. cerevisiae
atgcacaacttctctctaattatgg

SEQ ID NO: 4733 - DNA, 25 bp, S. cerevisiae
atgaccgctactgccgatgttttgg

SEQ ID NO: 4734 - DNA, 25 bp, S. cerevisiae
atgcagccctaaacacgctttttga

SEQ ID NO: 4735 - DNA, 25 bp, S. cerevisiae
atgagccgttcaacaccaatttcga

SEQ ID NO: 4736 - DNA, 25 bp, S. cerevisiae
atgacatcactgaggtcctttctac

SEQ ID NO: 4737 - DNA, 25 bp, S. cerevisiae
atgacacctatctttcgtattcttc

SEQ ID NO: 4738 - DNA, 25 bp, S. cerevisiae
atgaacccttgtactgttatcctct

SEQ ID NO: 4739 - DNA, 25 bp, S. cerevisiae
atgcaaccgatcaccactgcttcca

SEQ ID NO: 4740 - DNA, 25 bp, S. cerevisiae
atgaaagctctgtctgctcttctaa

SEQ ID NO: 4741 - DNA, 25 bp, S. cerevisiae
atgagaagcatgctgcctcagccaa

SEQ ID NO: 4742 - DNA, 25 bp, S. cerevisiae
atgaaagttctaaggcatccgttgt

SEQ ID NO: 4743 - DNA, 25 bp, S. cerevisiae
atgaaggtttagacgctgccaccgt

SEQ ID NO: 4744 - DNA, 25 bp, S. cerevisiae
atgcaggttgaagccattccctttg

SEQ ID NO: 4745 - DNA, 25 bp, S. cerevisiae
atgcaatttccttttgacgcccaaa

SEQ ID NO: 4746 - DNA, 25 bp, S. cerevisiae
acgcaaacccaacataatcctagac

SEQ ID NO: 4747 - DNA, 25 bp, S. cerevisiae
accacaacgccacaaaatgcctgtt

SEQ ID NO: 4748 - DNA, 25 bp, S. cerevisiae
accgaacgtgaaggaaaggctgatc

SEQ ID NO: 4749 - DNA, 25 bp, S. cerevisiae
aactatacgctatggaaagaggcag

SEQ ID NO: 4750 - DNA, 25 bp, S. cerevisiae
atgtctaatccatgccagaaggagg

SEQ ID NO: 4751 - DNA, 25 bp, S. cerevisiae
atgacttcccatggtctttgaacaa

SEQ ID NO: 4752 - DNA, 25 bp, S. cerevisiae
atgcagctccccatgttggtggaaa

SEQ ID NO: 4753 - DNA, 25 bp, S. cerevisiae
atgacgataccatccgcttattcga

SEQ ID NO: 4754 - DNA, 25 bp, S. cerevisiae
atggttacggttccaaacttctctg

SEQ ID NO: 4755 - DNA, 25 bp, S. cerevisiae
agtccaattagatgcgccaacctta

SEQ ID NO: 4756 - DNA, 25 bp, S. cerevisiae
atgaccgaaagaaagctattgcagc

SEQ ID NO: 4757 - DNA, 25 bp, S. cerevisiae
atgataatcaatgccttcgctaagg

SEQ ID NO: 4758 - DNA, 25 bp, S. cerevisiae
atgacggcagcacacagaactacag

SEQ ID NO: 4759 - DNA, 25 bp, S. cerevisiae
atgatctggcgtcagagtacccgct

SEQ ID NO: 4760 - DNA, 25 bp, S. cerevisiae
atgataccggctctcactcccgaag

SEQ ID NO: 4761 - DNA, 25 bp, S. cerevisiae
atgatgatgacgaggtactcccggg

SEQ ID NO: 4762 - DNA, 25 bp, S. cerevisiae
atgactgcttgctattttactttag

SEQ ID NO: 4763 - DNA, 25 bp, S. cerevisiae
atgcaccattctttcttactgtcac

SEQ ID NO: 4764 - DNA, 25 bp, S. cerevisiae
atgagcaggcgcacgatgtcacaat

SEQ ID NO: 4765 - DNA, 25 bp, S. cerevisiae
atgagcaaggctacgtgttcctttg

SEQ ID NO: 4766 - DNA, 25 bp, S. cerevisiae
atgaatgctgcacttctgatgatta

SEQ ID NO: 4767 - DNA, 25 bp, S. cerevisiae
atgcaatacagtgacatatatatac

SEQ ID NO: 4768 - DNA, 25 bp, S. cerevisiae
atgaatctcaatgcatattttgaag

SEQ ID NO: 4769 - DNA, 25 bp, S. cerevisiae
atgacttaaccatcgttgcacacac

SEQ ID NO: 4770 - DNA, 25 bp, S. cerevisiae
aggctctagccttagcgggaaagct

SEQ ID NO: 4771 - DNA, 25 bp, S. cerevisiae
aggccatttgcctgcaggagacaag

SEQ ID NO: 4772 - DNA, 25 bp, S. cerevisiae
atggacgttgtctccgaagaacctt

SEQ ID NO: 4773 - DNA, 25 bp, S. cerevisiae
atgtacgtttcctctgacagaagaa

SEQ ID NO: 4774 - DNA, 25 bp, S. cerevisiae
atgatgtgcgtctgtatcccaaaaa

SEQ ID NO: 4775 - DNA, 25 bp, S. cerevisiae
atgagagcagtcactagaaacaaaa

SEQ ID NO: 4776 - DNA, 25 bp, S. cerevisiae
atgactgcagcaactggacaacctg

SEQ ID NO: 4777 - DNA, 25 bp, S. cerevisiae
atgacggatttatccccatgagttt

SEQ ID NO: 4778 - DNA, 25 bp, S. cerevisiae
atgaacgaattcaccccagagaagt

SEQ ID NO: 4779 - DNA, 25 bp, S. cerevisiae
atgcaaccagtttggccaccaagaa

SEQ ID NO: 4780 - DNA, 25 bp, S. cerevisiae
atgcaaggcgattctgtcccaaaat

SEQ ID NO: 4781 - DNA, 25 bp, S. cerevisiae
atgaatgtggattcagctcccgcca

SEQ ID NO: 4782 - DNA, 25 bp, S. cerevisiae
atgaactgtattttttccgcaacaa

SEQ ID NO: 4783 - DNA, 25 bp, S. cerevisiae
atgcaatttcattcgttcttacaac

SEQ ID NO: 4784 - DNA, 25 bp, S. cerevisiae
atgcaattcttcattctttgagcaa

SEQ ID NO: 4785 - DNA, 25 bp, S. cerevisiae
atgacatcactacctttctggatat

SEQ ID NO: 4786 - DNA, 25 bp, S. cerevisiae
atgaattcatgattttctccggtga

SEQ ID NO: 4787 - DNA, 25 bp, S. cerevisiae
atgcaatcgctttaacacccatttg

SEQ ID NO: 4788 - DNA, 25 bp, S. cerevisiae
atgagacgcggctcctattatgtgt

SEQ ID NO: 4789 - DNA, 25 bp, S. cerevisiae
atgaataccgtttcttgtgccttac

SEQ ID NO: 4790 - DNA, 25 bp, S. cerevisiae
atgagacacctttgctggttgcttg

SEQ ID NO: 4791 - DNA, 25 bp, S. cerevisiae
atgagcgtggttcagggcactctac

SEQ ID NO: 4792 - DNA, 25 bp, S. cerevisiae
atgacattaaacctcctgttactcc

SEQ ID NO: 4793 - DNA, 25 bp, S. cerevisiae
atgacttaagtcttccaccagattc

SEQ ID NO: 4794 - DNA, 25 bp, S. cerevisiae
atgagaaattatgcccgtcaaaatt

SEQ ID NO: 4795 - DNA, 25 bp, S. cerevisiae
atgagagaaactgccgttcccatct

SEQ ID NO: 4796 - DNA, 25 bp, S. cerevisiae
atgaaaattctactacgcgaccctc

SEQ ID NO: 4797 - DNA, 25 bp, S. cerevisiae
atgactaactcatcttatgccagcc

SEQ ID NO: 4798 - DNA, 25 bp, S. cerevisiae
atgagtacggacgttgctgctgcac

SEQ ID NO: 4799 - DNA, 25 bp, S. cerevisiae
atgatgatggatcctcttcttccgg

SEQ ID NO: 4800 - DNA, 25 bp, S. cerevisiae
atgaatggctttgctgctgggtcaa

SEQ ID NO: 4801 - DNA, 25 bp, S. cerevisiae
atgactgccttctattccggtatta

SEQ ID NO: 4802 - DNA, 25 bp, S. cerevisiae
atgactgccttttcttctggtgtcg

SEQ ID NO: 4803 - DNA, 25 bp, S. cerevisiae
atgactcgtgatacacccgaagatg

SEQ ID NO: 4804 - DNA, 25 bp, S. cerevisiae
atgaccgatgtcatgccccatgaag

SEQ ID NO: 4805 - DNA, 25 bp, S. cerevisiae
atgaccgtgtcaaggcatccatgta

SEQ ID NO: 4806 - DNA, 25 bp, S. cerevisiae
atgattccctttcctgcacaacacg

SEQ ID NO: 4807 - DNA, 25 bp, S. cerevisiae
atgaatccttttgcatcgctagaag

SEQ ID NO: 4808 - DNA, 25 bp, S. cerevisiae
atgaactctttgtctactttggctc

SEQ ID NO: 4809 - DNA, 25 bp, S. cerevisiae
atgactcctctgctctgaatttgac

SEQ ID NO: 4810 - DNA, 25 bp, S. cerevisiae
atgacaatatctaccgcaacttaca

SEQ ID NO: 4811 - DNA, 25 bp, S. cerevisiae
atgacgatagtaccccacttaagaa

SEQ ID NO: 4812 - DNA, 25 bp, S. cerevisiae
atgactgtagtacccgcaataataa

SEQ ID NO: 4813 - DNA, 25 bp, S. cerevisiae
atgactgtactacccgcaaccataa

SEQ ID NO: 4814 - DNA, 25 bp, S. cerevisiae
atgacgaaccgtttagacgcagcaa

SEQ ID NO: 4815 - DNA, 25 bp, S. cerevisiae
atgaaatacctgttgtccggctacg

SEQ ID NO: 4816 - DNA, 25 bp, S. cerevisiae
atgatacttgcggtgttcggcggta

SEQ ID NO: 4817 - DNA, 25 bp, S. cerevisiae
agatcaatggccagtgcccgcggaa

SEQ ID NO: 4818 - DNA, 25 bp, S. cerevisiae
atgaaagcgctgattcgcatcacca

SEQ ID NO: 4819 - DNA, 25 bp, S. cerevisiae
atgaagtcagtgcatccgtctccat

SEQ ID NO: 4820 - DNA, 25 bp, S. cerevisiae
atgacagtcgctgaactgttcttag

SEQ ID NO: 4821 - DNA, 25 bp, S. cerevisiae
atgacttactgtctgtaggtgatat

SEQ ID NO: 4822 - DNA, 25 bp, S. cerevisiae
atgagttcacatcgccttatggtca

SEQ ID NO: 4823 - DNA, 25 bp, S. cerevisiae
atgagcattcctggcgtttcgtcaa

SEQ ID NO: 4824 - DNA, 25 bp, S. cerevisiae
atgacgcatcctaatggtcttcacc

SEQ ID NO: 4825 - DNA, 25 bp, S. cerevisiae
atgagccttctgcaggtttctcgaa

SEQ ID NO: 4826 - DNA, 25 bp, S. cerevisiae
atgacgcatttgttggtggttcgaa

SEQ ID NO: 4827 - DNA, 25 bp, S. cerevisiae
atgacgattatgacgctgaagtagc

SEQ ID NO: 4828 - DNA, 25 bp, S. cerevisiae
atgaagtcttaccatatccgtccta

SEQ ID NO: 4829 - DNA, 25 bp, S. cerevisiae
atgaactctgtcgtaaatccaacta

SEQ ID NO: 4830 - DNA, 25 bp, S. cerevisiae
atgaacctggttccgagcatcaaga

SEQ ID NO: 4831 - DNA, 25 bp, S. cerevisiae
atgatatcgatccattactccgcaa

SEQ ID NO: 4832 - DNA, 25 bp, S. cerevisiae
atgatagtaccgacgatgccgatga

SEQ ID NO: 4833 - DNA, 25 bp, S. cerevisiae
atgacaatttcgatgatgcccagga

SEQ ID NO: 4834 - DNA, 25 bp, S. cerevisiae
atgaaccgacctttgctgccaggaa

SEQ ID NO: 4835 - DNA, 25 bp, S. cerevisiae
atgaagcttgagacttctcgccgtg

SEQ ID NO: 4836 - DNA, 25 bp, S. cerevisiae
atgaacttcatgacttcctgtcctg

SEQ ID NO: 4837 - DNA, 25 bp, S. cerevisiae
atgagcactatgttttctgttggat

SEQ ID NO: 4838 - DNA, 25 bp, S. cerevisiae
atgagcatttggactggcatttcag

SEQ ID NO: 4839 - DNA, 25 bp, S. cerevisiae
atgatgttcactttgccgaggtgcc

SEQ ID NO: 4840 - DNA, 25 bp, S. cerevisiae
atgtaccgttacctgaagatgcgca

SEQ ID NO: 4841 - DNA, 25 bp, S. cerevisiae
atgaaagctcatccggtgcttctaa

SEQ ID NO: 4842 - DNA, 25 bp, S. cerevisiae
atgagctcaaactcggagtcccaga

SEQ ID NO: 4843 - DNA, 25 bp, S. cerevisiae
atgaacatagaatcggcctcctcaa

SEQ ID NO: 4844 - DNA, 25 bp, S. cerevisiae
atgaggctgatggtagctcctccca

SEQ ID NO: 4845 - DNA, 25 bp, S. cerevisiae
atgacgccattgcagtgattactaa

SEQ ID NO: 4846 - DNA, 25 bp, S. cerevisiae
atgactccaggcaaggttctcttta

SEQ ID NO: 4847 - DNA, 25 bp, S. cerevisiae
atgacttgcaggagcaactgccttt

SEQ ID NO: 4848 - DNA, 25 bp, S. cerevisiae
atgacttgacgctgcatcaggcact

SEQ ID NO: 4849 - DNA, 25 bp, S. cerevisiae
atgaggcaggtgtcagcatcaatgg

SEQ ID NO: 4850 - DNA, 25 bp, S. cerevisiae
atgagagggtgtacatcaagctgcg

SEQ ID NO: 4851 - DNA, 25 bp, S. cerevisiae
atgagaagaaagactctcgcaccta

SEQ ID NO: 4852 - DNA, 25 bp, S. cerevisiae
atgtacgccagaaccgtgcactaga

SEQ ID NO: 4853 - DNA, 25 bp, S. cerevisiae
atgaccgtgatcacatcaaccctga

SEQ ID NO: 4854 - DNA, 25 bp, S. cerevisiae
atgacttgtatctcattaccgctaa

SEQ ID NO: 4855 - DNA, 25 bp, S. cerevisiae
atgagtgttcttttaccgttgagat

SEQ ID NO: 4856 - DNA, 25 bp, S. cerevisiae
atgaggccctcataatccctgacga

SEQ ID NO: 4857 - DNA, 25 bp, S. cerevisiae
atgttggccatcaaataccctgacg

SEQ ID NO: 4858 - DNA, 25 bp, S. cerevisiae
atgttggcggcttagtatctgtgac

SEQ ID NO: 4859 - DNA, 25 bp, S. cerevisiae
atgttggcgagaatagctactatgc

SEQ ID NO: 4860 - DNA, 25 bp, S. cerevisiae
atgattaggctgatcactcactcgc

SEQ ID NO: 4861 - DNA, 25 bp, S. cerevisiae
atgtcatgtgcaggtgccgttggca

SEQ ID NO: 4862 - DNA, 25 bp, S. cerevisiae
atgacagtgcaagtgcctcttccgc

SEQ ID NO: 4863 - DNA, 25 bp, S. cerevisiae
atggaagagtcgaagccagttgctt

SEQ ID NO: 4864 - DNA, 25 bp, S. cerevisiae
atggtactagcagaccgtaggtttt

SEQ ID NO: 4865 - DNA, 25 bp, S. cerevisiae
atgttgcgtcaggagcaccagtgca

SEQ ID NO: 4866 - DNA, 25 bp, S. cerevisiae
atgattcgatcagcaccactagcaa

SEQ ID NO: 4867 - DNA, 25 bp, S. cerevisiae
atgttcgtgcaagcaggtctcatca

SEQ ID NO: 4868 - DNA, 25 bp, S. cerevisiae
atgtcggtgacggaaacatccattt

SEQ ID NO: 4869 - DNA, 25 bp, S. cerevisiae
atgtaggtcccgttaacttgtcaga

SEQ ID NO: 4870 - DNA, 25 bp, S. cerevisiae
atgtaacaccctacttgactttcag

SEQ ID NO: 4871 - DNA, 25 bp, S. cerevisiae
atggaaacaggaacaggcactttga

SEQ ID NO: 4872 - DNA, 25 bp, S. cerevisiae
atgaccaaatggaacggcactattt

SEQ ID NO: 4873 - DNA, 25 bp, S. cerevisiae
atgacgaaacgtacaaccttgatat

SEQ ID NO: 4874 - DNA, 25 bp, S. cerevisiae
atgacgtctgtcattaccccaagtg

SEQ ID NO: 4875 - DNA, 25 bp, S. cerevisiae
atgagactgtgtacgttgtggacga

SEQ ID NO: 4876 - DNA, 25 bp, S. cerevisiae
atgacaggttccgttttggcaagaa

SEQ ID NO: 4877 - DNA, 25 bp, S. cerevisiae
agattggcgcaaccggatactacga

SEQ ID NO: 4878 - DNA, 25 bp, S. cerevisiae
atgaggatgccaaggccgccatcaa

SEQ ID NO: 4879 - DNA, 25 bp, S. cerevisiae
atggtagagccggtgctactacttc

SEQ ID NO: 4880 - DNA, 25 bp, S. cerevisiae
atgatttgcgctggttttgtcgacc

SEQ ID NO: 4881 - DNA, 25 bp, S. cerevisiae
atgacttgatgggactttctgagaa

SEQ ID NO: 4882 - DNA, 25 bp, S. cerevisiae
atgatgctagatttcctcggtggcg

SEQ ID NO: 4883 - DNA, 25 bp, S. cerevisiae
atgactcaaggttacggttctgctg

SEQ ID NO: 4884 - DNA, 25 bp, S. cerevisiae
atgttcaaggcatcgacgacgtcca

SEQ ID NO: 4885 - DNA, 25 bp, S. cerevisiae
agagctttggtagccaagtttccaa

SEQ ID NO: 4886 - DNA, 25 bp, S. cerevisiae
atgagtttgagaatccccttttcct

SEQ ID NO: 4887 - DNA, 25 bp, S. cerevisiae
atgtagcagcattgacgggcgagtt

SEQ ID NO: 4888 - DNA, 25 bp, S. cerevisiae
atgacaacattaacgaggagctctt

SEQ ID NO: 4889 - DNA, 25 bp, S. cerevisiae
atggcagataattatttggacacag

SEQ ID NO: 4890 - DNA, 25 bp, S. cerevisiae
atgacaggcacaactctattaccac

SEQ ID NO: 4891 - DNA, 25 bp, S. cerevisiae
atgatcatggaacacttctcccaac

SEQ ID NO: 4892 - DNA, 25 bp, S. cerevisiae
atgatgatccatttagctcttcctc

SEQ ID NO: 4893 - DNA, 25 bp, S. cerevisiae
atgagtacattaccactgtctcctt

SEQ ID NO: 4894 - DNA, 25 bp, S. cerevisiae
atgagatctaatccacaacagccgc

SEQ ID NO: 4895 - DNA, 25 bp, S. cerevisiae
atgatgcgctactcaaagaatcgga

SEQ ID NO: 4896 - DNA, 25 bp, S. cerevisiae
atgtggcatatgtcgcggagttgat

SEQ ID NO: 4897 - DNA, 25 bp, S. cerevisiae
atgagcgcagttttgactacataac

SEQ ID NO: 4898 - DNA, 25 bp, S. cerevisiae
atgtcagcttgtcaccatcggaagt

SEQ ID NO: 4899 - DNA, 25 bp, S. cerevisiae
atgatgttcctgaagcacctgtgta

SEQ ID NO: 4900 - DNA, 25 bp, S. cerevisiae
atgatgtatcctgcttccgagaatg

SEQ ID NO: 4901 - DNA, 25 bp, S. cerevisiae
atgacatgggctgctgttctacaaa

SEQ ID NO: 4902 - DNA, 25 bp, S. cerevisiae
atgacatggacggtgttgacttcaa

SEQ ID NO: 4903 - DNA, 25 bp, S. cerevisiae
atgaccattcccaactcatgttaga

SEQ ID NO: 4904 - DNA, 25 bp, S. cerevisiae
atgagccttccgcatctctggaaag

SEQ ID NO: 4905 - DNA, 25 bp, S. cerevisiae
atgagaccacccagccaaggagata

SEQ ID NO: 4906 - DNA, 25 bp, S. cerevisiae
atgtcacccaccacaactatgaata

SEQ ID NO: 4907 - DNA, 25 bp, S. cerevisiae
atgtactcaaaccactacttaaagg

SEQ ID NO: 4908 - DNA, 25 bp, S. cerevisiae
atgacccaagtccacgattataaag

SEQ ID NO: 4909 - DNA, 25 bp, S. cerevisiae
atgacgcctgattctcccgtaaaat

SEQ ID NO: 4910 - DNA, 25 bp, S. cerevisiae
atgactcacgattgatctacggcaa

SEQ ID NO: 4911 - DNA, 25 bp, S. cerevisiae
atgacatctcttaagcctgcaggca

SEQ ID NO: 4912 - DNA, 25 bp, S. cerevisiae
atgacatctttattcctgagcagga

SEQ ID NO: 4913 - DNA, 25 bp, S. cerevisiae
atgatacatttctcactgggcagcc

SEQ ID NO: 4914 - DNA, 25 bp, S. cerevisiae
atgatacattactacacgacgtgct

SEQ ID NO: 4915 - DNA, 25 bp, S. cerevisiae
atgaccattgaaaacgttgccgaag

SEQ ID NO: 4916 - DNA, 25 bp, S. cerevisiae
atgaccttcttttaggtccgggcat

SEQ ID NO: 4917 - DNA, 25 bp, S. cerevisiae
atgtccacacatcaaaaaacccgtc

SEQ ID NO: 4918 - DNA, 25 bp, S. cerevisiae
atgtctgccaaagctcaaaacccta

SEQ ID NO: 4919 - DNA, 25 bp, S. cerevisiae
atgatgctgctcaagcggcttacga

SEQ ID NO: 4920 - DNA, 25 bp, S. cerevisiae
atgaggcacatacagctgatggcaa

SEQ ID NO: 4921 - DNA, 25 bp, S. cerevisiae
atgatgccaaatcagcttgatgctg

SEQ ID NO: 4922 - DNA, 25 bp, S. cerevisiae
atgaccatggaccaaggccttaacc

SEQ ID NO: 4923 - DNA, 25 bp, S. cerevisiae
atgaccaatctcgatgtgtccactg

SEQ ID NO: 4924 - DNA, 25 bp, S. cerevisiae
atgtcagcaaagtggatcctcgcgg

SEQ ID NO: 4925 - DNA, 25 bp, S. cerevisiae
agtcagcggcgctttgaaccgggaa

SEQ ID NO: 4926 - DNA, 25 bp, S. cerevisiae
atgtatcacggctttggacctacga

SEQ ID NO: 4927 - DNA, 25 bp, S. cerevisiae
atgactgttccttctgtggtaagaa

SEQ ID NO: 4928 - DNA, 25 bp, S. cerevisiae
atgactgcttttgcatctttaagag

SEQ ID NO: 4929 - DNA, 25 bp, S. cerevisiae
atgactgtcattttgatcctagaag

SEQ ID NO: 4930 - DNA, 25 bp, S. cerevisiae
atgtgcgtaccttattcgctacaac

SEQ ID NO: 4931 - DNA, 25 bp, S. cerevisiae
atgttacaatccctgaacccaaaca

SEQ ID NO: 4932 - DNA, 25 bp, S. cerevisiae
atgttatcgtccctaacgtttggag

SEQ ID NO: 4933 - DNA, 25 bp, S. cerevisiae
atgtcttcttcccaggtcgtcaggg

SEQ ID NO: 4934 - DNA, 25 bp, S. cerevisiae
atgttgactggtattgccccagacc

SEQ ID NO: 4935 - DNA, 25 bp, S. cerevisiae
atgtttgtgggcttctacctaacct

SEQ ID NO: 4936 - DNA, 25 bp, S. cerevisiae
atgtttggtagctttccaccattcc

SEQ ID NO: 4937 - DNA, 25 bp, S. cerevisiae
atgtttattcctatcgcctttacct

SEQ ID NO: 4938 - DNA, 25 bp, S. cerevisiae
atgatttttcctgtggactcagtaa

SEQ ID NO: 4939 - DNA, 25 bp, S. cerevisiae
atgtcaccgaattcgaggttcctaa

SEQ ID NO: 4940 - DNA, 25 bp, S. cerevisiae
agtccgcaccactagaagttccggt

SEQ ID NO: 4941 - DNA, 25 bp, S. cerevisiae
atgactcctcaagtagtgcagggtc

SEQ ID NO: 4942 - DNA, 25 bp, S. cerevisiae
atgagtcttcatcaagtgacagcga

SEQ ID NO: 4943 - DNA, 25 bp, S. cerevisiae
atgagtgtcgatccacgtcatatcc

SEQ ID NO: 4944 - DNA, 25 bp, S. cerevisiae
atgacgcctatgacaagtgcattca

SEQ ID NO: 4945 - DNA, 25 bp, S. cerevisiae
atgagcgtcattacggcgcatggca

SEQ ID NO: 4946 - DNA, 25 bp, S. cerevisiae
atggctttcaagaacctccaattcc

SEQ ID NO: 4947 - DNA, 25 bp, S. cerevisiae
atgattctcaatatgggttagccgc

SEQ ID NO: 4948 - DNA, 25 bp, S. cerevisiae
atgatgatgacttcgggccagacca

SEQ ID NO: 4949 - DNA, 25 bp, S. cerevisiae
atgatgatggtatcgacgcagaatc

SEQ ID NO: 4950 - DNA, 25 bp, S. cerevisiae
atgatagcgtggtccctagtggcta

SEQ ID NO: 4951 - DNA, 25 bp, S. cerevisiae
atgtacgatgagtacctgggctccc

SEQ ID NO: 4952 - DNA, 25 bp, S. cerevisiae
atgattttatttccttggctcctgg

SEQ ID NO: 4953 - DNA, 25 bp, S. cerevisiae
atggatttccggtcgattgtttaca

SEQ ID NO: 4954 - DNA, 25 bp, S. cerevisiae
atggttccgggagacttcatgaagc

SEQ ID NO: 4955 - DNA, 25 bp, S. cerevisiae
atgtgttacggtggcgactggtcaa

SEQ ID NO: 4956 - DNA, 25 bp, S. cerevisiae
atgttaacggcaacttcggctcaga

SEQ ID NO: 4957 - DNA, 25 bp, S. cerevisiae
atgtataaatgtgtcccgagttatt

SEQ ID NO: 4958 - DNA, 25 bp, S. cerevisiae
agttaaagactttggccactccatc

SEQ ID NO: 4959 - DNA, 25 bp, S. cerevisiae
atgttgggacttttgcagatcgtga

SEQ ID NO: 4960 - DNA, 25 bp, S. cerevisiae
atgttggtgggttctggatctttcc

SEQ ID NO: 4961 - DNA, 25 bp, S. cerevisiae
atgtaactcgtatagcttccttgct

SEQ ID NO: 4962 - DNA, 25 bp, S. cerevisiae
atgagactctcgtgaagcttacctt

SEQ ID NO: 4963 - DNA, 25 bp, S. cerevisiae
atgataccactgctgagacctcaaa

SEQ ID NO: 4964 - DNA, 25 bp, S. cerevisiae
atgtaacgagctgcctgttgttcta

SEQ ID NO: 4965 - DNA, 25 bp, S. cerevisiae
atgatcgaaactgccatttatggta

SEQ ID NO: 4966 - DNA, 25 bp, S. cerevisiae
atgaggtagactcccatccaaggac

SEQ ID NO: 4967 - DNA, 25 bp, S. cerevisiae
atgggtatgactgaaccaggttccc

SEQ ID NO: 4968 - DNA, 25 bp, S. cerevisiae
atgggcaatatctcactactgtact

SEQ ID NO: 4969 - DNA, 25 bp, S. cerevisiae
gtcggaaacccagattttcttcaca

SEQ ID NO: 4970 - DNA, 25 bp, S. cerevisiae
ctggcgaaatttattgtttttacat

SEQ ID NO: 4971 - DNA, 25 bp, S. cerevisiae
atgatttcccatttagctgtacctc

SEQ ID NO: 4972 - DNA, 25 bp, S. cerevisiae
atgttaccacgttcagcattagcac

SEQ ID NO: 4973 - DNA, 25 bp, S. cerevisiae
atgttacgattcacactcttccaaa

SEQ ID NO: 4974 - DNA, 25 bp, S. cerevisiae
atgtttccaatataccgccaatcaa

SEQ ID NO: 4975 - DNA, 25 bp, S. cerevisiae
atgttttccatcaaccctgggtgaa

SEQ ID NO: 4976 - DNA, 25 bp, S. cerevisiae
atgacgcttacactaccttgtttag

SEQ ID NO: 4977 - DNA, 25 bp, S. cerevisiae
agtacagtagcaggacacggtttag

SEQ ID NO: 4978 - DNA, 25 bp, S. cerevisiae
atgtatcgacaattaccgtgtttta

SEQ ID NO: 4979 - DNA, 25 bp, S. cerevisiae
atgatataccagaacacgccggtgt

SEQ ID NO: 4980 - DNA, 25 bp, S. cerevisiae
atgtcaagcccaactcctccaggtg

SEQ ID NO: 4981 - DNA, 25 bp, S. cerevisiae
atgtacagcttcgagatacccggta

SEQ ID NO: 4982 - DNA, 25 bp, S. cerevisiae
atgtaagttcggtacgcactgcacc

SEQ ID NO: 4983 - DNA, 25 bp, S. cerevisiae
atgagaagttgtcacccagcagcac

SEQ ID NO: 4984 - DNA, 25 bp, S. cerevisiae
atgatgacgttatagcgccactgcc

SEQ ID NO: 4985 - DNA, 25 bp, S. cerevisiae
atgaggctccttttcctgaagagaa

SEQ ID NO: 4986 - DNA, 25 bp, S. cerevisiae
atgaggccattgtcttatatatgaa

SEQ ID NO: 4987 - DNA, 25 bp, S. cerevisiae
atgagcagcatacttttattttgaa

SEQ ID NO: 4988 - DNA, 25 bp, S. cerevisiae
atgatcatttgttgtctttaccgac

SEQ ID NO: 4989 - DNA, 25 bp, S. cerevisiae
atgtatatcgtattccaaggcgtct

SEQ ID NO: 4990 - DNA, 25 bp, S. cerevisiae
atgaggctacaaacgcaattagtgt

SEQ ID NO: 4991 - DNA, 25 bp, S. cerevisiae
atgaggctataatccaatcttggct

SEQ ID NO: 4992 - DNA, 25 bp, S. cerevisiae
atgaggcttccaggcaaagattcgc

SEQ ID NO: 4993 - DNA, 25 bp, S. cerevisiae
atgagtgatactacggaagtcccta

SEQ ID NO: 4994 - DNA, 25 bp, S. cerevisiae
atgttgatccatacggtcagtctcc

SEQ ID NO: 4995 - DNA, 25 bp, S. cerevisiae
atgatttgcttgactgggatggccc

SEQ ID NO: 4996 - DNA, 25 bp, S. cerevisiae
atgttgtaaacatcttccccttagt

SEQ ID NO: 4997 - DNA, 25 bp, S. cerevisiae
atgttatgcttatgactccggcgac

SEQ ID NO: 4998 - DNA, 25 bp, S. cerevisiae
atgatttcggtggtgcttttgccat

SEQ ID NO: 4999 - DNA, 25 bp, S. cerevisiae
atgagaagtttggtgtttgtccaac

SEQ ID NO: 5000 - DNA, 25 bp, S. cerevisiae
atgagggtttcactggcttgtacaa

SEQ ID NO: 5001 - DNA, 25 bp, S. cerevisiae
atgtacgatgctacgtcaacctgct

SEQ ID NO: 5002 - DNA, 25 bp, S. cerevisiae
atgatattatgatgccgtcgcctaa

SEQ ID NO: 5003 - DNA, 25 bp, S. cerevisiae
atgagcttgtactcgtcaatcttcg

SEQ ID NO: 5004 - DNA, 25 bp, S. cerevisiae
atgagcttaatctcgccaaacctga

SEQ ID NO: 5005 - DNA, 25 bp, S. cerevisiae
aggcctgaattctccaaaactacca

SEQ ID NO: 5006 - DNA, 25 bp, S. cerevisiae
agagctcaagttcaccaaaacggaa

SEQ ID NO: 5007 - DNA, 25 bp, S. cerevisiae
atgtagtggttgtccctacttgggt

SEQ ID NO: 5008 - DNA, 25 bp, S. cerevisiae
agtcggtgttgtctctattttggaa

SEQ ID NO: 5009 - DNA, 25 bp, S. cerevisiae
atgttcggtcttccgttttgcagaa

SEQ ID NO: 5010 - DNA, 25 bp, S. cerevisiae
atgagctaggtgacttcgccattct

SEQ ID NO: 5011 - DNA, 25 bp, S. cerevisiae
atgatgttcatttgctttaccctcc

SEQ ID NO: 5012 - DNA, 25 bp, S. cerevisiae
atgtttgattctctcaagccactgg

SEQ ID NO: 5013 - DNA, 25 bp, S. cerevisiae
atgatggtttatcccatgtcaccac

SEQ ID NO: 5014 - DNA, 25 bp, S. cerevisiae
atgatgggtgattccgatttataca

SEQ ID NO: 5015 - DNA, 25 bp, S. cerevisiae
atgatagttgatttctattccaaca

SEQ ID NO: 5016 - DNA, 25 bp, S. cerevisiae
atgattctcgctttgggcgacttcc

SEQ ID NO: 5017 - DNA, 25 bp, S. cerevisiae
atgatattacgatcggctactccgg

SEQ ID NO: 5018 - DNA, 25 bp, S. cerevisiae
atgtttgggcacctatgcgagctaa

SEQ ID NO: 5019 - DNA, 25 bp, S. cerevisiae
atgttcgggttgctgtggaaactac

SEQ ID NO: 5020 - DNA, 25 bp, S. cerevisiae
gttacgatcccgcagtacaaacttt

SEQ ID NO: 5021 - DNA, 25 bp, S. cerevisiae
atggaaatcccaccgcaaatataag

SEQ ID NO: 5022 - DNA, 25 bp, S. cerevisiae
aggccaagcaacgtgaaaaggtcat

SEQ ID NO: 5023 - DNA, 25 bp, S. cerevisiae
atgtctcaaccggttcaacgcgctg

SEQ ID NO: 5024 - DNA, 25 bp, S. cerevisiae
atggtggacccgttcgcacgaagat

SEQ ID NO: 5025 - DNA, 25 bp, S. cerevisiae
atgagttcccggtttgcaagaagta

SEQ ID NO: 5026 - DNA, 25 bp, S. cerevisiae
atgagtttcctcatttgcctaatga

SEQ ID NO: 5027 - DNA, 25 bp, S. cerevisiae
atgttgcgtacttctcttactaaag

SEQ ID NO: 5028 - DNA, 25 bp, S. cerevisiae
atgatattacgcatccaattccgga

SEQ ID NO: 5029 - DNA, 25 bp, S. cerevisiae
atgtgtaactttttctttcttcaat

SEQ ID NO: 5030 - DNA, 25 bp, S. cerevisiae
atggttctttggctaattcttatat

SEQ ID NO: 5031 - DNA, 25 bp, S. cerevisiae
atggtgttttacaaagtcacgttga

SEQ ID NO: 5032 - DNA, 25 bp, S. cerevisiae
atgttctcttgaaattccccgttag

SEQ ID NO: 5033 - DNA, 25 bp, S. cerevisiae
atgatgtatttttatcgctcctcgt

SEQ ID NO: 5034 - DNA, 25 bp, S. cerevisiae
atgatggtccatctgacgatgacga

SEQ ID NO: 5035 - DNA, 25 bp, S. cerevisiae
atgatggttcacctcacgctgaaat

SEQ ID NO: 5036 - DNA, 25 bp, S. cerevisiae
atgatctttatccacatcttgcaag

SEQ ID NO: 5037 - DNA, 25 bp, S. cerevisiae
atgatgatttccacatttcacgacg

SEQ ID NO: 5038 - DNA, 25 bp, S. cerevisiae
atgttttggcgcaataccacgaggc

SEQ ID NO: 5039 - DNA, 25 bp, S. cerevisiae
atgttgaccggtatccccgctgacc

SEQ ID NO: 5040 - DNA, 25 bp, S. cerevisiae
atgttgaccggtatccccgctgacc

SEQ ID NO: 5041 - DNA, 25 bp, S. cerevisiae
atgttaagcagaattgtccccggaa

SEQ ID NO: 5042 - DNA, 25 bp, S. cerevisiae
atgttatagatgttgaggcccggga

SEQ ID NO: 5043 - DNA, 25 bp, S. cerevisiae
atgttctgaatggtatcgcgccggg

SEQ ID NO: 5044 - DNA, 25 bp, S. cerevisiae
atgatatcttactcagacgctgcgt

SEQ ID NO: 5045 - DNA, 25 bp, S. cerevisiae
atgatgatttcgaccctcgaggaaa

SEQ ID NO: 5046 - DNA, 25 bp, S. cerevisiae
atgttgctactttggctattgctta

SEQ ID NO: 5047 - DNA, 25 bp, S. cerevisiae
atgattggcgcatttggtaccataa

SEQ ID NO: 5048 - DNA, 25 bp, S. cerevisiae
atgagtgcgctgcaacttactgcat

SEQ ID NO: 5049 - DNA, 25 bp, S. cerevisiae
atgatcattgtatttgggcctgcca

SEQ ID NO: 5050 - DNA, 25 bp, S. cerevisiae
atgtcttcagacgtggcgatgcttg

SEQ ID NO: 5051 - DNA, 25 bp, S. cerevisiae
atggattggcacatcatctgtaggg

SEQ ID NO: 5052 - DNA, 25 bp, S. cerevisiae
atggctcatggaagctacgtaacga

SEQ ID NO: 5053 - DNA, 25 bp, S. cerevisiae
atgatgtcatcgagaacgtcgaaga

SEQ ID NO: 5054 - DNA, 25 bp, S. cerevisiae
atggtcacagcgcagtcgacgtcaa

SEQ ID NO: 5055 - DNA, 25 bp, S. cerevisiae
atgtgcatgcggcaaaccactctaa

SEQ ID NO: 5056 - DNA, 25 bp, S. cerevisiae
atgatgacgctgacattgatctcaa

SEQ ID NO: 5057 - DNA, 25 bp, S. cerevisiae
atgatggctgctgccgatccaagaa

SEQ ID NO: 5058 - DNA, 25 bp, S. cerevisiae
atgatgctcagctccaatgaagaca

SEQ ID NO: 5059 - DNA, 25 bp, S. cerevisiae
atgatttcaccctaaacacgccaaa

SEQ ID NO: 5060 - DNA, 25 bp, S. cerevisiae
atgttgcagacatgcttaccccaga

SEQ ID NO: 5061 - DNA, 25 bp, S. cerevisiae
atgttcaagaacgtccccttatgga

SEQ ID NO: 5062 - DNA, 25 bp, S. cerevisiae
atgtggaaactatccccttacacgt

SEQ ID NO: 5063 - DNA, 25 bp, S. cerevisiae
atgtctgtaaagtaccgttccctca

SEQ ID NO: 5064 - DNA, 25 bp, S. cerevisiae
agtctatgcaattggtggcgctatt

SEQ ID NO: 5065 - DNA, 25 bp, S. cerevisiae
atgtcctagactgtccatcgattgg

SEQ ID NO: 5066 - DNA, 25 bp, S. cerevisiae
atgatcgcccaaagtaccagattag

SEQ ID NO: 5067 - DNA, 25 bp, S. cerevisiae
agtactgaagatatgcccgtcgttg

SEQ ID NO: 5068 - DNA, 25 bp, S. cerevisiae
aggatccaagaaccctttcgtatgg

SEQ ID NO: 5069 - DNA, 25 bp, S. cerevisiae
atgttgcatgcgctacgtttgcatt

SEQ ID NO: 5070 - DNA, 25 bp, S. cerevisiae
atgtcgacggtgagtgggtcaccat

SEQ ID NO: 5071 - DNA, 25 bp, S. cerevisiae
atgtctacgatttcagtgggttccc

SEQ ID NO: 5072 - DNA, 25 bp, S. cerevisiae
atgttttggtatggacctgtccttc

SEQ ID NO: 5073 - DNA, 25 bp, S. cerevisiae
atgttcatactttggaggctcgcga

SEQ ID NO: 5074 - DNA, 25 bp, S. cerevisiae
atgattcacacgttcgtggctccaa

SEQ ID NO: 5075 - DNA, 25 bp, S. cerevisiae
atgttgagagcgttccgctgttcta

SEQ ID NO: 5076 - DNA, 25 bp, S. cerevisiae
atgtttttaacttttgcacttcctg

SEQ ID NO: 5077 - DNA, 25 bp, S. cerevisiae
atgtgtttccaattaatacgcttac

SEQ ID NO: 5078 - DNA, 25 bp, S. cerevisiae
atgtctggtttgtgtcggatatctt

SEQ ID NO: 5079 - DNA, 25 bp, S. cerevisiae
agtagctttagttccggagttccag

SEQ ID NO: 5080 - DNA, 25 bp, S. cerevisiae
atgttgcctattgccgctaagatga

SEQ ID NO: 5081 - DNA, 25 bp, S. cerevisiae
atgtacgtcattgccatctaggata

SEQ ID NO: 5082 - DNA, 25 bp, S. cerevisiae
atgtcacctcattggaagctagata

SEQ ID NO: 5083 - DNA, 25 bp, S. cerevisiae
atgtcaatccatcaattcactaata

SEQ ID NO: 5084 - DNA, 25 bp, S. cerevisiae
atgttggatgctgtggctccaggac

SEQ ID NO: 5085 - DNA, 25 bp, S. cerevisiae
atgttgatagtgctactccataccc

SEQ ID NO: 5086 - DNA, 25 bp, S. cerevisiae
atgttgcattatctatccctactgt

SEQ ID NO: 5087 - DNA, 25 bp, S. cerevisiae
atgtaattactgttcccgatggctc

SEQ ID NO: 5088 - DNA, 25 bp, S. cerevisiae
atgattatctctggttcccgtgaca

SEQ ID NO: 5089 - DNA, 25 bp, S. cerevisiae
atgtcattctctgtcagctgcaaga

SEQ ID NO: 5090 - DNA, 25 bp, S. cerevisiae
atgatcgtcttcagcagcagcaaca

SEQ ID NO: 5091 - DNA, 25 bp, S. cerevisiae
atgatctctgatgaacagctgaact

SEQ ID NO: 5092 - DNA, 25 bp, S. cerevisiae
agatcggtcgaaattgcaacgaatt

SEQ ID NO: 5093 - DNA, 25 bp, S. cerevisiae
atgatcagttcgtgtgttactagat

SEQ ID NO: 5094 - DNA, 25 bp, S. cerevisiae
atgtatttcgtctatgttcgcggcc

SEQ ID NO: 5095 - DNA, 25 bp, S. cerevisiae
atgtccaccgattctattgtcaagg

SEQ ID NO: 5096 - DNA, 25 bp, S. cerevisiae
atgtcacccagattctttatacgcc

SEQ ID NO: 5097 - DNA, 25 bp, S. cerevisiae
atgatccttgtgaggagtcctccaa

SEQ ID NO: 5098 - DNA, 25 bp, S. cerevisiae
atgttgatgaactgcatcctccgga

SEQ ID NO: 5099 - DNA, 25 bp, S. cerevisiae
atgtttgtctctgccatttttgggc

SEQ ID NO: 5100 - DNA, 25 bp, S. cerevisiae
atgttatcgcgtctacgttgggacc

SEQ ID NO: 5101 - DNA, 25 bp, S. cerevisiae
atgtttgaggctattgttcggtgac

SEQ ID NO: 5102 - DNA, 25 bp, S. cerevisiae
atgtttcacctcaagattacgttag

SEQ ID NO: 5103 - DNA, 25 bp, S. cerevisiae
atgtctcaagatttcgttacgttag

SEQ ID NO: 5104 - DNA, 25 bp, S. cerevisiae
atgttgcatccgtttttgcaggcaa

SEQ ID NO: 5105 - DNA, 25 bp, S. cerevisiae
atgttgatcggctatcggctgaggc

SEQ ID NO: 5106 - DNA, 25 bp, S. cerevisiae
atgtcgatggcttgtatggctcaaa

SEQ ID NO: 5107 - DNA, 25 bp, S. cerevisiae
atgtcgtcactgtcttggcagggta

SEQ ID NO: 5108 - DNA, 25 bp, S. cerevisiae
atgatctgttatttccttgttgtaa

SEQ ID NO: 5109 - DNA, 25 bp, S. cerevisiae
atgatcttctagtgcgtctttttga

SEQ ID NO: 5110 - DNA, 25 bp, S. cerevisiae
atgttttgacccatcgtgtcttgaa

SEQ ID NO: 5111 - DNA, 25 bp, S. cerevisiae
atgtttcaccatctatattcccaat

SEQ ID NO: 5112 - DNA, 25 bp, S. cerevisiae
atgatttactcaaggctgcccagga

SEQ ID NO: 5113 - DNA, 25 bp, S. cerevisiae
atgttctccatcatatcttccagga

SEQ ID NO: 5114 - DNA, 25 bp, S. cerevisiae
atgtgaaggagctttggacagagaa

SEQ ID NO: 5115 - DNA, 25 bp, S. cerevisiae
atgtgaacagtttccgacgagctcc

SEQ ID NO: 5116 - DNA, 25 bp, S. cerevisiae
atgtttggtctacctcaacaggaag

SEQ ID NO: 5117 - DNA, 25 bp, S. cerevisiae
atgtttagaccaaatgacggagcaa

SEQ ID NO: 5118 - DNA, 25 bp, S. cerevisiae
atgtgggtaatctacctccggatgc

SEQ ID NO: 5119 - DNA, 25 bp, S. cerevisiae
atgtcggtaacgctatcttggatgg

SEQ ID NO: 5120 - DNA, 25 bp, S. cerevisiae
atgtgggctatgtcgaaatttgaac

SEQ ID NO: 5121 - DNA, 25 bp, S. cerevisiae
atgttgtgccattcgaaaccttaag

SEQ ID NO: 5122 - DNA, 25 bp, S. cerevisiae
atgttgtgcctagaagacctcttcc

SEQ ID NO: 5123 - DNA, 25 bp, S. cerevisiae
atgtattccgcatgagggctttggt

SEQ ID NO: 5124 - DNA, 25 bp, S. cerevisiae
atgttgaacagctctcaggtggtca

SEQ ID NO: 5125 - DNA, 25 bp, S. cerevisiae
atgttggcacaggttcagcggcgac

SEQ ID NO: 5126 - DNA, 25 bp, S. cerevisiae
atgattaacagcgtttcgcccacaa

SEQ ID NO: 5127 - DNA, 25 bp, S. cerevisiae
atgtttacagcgatgtgtcacccac

SEQ ID NO: 5128 - DNA, 25 bp, S. cerevisiae
atgtttatcttagtatccgttgtaa

SEQ ID NO: 5129 - DNA, 25 bp, S. cerevisiae
atgtttacttcgaagcctgctttca

SEQ ID NO: 5130 - DNA, 25 bp, S. cerevisiae
atgttacaattcttgccaccggatg

SEQ ID NO: 5131 - DNA, 25 bp, S. cerevisiae
atgattccactgattcacacacggt

SEQ ID NO: 5132 - DNA, 25 bp, S. cerevisiae
atgatcccagctccacttgatgctt

SEQ ID NO: 5133 - DNA, 25 bp, S. cerevisiae
atgtagcgcatgcagcttatggctg

SEQ ID NO: 5134 - DNA, 25 bp, S. cerevisiae
agtccagcgttgcacgagcatcaag

SEQ ID NO: 5135 - DNA, 25 bp, S. cerevisiae
atgtgacagcgctctcaatgaataa

SEQ ID NO: 5136 - DNA, 25 bp, S. cerevisiae
atgtaatccttcgagtcaatatcag

SEQ ID NO: 5137 - DNA, 25 bp, S. cerevisiae
atgtacatgccatttcaacctcagc

SEQ ID NO: 5138 - DNA, 25 bp, S. cerevisiae
atgattcattcaacacgaccaccac

SEQ ID NO: 5139 - DNA, 25 bp, S. cerevisiae
atgatctcttcaataggtgctccca

SEQ ID NO: 5140 - DNA, 25 bp, S. cerevisiae
atgttctgctttttgtctctccatt

SEQ ID NO: 5141 - DNA, 25 bp, S. cerevisiae
atgttcctgtgtgtaacgcgttctg

SEQ ID NO: 5142 - DNA, 25 bp, S. cerevisiae
atgttccagggttctacctatctta

SEQ ID NO: 5143 - DNA, 25 bp, S. cerevisiae
atgtagcgcaacctttttacctgat

SEQ ID NO: 5144 - DNA, 25 bp, S. cerevisiae
atgtgcaccaagactttcaccgcag

SEQ ID NO: 5145 - DNA, 25 bp, S. cerevisiae
atgtgccaactgagttcaccacgag

SEQ ID NO: 5146 - DNA, 25 bp, S. cerevisiae
atggccatatggtgttcctacggga

SEQ ID NO: 5147 - DNA, 25 bp, S. cerevisiae
atgggattgtctgttttacgaggaa

SEQ ID NO: 5148 - DNA, 25 bp, S. cerevisiae
atgtcgtccctgttgatttagttga

SEQ ID NO: 5149 - DNA, 25 bp, S. cerevisiae
atgatttgtccgtacttcctatggt

SEQ ID NO: 5150 - DNA, 25 bp, S. cerevisiae
atgttaccctcaagatttccatatg

SEQ ID NO: 5151 - DNA, 25 bp, S. cerevisiae
atgttccccatcagtgaccaacagg

SEQ ID NO: 5152 - DNA, 25 bp, S. cerevisiae
atgattctcccgacatgattaataa

SEQ ID NO: 5153 - DNA, 25 bp, S. cerevisiae
atgttacagatgcatacgggtccat

SEQ ID NO: 5154 - DNA, 25 bp, S. cerevisiae
atgttcaactaatcgatggtccaga

SEQ ID NO: 5155 - DNA, 25 bp, S. cerevisiae
atgtttagcttatcgaactctcaat

SEQ ID NO: 5156 - DNA, 25 bp, S. cerevisiae
atgtctgcccaggtgtagctatgtt

SEQ ID NO: 5157 - DNA, 25 bp, S. cerevisiae
atgttgatccgtgaagctgctgcta

SEQ ID NO: 5158 - DNA, 25 bp, S. cerevisiae
atgtcgacatggatgcaagtcccgc

SEQ ID NO: 5159 - DNA, 25 bp, S. cerevisiae
atgtctgcacattttccatggagcc

SEQ ID NO: 5160 - DNA, 25 bp, S. cerevisiae
atgtagcacattatggctggatccc

SEQ ID NO: 5161 - DNA, 25 bp, S. cerevisiae
atgttaattcagcactcggctcttt

SEQ ID NO: 5162 - DNA, 25 bp, S. cerevisiae
atgttaatatgatacctggcctttc

SEQ ID NO: 5163 - DNA, 25 bp, S. cerevisiae
atgttatattgaccagagcggccaa

SEQ ID NO: 5164 - DNA, 25 bp, S. cerevisiae
atgtctgcattcgatgaagctgttt

SEQ ID NO: 5165 - DNA, 25 bp, S. cerevisiae
atgtcatcaatctcaggctgctgtt

SEQ ID NO: 5166 - DNA, 25 bp, S. cerevisiae
atgattcctttgctgatgacctaga

SEQ ID NO: 5167 - DNA, 25 bp, S. cerevisiae
atgttattcatccaaactgtgaggt

SEQ ID NO: 5168 - DNA, 25 bp, S. cerevisiae
atgattttgctgtacccttaagtta

SEQ ID NO: 5169 - DNA, 25 bp, S. cerevisiae
atgtgtttcgatttccttgacggga

SEQ ID NO: 5170 - DNA, 25 bp, S. cerevisiae
atggccggttcagacattcacgagg

SEQ ID NO: 5171 - DNA, 25 bp, S. cerevisiae
atgttactcacaccagccaagacta

SEQ ID NO: 5172 - DNA, 25 bp, S. cerevisiae
atgtctgctccacaagccaagattt

SEQ ID NO: 5173 - DNA, 25 bp, S. cerevisiae
aggctcccacaagcacaggaagtca

SEQ ID NO: 5174 - DNA, 25 bp, S. cerevisiae
atgtttcaaacaccatctctgcagg

SEQ ID NO: 5175 - DNA, 25 bp, S. cerevisiae
atgtatctcagtgcccagcttatga

SEQ ID NO: 5176 - DNA, 25 bp, S. cerevisiae
atgttccatgtaatctgcggcatca

SEQ ID NO: 5177 - DNA, 25 bp, S. cerevisiae
atgttcaatgtagcattaccatcac

SEQ ID NO: 5178 - DNA, 25 bp, S. cerevisiae
atgtcatcacctacaatcgacttca

SEQ ID NO: 5179 - DNA, 25 bp, S. cerevisiae
atgtagttcaagctctttctcttcc

SEQ ID NO: 5180 - DNA, 25 bp, S. cerevisiae
aggccttccagaacggtttatcgca

SEQ ID NO: 5181 - DNA, 25 bp, S. cerevisiae
atgtgacttcggtacaagttctgta

SEQ ID NO: 5182 - DNA, 25 bp, S. cerevisiae
atggaaccgagccaaagtcacttcg

SEQ ID NO: 5183 - DNA, 25 bp, S. cerevisiae
atgttatcaaggctttgcaatcctt

SEQ ID NO: 5184 - DNA, 25 bp, S. cerevisiae
atgtttagatccgtttgccgcattt

SEQ ID NO: 5185 - DNA, 25 bp, S. cerevisiae
atgtctcgcgaagggttccagattc

SEQ ID NO: 5186 - DNA, 25 bp, S. cerevisiae
atgtccgcgaatggcttgaccatat

SEQ ID NO: 5187 - DNA, 25 bp, S. cerevisiae
atgtcttgctagacccgaagcgatt

SEQ ID NO: 5188 - DNA, 25 bp, S. cerevisiae
atgtgcctaaagcagcctggtgtac

SEQ ID NO: 5189 - DNA, 25 bp, S. cerevisiae
atgtcacagtcttttgcaatggtta

SEQ ID NO: 5190 - DNA, 25 bp, S. cerevisiae
atgtcagcggcttttcttccagaaa

SEQ ID NO: 5191 - DNA, 25 bp, S. cerevisiae
atgtatgctggattctactgtccaa

SEQ ID NO: 5192 - DNA, 25 bp, S. cerevisiae
atgttttcatcaccatcttatcaga

SEQ ID NO: 5193 - DNA, 25 bp, S. cerevisiae
atgtttttcagcgtgccattgagaa

SEQ ID NO: 5194 - DNA, 25 bp, S. cerevisiae
atgttgttctataagcctgtgatga

SEQ ID NO: 5195 - DNA, 25 bp, S. cerevisiae
atgtctataatcctagctctgccac

SEQ ID NO: 5196 - DNA, 25 bp, S. cerevisiae
atgtactgctgctgtttgcgtatta

SEQ ID NO: 5197 - DNA, 25 bp, S. cerevisiae
atgttgattgtccagttcttccaga

SEQ ID NO: 5198 - DNA, 25 bp, S. cerevisiae
atgttcaatgttcttgcttgccgga

SEQ ID NO: 5199 - DNA, 25 bp, S. cerevisiae
atgttctgatccatcctagtacggt

SEQ ID NO: 5200 - DNA, 25 bp, S. cerevisiae
aggacatgagaagccggttgacaat

SEQ ID NO: 5201 - DNA, 25 bp, S. cerevisiae
agtacgagatcagcatccgtggcca

SEQ ID NO: 5202 - DNA, 25 bp, S. cerevisiae
atgtactgggagatgcacctggtgc

SEQ ID NO: 5203 - DNA, 25 bp, S. cerevisiae
atgtcctgctcaagtatgccacggg

SEQ ID NO: 5204 - DNA, 25 bp, S. cerevisiae
atgtctcaccagaaatcctgatggg

SEQ ID NO: 5205 - DNA, 25 bp, S. cerevisiae
atggctagcggttcattgcgtggat

SEQ ID NO: 5206 - DNA, 25 bp, S. cerevisiae
atgttcttcattttttcgttcgcca

SEQ ID NO: 5207 - DNA, 25 bp, S. cerevisiae
atgtccattcacgttcaaaggtcaa

SEQ ID NO: 5208 - DNA, 25 bp, S. cerevisiae
atgtgcctgtgggtccaaaggttcc

SEQ ID NO: 5209 - DNA, 25 bp, S. cerevisiae
atgtgcgttctgctccaaatactta

SEQ ID NO: 5210 - DNA, 25 bp, S. cerevisiae
atgttcggtgcagccatatattctt

SEQ ID NO: 5211 - DNA, 25 bp, S. cerevisiae
atgttcgccagactcgctaatcctg

SEQ ID NO: 5212 - DNA, 25 bp, S. cerevisiae
atgttctttattcttcactgcctag

SEQ ID NO: 5213 - DNA, 25 bp, S. cerevisiae
atgttattttgttttatcgtttctg

SEQ ID NO: 5214 - DNA, 25 bp, S. cerevisiae
atgttttttgactttcttgctgtga

SEQ ID NO: 5215 - DNA, 25 bp, S. cerevisiae
atgtctatggattttgcttgggtgc

SEQ ID NO: 5216 - DNA, 25 bp, S. cerevisiae
atgttagtgaccatgttggcctcgc

SEQ ID NO: 5217 - DNA, 25 bp, S. cerevisiae
atgtaaatactcctgtttcccgaat

SEQ ID NO: 5218 - DNA, 25 bp, S. cerevisiae
atgtctaacacctttgttgcagtcg

SEQ ID NO: 5219 - DNA, 25 bp, S. cerevisiae
atgtcctcaattaatttctccgtgg

SEQ ID NO: 5220 - DNA, 25 bp, S. cerevisiae
atgttgctcgtgttgttgttgctac

SEQ ID NO: 5221 - DNA, 25 bp, S. cerevisiae
atgtcgacaacgtctgggctgatgt

SEQ ID NO: 5222 - DNA, 25 bp, S. cerevisiae
atgtctgaattcttttgggatgtac

SEQ ID NO: 5223 - DNA, 25 bp, S. cerevisiae
atggagcacggtacttccgtttcaa

SEQ ID NO: 5224 - DNA, 25 bp, S. cerevisiae
atggtgatccttctaccgaacttaa

SEQ ID NO: 5225 - DNA, 25 bp, S. cerevisiae
aggcgaattccctctggtacaaaat

SEQ ID NO: 5226 - DNA, 25 bp, S. cerevisiae
atggtcgttcacatcttgggtaaag

SEQ ID NO: 5227 - DNA, 25 bp, S. cerevisiae
atgttcctatccacttgctgcttga

SEQ ID NO: 5228 - DNA, 25 bp, S. cerevisiae
atgtttgtagcagacgagccacaga

SEQ ID NO: 5229 - DNA, 25 bp, S. cerevisiae
atgtccttctgaacctatggcgtat

SEQ ID NO: 5230 - DNA, 25 bp, S. cerevisiae
atgtcacttctaactcaaactcttc

SEQ ID NO: 5231 - DNA, 25 bp, S. cerevisiae
atgtcatctggcacatctacgaacc

SEQ ID NO: 5232 - DNA, 25 bp, S. cerevisiae
atgtctatggagttctacgcaaatc

SEQ ID NO: 5233 - DNA, 25 bp, S. cerevisiae
atgtagaccaatctccaagactgtt

SEQ ID NO: 5234 - DNA, 25 bp, S. cerevisiae
atgggactccatcatacagtgcgtc

SEQ ID NO: 5235 - DNA, 25 bp, S. cerevisiae
atgggagcactcttggacgaagcac

SEQ ID NO: 5236 - DNA, 25 bp, S. cerevisiae
atgggacgccgttgaagatagattc

SEQ ID NO: 5237 - DNA, 25 bp, S. cerevisiae
atggagcacctggacattcgatacc

SEQ ID NO: 5238 - DNA, 25 bp, S. cerevisiae
atgggtctcgaatacgtcaaggcaa

SEQ ID NO: 5239 - DNA, 25 bp, S. cerevisiae
atgggatcactgactaacctgctag

SEQ ID NO: 5240 - DNA, 25 bp, S. cerevisiae
atgtcgtacttctacagctcttcag

SEQ ID NO: 5241 - DNA, 25 bp, S. cerevisiae
atgtttttacagactctccgcctaa

SEQ ID NO: 5242 - DNA, 25 bp, S. cerevisiae
atgtttcattactccaagccctatg

SEQ ID NO: 5243 - DNA, 25 bp, S. cerevisiae
atgttctcccacttcgaagtctcgg

SEQ ID NO: 5244 - DNA, 25 bp, S. cerevisiae
atgtattctttccaatcttcgcaac

SEQ ID NO: 5245 - DNA, 25 bp, S. cerevisiae
atgttcatccgtttccatctcagat

SEQ ID NO: 5246 - DNA, 25 bp, S. cerevisiae
atgtttcatcatcagattcttcatc

SEQ ID NO: 5247 - DNA, 25 bp, S. cerevisiae
atgtctactattccctcagaaatca

SEQ ID NO: 5248 - DNA, 25 bp, S. cerevisiae
atgtcgatgcgtgtgccccaagaaa

SEQ ID NO: 5249 - DNA, 25 bp, S. cerevisiae
atgtcaggttcatggcctccattaa

SEQ ID NO: 5250 - DNA, 25 bp, S. cerevisiae
atggaggttcatcggtctctagtaa

SEQ ID NO: 5251 - DNA, 25 bp, S. cerevisiae
atggccgcttacagagccggtatga

SEQ ID NO: 5252 - DNA, 25 bp, S. cerevisiae
atgtctacatcatccgtacgttttg

SEQ ID NO: 5253 - DNA, 25 bp, S. cerevisiae
atgtctaccgtggtgaacgtctttg

SEQ ID NO: 5254 - DNA, 25 bp, S. cerevisiae
atgtgttgctggctggttccgttac

SEQ ID NO: 5255 - DNA, 25 bp, S. cerevisiae
atgtgtttacgggatccagcgataa

SEQ ID NO: 5256 - DNA, 25 bp, S. cerevisiae
atgtgttatacaggtctccgctatg

SEQ ID NO: 5257 - DNA, 25 bp, S. cerevisiae
atgtgctgaaaagttctcacggatt

SEQ ID NO: 5258 - DNA, 25 bp, S. cerevisiae
atgtctgaattaggtgccaaatatc

SEQ ID NO: 5259 - DNA, 25 bp, S. cerevisiae
atgtatatggtggtgctgttgctct

SEQ ID NO: 5260 - DNA, 25 bp, S. cerevisiae
atgtattgcgatcatcccacagttc

SEQ ID NO: 5261 - DNA, 25 bp, S. cerevisiae
atgtataggagctgcccaaggtgct

SEQ ID NO: 5262 - DNA, 25 bp, S. cerevisiae
atgtatgaggtatgctccgagttca

SEQ ID NO: 5263 - DNA, 25 bp, S. cerevisiae
atgtcaatacttttgcccttgctaa

SEQ ID NO: 5264 - DNA, 25 bp, S. cerevisiae
atgtcgtttactgctccttcagatc

SEQ ID NO: 5265 - DNA, 25 bp, S. cerevisiae
atgtggtcgcaattccaaactttac

SEQ ID NO: 5266 - DNA, 25 bp, S. cerevisiae
ctgtggtagccctaagaacttttgg

SEQ ID NO: 5267 - DNA, 25 bp, S. cerevisiae
atgtactacgcggagccagaattaa

SEQ ID NO: 5268 - DNA, 25 bp, S. cerevisiae
atgtaccacgttgctgcaggtcgaa

SEQ ID NO: 5269 - DNA, 25 bp, S. cerevisiae
atgttatgccgcacttcgaagtcaa

SEQ ID NO: 5270 - DNA, 25 bp, S. cerevisiae
atgtggattcactcctcaatacaaa

SEQ ID NO: 5271 - DNA, 25 bp, S. cerevisiae
atgtgaagatcactctgtcccatac

SEQ ID NO: 5272 - DNA, 25 bp, S. cerevisiae
atgtccacccttttgaagtctgcta

SEQ ID NO: 5273 - DNA, 25 bp, S. cerevisiae
atgtctataccccattccgtatttt

SEQ ID NO: 5274 - DNA, 25 bp, S. cerevisiae
atggttccctagttctcgtgaatta

SEQ ID NO: 5275 - DNA, 25 bp, S. cerevisiae
atgtcctatttaccagatccaatcc

SEQ ID NO: 5276 - DNA, 25 bp, S. cerevisiae
atgtttgtgttgttgtttcttatta

SEQ ID NO: 5277 - DNA, 25 bp, S. cerevisiae
atggcatcttgttttttacctttga

SEQ ID NO: 5278 - DNA, 25 bp, S. cerevisiae
atgtgtttcctttgtgtgcagtatc

SEQ ID NO: 5279 - DNA, 25 bp, S. cerevisiae
atgtctttcatggttgtgggatact

SEQ ID NO: 5280 - DNA, 25 bp, S. cerevisiae
atgtggttctccctttggatacgac

SEQ ID NO: 5281 - DNA, 25 bp, S. cerevisiae
atgtactttagttttcacaccgcac

SEQ ID NO: 5282 - DNA, 25 bp, S. cerevisiae
atgtttgatctgtttctgcttggct

SEQ ID NO: 5283 - DNA, 25 bp, S. cerevisiae
atgtgcacacactcgtttctgggac

SEQ ID NO: 5284 - DNA, 25 bp, S. cerevisiae
atgtgcagcgtcactggtatcttga

SEQ ID NO: 5285 - DNA, 25 bp, S. cerevisiae
atgtgacagtcttagacggccctgt

SEQ ID NO: 5286 - DNA, 25 bp, S. cerevisiae
atgtcatcccataggtatggccctt

SEQ ID NO: 5287 - DNA, 25 bp, S. cerevisiae
atgtactgtcactgagcattccaaa

SEQ ID NO: 5288 - DNA, 25 bp, S. cerevisiae
atgtcatctgctctatacaaacaaa

SEQ ID NO: 5289 - DNA, 25 bp, S. cerevisiae
atgggccacccaatgacaaaatctg

SEQ ID NO: 5290 - DNA, 25 bp, S. cerevisiae
atgtcagccaccagagccaataaag

SEQ ID NO: 5291 - DNA, 25 bp, S. cerevisiae
atgtcactaggcgtactgtacctca

SEQ ID NO: 5292 - DNA, 25 bp, S. cerevisiae
atgggccagttgctcaaacctaaga

SEQ ID NO: 5293 - DNA, 25 bp, S. cerevisiae
atggtcaccccaagagaacctaaga

SEQ ID NO: 5294 - DNA, 25 bp, S. cerevisiae
atgggccaaccaaaggatccgaaat

SEQ ID NO: 5295 - DNA, 25 bp, S. cerevisiae
atgtcaccttctcgaagaggcggca

SEQ ID NO: 5296 - DNA, 25 bp, S. cerevisiae
atgtatcaaacaagaggccctgctg

SEQ ID NO: 5297 - DNA, 25 bp, S. cerevisiae
atgtatcaaacttcaaccccgacgg

SEQ ID NO: 5298 - DNA, 25 bp, S. cerevisiae
atggactgatcgtgaaccccgtcaa

SEQ ID NO: 5299 - DNA, 25 bp, S. cerevisiae
atgggattcgatcttcaaattccaa

SEQ ID NO: 5300 - DNA, 25 bp, S. cerevisiae
atgggttcgcccaggaatccaaaga

SEQ ID NO: 5301 - DNA, 25 bp, S. cerevisiae
agggtgtcgccatttgcagaaccga

SEQ ID NO: 5302 - DNA, 25 bp, S. cerevisiae
aggcttcattcgtttcagaggctgc

SEQ ID NO: 5303 - DNA, 25 bp, S. cerevisiae
aggcccattcgaagttggtgtccac

SEQ ID NO: 5304 - DNA, 25 bp, S. cerevisiae
atgtcccatttgcaaatgagttcca

SEQ ID NO: 5305 - DNA, 25 bp, S. cerevisiae
atgtactctaaattcctgcgttcca

SEQ ID NO: 5306 - DNA, 25 bp, S. cerevisiae
atgtccactaagttgcctattgtga

SEQ ID NO: 5307 - DNA, 25 bp, S. cerevisiae
atgggccaggcagtctggtttgcaa

SEQ ID NO: 5308 - DNA, 25 bp, S. cerevisiae
atggtattttacctgagccctcttt

SEQ ID NO: 5309 - DNA, 25 bp, S. cerevisiae
atggacttttacaaggccctttcag

SEQ ID NO: 5310 - DNA, 25 bp, S. cerevisiae
atggacactattacaaaccccaccg

SEQ ID NO: 5311 - DNA, 25 bp, S. cerevisiae
atgtagatgctcactctggtgtctt

SEQ ID NO: 5312 - DNA, 25 bp, S. cerevisiae
atgtcattatctttctgcggtgttc

SEQ ID NO: 5313 - DNA, 25 bp, S. cerevisiae
atgtatatactacccggtatccctc

SEQ ID NO: 5314 - DNA, 25 bp, S. cerevisiae
atgtagtttctgtgcggtatccacc

SEQ ID NO: 5315 - DNA, 25 bp, S. cerevisiae
atgtcccattccaaagcgcagaaac

SEQ ID NO: 5316 - DNA, 25 bp, S. cerevisiae
atgtcttcttctaaacgtattgcta

SEQ ID NO: 5317 - DNA, 25 bp, S. cerevisiae
atgtctttttcatcactatataaaa

SEQ ID NO: 5318 - DNA, 25 bp, S. cerevisiae
atgtcaattttaaaccgcttacaat

SEQ ID NO: 5319 - DNA, 25 bp, S. cerevisiae
atgtcatttttatatcctttagaga

SEQ ID NO: 5320 - DNA, 25 bp, S. cerevisiae
atgggaccagcgcaaacagtgcttg

SEQ ID NO: 5321 - DNA, 25 bp, S. cerevisiae
atgtgaacacaggaaccacgtctca

SEQ ID NO: 5322 - DNA, 25 bp, S. cerevisiae
atgtggagcctggtaccatttctac

SEQ ID NO: 5323 - DNA, 25 bp, S. cerevisiae
atgtggtgcactggtgttgtttcca

SEQ ID NO: 5324 - DNA, 25 bp, S. cerevisiae
aggcgtttggtttgtgttcccatga

SEQ ID NO: 5325 - DNA, 25 bp, S. cerevisiae
atgtcttttttactttccatccagg

SEQ ID NO: 5326 - DNA, 25 bp, S. cerevisiae
atgtcagtctttaagctcttcgagc

SEQ ID NO: 5327 - DNA, 25 bp, S. cerevisiae
atgtccgctttgaagatctttgcag

SEQ ID NO: 5328 - DNA, 25 bp, S. cerevisiae
atgtctgacttctttatttgtgcaa

SEQ ID NO: 5329 - DNA, 25 bp, S. cerevisiae
atgtctgactctattatttcctttg

SEQ ID NO: 5330 - DNA, 25 bp, S. cerevisiae
atgtgcaggctctacaaaacccaaa

SEQ ID NO: 5331 - DNA, 25 bp, S. cerevisiae
atgtggccacagtatggttcgcact

SEQ ID NO: 5332 - DNA, 25 bp, S. cerevisiae
atgtggccacagtatcgcaccatat

SEQ ID NO: 5333 - DNA, 25 bp, S. cerevisiae
atgtacccgaatccaccatattaga

SEQ ID NO: 5334 - DNA, 25 bp, S. cerevisiae
atgtcctcggatgaattctttgata

SEQ ID NO: 5335 - DNA, 25 bp, S. cerevisiae
atgtcttggcaagcatacactgata

SEQ ID NO: 5336 - DNA, 25 bp, S. cerevisiae
atgtcttctctatcaacgtctgatt

SEQ ID NO: 5337 - DNA, 25 bp, S. cerevisiae
atgtctttgtcttttcactaagcta

SEQ ID NO: 5338 - DNA, 25 bp, S. cerevisiae
atgtctagggattgtattaatgtct

SEQ ID NO: 5339 - DNA, 25 bp, S. cerevisiae
atgtcttacacacgagtagatcatc

SEQ ID NO: 5340 - DNA, 25 bp, S. cerevisiae
atgtctatcccacgcgaagtatcgg

SEQ ID NO: 5341 - DNA, 25 bp, S. cerevisiae
atgtgccttgctagatctttactga

SEQ ID NO: 5342 - DNA, 25 bp, S. cerevisiae
atgtcgcttgcatcatttcgatttg

SEQ ID NO: 5343 - DNA, 25 bp, S. cerevisiae
atgtctttatccgaagctcttctgg

SEQ ID NO: 5344 - DNA, 25 bp, S. cerevisiae
atgtcttcctccaagcgtattgcca

SEQ ID NO: 5345 - DNA, 25 bp, S. cerevisiae
atggtaccactccatttgttgccat

SEQ ID NO: 5346 - DNA, 25 bp, S. cerevisiae
aggtctccaattctatcggttcgga

SEQ ID NO: 5347 - DNA, 25 bp, S. cerevisiae
atgtggccatttttgattacgttgt

SEQ ID NO: 5348 - DNA, 25 bp, S. cerevisiae
atgtggctgcgtttctttgggtttc

SEQ ID NO: 5349 - DNA, 25 bp, S. cerevisiae
atgtcgtgtgtttgtatatgtgtgg

SEQ ID NO: 5350 - DNA, 25 bp, S. cerevisiae
atgtctttgaatcctccaatgccaa

SEQ ID NO: 5351 - DNA, 25 bp, S. cerevisiae
atgtgcctgtcgatgtatgccaaaa

SEQ ID NO: 5352 - DNA, 25 bp, S. cerevisiae
atgtgccgtgggatagtcagatact

SEQ ID NO: 5353 - DNA, 25 bp, S. cerevisiae
atgtcttgatggcaactgtaatcct

SEQ ID NO: 5354 - DNA, 25 bp, S. cerevisiae
atggttcgtgtagctaaaggttcag

SEQ ID NO: 5355 - DNA, 25 bp, S. cerevisiae
atgggttagctccagtcgaagcaga

SEQ ID NO: 5356 - DNA, 25 bp, S. cerevisiae
atgggcttacctttccacaatggaa

SEQ ID NO: 5357 - DNA, 25 bp, S. cerevisiae
atggatttagcccaacaccaaagaa

SEQ ID NO: 5358 - DNA, 25 bp, S. cerevisiae
atggatttaactcaattagcctaga

SEQ ID NO: 5359 - DNA, 25 bp, S. cerevisiae
atgggctttactccaatctatttgg

SEQ ID NO: 5360 - DNA, 25 bp, S. cerevisiae
atgggttccactccagaagctattg

SEQ ID NO: 5361 - DNA, 25 bp, S. cerevisiae
atggatttcccagaacctgttggcc

SEQ ID NO: 5362 - DNA, 25 bp, S. cerevisiae
aggagtctcccatgggcgatttcgg

SEQ ID NO: 5363 - DNA, 25 bp, S. cerevisiae
atgtcagactacgaggaggcgttta

SEQ ID NO: 5364 - DNA, 25 bp, S. cerevisiae
atgtcagaactcaagtgcgtgtttt

SEQ ID NO: 5365 - DNA, 25 bp, S. cerevisiae
atgggagccgtactcagctgttgta

SEQ ID NO: 5366 - DNA, 25 bp, S. cerevisiae
atgggacaggtctggcatgcctata

SEQ ID NO: 5367 - DNA, 25 bp, S. cerevisiae
atgggttctaggacgtactccacat

SEQ ID NO: 5368 - DNA, 25 bp, S. cerevisiae
atgtgttgtttcgataccctccata

SEQ ID NO: 5369 - DNA, 25 bp, S. cerevisiae
atgtgtgtgtgtgcgataccctttt

SEQ ID NO: 5370 - DNA, 25 bp, S. cerevisiae
atgtcgtttgtttccaagcttctct

SEQ ID NO: 5371 - DNA, 25 bp, S. cerevisiae
atgtcttatatggttgccctattcc

SEQ ID NO: 5372 - DNA, 25 bp, S. cerevisiae
atgtcttgaattttgccactcagca

SEQ ID NO: 5373 - DNA, 25 bp, S. cerevisiae
atgtcgtatatttctacactccacc

SEQ ID NO: 5374 - DNA, 25 bp, S. cerevisiae
atgtgtatgctagcatgttctgcat

SEQ ID NO: 5375 - DNA, 25 bp, S. cerevisiae
atggtcactataggtatcgcatgcc

SEQ ID NO: 5376 - DNA, 25 bp, S. cerevisiae
atggctatgctttgcgtgacgtaca

SEQ ID NO: 5377 - DNA, 25 bp, S. cerevisiae
atggctccatctgctaaggctactg

SEQ ID NO: 5378 - DNA, 25 bp, S. cerevisiae
atgtgaccccatttacgtgagagca

SEQ ID NO: 5379 - DNA, 25 bp, S. cerevisiae
atggacagcacatttcaacgtcgaa

SEQ ID NO: 5380 - DNA, 25 bp, S. cerevisiae
atggtcctcttctgcgatgcacgtt

SEQ ID NO: 5381 - DNA, 25 bp, S. cerevisiae
atggtccggcctcagaatgttcact

SEQ ID NO: 5382 - DNA, 25 bp, S. cerevisiae
cattggaccgttgttttactgaagt

SEQ ID NO: 5383 - DNA, 25 bp, S. cerevisiae
atgggatttcgtacacacttgggac

SEQ ID NO: 5384 - DNA, 25 bp, S. cerevisiae
atgggcaattttgaccaatgggcac

SEQ ID NO: 5385 - DNA, 25 bp, S. cerevisiae
atggtactgtttggactaggtagac

SEQ ID NO: 5386 - DNA, 25 bp, S. cerevisiae
atgtgcctggttgctatttttcgaa

SEQ ID NO: 5387 - DNA, 25 bp, S. cerevisiae
atgtcctgatatgtctttttctaga

SEQ ID NO: 5388 - DNA, 25 bp, S. cerevisiae
atgtctgccattgatatctttgtta

SEQ ID NO: 5389 - DNA, 25 bp, S. cerevisiae
atgtgcttctgacaacttgccagta

SEQ ID NO: 5390 - DNA, 25 bp, S. cerevisiae
atgggcgcggtgtagtacgaaacta

SEQ ID NO: 5391 - DNA, 25 bp, S. cerevisiae
atgggcgctgccgacgtgaagaaac

SEQ ID NO: 5392 - DNA, 25 bp, S. cerevisiae
atggatcatcccgacgagcgaaaag

SEQ ID NO: 5393 - DNA, 25 bp, S. cerevisiae
atggttcccaatctcggtattgcaa

SEQ ID NO: 5394 - DNA, 25 bp, S. cerevisiae
atggttcggacccttggaatacaag

SEQ ID NO: 5395 - DNA, 25 bp, S. cerevisiae
atggtgtagcatgccactttggtac

SEQ ID NO: 5396 - DNA, 25 bp, S. cerevisiae
atggtcatatgagccctaaatgtgc

SEQ ID NO: 5397 - DNA, 25 bp, S. cerevisiae
atggatcatatggttcccgtttgac

SEQ ID NO: 5398 - DNA, 25 bp, S. cerevisiae
atgggaatggtagctcgtttaacga

SEQ ID NO: 5399 - DNA, 25 bp, S. cerevisiae
atgggtaatttcagatttcctataa

SEQ ID NO: 5400 - DNA, 25 bp, S. cerevisiae
atggtggtttacactttcacggaga

SEQ ID NO: 5401 - DNA, 25 bp, S. cerevisiae
atgtctttggccaaatccgctgcta

SEQ ID NO: 5402 - DNA, 25 bp, S. cerevisiae
atggcttgtgccagtaagtcctcat

SEQ ID NO: 5403 - DNA, 25 bp, S. cerevisiae
atgggttattggaacgcccactcca

SEQ ID NO: 5404 - DNA, 25 bp, S. cerevisiae
atgggttcagagacaatcctggtaa

SEQ ID NO: 5405 - DNA, 25 bp, S. cerevisiae
atggccagcgaaacaccaagagttg

SEQ ID NO: 5406 - DNA, 25 bp, S. cerevisiae
atggccacagaatctcaggtacttg

SEQ ID NO: 5407 - DNA, 25 bp, S. cerevisiae
atggacccactgcacagtttagttt

SEQ ID NO: 5408 - DNA, 25 bp, S. cerevisiae
atggaccgatctttgcaagtatata

SEQ ID NO: 5409 - DNA, 25 bp, S. cerevisiae
atgtgtcggttacgccataggctac

SEQ ID NO: 5410 - DNA, 25 bp, S. cerevisiae
atgtgtctttagaggctgtcgctac

SEQ ID NO: 5411 - DNA, 25 bp, S. cerevisiae
atggatgtcttaatggagcccgtca

SEQ ID NO: 5412 - DNA, 25 bp, S. cerevisiae
atgtctgttcatatcgccgctaaat

SEQ ID NO: 5413 - DNA, 25 bp, S. cerevisiae
atgggattagagtcgctctgcccca

SEQ ID NO: 5414 - DNA, 25 bp, S. cerevisiae
atgggtgctaagtcctcgcgaagaa

SEQ ID NO: 5415 - DNA, 25 bp, S. cerevisiae
atggagcgccacaaactagcagacg

SEQ ID NO: 5416 - DNA, 25 bp, S. cerevisiae
atggcccgccaagcaaacgtatgaa

SEQ ID NO: 5417 - DNA, 25 bp, S. cerevisiae
atggttcgaagctcactacggtcaa

SEQ ID NO: 5418 - DNA, 25 bp, S. cerevisiae
atgtccttacgtatactagcgaaga

SEQ ID NO: 5419 - DNA, 25 bp, S. cerevisiae
atgtccactgattctattgttaaag

SEQ ID NO: 5420 - DNA, 25 bp, S. cerevisiae
atgtctcacttattacttccaacgc

SEQ ID NO: 5421 - DNA, 25 bp, S. cerevisiae
atgtctgcctttgttactaaagctg

SEQ ID NO: 5422 - DNA, 25 bp, S. cerevisiae
atgtgcctcgtctgtcgtttaatga

SEQ ID NO: 5423 - DNA, 25 bp, S. cerevisiae
aggctcaggctcaagttcagttaaa

SEQ ID NO: 5424 - DNA, 25 bp, S. cerevisiae
atgtgtcatcctaggttatgtctta

SEQ ID NO: 5425 - DNA, 25 bp, S. cerevisiae
atgtgtctccatcagtgtttttgtt

SEQ ID NO: 5426 - DNA, 25 bp, S. cerevisiae
aggctactctagattgggttttgct

SEQ ID NO: 5427 - DNA, 25 bp, S. cerevisiae
atggtggcctgatgtttttctttat

SEQ ID NO: 5428 - DNA, 25 bp, S. cerevisiae
atgggcaacatagcttcacccttat

SEQ ID NO: 5429 - DNA, 25 bp, S. cerevisiae
atgtccatgatcaactacttcaccg

SEQ ID NO: 5430 - DNA, 25 bp, S. cerevisiae
atgtccgtgataacttgcaagctcc

SEQ ID NO: 5431 - DNA, 25 bp, S. cerevisiae
atgtccctgataaatgatgctatgg

SEQ ID NO: 5432 - DNA, 25 bp, S. cerevisiae
atgtgccctcgcacagttttgctca

SEQ ID NO: 5433 - DNA, 25 bp, S. cerevisiae
atggcttgaccatgagcgcagacaa

SEQ ID NO: 5434 - DNA, 25 bp, S. cerevisiae
atggatgtgcatcgcaaagggaaaa

SEQ ID NO: 5435 - DNA, 25 bp, S. cerevisiae
atggtcatactttcgttccacagta

SEQ ID NO: 5436 - DNA, 25 bp, S. cerevisiae
atgtcgatgtggctagctgttttcc

SEQ ID NO: 5437 - DNA, 25 bp, S. cerevisiae
atgtgcctgatgtagttcttgtgaa

SEQ ID NO: 5438 - DNA, 25 bp, S. cerevisiae
atgtgctgatggtgtgctattctgt

SEQ ID NO: 5439 - DNA, 25 bp, S. cerevisiae
atggtgcatcatccacatctgttaa

SEQ ID NO: 5440 - DNA, 25 bp, S. cerevisiae
atggatgattctcccgttaacgaag

SEQ ID NO: 5441 - DNA, 25 bp, S. cerevisiae
atgggatttcgctgtaatactgacg

SEQ ID NO: 5442 - DNA, 25 bp, S. cerevisiae
atgggaggtccatcggcatcaccaa

SEQ ID NO: 5443 - DNA, 25 bp, S. cerevisiae
atgggtggtcactacaggtgcctca

SEQ ID NO: 5444 - DNA, 25 bp, S. cerevisiae
atgggcggctacgtatttgcgatct

SEQ ID NO: 5445 - DNA, 25 bp, S. cerevisiae
atggtgcggctttcgtatctgcgtc

SEQ ID NO: 5446 - DNA, 25 bp, S. cerevisiae
atgggaccaatgacggcaggacaat

SEQ ID NO: 5447 - DNA, 25 bp, S. cerevisiae
atggcagacaatacgcgcctggaaa

SEQ ID NO: 5448 - DNA, 25 bp, S. cerevisiae
atgtgtacaggtgccatcatcatgt

SEQ ID NO: 5449 - DNA, 25 bp, S. cerevisiae
atggtgcaatgagcgatgatggatc

SEQ ID NO: 5450 - DNA, 25 bp, S. cerevisiae
atggctgcaggaccaatttgatcgt

SEQ ID NO: 5451 - DNA, 25 bp, S. cerevisiae
aggccagccactttttaaaggcgat

SEQ ID NO: 5452 - DNA, 25 bp, S. cerevisiae
agggtgctacattgtttaaaacgag

SEQ ID NO: 5453 - DNA, 25 bp, S. cerevisiae
aggccattagctactttcaaaacgg

SEQ ID NO: 5454 - DNA, 25 bp, S. cerevisiae
atgggcagctggactttatgaaaac

SEQ ID NO: 5455 - DNA, 25 bp, S. cerevisiae
atgggcatcaatggcctaatgacaa

SEQ ID NO: 5456 - DNA, 25 bp, S. cerevisiae
atgtgctcagcaggcggtatcagaa

SEQ ID NO: 5457 - DNA, 25 bp, S. cerevisiae
atggtccacgcaggtcacagaagtt

SEQ ID NO: 5458 - DNA, 25 bp, S. cerevisiae
atggtccacgaagcattaaatcttt

SEQ ID NO: 5459 - DNA, 25 bp, S. cerevisiae
atggtcgcacggttttcaatgcttc

SEQ ID NO: 5460 - DNA, 25 bp, S. cerevisiae
atgggctttacatatctttggcaaa

SEQ ID NO: 5461 - DNA, 25 bp, S. cerevisiae
atggtggcgccattagacacttgat

SEQ ID NO: 5462 - DNA, 25 bp, S. cerevisiae
atggtggcaaactattcaatggatt

SEQ ID NO: 5463 - DNA, 25 bp, S. cerevisiae
atggtggccaactttctcaaatgca

SEQ ID NO: 5464 - DNA, 25 bp, S. cerevisiae
atggtcaacaacgttgtccactctt

SEQ ID NO: 5465 - DNA, 25 bp, S. cerevisiae
atggtaacgaagtttctgccgccta

SEQ ID NO: 5466 - DNA, 25 bp, S. cerevisiae
atggtaagccaaactctaccacctc

SEQ ID NO: 5467 - DNA, 25 bp, S. cerevisiae
atgtggaagatctctggttcccaga

SEQ ID NO: 5468 - DNA, 25 bp, S. cerevisiae
atgtccaacatctggtttctcaagt

SEQ ID NO: 5469 - DNA, 25 bp, S. cerevisiae
atgtccctggaatgtacactgtcgc

SEQ ID NO: 5470 - DNA, 25 bp, S. cerevisiae
atgtccctccgtagatgaactgtac

SEQ ID NO: 5471 - DNA, 25 bp, S. cerevisiae
atggtgtcctggattgcggctattc

SEQ ID NO: 5472 - DNA, 25 bp, S. cerevisiae
atggttctactgacgtgggctacta

SEQ ID NO: 5473 - DNA, 25 bp, S. cerevisiae
atggtttacgttttggattctatga

SEQ ID NO: 5474 - DNA, 25 bp, S. cerevisiae
atgggcttagctcatagggatttaa

SEQ ID NO: 5475 - DNA, 25 bp, S. cerevisiae
atggagttgcgccaaggtgtaccaa

SEQ ID NO: 5476 - DNA, 25 bp, S. cerevisiae
atgtggtggagctgtggcactctac

SEQ ID NO: 5477 - DNA, 25 bp, S. cerevisiae
atgtgactaactctgctgactcaac

SEQ ID NO: 5478 - DNA, 25 bp, S. cerevisiae
atgtgtaaactcatgtggtgcactg

SEQ ID NO: 5479 - DNA, 25 bp, S. cerevisiae
atgtgcgaatactctgttgctgaaa

SEQ ID NO: 5480 - DNA, 25 bp, S. cerevisiae
atggtagtacatctctctggaatag

SEQ ID NO: 5481 - DNA, 25 bp, S. cerevisiae
aggctttatcatcccaaggtcatag

SEQ ID NO: 5482 - DNA, 25 bp, S. cerevisiae
atggattgattgttgccacgcctac

SEQ ID NO: 5483 - DNA, 25 bp, S. cerevisiae
atggagatcaagtcccaactctatt

SEQ ID NO: 5484 - DNA, 25 bp, S. cerevisiae
atgtggtgtcacagagtcatccctg

SEQ ID NO: 5485 - DNA, 25 bp, S. cerevisiae
atgtggtccttattctatgttctta

SEQ ID NO: 5486 - DNA, 25 bp, S. cerevisiae
atggtctccttgtccattttcaata

SEQ ID NO: 5487 - DNA, 25 bp, S. cerevisiae
atgtggccgttctaccttgaataaa

SEQ ID NO: 5488 - DNA, 25 bp, S. cerevisiae
atgggaatggccaaccttgcataaa

SEQ ID NO: 5489 - DNA, 25 bp, S. cerevisiae
atggtattctactagcagttcctaa

SEQ ID NO: 5490 - DNA, 25 bp, S. cerevisiae
atgtgtattctacgatgcggtgccc

SEQ ID NO: 5491 - DNA, 25 bp, S. cerevisiae
atgtggtgactccattctcaatgct

SEQ ID NO: 5492 - DNA, 25 bp, S. cerevisiae
atgtgttgagcacctcattccagta

SEQ ID NO: 5493 - DNA, 25 bp, S. cerevisiae
atgtgtcttatcaatcataccgccc

SEQ ID NO: 5494 - DNA, 25 bp, S. cerevisiae
atggttttgcattgattccgcccta

SEQ ID NO: 5495 - DNA, 25 bp, S. cerevisiae
atggttcttctgatattccccgaag

SEQ ID NO: 5496 - DNA, 25 bp, S. cerevisiae
atgtgttcttctttgttccagagac

SEQ ID NO: 5497 - DNA, 25 bp, S. cerevisiae
atggttcttcgatgcttctaagcca

SEQ ID NO: 5498 - DNA, 25 bp, S. cerevisiae
atggtgcagtccctatctttagaaa

SEQ ID NO: 5499 - DNA, 25 bp, S. cerevisiae
atgtgaccgtttcctcagtcgaaag

SEQ ID NO: 5500 - DNA, 25 bp, S. cerevisiae
atggaactgttaccacagggacaaa

SEQ ID NO: 5501 - DNA, 25 bp, S. cerevisiae
atgggtgctgtcttcagagctgata

SEQ ID NO: 5502 - DNA, 25 bp, S. cerevisiae
atgtgccggcatttcgacgaattgt

SEQ ID NO: 5503 - DNA, 25 bp, S. cerevisiae
aggcagatgctccaattgacaagtc

SEQ ID NO: 5504 - DNA, 25 bp, S. cerevisiae
atggtgcagctggattgtgatgtct

SEQ ID NO: 5505 - DNA, 25 bp, S. cerevisiae
atgtggttgctcgatggatttcctc

SEQ ID NO: 5506 - DNA, 25 bp, S. cerevisiae
atgtggtagacctcagctattctct

SEQ ID NO: 5507 - DNA, 25 bp, S. cerevisiae
atggaagccatcttccgcatccgaa

SEQ ID NO: 5508 - DNA, 25 bp, S. cerevisiae
atgtgtgtattggatgtgccactct

SEQ ID NO: 5509 - DNA, 25 bp, S. cerevisiae
atggtttatccagtctacttgtgca

SEQ ID NO: 5510 - DNA, 25 bp, S. cerevisiae
atgtgtttgcatcagtccttgtgtc

SEQ ID NO: 5511 - DNA, 25 bp, S. cerevisiae
agtcagggctaactcctcgtgttaa

SEQ ID NO: 5512 - DNA, 25 bp, S. cerevisiae
atggcaatttaccacagccggtttt

SEQ ID NO: 5513 - DNA, 25 bp, S. cerevisiae
atgggagttatttggcctttgtgca

SEQ ID NO: 5514 - DNA, 25 bp, S. cerevisiae
atgggaattattcggcctttgtgcg

SEQ ID NO: 5515 - DNA, 25 bp, S. cerevisiae
atgggaatccataccgcccaagttt

SEQ ID NO: 5516 - DNA, 25 bp, S. cerevisiae
atgggacccttgacacaacttgttt

SEQ ID NO: 5517 - DNA, 25 bp, S. cerevisiae
atgggaatcgttctgcaagctcttc

SEQ ID NO: 5518 - DNA, 25 bp, S. cerevisiae
atggagtacaataccgcgcaatcgc

SEQ ID NO: 5519 - DNA, 25 bp, S. cerevisiae
atggtgtacttacgcactggatcga

SEQ ID NO: 5520 - DNA, 25 bp, S. cerevisiae
atgggtcactatatccggtgcatgc

SEQ ID NO: 5521 - DNA, 25 bp, S. cerevisiae
atgggtacatgatgcccgttcacaa

SEQ ID NO: 5522 - DNA, 25 bp, S. cerevisiae
atggttccaaaccttgtgctcgcaa

SEQ ID NO: 5523 - DNA, 25 bp, S. cerevisiae
atgggtgtcggctttaggccacatc

SEQ ID NO: 5524 - DNA, 25 bp, S. cerevisiae
atgtgacaaccttttgacaagtgta

SEQ ID NO: 5525 - DNA, 25 bp, S. cerevisiae
atggtacgcttatactacatgtgtc

SEQ ID NO: 5526 - DNA, 25 bp, S. cerevisiae
atggtacgccgtattattttcccag

SEQ ID NO: 5527 - DNA, 25 bp, S. cerevisiae
agtggccaatgtcgagttaacccct

SEQ ID NO: 5528 - DNA, 25 bp, S. cerevisiae
aggcctacttgccagttaacgaatc

SEQ ID NO: 5529 - DNA, 25 bp, S. cerevisiae
atgggtgcgtctgttcattgtgcaa

SEQ ID NO: 5530 - DNA, 25 bp, S. cerevisiae
atggatctcttctgcatttacggga

SEQ ID NO: 5531 - DNA, 25 bp, S. cerevisiae
atgggatcttctgcaatctgggtcg

SEQ ID NO: 5532 - DNA, 25 bp, S. cerevisiae
atgggttcttccaagtggtgcctaa

SEQ ID NO: 5533 - DNA, 25 bp, S. cerevisiae
atggttgttttcatgtggtcctccc

SEQ ID NO: 5534 - DNA, 25 bp, S. cerevisiae
atggctttcccagctttacatagac

SEQ ID NO: 5535 - DNA, 25 bp, S. cerevisiae
atggctttgccatgtttaaccgtcc

SEQ ID NO: 5536 - DNA, 25 bp, S. cerevisiae
atggcagtatcctcttacttaatgg

SEQ ID NO: 5537 - DNA, 25 bp, S. cerevisiae
atggagtctcgtggctttatttttg

SEQ ID NO: 5538 - DNA, 25 bp, S. cerevisiae
atggttacgttcaactgtgaggtgt

SEQ ID NO: 5539 - DNA, 25 bp, S. cerevisiae
aggtctgaatattgctacgggtgtt

SEQ ID NO: 5540 - DNA, 25 bp, S. cerevisiae
atggttgttctgttacggatgcttg

SEQ ID NO: 5541 - DNA, 25 bp, S. cerevisiae
aggccctagtggcatctggcgttaa

SEQ ID NO: 5542 - DNA, 25 bp, S. cerevisiae
atggtcattacgtatgcatttgcag

SEQ ID NO: 5543 - DNA, 25 bp, S. cerevisiae
atgggctgtagggtgcattcttgca

SEQ ID NO: 5544 - DNA, 25 bp, S. cerevisiae
atgggcttctgggtgatagattcaa

SEQ ID NO: 5545 - DNA, 25 bp, S. cerevisiae
atgggcaagcgggtgttgatatcaa

SEQ ID NO: 5546 - DNA, 25 bp, S. cerevisiae
atgtggacgctagtgcacgcttcaa

SEQ ID NO: 5547 - DNA, 25 bp, S. cerevisiae
atgggcaactttacggatgactcta

SEQ ID NO: 5548 - DNA, 25 bp, S. cerevisiae
atggacttgcccgttgatcggacca

SEQ ID NO: 5549 - DNA, 25 bp, S. cerevisiae
aggccacagagttccaacatttcag

SEQ ID NO: 5550 - DNA, 25 bp, S. cerevisiae
aggccacggctgtcgaaacactgat

SEQ ID NO: 5551 - DNA, 25 bp, S. cerevisiae
aggccacatcgtgcaataactatga

SEQ ID NO: 5552 - DNA, 25 bp, S. cerevisiae
aggcgcaactctgtattgccggcaa

SEQ ID NO: 5553 - DNA, 25 bp, S. cerevisiae
atggacaacacggatatctccccaa

SEQ ID NO: 5554 - DNA, 25 bp, S. cerevisiae
atggacttaccattttcaccagaag

SEQ ID NO: 5555 - DNA, 25 bp, S. cerevisiae
atgggcctcccagatgaacaacata

SEQ ID NO: 5556 - DNA, 25 bp, S. cerevisiae
atggccgcaactaaagaagcaaagc

SEQ ID NO: 5557 - DNA, 25 bp, S. cerevisiae
atgggagccttccagtgaactgagc

SEQ ID NO: 5558 - DNA, 25 bp, S. cerevisiae
atggtgacctggcacagaactggca

SEQ ID NO: 5559 - DNA, 25 bp, S. cerevisiae
atgggatctcccttcaatacatgga

SEQ ID NO: 5560 - DNA, 25 bp, S. cerevisiae
atgggacatgctcaacagtaccgat

SEQ ID NO: 5561 - DNA, 25 bp, S. cerevisiae
aggccactgcatgaaggtacttata

SEQ ID NO: 5562 - DNA, 25 bp, S. cerevisiae
atggcgtcgagggaagtactccaaa

SEQ ID NO: 5563 - DNA, 25 bp, S. cerevisiae
aggctgaaggtccaaccgttgaaga

SEQ ID NO: 5564 - DNA, 25 bp, S. cerevisiae
atggctaaggagtacccgcatttta

SEQ ID NO: 5565 - DNA, 25 bp, S. cerevisiae
atggtatttcagtacccctgtatct

SEQ ID NO: 5566 - DNA, 25 bp, S. cerevisiae
aggcatggttgcaaaccctgtttcc

SEQ ID NO: 5567 - DNA, 25 bp, S. cerevisiae
atggatccatatcaacacggttgct

SEQ ID NO: 5568 - DNA, 25 bp, S. cerevisiae
atggcagccagtgaccctcgtagag

SEQ ID NO: 5569 - DNA, 25 bp, S. cerevisiae
atgggctcattggaactgttgttaa

SEQ ID NO: 5570 - DNA, 25 bp, S. cerevisiae
atgggccactcaagcgatgatcgtt

SEQ ID NO: 5571 - DNA, 25 bp, S. cerevisiae
atggcgccaccattagtatttctgc

SEQ ID NO: 5572 - DNA, 25 bp, S. cerevisiae
atgggcaccacatctatttcttggg

SEQ ID NO: 5573 - DNA, 25 bp, S. cerevisiae
atggagatactttccctgacgaaaa

SEQ ID NO: 5574 - DNA, 25 bp, S. cerevisiae
atgggacatttcatgctgcagagga

SEQ ID NO: 5575 - DNA, 25 bp, S. cerevisiae
atggatctacttctgtttctcgttc

SEQ ID NO: 5576 - DNA, 25 bp, S. cerevisiae
atgggcattactctgttgcttacct

SEQ ID NO: 5577 - DNA, 25 bp, S. cerevisiae
atgggttatgtaatcctcctacgct

SEQ ID NO: 5578 - DNA, 25 bp, S. cerevisiae
atgggtcccactttgttgcgcagta

SEQ ID NO: 5579 - DNA, 25 bp, S. cerevisiae
atggagtcttccaaggtatccgata

SEQ ID NO: 5580 - DNA, 25 bp, S. cerevisiae
atggaattgcttcactggccaacaa

SEQ ID NO: 5581 - DNA, 25 bp, S. cerevisiae
atggaacatttcttccccaacaaga

SEQ ID NO: 5582 - DNA, 25 bp, S. cerevisiae
atggagatattgagcctcccctaca

SEQ ID NO: 5583 - DNA, 25 bp, S. cerevisiae
atgggcacttgatgacattcctgta

SEQ ID NO: 5584 - DNA, 25 bp, S. cerevisiae
atgggcagttcaaacatgattcgta

SEQ ID NO: 5585 - DNA, 25 bp, S. cerevisiae
atggtgcacactcaaatgatttttt

SEQ ID NO: 5586 - DNA, 25 bp, S. cerevisiae
atgggcacacatggatacaacttta

SEQ ID NO: 5587 - DNA, 25 bp, S. cerevisiae
atggcgcccaattgtcactttactt

SEQ ID NO: 5588 - DNA, 25 bp, S. cerevisiae
atggaaatgcgattgatgccttgtc

SEQ ID NO: 5589 - DNA, 25 bp, S. cerevisiae
atggctagtgtattgcacctaccgg

SEQ ID NO: 5590 - DNA, 25 bp, S. cerevisiae
atggtggtgctaatcacctggccga

SEQ ID NO: 5591 - DNA, 25 bp, S. cerevisiae
aggccatctccaaagacctttacga

SEQ ID NO: 5592 - DNA, 25 bp, S. cerevisiae
atggatattcctcgagagcacatat

SEQ ID NO: 5593 - DNA, 25 bp, S. cerevisiae
atggctccatcgcagagagcagtag

SEQ ID NO: 5594 - DNA, 25 bp, S. cerevisiae
atggatcccaaaatggcaatagcga

SEQ ID NO: 5595 - DNA, 25 bp, S. cerevisiae
atggccccatttaaacaatgcgttg

SEQ ID NO: 5596 - DNA, 25 bp, S. cerevisiae
atggcctcctctaataacgcgttag

SEQ ID NO: 5597 - DNA, 25 bp, S. cerevisiae
atggaccctttaaacagctctcaaa

SEQ ID NO: 5598 - DNA, 25 bp, S. cerevisiae
agggcgttgatgctagttttgactc

SEQ ID NO: 5599 - DNA, 25 bp, S. cerevisiae
aggcgcggaaattatccttgatttt

SEQ ID NO: 5600 - DNA, 25 bp, S. cerevisiae
atggtccgacgatgaacctgaagtc

SEQ ID NO: 5601 - DNA, 25 bp, S. cerevisiae
atggtcctggaaagcaaactgaatc

SEQ ID NO: 5602 - DNA, 25 bp, S. cerevisiae
atggattgtgggatctcaccgcgac

SEQ ID NO: 5603 - DNA, 25 bp, S. cerevisiae
atggcattgggtgcatcgaccttac

SEQ ID NO: 5604 - DNA, 25 bp, S. cerevisiae
atggattgggtaacagctcctcctc

SEQ ID NO: 5605 - DNA, 25 bp, S. cerevisiae
atggatgtggccaatgtgcactcct

SEQ ID NO: 5606 - DNA, 25 bp, S. cerevisiae
atggtgtcaacacttgagttcaaaa

SEQ ID NO: 5607 - DNA, 25 bp, S. cerevisiae
atgggtctatcatctatctttggcg

SEQ ID NO: 5608 - DNA, 25 bp, S. cerevisiae
atgggtcaaaagctcagttaatcga

SEQ ID NO: 5609 - DNA, 25 bp, S. cerevisiae
atgggtgctgcatacaaagtatttg

SEQ ID NO: 5610 - DNA, 25 bp, S. cerevisiae
atggtggctgcatctacaaaattcc

SEQ ID NO: 5611 - DNA, 25 bp, S. cerevisiae
atggtagctgcatcaacatggttca

SEQ ID NO: 5612 - DNA, 25 bp, S. cerevisiae
atgggtgatgttgctctagccacaa

SEQ ID NO: 5613 - DNA, 25 bp, S. cerevisiae
atggcgttgtgtgttgctgcccaaa

SEQ ID NO: 5614 - DNA, 25 bp, S. cerevisiae
atggtgttgtgacgtgtgcttccaa

SEQ ID NO: 5615 - DNA, 25 bp, S. cerevisiae
aggcattccaggtcttcgacaagga

SEQ ID NO: 5616 - DNA, 25 bp, S. cerevisiae
atggcaccggccgactaataagttg

SEQ ID NO: 5617 - DNA, 25 bp, S. cerevisiae
atggactcatgtcacctgaaaggat

SEQ ID NO: 5618 - DNA, 25 bp, S. cerevisiae
atggtttggctccagaaatcccaga

SEQ ID NO: 5619 - DNA, 25 bp, S. cerevisiae
atggtttccatctggatatcctcaa

SEQ ID NO: 5620 - DNA, 25 bp, S. cerevisiae
atggtatgtagcaagggtctctcaa

SEQ ID NO: 5621 - DNA, 25 bp, S. cerevisiae
atggtttagactatcctccagttaa

SEQ ID NO: 5622 - DNA, 25 bp, S. cerevisiae
atggtgtactacttcgtcatttgcg

SEQ ID NO: 5623 - DNA, 25 bp, S. cerevisiae
atggattattccttagtcattggta

SEQ ID NO: 5624 - DNA, 25 bp, S. cerevisiae
atggagtactccttactacttttat

SEQ ID NO: 5625 - DNA, 25 bp, S. cerevisiae
atggcaaactcgatgcgtggcatgt

SEQ ID NO: 5626 - DNA, 25 bp, S. cerevisiae
atggcagtacccatgttcatgcgaa

SEQ ID NO: 5627 - DNA, 25 bp, S. cerevisiae
atggcaatccctgttctacgaacat

SEQ ID NO: 5628 - DNA, 25 bp, S. cerevisiae
atgggtctctgccatcttttgagat

SEQ ID NO: 5629 - DNA, 25 bp, S. cerevisiae
atgggttttgtcatcttgccttttc

SEQ ID NO: 5630 - DNA, 25 bp, S. cerevisiae
atggtggaactcgatactcttttga

SEQ ID NO: 5631 - DNA, 25 bp, S. cerevisiae
atggtggtatgtccaatccgtttca

SEQ ID NO: 5632 - DNA, 25 bp, S. cerevisiae
atggtttcatgccttgatcactgcc

SEQ ID NO: 5633 - DNA, 25 bp, S. cerevisiae
atggtcacacattgagtcatcgtat

SEQ ID NO: 5634 - DNA, 25 bp, S. cerevisiae
atggtcgcagattgtatgctcgcta

SEQ ID NO: 5635 - DNA, 25 bp, S. cerevisiae
atggtccgctttatcgctatgatga

SEQ ID NO: 5636 - DNA, 25 bp, S. cerevisiae
atggtcgcctttatatgatctgata

SEQ ID NO: 5637 - DNA, 25 bp, S. cerevisiae
atggtcacgagttaatcatacctga

SEQ ID NO: 5638 - DNA, 25 bp, S. cerevisiae
atggtccaatgtccctgataaatga

SEQ ID NO: 5639 - DNA, 25 bp, S. cerevisiae
atggtgattatctgctatatacgac

SEQ ID NO: 5640 - DNA, 25 bp, S. cerevisiae
atggtccatctgcaggtgtcactat

SEQ ID NO: 5641 - DNA, 25 bp, S. cerevisiae
atggtaccatttcgaccacaacgac

SEQ ID NO: 5642 - DNA, 25 bp, S. cerevisiae
aggcgcggttcactatttttcctag

SEQ ID NO: 5643 - DNA, 25 bp, S. cerevisiae
atggtgccgtccatctttctactta

SEQ ID NO: 5644 - DNA, 25 bp, S. cerevisiae
atggtgacgcatcctttaacatgac

SEQ ID NO: 5645 - DNA, 25 bp, S. cerevisiae
atggaaacacgcttctcgatcagaa

SEQ ID NO: 5646 - DNA, 25 bp, S. cerevisiae
atggtaccacgctatttctcagaag

SEQ ID NO: 5647 - DNA, 25 bp, S. cerevisiae
atggtaccacagaatccttcgatga

SEQ ID NO: 5648 - DNA, 25 bp, S. cerevisiae
atggcgatcgcattgacccttcaat

SEQ ID NO: 5649 - DNA, 25 bp, S. cerevisiae
atggcgctggcactactggaaatga

SEQ ID NO: 5650 - DNA, 25 bp, S. cerevisiae
atggtccccatcctgagaatattga

SEQ ID NO: 5651 - DNA, 25 bp, S. cerevisiae
atggctcacggctatggtaggttta

SEQ ID NO: 5652 - DNA, 25 bp, S. cerevisiae
atggtagggaactttgcgcttctgc

SEQ ID NO: 5653 - DNA, 25 bp, S. cerevisiae
atggctgagtccaacttatcgtcct

SEQ ID NO: 5654 - DNA, 25 bp, S. cerevisiae
aggcgagtctgccatcctagatgat

SEQ ID NO: 5655 - DNA, 25 bp, S. cerevisiae
atggtcatttgcgtcttctggatat

SEQ ID NO: 5656 - DNA, 25 bp, S. cerevisiae
atggtgctattcatgccgtggattc

SEQ ID NO: 5657 - DNA, 25 bp, S. cerevisiae
atggatgaggactgcagcctttccc

SEQ ID NO: 5658 - DNA, 25 bp, S. cerevisiae
atggctatttaatggcttgcacctg

SEQ ID NO: 5659 - DNA, 25 bp, S. cerevisiae
atggcttttacatcattgggctatg

SEQ ID NO: 5660 - DNA, 25 bp, S. cerevisiae
atggcttggcggtagtatacttaca

SEQ ID NO: 5661 - DNA, 25 bp, S. cerevisiae
atggttgtgcggtggtgtcctactc

SEQ ID NO: 5662 - DNA, 25 bp, S. cerevisiae
atggttatcctgtggcggacattac

SEQ ID NO: 5663 - DNA, 25 bp, S. cerevisiae
atggatttcttacacggactcttgc

SEQ ID NO: 5664 - DNA, 25 bp, S. cerevisiae
atggaaggcaaacgaccgtcctgag

SEQ ID NO: 5665 - DNA, 25 bp, S. cerevisiae
atggacaacaaacaacagctctctt

SEQ ID NO: 5666 - DNA, 25 bp, S. cerevisiae
atggacaaagcacgcgaacacattt

SEQ ID NO: 5667 - DNA, 25 bp, S. cerevisiae
atggcacaaaagcaaacctgttaag

SEQ ID NO: 5668 - DNA, 25 bp, S. cerevisiae
atggcactatagcacgtcccttgtt

SEQ ID NO: 5669 - DNA, 25 bp, S. cerevisiae
atggacatgctagatccttcctttc

SEQ ID NO: 5670 - DNA, 25 bp, S. cerevisiae
atggctattgttacgtcattaggac

SEQ ID NO: 5671 - DNA, 25 bp, S. cerevisiae
atggtactgttgaagattctgaatc

SEQ ID NO: 5672 - DNA, 25 bp, S. cerevisiae
aggctccctagttctgcgaaacagg

SEQ ID NO: 5673 - DNA, 25 bp, S. cerevisiae
aggcgacctgatgggctcaaacgtt

SEQ ID NO: 5674 - DNA, 25 bp, S. cerevisiae
aggaacctgaccctaacactgttgt

SEQ ID NO: 5675 - DNA, 25 bp, S. cerevisiae
agagcaacctactccaacggacttt

SEQ ID NO: 5676 - DNA, 25 bp, S. cerevisiae
atggccccatactccataagacaaa

SEQ ID NO: 5677 - DNA, 25 bp, S. cerevisiae
aggcagccctccacgaaacaattga

SEQ ID NO: 5678 - DNA, 25 bp, S. cerevisiae
aggcgtcctcgctcgagaaatggga

SEQ ID NO: 5679 - DNA, 25 bp, S. cerevisiae
aggcgttccgttaagaccataatga

SEQ ID NO: 5680 - DNA, 25 bp, S. cerevisiae
agacgctttcgttaaaacagacaat

SEQ ID NO: 5681 - DNA, 25 bp, S. cerevisiae
agaccttacctatgtgcaatcgcaa

SEQ ID NO: 5682 - DNA, 25 bp, S. cerevisiae
atggtcctttcatctgtagtggcca

SEQ ID NO: 5683 - DNA, 25 bp, S. cerevisiae
atggtcctttcttctgtcgttgcaa

SEQ ID NO: 5684 - DNA, 25 bp, S. cerevisiae
atggtcgtcttctttgccgctagaa

SEQ ID NO: 5685 - DNA, 25 bp, S. cerevisiae
atggtacttcatctatctcttcgaa

SEQ ID NO: 5686 - DNA, 25 bp, S. cerevisiae
atggacgcttcactgtacctaacaa

SEQ ID NO: 5687 - DNA, 25 bp, S. cerevisiae
atggcacagcaatggctatcccaag

SEQ ID NO: 5688 - DNA, 25 bp, S. cerevisiae
aggacgaaagtcgaccctctattgt

SEQ ID NO: 5689 - DNA, 25 bp, S. cerevisiae
aggatcctaactcagccgcttttga

SEQ ID NO: 5690 - DNA, 25 bp, S. cerevisiae
atggtagtaagttggccgtattgtc

SEQ ID NO: 5691 - DNA, 25 bp, S. cerevisiae
aggtaggaatactgccgtcttcttc

SEQ ID NO: 5692 - DNA, 25 bp, S. cerevisiae
aggtaaacctcattacgtccagcgt

SEQ ID NO: 5693 - DNA, 25 bp, S. cerevisiae
aggccaaacaactcatgatttccga

SEQ ID NO: 5694 - DNA, 25 bp, S. cerevisiae
aggccaaaatttctcaggtcgatga

SEQ ID NO: 5695 - DNA, 25 bp, S. cerevisiae
atggcctacaagatcccagttcgga

SEQ ID NO: 5696 - DNA, 25 bp, S. cerevisiae
atggctccaaaagctccagttgcta

SEQ ID NO: 5697 - DNA, 25 bp, S. cerevisiae
atggattctaagaccccagtcacct

SEQ ID NO: 5698 - DNA, 25 bp, S. cerevisiae
atggatgttgacttttctcctacgg

SEQ ID NO: 5699 - DNA, 25 bp, S. cerevisiae
atggatttaactcatgtcctaagat

SEQ ID NO: 5700 - DNA, 25 bp, S. cerevisiae
atggctccatcttgacgtacgaaac

SEQ ID NO: 5701 - DNA, 25 bp, S. cerevisiae
atggtctagtgattgtggcctttcc

SEQ ID NO: 5702 - DNA, 25 bp, S. cerevisiae
atggtatgattgttgtgccctgttc

SEQ ID NO: 5703 - DNA, 25 bp, S. cerevisiae
atggagacatggatagcgctgctga

SEQ ID NO: 5704 - DNA, 25 bp, S. cerevisiae
atggcagacatgcttctcgtgagaa

SEQ ID NO: 5705 - DNA, 25 bp, S. cerevisiae
atggaagctgctctcacgatggata

SEQ ID NO: 5706 - DNA, 25 bp, S. cerevisiae
atggataggctgaccgctgaacaaa

SEQ ID NO: 5707 - DNA, 25 bp, S. cerevisiae
atggattacgatagctctgatacaa

SEQ ID NO: 5708 - DNA, 25 bp, S. cerevisiae
atggacgctatgtcggctgccacaa

SEQ ID NO: 5709 - DNA, 25 bp, S. cerevisiae
atggcacacttgaggcatccacatt

SEQ ID NO: 5710 - DNA, 25 bp, S. cerevisiae
aggcaacatattcgagaccgctatt

SEQ ID NO: 5711 - DNA, 25 bp, S. cerevisiae
atggctttagctccgatgatcgtgt

SEQ ID NO: 5712 - DNA, 25 bp, S. cerevisiae
atggtttatctgctgtgactggtaa

SEQ ID NO: 5713 - DNA, 25 bp, S. cerevisiae
atggcgttacagtaagggccgacga

SEQ ID NO: 5714 - DNA, 25 bp, S. cerevisiae
atggcggcatatagccgagtcccat

SEQ ID NO: 5715 - DNA, 25 bp, S. cerevisiae
aggccgaacgacagctctacgatgc

SEQ ID NO: 5716 - DNA, 25 bp, S. cerevisiae
aggccgcaaggttagctgctgagaa

SEQ ID NO: 5717 - DNA, 25 bp, S. cerevisiae
atggacgattggttggcttatgaaa

SEQ ID NO: 5718 - DNA, 25 bp, S. cerevisiae
atggccaggatgtctcgcagtttaa

SEQ ID NO: 5719 - DNA, 25 bp, S. cerevisiae
atggctcagagattcaagacgcttt

SEQ ID NO: 5720 - DNA, 25 bp, S. cerevisiae
aggaacaagtttctcttcaacaaga

SEQ ID NO: 5721 - DNA, 25 bp, S. cerevisiae
aggcaacaagtttcctctataggag

SEQ ID NO: 5722 - DNA, 25 bp, S. cerevisiae
atggctccacggaccctgaaatgta

SEQ ID NO: 5723 - DNA, 25 bp, S. cerevisiae
atggcacgcatccatatcagcttag

SEQ ID NO: 5724 - DNA, 25 bp, S. cerevisiae
atggcatccatctgaagcattactg

SEQ ID NO: 5725 - DNA, 25 bp, S. cerevisiae
atggttcactggacgatctactttc

SEQ ID NO: 5726 - DNA, 25 bp, S. cerevisiae
atggttcacatactttctcctggat

SEQ ID NO: 5727 - DNA, 25 bp, S. cerevisiae
atggtttgctatatcatgcctctct

SEQ ID NO: 5728 - DNA, 25 bp, S. cerevisiae
atggttcaaggaacactcttcgtaa

SEQ ID NO: 5729 - DNA, 25 bp, S. cerevisiae
aggtatcaaagttactgtccaattg

SEQ ID NO: 5730 - DNA, 25 bp, S. cerevisiae
aggcaaaaatttgcgtcgccgtcag

SEQ ID NO: 5731 - DNA, 25 bp, S. cerevisiae
gagggaaaagtctgcgacgccttcc

SEQ ID NO: 5732 - DNA, 25 bp, S. cerevisiae
aggccaacggtcacttgcaaattct

SEQ ID NO: 5733 - DNA, 25 bp, S. cerevisiae
aggcaccgccagttttcgaaatttg

SEQ ID NO: 5734 - DNA, 25 bp, S. cerevisiae
agtttggctatcttttcggactttg

SEQ ID NO: 5735 - DNA, 25 bp, S. cerevisiae
aggttgggaccacttggccttattg

SEQ ID NO: 5736 - DNA, 25 bp, S. cerevisiae
aggttgggaccacctatccttgttg

SEQ ID NO: 5737 - DNA, 25 bp, S. cerevisiae
aggacgtggatctggctactttgat

SEQ ID NO: 5738 - DNA, 25 bp, S. cerevisiae
atggacgctttgtgggactcctgat

SEQ ID NO: 5739 - DNA, 25 bp, S. cerevisiae
agcagggcttgttgttacccgggca

SEQ ID NO: 5740 - DNA, 25 bp, S. cerevisiae
atggatttattgtcttactccgaag

SEQ ID NO: 5741 - DNA, 25 bp, S. cerevisiae
aggctttttactgacatcttgatgg

SEQ ID NO: 5742 - DNA, 25 bp, S. cerevisiae
atggttccactctgttcatcatgaa

SEQ ID NO: 5743 - DNA, 25 bp, S. cerevisiae
atggttataccttgttgctctcata

SEQ ID NO: 5744 - DNA, 25 bp, S. cerevisiae
aggcccaaatcttgttgtccattgc

SEQ ID NO: 5745 - DNA, 25 bp, S. cerevisiae
aggccgaaatcgaagctgctcaatt

SEQ ID NO: 5746 - DNA, 25 bp, S. cerevisiae
aggaatttcggccacttcaagttct

SEQ ID NO: 5747 - DNA, 25 bp, S. cerevisiae
aggtggttcagtcattccaactttc

SEQ ID NO: 5748 - DNA, 25 bp, S. cerevisiae
agggtgcaggagcttttctactttc

SEQ ID NO: 5749 - DNA, 25 bp, S. cerevisiae
atggcttcaggaccgtttttgattc

SEQ ID NO: 5750 - DNA, 25 bp, S. cerevisiae
atggttcaggacattgtgctttgta

SEQ ID NO: 5751 - DNA, 25 bp, S. cerevisiae
atggaggatccatgttgtccctgta

SEQ ID NO: 5752 - DNA, 25 bp, S. cerevisiae
atggcagccgatcgttctgtctata

SEQ ID NO: 5753 - DNA, 25 bp, S. cerevisiae
atggaccctgtggtggcagatccaa

SEQ ID NO: 5754 - DNA, 25 bp, S. cerevisiae
atggttccatggtactcctctagat

SEQ ID NO: 5755 - DNA, 25 bp, S. cerevisiae
atggttccatggtattcttccaggc

SEQ ID NO: 5756 - DNA, 25 bp, S. cerevisiae
atggttctactggattttctgctgc

SEQ ID NO: 5757 - DNA, 25 bp, S. cerevisiae
atggattctccagcattatcctctg

SEQ ID NO: 5758 - DNA, 25 bp, S. cerevisiae
atggattctccatcactatacttga

SEQ ID NO: 5759 - DNA, 25 bp, S. cerevisiae
atggatcgccatttattccttctct

SEQ ID NO: 5760 - DNA, 25 bp, S. cerevisiae
atggttgccatcattacttgcccat

SEQ ID NO: 5761 - DNA, 25 bp, S. cerevisiae
atggttgtcaactatgatcttccaa

SEQ ID NO: 5762 - DNA, 25 bp, S. cerevisiae
aggcgcttccgcaaggtcccaaggg

SEQ ID NO: 5763 - DNA, 25 bp, S. cerevisiae
aggccctaggccaagacacagaaaa

SEQ ID NO: 5764 - DNA, 25 bp, S. cerevisiae
atggcacctgtaacaccgatcaaag

SEQ ID NO: 5765 - DNA, 25 bp, S. cerevisiae
atggcccgcactagctttaattaag

SEQ ID NO: 5766 - DNA, 25 bp, S. cerevisiae
atggcacccacacaattggatataa

SEQ ID NO: 5767 - DNA, 25 bp, S. cerevisiae
atggcctcctcaagtagcacgctac

SEQ ID NO: 5768 - DNA, 25 bp, S. cerevisiae
atggcactgacccagtaactgctga

SEQ ID NO: 5769 - DNA, 25 bp, S. cerevisiae
atggcactgcatggagcaggaccat

SEQ ID NO: 5770 - DNA, 25 bp, S. cerevisiae
atggcactgttgacatcgatactaa

SEQ ID NO: 5771 - DNA, 25 bp, S. cerevisiae
atggcatctgtcacacaacctggaa

SEQ ID NO: 5772 - DNA, 25 bp, S. cerevisiae
atggcagcttcagttccaccaggag

SEQ ID NO: 5773 - DNA, 25 bp, S. cerevisiae
atggctgtagatgttcctcgtgcgg

SEQ ID NO: 5774 - DNA, 25 bp, S. cerevisiae
atggctgctcaaaagtctttcagaa

SEQ ID NO: 5775 - DNA, 25 bp, S. cerevisiae
aggcgtcattgcgagtagttcaaca

SEQ ID NO: 5776 - DNA, 25 bp, S. cerevisiae
atggcttttcccaatgcttcaaaga

SEQ ID NO: 5777 - DNA, 25 bp, S. cerevisiae
atggctcttgttatgactgtggaac

SEQ ID NO: 5778 - DNA, 25 bp, S. cerevisiae
atggatggtttcgtactggtgatat

SEQ ID NO: 5779 - DNA, 25 bp, S. cerevisiae
atggaaggtgtagacggcgcatctt

SEQ ID NO: 5780 - DNA, 25 bp, S. cerevisiae
atggaacgtgttgaacagagatttt

SEQ ID NO: 5781 - DNA, 25 bp, S. cerevisiae
atggaactgtttcatatacgttatt

SEQ ID NO: 5782 - DNA, 25 bp, S. cerevisiae
atggacctgtgtggaatttctcccc

SEQ ID NO: 5783 - DNA, 25 bp, S. cerevisiae
atggaacatttaacctctaccctct

SEQ ID NO: 5784 - DNA, 25 bp, S. cerevisiae
atggcaacgttggattttaccacta

SEQ ID NO: 5785 - DNA, 25 bp, S. cerevisiae
atggctggacttcggtgctttgaac

SEQ ID NO: 5786 - DNA, 25 bp, S. cerevisiae
agttaaggacattcacggacgcatc

SEQ ID NO: 5787 - DNA, 25 bp, S. cerevisiae
agttatgggacttacaggttgacgt

SEQ ID NO: 5788 - DNA, 25 bp, S. cerevisiae
aggctacggtcaatcgtggttgcca

SEQ ID NO: 5789 - DNA, 25 bp, S. cerevisiae
agcagtacgggtctagttccagcat

SEQ ID NO: 5790 - DNA, 25 bp, S. cerevisiae
atggactctgtcttattgacttgga

SEQ ID NO: 5791 - DNA, 25 bp, S. cerevisiae
aggacttctcttgatatgctcggct

SEQ ID NO: 5792 - DNA, 25 bp, S. cerevisiae
aggccaacttccaaagatctgcgct

SEQ ID NO: 5793 - DNA, 25 bp, S. cerevisiae
atggctaagttcttgaaagctggta

SEQ ID NO: 5794 - DNA, 25 bp, S. cerevisiae
aggcccaggccgataagaagagata

SEQ ID NO: 5795 - DNA, 25 bp, S. cerevisiae
aggcctggtgacatgctaaagacaa

SEQ ID NO: 5796 - DNA, 25 bp, S. cerevisiae
aggccggcgattttgaacagccaaa

SEQ ID NO: 5797 - DNA, 25 bp, S. cerevisiae
aggccggcgctagtataaattcaat

SEQ ID NO: 5798 - DNA, 25 bp, S. cerevisiae
aggccgatgctgctgctaagaaagc

SEQ ID NO: 5799 - DNA, 25 bp, S. cerevisiae
aggcgggcttttttgagcaagcttt

SEQ ID NO: 5800 - DNA, 25 bp, S. cerevisiae
atggctccagtcttttcattaactc

SEQ ID NO: 5801 - DNA, 25 bp, S. cerevisiae
atggctctcaacttttgtacatcag

SEQ ID NO: 5802 - DNA, 25 bp, S. cerevisiae
aggctgctgcatcccaaattacaga

SEQ ID NO: 5803 - DNA, 25 bp, S. cerevisiae
aggccaattccagtactacgacttt

SEQ ID NO: 5804 - DNA, 25 bp, S. cerevisiae
atggccgattacgtagtcgaccttt

SEQ ID NO: 5805 - DNA, 25 bp, S. cerevisiae
atggctaacgaccttgttcaagctc

SEQ ID NO: 5806 - DNA, 25 bp, S. cerevisiae
atggcaaatactggctgtttatcac

SEQ ID NO: 5807 - DNA, 25 bp, S. cerevisiae
aggccaaagctttgtaccgtcgtgg

SEQ ID NO: 5808 - DNA, 25 bp, S. cerevisiae
aggcactgtatattgtactcccgct

SEQ ID NO: 5809 - DNA, 25 bp, S. cerevisiae
aggttggaaacttggcgcgccatgc

SEQ ID NO: 5810 - DNA, 25 bp, S. cerevisiae
aggtttaatgacttggacgttccag

SEQ ID NO: 5811 - DNA, 25 bp, S. cerevisiae
atggcttgcttttttgaactgtatc

SEQ ID NO: 5812 - DNA, 25 bp, S. cerevisiae
atggctctgcgaacgttactgttga

SEQ ID NO: 5813 - DNA, 25 bp, S. cerevisiae
aggcgctgacttggctgctttagtc

SEQ ID NO: 5814 - DNA, 25 bp, S. cerevisiae
atggcgctacattcactgttactgc

SEQ ID NO: 5815 - DNA, 25 bp, S. cerevisiae
atggctatatgtggcgcttttggat

SEQ ID NO: 5816 - DNA, 25 bp, S. cerevisiae
atggaaatgatcgtctattggccaa

SEQ ID NO: 5817 - DNA, 25 bp, S. cerevisiae
atggcaaaatattcgtactcagtac

SEQ ID NO: 5818 - DNA, 25 bp, S. cerevisiae
aggcatcaggatttggcgactacta

SEQ ID NO: 5819 - DNA, 25 bp, S. cerevisiae
atggccatggtatttctgtaggttc

SEQ ID NO: 5820 - DNA, 25 bp, S. cerevisiae
atggcgctgttattggctacatgga

SEQ ID NO: 5821 - DNA, 25 bp, S. cerevisiae
atggaatctatatttctacatgcta

SEQ ID NO: 5822 - DNA, 25 bp, S. cerevisiae
atggccattgcggttggtgcgaact

SEQ ID NO: 5823 - DNA, 25 bp, S. cerevisiae
atggccataccaagctgtagctgat

SEQ ID NO: 5824 - DNA, 25 bp, S. cerevisiae
atggctacctacgtggcagattgtt

SEQ ID NO: 5825 - DNA, 25 bp, S. cerevisiae
atggagcaccttcattttgggctgt

SEQ ID NO: 5826 - DNA, 25 bp, S. cerevisiae
atggagccgttcgttctatggcagc

SEQ ID NO: 5827 - DNA, 25 bp, S. cerevisiae
aggctacttgttcttacgtgcggga

SEQ ID NO: 5828 - DNA, 25 bp, S. cerevisiae
aggccactaattctgctacgatctt

SEQ ID NO: 5829 - DNA, 25 bp, S. cerevisiae
ggagaaccctaaggtcgccctgttg

SEQ ID NO: 5830 - DNA, 25 bp, S. cerevisiae
atggaacccaaaggttcagtctttg

SEQ ID NO: 5831 - DNA, 25 bp, S. cerevisiae
aggagacctgggacgctcaagttaa

SEQ ID NO: 5832 - DNA, 25 bp, S. cerevisiae
aggccaccttgctcgtgagattatt

SEQ ID NO: 5833 - DNA, 25 bp, S. cerevisiae
aggcagaaggctcacgaaatagttt

SEQ ID NO: 5834 - DNA, 25 bp, S. cerevisiae
atggccccggtattgtaatcgattt

SEQ ID NO: 5835 - DNA, 25 bp, S. cerevisiae
atggctccgggcaaggtgtatctac

SEQ ID NO: 5836 - DNA, 25 bp, S. cerevisiae
atggcaacggaggacccttgcatat

SEQ ID NO: 5837 - DNA, 25 bp, S. cerevisiae
atggacccagagttacaagctatta

SEQ ID NO: 5838 - DNA, 25 bp, S. cerevisiae
aggacgcctcaattacatggccatc

SEQ ID NO: 5839 - DNA, 25 bp, S. cerevisiae
atggcctaatcatttcctggtctaa

SEQ ID NO: 5840 - DNA, 25 bp, S. cerevisiae
atggcatcccacaaagcgcaatgtt

SEQ ID NO: 5841 - DNA, 25 bp, S. cerevisiae
atggctttccatcctcatagaatga

SEQ ID NO: 5842 - DNA, 25 bp, S. cerevisiae
agaggcatcctcttcagtgcagatg

SEQ ID NO: 5843 - DNA, 25 bp, S. cerevisiae
atggccaactctcctgttctaaaat

SEQ ID NO: 5844 - DNA, 25 bp, S. cerevisiae
atggccacggtcgttatcttactga

SEQ ID NO: 5845 - DNA, 25 bp, S. cerevisiae
atggcaaatgtaacttgttttctga

SEQ ID NO: 5846 - DNA, 25 bp, S. cerevisiae
aggccatacctgcactgttcaaggc

SEQ ID NO: 5847 - DNA, 25 bp, S. cerevisiae
agcgacttatcgtggtaaacttgtt

SEQ ID NO: 5848 - DNA, 25 bp, S. cerevisiae
atggccgctattttcttgaggaaca

SEQ ID NO: 5849 - DNA, 25 bp, S. cerevisiae
atggaagtcgctgttgctagtgcaa

SEQ ID NO: 5850 - DNA, 25 bp, S. cerevisiae
atggaagccctgtttttctgttatt

SEQ ID NO: 5851 - DNA, 25 bp, S. cerevisiae
aggaaccattacaccatatgtcggg

SEQ ID NO: 5852 - DNA, 25 bp, S. cerevisiae
agggcccgataaacgatactcggat

SEQ ID NO: 5853 - DNA, 25 bp, S. cerevisiae
aggaagttccaatcctccttccgcg

SEQ ID NO: 5854 - DNA, 25 bp, S. cerevisiae
aggaagtttcaagcgagcctaaaga

SEQ ID NO: 5855 - DNA, 25 bp, S. cerevisiae
aggaaggcattatcgtcggctgcaa

SEQ ID NO: 5856 - DNA, 25 bp, S. cerevisiae
aggagatgctcttcaacgtcggcag

SEQ ID NO: 5857 - DNA, 25 bp, S. cerevisiae
aggcaatcacgaaacccggcaaatt

SEQ ID NO: 5858 - DNA, 25 bp, S. cerevisiae
aggcatcaccgaaaaccttgacaag

SEQ ID NO: 5859 - DNA, 25 bp, S. cerevisiae
atggccaccactgaatcttctaaag

SEQ ID NO: 5860 - DNA, 25 bp, S. cerevisiae
aggccaccggcgatcgtacaaagga

SEQ ID NO: 5861 - DNA, 25 bp, S. cerevisiae
aggccgtcagaggtttacactattc

SEQ ID NO: 5862 - DNA, 25 bp, S. cerevisiae
aggcgtgctgagtcttttgaacatt

SEQ ID NO: 5863 - DNA, 25 bp, S. cerevisiae
atggcctcttttttggaagcatctg

SEQ ID NO: 5864 - DNA, 25 bp, S. cerevisiae
aggccgtttggctgtaatactccaa

SEQ ID NO: 5865 - DNA, 25 bp, S. cerevisiae
aggcctttgaccagttatcttacca

SEQ ID NO: 5866 - DNA, 25 bp, S. cerevisiae
aggcaccgtaccatcaattttctaa

SEQ ID NO: 5867 - DNA, 25 bp, S. cerevisiae
aggaagccatcccagcattgattaa

SEQ ID NO: 5868 - DNA, 25 bp, S. cerevisiae
atggaactgcgccaagcaccagtaa

SEQ ID NO: 5869 - DNA, 25 bp, S. cerevisiae
atggaaggccgttgctgccatttca

SEQ ID NO: 5870 - DNA, 25 bp, S. cerevisiae
aggaagagccgattgtcttgcccat

SEQ ID NO: 5871 - DNA, 25 bp, S. cerevisiae
aggatgatgagcacaaccctaccat

SEQ ID NO: 5872 - DNA, 25 bp, S. cerevisiae
atggcattgccaagaactcctttga

SEQ ID NO: 5873 - DNA, 25 bp, S. cerevisiae
atggctactgaaccaaattcctgta

SEQ ID NO: 5874 - DNA, 25 bp, S. cerevisiae
aggctcatgtcagcgattgcaccat

SEQ ID NO: 5875 - DNA, 25 bp, S. cerevisiae
aggctgtgccacgagaggatcatct

SEQ ID NO: 5876 - DNA, 25 bp, S. cerevisiae
aggctggtcccatagatcattaaaa

SEQ ID NO: 5877 - DNA, 25 bp, S. cerevisiae
aggcaggtcgccaggtcaaaagcaa

SEQ ID NO: 5878 - DNA, 25 bp, S. cerevisiae
atggcatatcaatccttaacgtcaa

SEQ ID NO: 5879 - DNA, 25 bp, S. cerevisiae
atggcccaataccttgcacaagtgc

SEQ ID NO: 5880 - DNA, 25 bp, S. cerevisiae
atggcttcatttactggatcactgt

SEQ ID NO: 5881 - DNA, 25 bp, S. cerevisiae
atggctctttggacgtccatctgaa

SEQ ID NO: 5882 - DNA, 25 bp, S. cerevisiae
atggcttacattttgccgccataca

SEQ ID NO: 5883 - DNA, 25 bp, S. cerevisiae
atggctattttgttcctgcctacag

SEQ ID NO: 5884 - DNA, 25 bp, S. cerevisiae
aggcaacgatggtcactgttaacat

SEQ ID NO: 5885 - DNA, 25 bp, S. cerevisiae
aggctggctactatcgaatgcggat

SEQ ID NO: 5886 - DNA, 25 bp, S. cerevisiae
aggaagctacttacgaccaaatcaa

SEQ ID NO: 5887 - DNA, 25 bp, S. cerevisiae
atggccgtttttggactcaaatacg

SEQ ID NO: 5888 - DNA, 25 bp, S. cerevisiae
atggcgcgtctttattactaatgta

SEQ ID NO: 5889 - DNA, 25 bp, S. cerevisiae
atggcaatggcagcactgaccagat

SEQ ID NO: 5890 - DNA, 25 bp, S. cerevisiae
aggccatgatcttgagcttctacta

SEQ ID NO: 5891 - DNA, 25 bp, S. cerevisiae
aggccactggtcttttggctggaat

SEQ ID NO: 5892 - DNA, 25 bp, S. cerevisiae
aggcccgggctttactgatgctaat

SEQ ID NO: 5893 - DNA, 25 bp, S. cerevisiae
atggctgcctatttttagctcctaa

SEQ ID NO: 5894 - DNA, 25 bp, S. cerevisiae
atggctcgtgttacatggtggttta

SEQ ID NO: 5895 - DNA, 25 bp, S. cerevisiae
aggacgattgcgaaccaggaccatt

SEQ ID NO: 5896 - DNA, 25 bp, S. cerevisiae
aggctgtgctttcaccaaatccatt

SEQ ID NO: 5897 - DNA, 25 bp, S. cerevisiae
aggctgtcactgctactgaagacgc

SEQ ID NO: 5898 - DNA, 25 bp, S. cerevisiae
atggctaatacatctggtgtcagta

SEQ ID NO: 5899 - DNA, 25 bp, S. cerevisiae
atggctgaaaagttggctgctcaaa

SEQ ID NO: 5900 - DNA, 25 bp, S. cerevisiae
atggctacatgtatagtgctttcaa

SEQ ID NO: 5901 - DNA, 25 bp, S. cerevisiae
atggctagtgttttgttgcctcaat

SEQ ID NO: 5902 - DNA, 25 bp, S. cerevisiae
aggctggccacacaagggcacactg

SEQ ID NO: 5903 - DNA, 25 bp, S. cerevisiae
aggctaagaagcaaaacagaccatt

SEQ ID NO: 5904 - DNA, 25 bp, S. cerevisiae
aggtccgcagaacgagaatttgtct

SEQ ID NO: 5905 - DNA, 25 bp, S. cerevisiae
cagttccgttagagacatattttca

SEQ ID NO: 5906 - DNA, 25 bp, S. cerevisiae
gtgagtacgttacctacgctttgtc

SEQ ID NO: 5907 - DNA, 25 bp, S. cerevisiae
aggtagtactgtgtgacgctgccga

SEQ ID NO: 5908 - DNA, 25 bp, S. cerevisiae
aggcccttctgtggaatcgtacgaa

SEQ ID NO: 5909 - DNA, 25 bp, S. cerevisiae
aggcgccttttgcatggcattaaaa

SEQ ID NO: 5910 - DNA, 25 bp, S. cerevisiae
aggccacgttgtcagtttcgcataa

SEQ ID NO: 5911 - DNA, 25 bp, S. cerevisiae
atggccaggacggtccttcttcgaa

SEQ ID NO: 5912 - DNA, 25 bp, S. cerevisiae
atggccaggacggtccttcttcgaa

SEQ ID NO: 5913 - DNA, 25 bp, S. cerevisiae
atggcaggtttcctattgatcagaa

SEQ ID NO: 5914 - DNA, 25 bp, S. cerevisiae
aggccacaaatgacgcttgccagag

SEQ ID NO: 5915 - DNA, 25 bp, S. cerevisiae
aggcatgccttccaggttcactaaa

SEQ ID NO: 5916 - DNA, 25 bp, S. cerevisiae
atggctcggagctggtggactcaaa

SEQ ID NO: 5917 - DNA, 25 bp, S. cerevisiae
atggcggtgtgctacatcttgaatt

SEQ ID NO: 5918 - DNA, 25 bp, S. cerevisiae
atggccatttgcttcacttatattc

SEQ ID NO: 5919 - DNA, 25 bp, S. cerevisiae
atggcttggtttagctttgcattcc

SEQ ID NO: 5920 - DNA, 25 bp, S. cerevisiae
atggcctcgatttcagcaattggtc

SEQ ID NO: 5921 - DNA, 25 bp, S. cerevisiae
atggctcttatcaccatcatgggac

SEQ ID NO: 5922 - DNA, 25 bp, S. cerevisiae
aggcttatcctgtccaattgaaccg

SEQ ID NO: 5923 - DNA, 25 bp, S. cerevisiae
agtgattatacttcccattacccag

SEQ ID NO: 5924 - DNA, 25 bp, S. cerevisiae
aggcttacatcttttttggccccat

SEQ ID NO: 5925 - DNA, 25 bp, S. cerevisiae
agcaattagcttctaaggctgccag

SEQ ID NO: 5926 - DNA, 25 bp, S. cerevisiae
acgtccttcaatgctttaccacaag

SEQ ID NO: 5927 - DNA, 25 bp, S. cerevisiae
aggctgccgtaatctttaattcaag

SEQ ID NO: 5928 - DNA, 25 bp, S. cerevisiae
aggcgccgtaggtcattggtcatac

SEQ ID NO: 5929 - DNA, 25 bp, S. cerevisiae
aggacctgtatgagcatgggatcaa

SEQ ID NO: 5930 - DNA, 25 bp, S. cerevisiae
atggctttggtaaccagtctcaaca

SEQ ID NO: 5931 - DNA, 25 bp, S. cerevisiae
aggcttttgtttccagtcaaccatg

SEQ ID NO: 5932 - DNA, 25 bp, S. cerevisiae
aggacaaccaaccaacttctgagaa

SEQ ID NO: 5933 - DNA, 25 bp, S. cerevisiae
aggagccaagcaaaaagattcggac

SEQ ID NO: 5934 - DNA, 25 bp, S. cerevisiae
aggacgccagccaagaagaatctct

SEQ ID NO: 5935 - DNA, 25 bp, S. cerevisiae
aggcatcagccaccaaaagcaggat

SEQ ID NO: 5936 - DNA, 25 bp, S. cerevisiae
aggcaacagcattcacagcaagaaa

SEQ ID NO: 5937 - DNA, 25 bp, S. cerevisiae
atggctaagccgtcacaatgtcaaa

SEQ ID NO: 5938 - DNA, 25 bp, S. cerevisiae
aggcggcagtcgatggatatcccat

SEQ ID NO: 5939 - DNA, 25 bp, S. cerevisiae
atggcctcgtgcctgttcaaagagt

SEQ ID NO: 5940 - DNA, 25 bp, S. cerevisiae
atggctctcctacattagcagggtc

SEQ ID NO: 5941 - DNA, 25 bp, S. cerevisiae
aggcttctgcaacaaacaacgacgt

SEQ ID NO: 5942 - DNA, 25 bp, S. cerevisiae
agggtccaccgataacacagcaaaa

SEQ ID NO: 5943 - DNA, 25 bp, S. cerevisiae
aggtatcccgtttcaatacacagaa

SEQ ID NO: 5944 - DNA, 25 bp, S. cerevisiae
aggccaccttcaagattatctgcag

SEQ ID NO: 5945 - DNA, 25 bp, S. cerevisiae
aggccctatatgaaattagctcgag

SEQ ID NO: 5946 - DNA, 25 bp, S. cerevisiae
atggccagatatccgtagcactaca

SEQ ID NO: 5947 - DNA, 25 bp, S. cerevisiae
atggctcagacgctgtacacacgaa

SEQ ID NO: 5948 - DNA, 25 bp, S. cerevisiae
atggccaagagttgcttccaactct

SEQ ID NO: 5949 - DNA, 25 bp, S. cerevisiae
agaactcaacttcaggacctttagt

SEQ ID NO: 5950 - DNA, 25 bp, S. cerevisiae
aggattctacttccagggagctctt

SEQ ID NO: 5951 - DNA, 25 bp, S. cerevisiae
aggctggtactttgggtggtcctat

SEQ ID NO: 5952 - DNA, 25 bp, S. cerevisiae
aggttggtatcgcaatgtcacccct

SEQ ID NO: 5953 - DNA, 25 bp, S. cerevisiae
aggatatttaccgaatacccctgct

SEQ ID NO: 5954 - DNA, 25 bp, S. cerevisiae
aggcggtttccatatgatccccaga

SEQ ID NO: 5955 - DNA, 25 bp, S. cerevisiae
aggcgccttataatatttcctccct

SEQ ID NO: 5956 - DNA, 25 bp, S. cerevisiae
atggcctcttttgattcattcttcc

SEQ ID NO: 5957 - DNA, 25 bp, S. cerevisiae
aggctctaacttctacgcttataac

SEQ ID NO: 5958 - DNA, 25 bp, S. cerevisiae
aggcttaaataccaagagcttctaa

SEQ ID NO: 5959 - DNA, 25 bp, S. cerevisiae
aggctcctgtatctctgcaattaca

SEQ ID NO: 5960 - DNA, 25 bp, S. cerevisiae
aggactctatcggtggtgtcgtcac

SEQ ID NO: 5961 - DNA, 25 bp, S. cerevisiae
atggccgctactgttggttatccag

SEQ ID NO: 5962 - DNA, 25 bp, S. cerevisiae
atggctgcgcttccaattggtattt

SEQ ID NO: 5963 - DNA, 25 bp, S. cerevisiae
aggccagcacatctcttggtattgg

SEQ ID NO: 5964 - DNA, 25 bp, S. cerevisiae
aggcatctgcgcgaacattttgtag

SEQ ID NO: 5965 - DNA, 25 bp, S. cerevisiae
aggcgctccagcgagatctattata

SEQ ID NO: 5966 - DNA, 25 bp, S. cerevisiae
atggcgttggctatcctctaaagaa

SEQ ID NO: 5967 - DNA, 25 bp, S. cerevisiae
aggcctttgataatgcccttgaaaa

SEQ ID NO: 5968 - DNA, 25 bp, S. cerevisiae
aggcgtttgataagaactctcccaa

SEQ ID NO: 5969 - DNA, 25 bp, S. cerevisiae
atggctgttatcctggctttgatta

SEQ ID NO: 5970 - DNA, 25 bp, S. cerevisiae
aggctacttcctctattgattacga

SEQ ID NO: 5971 - DNA, 25 bp, S. cerevisiae
agtcggtcaacatgcgcacgatgtt

SEQ ID NO: 5972 - DNA, 25 bp, S. cerevisiae
agtgggataccaatgctacgacatg

SEQ ID NO: 5973 - DNA, 25 bp, S. cerevisiae
aggcgctaactcactactggattta

SEQ ID NO: 5974 - DNA, 25 bp, S. cerevisiae
atggccagaatctctctattgggta

SEQ ID NO: 5975 - DNA, 25 bp, S. cerevisiae
aggccgttcttatgcttactttatg

SEQ ID NO: 5976 - DNA, 25 bp, S. cerevisiae
atggccgtacagacaccaagacaaa

SEQ ID NO: 5977 - DNA, 25 bp, S. cerevisiae
atggccagaacaaagcaaacagcaa

SEQ ID NO: 5978 - DNA, 25 bp, S. cerevisiae
atggccagaactaaacaaacagcta

SEQ ID NO: 5979 - DNA, 25 bp, S. cerevisiae
aggccctatcaaatacaaacagtct

SEQ ID NO: 5980 - DNA, 25 bp, S. cerevisiae
aggaccaagctttatcaaacgccca

SEQ ID NO: 5981 - DNA, 25 bp, S. cerevisiae
aggcttcaagattaccaaaacggcg

SEQ ID NO: 5982 - DNA, 25 bp, S. cerevisiae
agagtcctttcttctgaacaacggc

SEQ ID NO: 5983 - DNA, 25 bp, S. cerevisiae
agaggaatttgcactaactacattg

SEQ ID NO: 5984 - DNA, 25 bp, S. cerevisiae
agggaagttactgccacaacactgc

SEQ ID NO: 5985 - DNA, 25 bp, S. cerevisiae
aggcgagatcaacattcaacaattc

SEQ ID NO: 5986 - DNA, 25 bp, S. cerevisiae
aggaacatctgggaattatctttga

SEQ ID NO: 5987 - DNA, 25 bp, S. cerevisiae
aggaatgacggcgacatccctacta

SEQ ID NO: 5988 - DNA, 25 bp, S. cerevisiae
aggaatagcaatgtatcccatcacc

SEQ ID NO: 5989 - DNA, 25 bp, S. cerevisiae
aggcagatattttttccctgggtct

SEQ ID NO: 5990 - DNA, 25 bp, S. cerevisiae
aggcgatttgatttccagactggag

SEQ ID NO: 5991 - DNA, 25 bp, S. cerevisiae
aggcgattcatgatgctcctcaata

SEQ ID NO: 5992 - DNA, 25 bp, S. cerevisiae
aggctttggaacttctaactaaatg

SEQ ID NO: 5993 - DNA, 25 bp, S. cerevisiae
aggctctcagtatcgatctaacgcc

SEQ ID NO: 5994 - DNA, 25 bp, S. cerevisiae
aggctctccatctcattaaactgct

SEQ ID NO: 5995 - DNA, 25 bp, S. cerevisiae
aggacagattaccatttgaccctcc

SEQ ID NO: 5996 - DNA, 25 bp, S. cerevisiae
aggagacgctaccaattgtccctag

SEQ ID NO: 5997 - DNA, 25 bp, S. cerevisiae
aggagggctaggtatcaatctgact

SEQ ID NO: 5998 - DNA, 25 bp, S. cerevisiae
aggatgtggctactcatatcactaa

SEQ ID NO: 5999 - DNA, 25 bp, S. cerevisiae
aggatatccgcgcaacagctgaagg

SEQ ID NO: 6000 - DNA, 25 bp, S. cerevisiae
aggataatgtggctccctttcgatt

SEQ ID NO: 6001 - DNA, 25 bp, S. cerevisiae
aggaggtgtacgtcaattcccgtcg

SEQ ID NO: 6002 - DNA, 25 bp, S. cerevisiae
aggcagttgttttcaacaccgttgc

SEQ ID NO: 6003 - DNA, 25 bp, S. cerevisiae
aggaggctctttttcaacctgagtc

SEQ ID NO: 6004 - DNA, 25 bp, S. cerevisiae
aggcgactctttttacatcagcagc

SEQ ID NO: 6005 - DNA, 25 bp, S. cerevisiae
aggctacgcttttcgagtacggtga

SEQ ID NO: 6006 - DNA, 25 bp, S. cerevisiae
aggaactcactgtgccctgggatga

SEQ ID NO: 6007 - DNA, 25 bp, S. cerevisiae
aggaagaactcttctgcctcggaac

SEQ ID NO: 6008 - DNA, 25 bp, S. cerevisiae
aggcgactattgtatgctgcattac

SEQ ID NO: 6009 - DNA, 25 bp, S. cerevisiae
aggttcattgtctggtcttgctggc

SEQ ID NO: 6010 - DNA, 25 bp, S. cerevisiae
aggctctaggtatcatggctttatt

SEQ ID NO: 6011 - DNA, 25 bp, S. cerevisiae
aggcttggcccagcagatttgttat

SEQ ID NO: 6012 - DNA, 25 bp, S. cerevisiae
aggtagaccctcgagattgcatgat

SEQ ID NO: 6013 - DNA, 25 bp, S. cerevisiae
aggctacatcctccaagttatgcaa

SEQ ID NO: 6014 - DNA, 25 bp, S. cerevisiae
aggcgactcctcaatttgttgcaga

SEQ ID NO: 6015 - DNA, 25 bp, S. cerevisiae
aggcggctgttacgttattgtctca

SEQ ID NO: 6016 - DNA, 25 bp, S. cerevisiae
aggccggtttgactgatgattccca

SEQ ID NO: 6017 - DNA, 25 bp, S. cerevisiae
aggccctgggatttgagctacccaa

SEQ ID NO: 6018 - DNA, 25 bp, S. cerevisiae
aggccaccggtgttgacaatttcat

SEQ ID NO: 6019 - DNA, 25 bp, S. cerevisiae
aggcctcctgggtgaagttgataat

SEQ ID NO: 6020 - DNA, 25 bp, S. cerevisiae
aggaaccttggtgacatgttacaat

SEQ ID NO: 6021 - DNA, 25 bp, S. cerevisiae
aggcgaacggtatccatgctttaca

SEQ ID NO: 6022 - DNA, 25 bp, S. cerevisiae
agggacacttaatcggctcacatac

SEQ ID NO: 6023 - DNA, 25 bp, S. cerevisiae
aggctgcaagctcgttaggatttaa

SEQ ID NO: 6024 - DNA, 25 bp, S. cerevisiae
aggacgcgctagatgagttgttcaa

SEQ ID NO: 6025 - DNA, 25 bp, S. cerevisiae
aggacagcgccgtggtatcttccaa

SEQ ID NO: 6026 - DNA, 25 bp, S. cerevisiae
aggcagtcgccatattttttcaatc

SEQ ID NO: 6027 - DNA, 25 bp, S. cerevisiae
aggcgtctcaagtcacgttcatatt

SEQ ID NO: 6028 - DNA, 25 bp, S. cerevisiae
aggccgtgacagtttttaaatcgca

SEQ ID NO: 6029 - DNA, 25 bp, S. cerevisiae
aggccgcttatgtggctgcgtttct

SEQ ID NO: 6030 - DNA, 25 bp, S. cerevisiae
aggcacttccagacacgtacgatta

SEQ ID NO: 6031 - DNA, 25 bp, S. cerevisiae
aggacaatgccaccaagggaggatt

SEQ ID NO: 6032 - DNA, 25 bp, S. cerevisiae
aggcgattatggtcctccaagagat

SEQ ID NO: 6033 - DNA, 25 bp, S. cerevisiae
aggcgtttctgtttccagtgtgaga

SEQ ID NO: 6034 - DNA, 25 bp, S. cerevisiae
aggcgtatctataactccaggtaaa

SEQ ID NO: 6035 - DNA, 25 bp, S. cerevisiae
aggcgctatttcaaaactcagagag

SEQ ID NO: 6036 - DNA, 25 bp, S. cerevisiae
aggcggtcacgcatacgtcattgaa

SEQ ID NO: 6037 - DNA, 25 bp, S. cerevisiae
aggccgctgaaaaactgtcatcgaa

SEQ ID NO: 6038 - DNA, 25 bp, S. cerevisiae
aggcttcagatcattaactcgtcat

SEQ ID NO: 6039 - DNA, 25 bp, S. cerevisiae
aggctactggttgatttcctttcaa

SEQ ID NO: 6040 - DNA, 25 bp, S. cerevisiae
aggctattggtgtaacttcgttgtc

SEQ ID NO: 6041 - DNA, 25 bp, S. cerevisiae
aggccagacagtaatcgcgatcttt

SEQ ID NO: 6042 - DNA, 25 bp, S. cerevisiae
aggcgcgtcatttgagggattttac

SEQ ID NO: 6043 - DNA, 25 bp, S. cerevisiae
aggcggcattgctagggagattttc

SEQ ID NO: 6044 - DNA, 25 bp, S. cerevisiae
aggcgccattgccaaggattccttg

SEQ ID NO: 6045 - DNA, 25 bp, S. cerevisiae
aggcgaagcccatccagtttatgaa

SEQ ID NO: 6046 - DNA, 25 bp, S. cerevisiae
agggctcagggctacgcagatgatt

SEQ ID NO: 6047 - DNA, 25 bp, S. cerevisiae
aggaccaaggctgttgttatcaaac

SEQ ID NO: 6048 - DNA, 25 bp, S. cerevisiae
aggaaaagcctggtattttcaacat

SEQ ID NO: 6049 - DNA, 25 bp, S. cerevisiae
aggataggcccggtgcaaattccac

SEQ ID NO: 6050 - DNA, 25 bp, S. cerevisiae
aggtttgagacataagttatccaag

SEQ ID NO: 6051 - DNA, 25 bp, S. cerevisiae
aggctaccagaatcagttttccaga

SEQ ID NO: 6052 - DNA, 25 bp, S. cerevisiae
aggcgtgcagggtccgtttgactaa

SEQ ID NO: 6053 - DNA, 25 bp, S. cerevisiae
aggcgtcaacctggcatttatactg

SEQ ID NO: 6054 - DNA, 25 bp, S. cerevisiae
agggaaagctcatctccggaaattt

SEQ ID NO: 6055 - DNA, 25 bp, S. cerevisiae
agggagggtcttggattgcaccaat

SEQ ID NO: 6056 - DNA, 25 bp, S. cerevisiae
aggtcgggtcctgaatgcaatcact

SEQ ID NO: 6057 - DNA, 25 bp, S. cerevisiae
agggcgggtgccagattaatcatca

SEQ ID NO: 6058 - DNA, 25 bp, S. cerevisiae
aggacgaggcggaaatcttcagaat

SEQ ID NO: 6059 - DNA, 25 bp, S. cerevisiae
agggcggctgggtaactcacaatta

SEQ ID NO: 6060 - DNA, 25 bp, S. cerevisiae
aggcgccctgggtatagaaattaga

SEQ ID NO: 6061 - DNA, 25 bp, S. cerevisiae
aggcgaactggctgatcatgaaatt

SEQ ID NO: 6062 - DNA, 25 bp, S. cerevisiae
aggcgaagtcacctgtcagagaaat

SEQ ID NO: 6063 - DNA, 25 bp, S. cerevisiae
aggccttccacttttgaattactgc

SEQ ID NO: 6064 - DNA, 25 bp, S. cerevisiae
aggacatagctatctttttcttttc

SEQ ID NO: 6065 - DNA, 25 bp, S. cerevisiae
aggcagtcctttctatttcatttct

SEQ ID NO: 6066 - DNA, 25 bp, S. cerevisiae
aggctcttcttcacatactgaaaag

SEQ ID NO: 6067 - DNA, 25 bp, S. cerevisiae
aggcctttactcttccgaggataga

SEQ ID NO: 6068 - DNA, 25 bp, S. cerevisiae
aggcgcagagattgttttcctccac

SEQ ID NO: 6069 - DNA, 25 bp, S. cerevisiae
aggttcaatggtttcgcctgccact

SEQ ID NO: 6070 - DNA, 25 bp, S. cerevisiae
aggtatccgataagacgacgccgcc

SEQ ID NO: 6071 - DNA, 25 bp, S. cerevisiae
aggttccattaagcagacttccgat

SEQ ID NO: 6072 - DNA, 25 bp, S. cerevisiae
aggccccattggttattgctgatcc

SEQ ID NO: 6073 - DNA, 25 bp, S. cerevisiae
aggcgtatttcagtgtgcttgagca

SEQ ID NO: 6074 - DNA, 25 bp, S. cerevisiae
aggcctgttcatggcgtcaatggca

SEQ ID NO: 6075 - DNA, 25 bp, S. cerevisiae
aggccgtatccgttgaagcgcaatt

SEQ ID NO: 6076 - DNA, 25 bp, S. cerevisiae
aggccattgagcgtcggatagccaa

SEQ ID NO: 6077 - DNA, 25 bp, S. cerevisiae
aggaacttgcgcctgaatatgccaa

SEQ ID NO: 6078 - DNA, 25 bp, S. cerevisiae
aggaaaagcacaatgatgtcatcga

SEQ ID NO: 6079 - DNA, 25 bp, S. cerevisiae
aggcaacaacaggtgctactggaat

SEQ ID NO: 6080 - DNA, 25 bp, S. cerevisiae
aggcgatgcagatgtccttgttgac

SEQ ID NO: 6081 - DNA, 25 bp, S. cerevisiae
agggctcgatagaccttaagtcgtt

SEQ ID NO: 6082 - DNA, 25 bp, S. cerevisiae
aggcttgcctggtccattagatcat

SEQ ID NO: 6083 - DNA, 25 bp, S. cerevisiae
aggttcctgctgtcgagtaccatca

SEQ ID NO: 6084 - DNA, 25 bp, S. cerevisiae
aggttctggttctagtatcactacc

SEQ ID NO: 6085 - DNA, 25 bp, S. cerevisiae
aggaatttggtattgtctgcactca

SEQ ID NO: 6086 - DNA, 25 bp, S. cerevisiae
aggactactgtgacggcttcagcta

SEQ ID NO: 6087 - DNA, 25 bp, S. cerevisiae
aggatgtagccaccgactctgagta

SEQ ID NO: 6088 - DNA, 25 bp, S. cerevisiae
aggatgtggcaagtcgtctacgtgt

SEQ ID NO: 6089 - DNA, 25 bp, S. cerevisiae
aggcattggcatgtttctgttttca

SEQ ID NO: 6090 - DNA, 25 bp, S. cerevisiae
aggccggcaggcttattgatttcta

SEQ ID NO: 6091 - DNA, 25 bp, S. cerevisiae
aggcgccgctggtgttgctctagct

SEQ ID NO: 6092 - DNA, 25 bp, S. cerevisiae
agaggcctctggtgtttttgacgac

SEQ ID NO: 6093 - DNA, 25 bp, S. cerevisiae
aggctgctttcgttgctattggtaa

SEQ ID NO: 6094 - DNA, 25 bp, S. cerevisiae
aggcaaggctagtccatgatttcaa

SEQ ID NO: 6095 - DNA, 25 bp, S. cerevisiae
aggcaactctcgaacatgatcttga

SEQ ID NO: 6096 - DNA, 25 bp, S. cerevisiae
aggcgagcatcttctactctaagtt

SEQ ID NO: 6097 - DNA, 25 bp, S. cerevisiae
aggctcatgatattgctaccaaccc

SEQ ID NO: 6098 - DNA, 25 bp, S. cerevisiae
aggctctaactttcaaagctcctcg

SEQ ID NO: 6099 - DNA, 25 bp, S. cerevisiae
aggaatgaccttccagatacctctc

SEQ ID NO: 6100 - DNA, 25 bp, S. cerevisiae
aggaaatggcaaccccagcgaacaa

SEQ ID NO: 6101 - DNA, 25 bp, S. cerevisiae
aggaaagctgaaggcccattgttaa

SEQ ID NO: 6102 - DNA, 25 bp, S. cerevisiae
aggagctcaccgatgacgacatggc

SEQ ID NO: 6103 - DNA, 25 bp, S. cerevisiae
aggagcgccgcgatatggatatagt

SEQ ID NO: 6104 - DNA, 25 bp, S. cerevisiae
aggcgccttggtagatagtgacgat

SEQ ID NO: 6105 - DNA, 25 bp, S. cerevisiae
aggacattgcgtttgctttaggccc

SEQ ID NO: 6106 - DNA, 25 bp, S. cerevisiae
aggactgcccaaaggttacgataat

SEQ ID NO: 6107 - DNA, 25 bp, S. cerevisiae
aggccgccactagagcttcattgat

SEQ ID NO: 6108 - DNA, 25 bp, S. cerevisiae
aggcgccaatgcaagccatttgatt

SEQ ID NO: 6109 - DNA, 25 bp, S. cerevisiae
aggcgctgacagatcgttgtgttac

SEQ ID NO: 6110 - DNA, 25 bp, S. cerevisiae
agtgctcgtggtaaccagtttttgc

SEQ ID NO: 6111 - DNA, 25 bp, S. cerevisiae
aggctgctgctgcttatgggtattt

SEQ ID NO: 6112 - DNA, 25 bp, S. cerevisiae
aggctggttctgcatgcgcgaaaat

SEQ ID NO: 6113 - DNA, 25 bp, S. cerevisiae
aggaggctgccattaggcgtgaaaa

SEQ ID NO: 6114 - DNA, 25 bp, S. cerevisiae
aggcatttcatattactgcgatgga

SEQ ID NO: 6115 - DNA, 25 bp, S. cerevisiae
aggcgcccgtgattattgtagcatt

SEQ ID NO: 6116 - DNA, 25 bp, S. cerevisiae
aggcagctcctgaatctattttttc

SEQ ID NO: 6117 - DNA, 25 bp, S. cerevisiae
aggcagttatgtgtttactcgtcaa

SEQ ID NO: 6118 - DNA, 25 bp, S. cerevisiae
aggcatctatcatcgtttcaccttg

SEQ ID NO: 6119 - DNA, 25 bp, S. cerevisiae
aggctcttcttctttgtacactttg

SEQ ID NO: 6120 - DNA, 25 bp, S. cerevisiae
aggaatgtatcttatgggccaatgg

SEQ ID NO: 6121 - DNA, 25 bp, S. cerevisiae
aggaccgtcacttgtatgcgctcta

SEQ ID NO: 6122 - DNA, 25 bp, S. cerevisiae
aggcgattacatcatctctggttca

SEQ ID NO: 6123 - DNA, 25 bp, S. cerevisiae
aggaactgcttcttacctcaaagct

SEQ ID NO: 6124 - DNA, 25 bp, S. cerevisiae
aggaaagcttatttactgcaatgag

SEQ ID NO: 6125 - DNA, 25 bp, S. cerevisiae
aggaaggcttatcaatcgcacgaga

SEQ ID NO: 6126 - DNA, 25 bp, S. cerevisiae
aggcaccgcttacaaatcacataga

SEQ ID NO: 6127 - DNA, 25 bp, S. cerevisiae
aggatcgctatcacaaagtcaaaga

SEQ ID NO: 6128 - DNA, 25 bp, S. cerevisiae
agagacgtctcgcaaaatacaaatc

SEQ ID NO: 6129 - DNA, 25 bp, S. cerevisiae
aggaagtttgcctgataacatcgga

SEQ ID NO: 6130 - DNA, 25 bp, S. cerevisiae
acgacgcttcgagcactaaggtgga

SEQ ID NO: 6131 - DNA, 25 bp, S. cerevisiae
aggaagcttctagagctccagccgg

SEQ ID NO: 6132 - DNA, 25 bp, S. cerevisiae
aggatcctcttagaatacccacggt

SEQ ID NO: 6133 - DNA, 25 bp, S. cerevisiae
aggatcgccttgaaactactgagac

SEQ ID NO: 6134 - DNA, 25 bp, S. cerevisiae
aggacacctgtagagctagccagaa

SEQ ID NO: 6135 - DNA, 25 bp, S. cerevisiae
agagaactagaagacttaagagaaa

SEQ ID NO: 6136 - DNA, 25 bp, S. cerevisiae
aggacctagacctcatgatagcgaa

SEQ ID NO: 6137 - DNA, 25 bp, S. cerevisiae
aggcgagtcttcttacgatatcagt

SEQ ID NO: 6138 - DNA, 25 bp, S. cerevisiae
agggttttcagatcgttagcatttc

SEQ ID NO: 6139 - DNA, 25 bp, S. cerevisiae
aggtcgaggcgttccgttacagaat

SEQ ID NO: 6140 - DNA, 25 bp, S. cerevisiae
aggaagctggtgacgtctattacaa

SEQ ID NO: 6141 - DNA, 25 bp, S. cerevisiae
aggaagctacccgtcaaatgcaaga

SEQ ID NO: 6142 - DNA, 25 bp, S. cerevisiae
agggcactacaatggccaattgcga

SEQ ID NO: 6143 - DNA, 25 bp, S. cerevisiae
aggtgacagaggtgccctagccaga

SEQ ID NO: 6144 - DNA, 25 bp, S. cerevisiae
aggcgagtaggcagtcccagacaga

SEQ ID NO: 6145 - DNA, 25 bp, S. cerevisiae
aggtctacaaagttccggcatcaag

SEQ ID NO: 6146 - DNA, 25 bp, S. cerevisiae
aggctcctaaatatcatggcgctaa

SEQ ID NO: 6147 - DNA, 25 bp, S. cerevisiae
aggcgattcgtttaattcaatgcca

SEQ ID NO: 6148 - DNA, 25 bp, S. cerevisiae
aggagagtctgcagattctcaccct

SEQ ID NO: 6149 - DNA, 25 bp, S. cerevisiae
aggcacaatccattaggcacaccgt

SEQ ID NO: 6150 - DNA, 25 bp, S. cerevisiae
aggcagtgcttcaacgagatggcgt

SEQ ID NO: 6151 - DNA, 25 bp, S. cerevisiae
agagatgtgctacacaaggacgctg

SEQ ID NO: 6152 - DNA, 25 bp, S. cerevisiae
aggaggatgccaagccaggctctga

SEQ ID NO: 6153 - DNA, 25 bp, S. cerevisiae
aggaggagtgcaccatcattgcctt

SEQ ID NO: 6154 - DNA, 25 bp, S. cerevisiae
aggaccatggagctatattcgaact

SEQ ID NO: 6155 - DNA, 25 bp, S. cerevisiae
aggaatcgcgctacgtggacgaact

SEQ ID NO: 6156 - DNA, 25 bp, S. cerevisiae
agggccattttacaattggataagg

SEQ ID NO: 6157 - DNA, 25 bp, S. cerevisiae
aggacctgttttctgtccatacaga

SEQ ID NO: 6158 - DNA, 25 bp, S. cerevisiae
aggacttgttagctgttgccattgc

SEQ ID NO: 6159 - DNA, 25 bp, S. cerevisiae
aggaccgttacgatgatgctttgaa

SEQ ID NO: 6160 - DNA, 25 bp, S. cerevisiae
aggacactgaaacgctcgatgctgt

SEQ ID NO: 6161 - DNA, 25 bp, S. cerevisiae
aggctcagacttagcatccaattct

SEQ ID NO: 6162 - DNA, 25 bp, S. cerevisiae
aggcattggtagctgccaagattga

SEQ ID NO: 6163 - DNA, 25 bp, S. cerevisiae
aggcaagtcatggagcgtctacaaa

SEQ ID NO: 6164 - DNA, 25 bp, S. cerevisiae
agtccagggaaatctgcctcgtttg

SEQ ID NO: 6165 - DNA, 25 bp, S. cerevisiae
agtccggtttcatcttccaatatgt

SEQ ID NO: 6166 - DNA, 25 bp, S. cerevisiae
agagcccgtttcaccttggaagtgg

SEQ ID NO: 6167 - DNA, 25 bp, S. cerevisiae
aggtgccgtgttatccttcgaaacg

SEQ ID NO: 6168 - DNA, 25 bp, S. cerevisiae
aggctccttgactttcaactctaaa

SEQ ID NO: 6169 - DNA, 25 bp, S. cerevisiae
aggctccattgtcgtgttgatcatc

SEQ ID NO: 6170 - DNA, 25 bp, S. cerevisiae
aggaccttgttattgctgattgcgc

SEQ ID NO: 6171 - DNA, 25 bp, S. cerevisiae
aggacacttgtctaagctggctatc

SEQ ID NO: 6172 - DNA, 25 bp, S. cerevisiae
aggcagactctttcacaggacctct

SEQ ID NO: 6173 - DNA, 25 bp, S. cerevisiae
aggcaacctggataagacactctat

SEQ ID NO: 6174 - DNA, 25 bp, S. cerevisiae
agtccaagcgtgtcgaagctcaact

SEQ ID NO: 6175 - DNA, 25 bp, S. cerevisiae
agtcgaagttgctgaagccgttttc

SEQ ID NO: 6176 - DNA, 25 bp, S. cerevisiae
agtcgaagttgctgaagccgttttc

SEQ ID NO: 6177 - DNA, 25 bp, S. cerevisiae
aggaatccctcatgatctagtctgg

SEQ ID NO: 6178 - DNA, 25 bp, S. cerevisiae
aggaaagcatctctgggactccgac

SEQ ID NO: 6179 - DNA, 25 bp, S. cerevisiae
aggaaaattggtgtggctcgctgcc

SEQ ID NO: 6180 - DNA, 25 bp, S. cerevisiae
aggtaagatcggtgttgccgccatt

SEQ ID NO: 6181 - DNA, 25 bp, S. cerevisiae
aggatctcaatctggtgggcacctc

SEQ ID NO: 6182 - DNA, 25 bp, S. cerevisiae
agatctattgtttgcttgaagtttt

SEQ ID NO: 6183 - DNA, 25 bp, S. cerevisiae
aggattctgttcactttgttggtac

SEQ ID NO: 6184 - DNA, 25 bp, S. cerevisiae
aggctccacttctatttctttcatt

SEQ ID NO: 6185 - DNA, 25 bp, S. cerevisiae
aggtcaagaacgttggcatgtccag

SEQ ID NO: 6186 - DNA, 25 bp, S. cerevisiae
aggcaaatgcttaccgattgaccaa

SEQ ID NO: 6187 - DNA, 25 bp, S. cerevisiae
aggaaatgcttcatcgttgccacca

SEQ ID NO: 6188 - DNA, 25 bp, S. cerevisiae
aggcacccaggattcggctcataat

SEQ ID NO: 6189 - DNA, 25 bp, S. cerevisiae
aggaaaatccttgggccacagcaga

SEQ ID NO: 6190 - DNA, 25 bp, S. cerevisiae
aggataaatcctctgaaaagaaaga

SEQ ID NO: 6191 - DNA, 25 bp, S. cerevisiae
aggaatttgcctctatatactgtaa

SEQ ID NO: 6192 - DNA, 25 bp, S. cerevisiae
aggaattctcctacttagccagtga

SEQ ID NO: 6193 - DNA, 25 bp, S. cerevisiae
aggaacgtatatctgtcgcagccgc

SEQ ID NO: 6194 - DNA, 25 bp, S. cerevisiae
agtgattatttacctaccgcaaccg

SEQ ID NO: 6195 - DNA, 25 bp, S. cerevisiae
agggtttgataccttctccaagtca

SEQ ID NO: 6196 - DNA, 25 bp, S. cerevisiae
aggtttattaaattggccacaggca

SEQ ID NO: 6197 - DNA, 25 bp, S. cerevisiae
aggtatttgtactgtcccagggtct

SEQ ID NO: 6198 - DNA, 25 bp, S. cerevisiae
aggaatgttattgagcggcgtacca

SEQ ID NO: 6199 - DNA, 25 bp, S. cerevisiae
aggcacagttacttcgaggcagcga

SEQ ID NO: 6200 - DNA, 25 bp, S. cerevisiae
aggcagttcaagaagctcgccactt

SEQ ID NO: 6201 - DNA, 25 bp, S. cerevisiae
aggatttggaggtcctggtccacaa

SEQ ID NO: 6202 - DNA, 25 bp, S. cerevisiae
aggtttcggtggtggtcagcctcaa

SEQ ID NO: 6203 - DNA, 25 bp, S. cerevisiae
aggacttcttattgtcgtcttgata

SEQ ID NO: 6204 - DNA, 25 bp, S. cerevisiae
aggacgtcaaatttccacatgataa

SEQ ID NO: 6205 - DNA, 25 bp, S. cerevisiae
aggacaccacacacatcaagtttgc

SEQ ID NO: 6206 - DNA, 25 bp, S. cerevisiae
aggacactgtcgcacgtatttgttt

SEQ ID NO: 6207 - DNA, 25 bp, S. cerevisiae
aggcaaaactactgtctggcatatt

SEQ ID NO: 6208 - DNA, 25 bp, S. cerevisiae
aggaacacctatgcgcatctagaat

SEQ ID NO: 6209 - DNA, 25 bp, S. cerevisiae
aggaaacactgaactcttatgaaga

SEQ ID NO: 6210 - DNA, 25 bp, S. cerevisiae
aggctatcagccagtctctaaggga

SEQ ID NO: 6211 - DNA, 25 bp, S. cerevisiae
aggctactgccaagacattcacgga

SEQ ID NO: 6212 - DNA, 25 bp, S. cerevisiae
aggcatcttccttatcatcatacat

SEQ ID NO: 6213 - DNA, 25 bp, S. cerevisiae
aggcatcctgctttaattgactata

SEQ ID NO: 6214 - DNA, 25 bp, S. cerevisiae
aggcaccatgctatcaaatcctgca

SEQ ID NO: 6215 - DNA, 25 bp, S. cerevisiae
aggaagcttctttggcagttgcaca

SEQ ID NO: 6216 - DNA, 25 bp, S. cerevisiae
aggacatcatagtgcctccacctga

SEQ ID NO: 6217 - DNA, 25 bp, S. cerevisiae
aggaatattactacgatcccgaatt

SEQ ID NO: 6218 - DNA, 25 bp, S. cerevisiae
aggaaatacatccactgtccctaat

SEQ ID NO: 6219 - DNA, 25 bp, S. cerevisiae
aggctatatgttcactgtcccaggt

SEQ ID NO: 6220 - DNA, 25 bp, S. cerevisiae
aggttctttggcctgtgacacagct

SEQ ID NO: 6221 - DNA, 25 bp, S. cerevisiae
aggatacttttcctcataacgctcc

SEQ ID NO: 6222 - DNA, 25 bp, S. cerevisiae
aggagtatttccctgataatctttc

SEQ ID NO: 6223 - DNA, 25 bp, S. cerevisiae
aggaggcttaacgttcactgtttat

SEQ ID NO: 6224 - DNA, 25 bp, S. cerevisiae
agtgggttatgggagtcgcttctat

SEQ ID NO: 6225 - DNA, 25 bp, S. cerevisiae
aggaggattataccagtcattttat

SEQ ID NO: 6226 - DNA, 25 bp, S. cerevisiae
aggaagctttatccgcttttctgtt

SEQ ID NO: 6227 - DNA, 25 bp, S. cerevisiae
aggcttcaatttgggctcatttctg

SEQ ID NO: 6228 - DNA, 25 bp, S. cerevisiae
aggcttatatttcccttgctatcaa

SEQ ID NO: 6229 - DNA, 25 bp, S. cerevisiae
aggcttattcccgtgggtgataaca

SEQ ID NO: 6230 - DNA, 25 bp, S. cerevisiae
aggctttgatccgttagtgctgaca

SEQ ID NO: 6231 - DNA, 25 bp, S. cerevisiae
aggcaattacctttctgaagtacaa

SEQ ID NO: 6232 - DNA, 25 bp, S. cerevisiae
aggcttcacttttggtcaagacatc

SEQ ID NO: 6233 - DNA, 25 bp, S. cerevisiae
aggcttcacttttggacaagatgtc

SEQ ID NO: 6234 - DNA, 25 bp, S. cerevisiae
aggcatctctagtgtattgtctcaa

SEQ ID NO: 6235 - DNA, 25 bp, S. cerevisiae
aggctattccccatttcaacaagat

SEQ ID NO: 6236 - DNA, 25 bp, S. cerevisiae
aggtattgacgttgattccgacgaa

SEQ ID NO: 6237 - DNA, 25 bp, S. cerevisiae
aggtattcctgccaattccgaactg

SEQ ID NO: 6238 - DNA, 25 bp, S. cerevisiae
aggaatttgctccatcattattgaa

SEQ ID NO: 6239 - DNA, 25 bp, S. cerevisiae
aggagattatgaacgcccttgaaat

SEQ ID NO: 6240 - DNA, 25 bp, S. cerevisiae
aggtcaattgcattcaaccctaaat

SEQ ID NO: 6241 - DNA, 25 bp, S. cerevisiae
aggacgatgttctaagcgctttaat

SEQ ID NO: 6242 - DNA, 25 bp, S. cerevisiae
aggagctgggtataccattcatcga

SEQ ID NO: 6243 - DNA, 25 bp, S. cerevisiae
aggaagtggcttcccattcggaaat

SEQ ID NO: 6244 - DNA, 25 bp, S. cerevisiae
aggagaatatctggccacattgcgg

SEQ ID NO: 6245 - DNA, 25 bp, S. cerevisiae
aggactctgatcgatgctctgcaac

SEQ ID NO: 6246 - DNA, 25 bp, S. cerevisiae
aggacattcttgacatctcagcttc

SEQ ID NO: 6247 - DNA, 25 bp, S. cerevisiae
aggaaattatatcccctcttcgaga

SEQ ID NO: 6248 - DNA, 25 bp, S. cerevisiae
aggaaatatactcccctagcataaa

SEQ ID NO: 6249 - DNA, 25 bp, S. cerevisiae
aggaagtacatctactctctagccc

SEQ ID NO: 6250 - DNA, 25 bp, S. cerevisiae
aggacttgaaattcccattgcctca

SEQ ID NO: 6251 - DNA, 25 bp, S. cerevisiae
aggactcatgacatttcgctggacc

SEQ ID NO: 6252 - DNA, 25 bp, S. cerevisiae
aggcattcaagcaacgtcgtaaccc

SEQ ID NO: 6253 - DNA, 25 bp, S. cerevisiae
acgtgaatcctatgggacaacccag

SEQ ID NO: 6254 - DNA, 25 bp, S. cerevisiae
aggtattgcatgacccggaaatcgc

SEQ ID NO: 6255 - DNA, 25 bp, S. cerevisiae
aggagaaaccgttccactgtcacat

SEQ ID NO: 6256 - DNA, 25 bp, S. cerevisiae
aggatgctgaaagcgttcactccca

SEQ ID NO: 6257 - DNA, 25 bp, S. cerevisiae
aggattgcgaccttgttatcatggc

SEQ ID NO: 6258 - DNA, 25 bp, S. cerevisiae
aggaattatgctctgtccgatgcgc

SEQ ID NO: 6259 - DNA, 25 bp, S. cerevisiae
aggattctatcgaagctcacagaca

SEQ ID NO: 6260 - DNA, 25 bp, S. cerevisiae
cggttcctcagcagtcgaaagactt

SEQ ID NO: 6261 - DNA, 25 bp, S. cerevisiae
aggtcacggctgctgctaattcagt

SEQ ID NO: 6262 - DNA, 25 bp, S. cerevisiae
aggtcatcaggtgggctgaacgtta

SEQ ID NO: 6263 - DNA, 25 bp, S. cerevisiae
aggagccagctgatgactacgttct

SEQ ID NO: 6264 - DNA, 25 bp, S. cerevisiae
aggagccagcgcagaatcattcttt

SEQ ID NO: 6265 - DNA, 25 bp, S. cerevisiae
aggatggcaccaacacacagtgtgg

SEQ ID NO: 6266 - DNA, 25 bp, S. cerevisiae
aggaagcagtcacccatcagaggat

SEQ ID NO: 6267 - DNA, 25 bp, S. cerevisiae
aggatatggtccttgcgcaaagata

SEQ ID NO: 6268 - DNA, 25 bp, S. cerevisiae
aggacacctactacacttggcaagg

SEQ ID NO: 6269 - DNA, 25 bp, S. cerevisiae
aggacacactctggcgaaaaacctt

SEQ ID NO: 6270 - DNA, 25 bp, S. cerevisiae
aggactagctctgggcagcatcata

SEQ ID NO: 6271 - DNA, 25 bp, S. cerevisiae
aggaattttctaacgctgcaagtgg

SEQ ID NO: 6272 - DNA, 25 bp, S. cerevisiae
aggaagtttcgtccagcgcaaataa

SEQ ID NO: 6273 - DNA, 25 bp, S. cerevisiae
aggaggacccaaaccagcaagtacg

SEQ ID NO: 6274 - DNA, 25 bp, S. cerevisiae
aggaagatcgcctcctcaaagtaag

SEQ ID NO: 6275 - DNA, 25 bp, S. cerevisiae
aggagagcagcgactaccatgcaaa

SEQ ID NO: 6276 - DNA, 25 bp, S. cerevisiae
aggaggctggtcacatcggcataac

SEQ ID NO: 6277 - DNA, 25 bp, S. cerevisiae
aggcaatgcgcaactgcttcatttt

SEQ ID NO: 6278 - DNA, 25 bp, S. cerevisiae
aggatagtgtcaccgaatgttcgaa

SEQ ID NO: 6279 - DNA, 25 bp, S. cerevisiae
aggttccgtattctggatgtcacca

SEQ ID NO: 6280 - DNA, 25 bp, S. cerevisiae
aggttccattttcaatttcacacag

SEQ ID NO: 6281 - DNA, 25 bp, S. cerevisiae
aggtaagttgtaccctcttgcaacg

SEQ ID NO: 6282 - DNA, 25 bp, S. cerevisiae
aggaatacttcgaagctgccaacaa

SEQ ID NO: 6283 - DNA, 25 bp, S. cerevisiae
aggacatcaaaaccgctatcaacaa

SEQ ID NO: 6284 - DNA, 25 bp, S. cerevisiae
aggttgcaaaaacgcttcctcacgg

SEQ ID NO: 6285 - DNA, 25 bp, S. cerevisiae
aggttcaacggatgcgattccctgg

SEQ ID NO: 6286 - DNA, 25 bp, S. cerevisiae
aggatacaacggcacctatacactc

SEQ ID NO: 6287 - DNA, 25 bp, S. cerevisiae
aggaagctcccgtgagcacttctaa

SEQ ID NO: 6288 - DNA, 25 bp, S. cerevisiae
aggacatgtgcgtacgttgcgttta

SEQ ID NO: 6289 - DNA, 25 bp, S. cerevisiae
aggactatcgctgcccgatttgttt

SEQ ID NO: 6290 - DNA, 25 bp, S. cerevisiae
aggagtcttgatgccaagtgcttcc

SEQ ID NO: 6291 - DNA, 25 bp, S. cerevisiae
agggcttactgtcgttactttaatg

SEQ ID NO: 6292 - DNA, 25 bp, S. cerevisiae
aggagttacaaccaacagctgcatt

SEQ ID NO: 6293 - DNA, 25 bp, S. cerevisiae
aggagcttatccttcaacgtttgaa

SEQ ID NO: 6294 - DNA, 25 bp, S. cerevisiae
aggaatcacccttccaagagtggaa

SEQ ID NO: 6295 - DNA, 25 bp, S. cerevisiae
aggaagactgcgcttacaagacgaa

SEQ ID NO: 6296 - DNA, 25 bp, S. cerevisiae
aggagctcgtcatcttttgtcgaaa

SEQ ID NO: 6297 - DNA, 25 bp, S. cerevisiae
aggtctctctagtctttgggaacgt

SEQ ID NO: 6298 - DNA, 25 bp, S. cerevisiae
aggtttagacctttacagcaatttg

SEQ ID NO: 6299 - DNA, 25 bp, S. cerevisiae
aggtttccacttattgatgttcttc

SEQ ID NO: 6300 - DNA, 25 bp, S. cerevisiae
agggtttactacatcgtgcattctc

SEQ ID NO: 6301 - DNA, 25 bp, S. cerevisiae
aggtttttcaaactgcacggctcgc

SEQ ID NO: 6302 - DNA, 25 bp, S. cerevisiae
aggtttatacattggtgacgttgac

SEQ ID NO: 6303 - DNA, 25 bp, S. cerevisiae
aggtgccttgactaggttccttgga

SEQ ID NO: 6304 - DNA, 25 bp, S. cerevisiae
agggctcgcgatcaagattccattg

SEQ ID NO: 6305 - DNA, 25 bp, S. cerevisiae
aggttgtttccatctagcacttaca

SEQ ID NO: 6306 - DNA, 25 bp, S. cerevisiae
aggtttgttggctctatcattgata

SEQ ID NO: 6307 - DNA, 25 bp, S. cerevisiae
aggaattttcgcgtctcatttcata

SEQ ID NO: 6308 - DNA, 25 bp, S. cerevisiae
aggatattgctgtcgcggcatttgt

SEQ ID NO: 6309 - DNA, 25 bp, S. cerevisiae
aggtgtaggccatcaaacgggtatt

SEQ ID NO: 6310 - DNA, 25 bp, S. cerevisiae
aggtcaacgaaatgcgccgctggga

SEQ ID NO: 6311 - DNA, 25 bp, S. cerevisiae
aggaaaaacacgctcatcaacttga

SEQ ID NO: 6312 - DNA, 25 bp, S. cerevisiae
aggaaataacccctcaatcaattga

SEQ ID NO: 6313 - DNA, 25 bp, S. cerevisiae
aggaataccacatccgcaacaatcg

SEQ ID NO: 6314 - DNA, 25 bp, S. cerevisiae
aggacacaccacttttcaatgacac

SEQ ID NO: 6315 - DNA, 25 bp, S. cerevisiae
aggtgcctcaacatgttcttatcca

SEQ ID NO: 6316 - DNA, 25 bp, S. cerevisiae
aggagcgttccgaatacttgcagcg

SEQ ID NO: 6317 - DNA, 25 bp, S. cerevisiae
aggtagatgcctcttccagaacatt

SEQ ID NO: 6318 - DNA, 25 bp, S. cerevisiae
aggtaatgcccacgttagacagcgc

SEQ ID NO: 6319 - DNA, 25 bp, S. cerevisiae
agggaaccccaatcaagtattctag

SEQ ID NO: 6320 - DNA, 25 bp, S. cerevisiae
agggacctgtccaaatcaaatttca

SEQ ID NO: 6321 - DNA, 25 bp, S. cerevisiae
agggccacgttaaatatctgctttc

SEQ ID NO: 6322 - DNA, 25 bp, S. cerevisiae
aggagtacggttctgatctttttga

SEQ ID NO: 6323 - DNA, 25 bp, S. cerevisiae
aggaaacgtttttgccattggtgat

SEQ ID NO: 6324 - DNA, 25 bp, S. cerevisiae
aggacactttcctttagcaaagctt

SEQ ID NO: 6325 - DNA, 25 bp, S. cerevisiae
aggacatatattacgttccacgtga

SEQ ID NO: 6326 - DNA, 25 bp, S. cerevisiae
agggctcagtttggtttcaggtcac

SEQ ID NO: 6327 - DNA, 25 bp, S. cerevisiae
aggatttgtttttggccctcagcta

SEQ ID NO: 6328 - DNA, 25 bp, S. cerevisiae
aggtgtgtaatgatactgtgcccaa

SEQ ID NO: 6329 - DNA, 25 bp, S. cerevisiae
aggtatggtttccaccgacatatcg

SEQ ID NO: 6330 - DNA, 25 bp, S. cerevisiae
aggatgattggcttgtatccgtccc

SEQ ID NO: 6331 - DNA, 25 bp, S. cerevisiae
aggaaccacattctcagctgatatg

SEQ ID NO: 6332 - DNA, 25 bp, S. cerevisiae
aggagagccacttcattcgcttgtc

SEQ ID NO: 6333 - DNA, 25 bp, S. cerevisiae
aggagcagtatcacctcgatgtgcc

SEQ ID NO: 6334 - DNA, 25 bp, S. cerevisiae
aggacaatatgcagccttgtttcga

SEQ ID NO: 6335 - DNA, 25 bp, S. cerevisiae
aggatggccaactcatcggcaagat

SEQ ID NO: 6336 - DNA, 25 bp, S. cerevisiae
aggataggaccgtttgctgatgcaa

SEQ ID NO: 6337 - DNA, 25 bp, S. cerevisiae
aggaacgtcagattgcttggatcat

SEQ ID NO: 6338 - DNA, 25 bp, S. cerevisiae
aggatcttggactgctttttcaaca

SEQ ID NO: 6339 - DNA, 25 bp, S. cerevisiae
aggatgctatgctctttcattcttc

SEQ ID NO: 6340 - DNA, 25 bp, S. cerevisiae
aggagaccgtctacagattctgatc

SEQ ID NO: 6341 - DNA, 25 bp, S. cerevisiae
aggacacgtatcatccaatctgtaa

SEQ ID NO: 6342 - DNA, 25 bp, S. cerevisiae
aggagcccattctatcctatctaat

SEQ ID NO: 6343 - DNA, 25 bp, S. cerevisiae
aggattccattttccaacgcatcat

SEQ ID NO: 6344 - DNA, 25 bp, S. cerevisiae
aggacagagctctaacgcaacgaat

SEQ ID NO: 6345 - DNA, 25 bp, S. cerevisiae
aggtaatgcatctacctcccgttac

SEQ ID NO: 6346 - DNA, 25 bp, S. cerevisiae
agggaactaaccgagtctgtctcac

SEQ ID NO: 6347 - DNA, 25 bp, S. cerevisiae
agaggttgtaagagcgttttcagac

SEQ ID NO: 6348 - DNA, 25 bp, S. cerevisiae
aggttacgcgagatcttgtattcaa

SEQ ID NO: 6349 - DNA, 25 bp, S. cerevisiae
aggtctacgctagccaattttgata

SEQ ID NO: 6350 - DNA, 25 bp, S. cerevisiae
aggatcacaccttcgggccaatttg

SEQ ID NO: 6351 - DNA, 25 bp, S. cerevisiae
aggatggctcctacgaatcaagatt

SEQ ID NO: 6352 - DNA, 25 bp, S. cerevisiae
aggactgtccttctgctgacaaaga

SEQ ID NO: 6353 - DNA, 25 bp, S. cerevisiae
aggagtttcttctgtcacagacgct

SEQ ID NO: 6354 - DNA, 25 bp, S. cerevisiae
aggtacggtggccattctatgtctg

SEQ ID NO: 6355 - DNA, 25 bp, S. cerevisiae
agagtataaagtcgcactgcaaggt

SEQ ID NO: 6356 - DNA, 25 bp, S. cerevisiae
aggactattcatcattgctggccac

SEQ ID NO: 6357 - DNA, 25 bp, S. cerevisiae
aggatactaatgatggagcgccacc

SEQ ID NO: 6358 - DNA, 25 bp, S. cerevisiae
aggtagctcaatatggtgtcgaaac

SEQ ID NO: 6359 - DNA, 25 bp, S. cerevisiae
aggtccatcagtaagtcgtccaaga

SEQ ID NO: 6360 - DNA, 25 bp, S. cerevisiae
aggtggaaggccttaactgctgaag

SEQ ID NO: 6361 - DNA, 25 bp, S. cerevisiae
aggtctattgccattgaacttcaag

SEQ ID NO: 6362 - DNA, 25 bp, S. cerevisiae
aggtctagtcaagtctccaataaag

SEQ ID NO: 6363 - DNA, 25 bp, S. cerevisiae
aggtctacaccaccccaaagaagat

SEQ ID NO: 6364 - DNA, 25 bp, S. cerevisiae
aggactatccctacccagaggagat

SEQ ID NO: 6365 - DNA, 25 bp, S. cerevisiae
aggatcaatccctcacagacgtgaa

SEQ ID NO: 6366 - DNA, 25 bp, S. cerevisiae
aggaccattggctcaacctgcaaag

SEQ ID NO: 6367 - DNA, 25 bp, S. cerevisiae
aggacttccgttacagatttcactg

SEQ ID NO: 6368 - DNA, 25 bp, S. cerevisiae
aggagctctacgtcttcaagtttgg

SEQ ID NO: 6369 - DNA, 25 bp, S. cerevisiae
aggttcttcgttactgatttctggc

SEQ ID NO: 6370 - DNA, 25 bp, S. cerevisiae
agggtttggctcttggctatggtaa

SEQ ID NO: 6371 - DNA, 25 bp, S. cerevisiae
aggattattccatagatagtattga

SEQ ID NO: 6372 - DNA, 25 bp, S. cerevisiae
aggactattccatcgacagtgttga

SEQ ID NO: 6373 - DNA, 25 bp, S. cerevisiae
aggtcaccaatacactaagcagctt

SEQ ID NO: 6374 - DNA, 25 bp, S. cerevisiae
aggatcatccaaacacacttcacgt

SEQ ID NO: 6375 - DNA, 25 bp, S. cerevisiae
aggacatctataaccagcttcacat

SEQ ID NO: 6376 - DNA, 25 bp, S. cerevisiae
aggacgttcaagtcagcttcaatga

SEQ ID NO: 6377 - DNA, 25 bp, S. cerevisiae
aggtctcgtatcagcgctacaagga

SEQ ID NO: 6378 - DNA, 25 bp, S. cerevisiae
aggtcgttacggcatatagagctaa

SEQ ID NO: 6379 - DNA, 25 bp, S. cerevisiae
aggtcttgtaactcgattgcagttc

SEQ ID NO: 6380 - DNA, 25 bp, S. cerevisiae
aggagcggacttatcgtcgatgcta

SEQ ID NO: 6381 - DNA, 25 bp, S. cerevisiae
aggattcgatcccactcatggaaaa

SEQ ID NO: 6382 - DNA, 25 bp, S. cerevisiae
agggtggtcccctagcgatagagca

SEQ ID NO: 6383 - DNA, 25 bp, S. cerevisiae
aggacagtacgcatctaggctacaa

SEQ ID NO: 6384 - DNA, 25 bp, S. cerevisiae
aggacagaccgcataagtgccctat

SEQ ID NO: 6385 - DNA, 25 bp, S. cerevisiae
agtcagaaccttttgggcctgttga

SEQ ID NO: 6386 - DNA, 25 bp, S. cerevisiae
agtcgccaagcatagggttcgttaa

SEQ ID NO: 6387 - DNA, 25 bp, S. cerevisiae
agctcaagaagctcagaggtgggaa

SEQ ID NO: 6388 - DNA, 25 bp, S. cerevisiae
agtgtcaacagcgtcaatggctccg

SEQ ID NO: 6389 - DNA, 25 bp, S. cerevisiae
aggtcaacgagaactctgctccaga

SEQ ID NO: 6390 - DNA, 25 bp, S. cerevisiae
aggtaccatatgtcgtctgccctga

SEQ ID NO: 6391 - DNA, 25 bp, S. cerevisiae
aggtaccaagttcctttgctgacta

SEQ ID NO: 6392 - DNA, 25 bp, S. cerevisiae
aggtacctctggctttacatcaatg

SEQ ID NO: 6393 - DNA, 25 bp, S. cerevisiae
aggagaaccatccttcattagcccg

SEQ ID NO: 6394 - DNA, 25 bp, S. cerevisiae
agggtagcgtcgttgcactctcaaa

SEQ ID NO: 6395 - DNA, 25 bp, S. cerevisiae
aggagttttctctgtcattcaagac

SEQ ID NO: 6396 - DNA, 25 bp, S. cerevisiae
aggagcatttgttgcagcaggcttc

SEQ ID NO: 6397 - DNA, 25 bp, S. cerevisiae
aggagcttcctccatatggctacat

SEQ ID NO: 6398 - DNA, 25 bp, S. cerevisiae
aggatcattttcgtgcatctgtaat

SEQ ID NO: 6399 - DNA, 25 bp, S. cerevisiae
aggatggttctcgtgcagtggatat

SEQ ID NO: 6400 - DNA, 25 bp, S. cerevisiae
aggatcctcatccattcttgcaact

SEQ ID NO: 6401 - DNA, 25 bp, S. cerevisiae
aggagccattacatcatctgccagc

SEQ ID NO: 6402 - DNA, 25 bp, S. cerevisiae
aggttcagctgtgagactgcctggt

SEQ ID NO: 6403 - DNA, 25 bp, S. cerevisiae
aggtgcaatcgcaaaagagggaatt

SEQ ID NO: 6404 - DNA, 25 bp, S. cerevisiae
aggtcactgagcatcccacaaaatt

SEQ ID NO: 6405 - DNA, 25 bp, S. cerevisiae
agtgacaatttgtttattcgtagat

SEQ ID NO: 6406 - DNA, 25 bp, S. cerevisiae
aggacgatttgctctttactaacta

SEQ ID NO: 6407 - DNA, 25 bp, S. cerevisiae
aggatcacttctgccctatttgtaa

SEQ ID NO: 6408 - DNA, 25 bp, S. cerevisiae
acccctttccctgagtgtatcaaga

SEQ ID NO: 6409 - DNA, 25 bp, S. cerevisiae
agttcctttcggtgggttcaatgca

SEQ ID NO: 6410 - DNA, 25 bp, S. cerevisiae
aggactgtttacctgggcagcttgc

SEQ ID NO: 6411 - DNA, 25 bp, S. cerevisiae
aggtcatgcctccaagactgatgtt

SEQ ID NO: 6412 - DNA, 25 bp, S. cerevisiae
aggatagctcgatcgcagatacgcg

SEQ ID NO: 6413 - DNA, 25 bp, S. cerevisiae
aggatagccgctagcgccatggcca

SEQ ID NO: 6414 - DNA, 25 bp, S. cerevisiae
aggtattgcagaagcctctgcccaa

SEQ ID NO: 6415 - DNA, 25 bp, S. cerevisiae
aggtgttgcaaagatctcggcgtcg

SEQ ID NO: 6416 - DNA, 25 bp, S. cerevisiae
aggtctagctagttattcccagttg

SEQ ID NO: 6417 - DNA, 25 bp, S. cerevisiae
aggtgggttgttatcctcatggaac

SEQ ID NO: 6418 - DNA, 25 bp, S. cerevisiae
agggcacggcgtttggacgccataa

SEQ ID NO: 6419 - DNA, 25 bp, S. cerevisiae
aggtgctttggactggtacccaatc

SEQ ID NO: 6420 - DNA, 25 bp, S. cerevisiae
agaggatttggatagtgacttattc

SEQ ID NO: 6421 - DNA, 25 bp, S. cerevisiae
aggatacgtggcatgctacccgtgt

SEQ ID NO: 6422 - DNA, 25 bp, S. cerevisiae
aggtgctagaactgctaccgtttct

SEQ ID NO: 6423 - DNA, 25 bp, S. cerevisiae
aggtgaaacactggccaacgtttat

SEQ ID NO: 6424 - DNA, 25 bp, S. cerevisiae
aggtgaatccatctcaaacgctctt

SEQ ID NO: 6425 - DNA, 25 bp, S. cerevisiae
aggatattccagctttggtctctgt

SEQ ID NO: 6426 - DNA, 25 bp, S. cerevisiae
aggtttccggaactcgcaatgctaa

SEQ ID NO: 6427 - DNA, 25 bp, S. cerevisiae
aggttaccaatttgctgctgctctg

SEQ ID NO: 6428 - DNA, 25 bp, S. cerevisiae
aggtctacgcacagcagtcgactgt

SEQ ID NO: 6429 - DNA, 25 bp, S. cerevisiae
aggttaccagagtcgtcggtgccaa

SEQ ID NO: 6430 - DNA, 25 bp, S. cerevisiae
agttttacggcgattccccatatat

SEQ ID NO: 6431 - DNA, 25 bp, S. cerevisiae
agattttaaggcctttcttgccgca

SEQ ID NO: 6432 - DNA, 25 bp, S. cerevisiae
aggtttaggtgccttctattctcca

SEQ ID NO: 6433 - DNA, 25 bp, S. cerevisiae
aggttgaccgggatgtctgctgcta

SEQ ID NO: 6434 - DNA, 25 bp, S. cerevisiae
aggagagaaccccattgctcgtgta

SEQ ID NO: 6435 - DNA, 25 bp, S. cerevisiae
aggataccttcctgatcttgagagg

SEQ ID NO: 6436 - DNA, 25 bp, S. cerevisiae
aggacctatgacatttctctcacag

SEQ ID NO: 6437 - DNA, 25 bp, S. cerevisiae
aggagattttctccgatccagaaaa

SEQ ID NO: 6438 - DNA, 25 bp, S. cerevisiae
agggcaacagaactcgtcgaagcaa

SEQ ID NO: 6439 - DNA, 25 bp, S. cerevisiae
aggattcaaatctgctggctacgaa

SEQ ID NO: 6440 - DNA, 25 bp, S. cerevisiae
agggcaatagccgttataggtcgaa

SEQ ID NO: 6441 - DNA, 25 bp, S. cerevisiae
agggatatcggcgtcttggaactat

SEQ ID NO: 6442 - DNA, 25 bp, S. cerevisiae
aggtatacctgttttgcggcactct

SEQ ID NO: 6443 - DNA, 25 bp, S. cerevisiae
aggttaccgctttgtacgcacgtag

SEQ ID NO: 6444 - DNA, 25 bp, S. cerevisiae
aggattcaacagctaattctcccgc

SEQ ID NO: 6445 - DNA, 25 bp, S. cerevisiae
aggtttttgtctgagatcgcctctc

SEQ ID NO: 6446 - DNA, 25 bp, S. cerevisiae
aggttttaccttgacatccagagat

SEQ ID NO: 6447 - DNA, 25 bp, S. cerevisiae
aggattttaacttctctgattctga

SEQ ID NO: 6448 - DNA, 25 bp, S. cerevisiae
aggttttgaagatctccaccagaaa

SEQ ID NO: 6449 - DNA, 25 bp, S. cerevisiae
agggtgttaatatcctcgccagtaa

SEQ ID NO: 6450 - DNA, 25 bp, S. cerevisiae
aggtgcttataacccagacactggt

SEQ ID NO: 6451 - DNA, 25 bp, S. cerevisiae
aggagcttattttgacgcccgaaca

SEQ ID NO: 6452 - DNA, 25 bp, S. cerevisiae
aggagtttttaagcaccgcctcata

SEQ ID NO: 6453 - DNA, 25 bp, S. cerevisiae
aggatgtctttggaaagcctcccct

SEQ ID NO: 6454 - DNA, 25 bp, S. cerevisiae
aggttgctttatgaggccttcccaa

SEQ ID NO: 6455 - DNA, 25 bp, S. cerevisiae
aggagctgtcctaacttcaatgtcg

SEQ ID NO: 6456 - DNA, 25 bp, S. cerevisiae
aggagtcaccacaatttctacaagt

SEQ ID NO: 6457 - DNA, 25 bp, S. cerevisiae
agggaacgtccaccgatgatgcaat

SEQ ID NO: 6458 - DNA, 25 bp, S. cerevisiae
agggaactcctctatcaaggtgctc

SEQ ID NO: 6459 - DNA, 25 bp, S. cerevisiae
aggagtcatattttcgctaccaacg

SEQ ID NO: 6460 - DNA, 25 bp, S. cerevisiae
aggatgctatcaccactcaaattat

SEQ ID NO: 6461 - DNA, 25 bp, S. cerevisiae
aggagtcagcttaccaaacgatggt

SEQ ID NO: 6462 - DNA, 25 bp, S. cerevisiae
aggattttgctaggcttatcaggga

SEQ ID NO: 6463 - DNA, 25 bp, S. cerevisiae
aggagtttgcttctacttcgaacgg

SEQ ID NO: 6464 - DNA, 25 bp, S. cerevisiae
aggagatttttcacactttaccaga

SEQ ID NO: 6465 - DNA, 25 bp, S. cerevisiae
agggttctacgtccattacttgtga

SEQ ID NO: 6466 - DNA, 25 bp, S. cerevisiae
aggtccaacatcgtatcactacttt

SEQ ID NO: 6467 - DNA, 25 bp, S. cerevisiae
aggtgcgaaatacgtcttacaatca

SEQ ID NO: 6468 - DNA, 25 bp, S. cerevisiae
aggattctgtcattctagcgtcttc

SEQ ID NO: 6469 - DNA, 25 bp, S. cerevisiae
agtgattcgatagctggccctacgc

SEQ ID NO: 6470 - DNA, 25 bp, S. cerevisiae
aggtgttaaagcatatgttgccttt

SEQ ID NO: 6471 - DNA, 25 bp, S. cerevisiae
agggtccccatgatatggctcgatg

SEQ ID NO: 6472 - DNA, 25 bp, S. cerevisiae
aggatttttcctttccattggcatg

SEQ ID NO: 6473 - DNA, 25 bp, S. cerevisiae
aggatcgactgccaatctttctttg

SEQ ID NO: 6474 - DNA, 25 bp, S. cerevisiae
aggatggaacctcttgttagtaaag

SEQ ID NO: 6475 - DNA, 25 bp, S. cerevisiae
aggaggcaactctcttttgatttat

SEQ ID NO: 6476 - DNA, 25 bp, S. cerevisiae
agaggtaacaacatcggttcgcctt

SEQ ID NO: 6477 - DNA, 25 bp, S. cerevisiae
agatgtttgaccgtctagggtggcc

SEQ ID NO: 6478 - DNA, 25 bp, S. cerevisiae
aggatttaccatcatcgggttccca

SEQ ID NO: 6479 - DNA, 25 bp, S. cerevisiae
aggtacatttctactcagccaattg

SEQ ID NO: 6480 - DNA, 25 bp, S. cerevisiae
agggagttcctgatcaagccattgc

SEQ ID NO: 6481 - DNA, 25 bp, S. cerevisiae
agcgaactacccgaaatgctttcac

SEQ ID NO: 6482 - DNA, 25 bp, S. cerevisiae
aggtgtatatgtgcccaatgattta

SEQ ID NO: 6483 - DNA, 25 bp, S. cerevisiae
aggtaatcatatcgtcctttcctcc

SEQ ID NO: 6484 - DNA, 25 bp, S. cerevisiae
aggttgccgaaattattctccgcta

SEQ ID NO: 6485 - DNA, 25 bp, S. cerevisiae
aggtttgcgaatttatgatctccca

SEQ ID NO: 6486 - DNA, 25 bp, S. cerevisiae
aggtcatcaagcacaggcactggga

SEQ ID NO: 6487 - DNA, 25 bp, S. cerevisiae
aggttctaccacaagatcttcgaag

SEQ ID NO: 6488 - DNA, 25 bp, S. cerevisiae
aggatgggcaccattacttgcactt

SEQ ID NO: 6489 - DNA, 25 bp, S. cerevisiae
aggatcggcctcacaagtgtcccat

SEQ ID NO: 6490 - DNA, 25 bp, S. cerevisiae
aggttccacttgtcttatcgacgac

SEQ ID NO: 6491 - DNA, 25 bp, S. cerevisiae
agggtcaacctgtgttcgatgcatc

SEQ ID NO: 6492 - DNA, 25 bp, S. cerevisiae
aggttaaccttactacgatatcatt

SEQ ID NO: 6493 - DNA, 25 bp, S. cerevisiae
aggttaacacattggccatcaggta

SEQ ID NO: 6494 - DNA, 25 bp, S. cerevisiae
aggtcagatacgatcctgtggtgaa

SEQ ID NO: 6495 - DNA, 25 bp, S. cerevisiae
aggtcaatgggtacttcgcgtgtca

SEQ ID NO: 6496 - DNA, 25 bp, S. cerevisiae
aggtttggtaatttgccggctcaat

SEQ ID NO: 6497 - DNA, 25 bp, S. cerevisiae
aggtttgccattatgcctgggtcaa

SEQ ID NO: 6498 - DNA, 25 bp, S. cerevisiae
aggtttcctgttcatctgggccaat

SEQ ID NO: 6499 - DNA, 25 bp, S. cerevisiae
aggtttcaaatatatctggatgaca

SEQ ID NO: 6500 - DNA, 25 bp, S. cerevisiae
aggtatcgtacatctgcttggtcac

SEQ ID NO: 6501 - DNA, 25 bp, S. cerevisiae
aggtattgattctccgtggtacttt

SEQ ID NO: 6502 - DNA, 25 bp, S. cerevisiae
aggtcaaatctctgctggttactct

SEQ ID NO: 6503 - DNA, 25 bp, S. cerevisiae
aggtgcatttctgttgggtagctat

SEQ ID NO: 6504 - DNA, 25 bp, S. cerevisiae
aggtttaactctgtgccgatcgcta

SEQ ID NO: 6505 - DNA, 25 bp, S. cerevisiae
agggtgaacctcagagtacatcgat

SEQ ID NO: 6506 - DNA, 25 bp, S. cerevisiae
agggatatcccgcaagtattccatc

SEQ ID NO: 6507 - DNA, 25 bp, S. cerevisiae
agggagacaccgtctacattgtcca

SEQ ID NO: 6508 - DNA, 25 bp, S. cerevisiae
aggtagcaacagctgttctttccac

SEQ ID NO: 6509 - DNA, 25 bp, S. cerevisiae
agggtattcgtacacagatgccaat

SEQ ID NO: 6510 - DNA, 25 bp, S. cerevisiae
aggttcattcagaccattccgtaat

SEQ ID NO: 6511 - DNA, 25 bp, S. cerevisiae
aggtgtctctagtaaatccaataac

SEQ ID NO: 6512 - DNA, 25 bp, S. cerevisiae
aggtctccaccgttgatcgaaggga

SEQ ID NO: 6513 - DNA, 25 bp, S. cerevisiae
aggatctacctctctgatcgaaggt

SEQ ID NO: 6514 - DNA, 25 bp, S. cerevisiae
aggtttcaagattgccctcgagctt

SEQ ID NO: 6515 - DNA, 25 bp, S. cerevisiae
aggataccgctgaaatcaccgctta

SEQ ID NO: 6516 - DNA, 25 bp, S. cerevisiae
aggttggcaatgaccacatggaatt

SEQ ID NO: 6517 - DNA, 25 bp, S. cerevisiae
aggatctcctgcatattctccaaag

SEQ ID NO: 6518 - DNA, 25 bp, S. cerevisiae
aggatctgcacgactttactgccaa

SEQ ID NO: 6519 - DNA, 25 bp, S. cerevisiae
aggtcgacattgctttgccatgtgc

SEQ ID NO: 6520 - DNA, 25 bp, S. cerevisiae
aggtaatctggcttctggtggtgca

SEQ ID NO: 6521 - DNA, 25 bp, S. cerevisiae
aggtaatctagcttctgcagcggct

SEQ ID NO: 6522 - DNA, 25 bp, S. cerevisiae
aggtattaacttcagcggcttaaat

SEQ ID NO: 6523 - DNA, 25 bp, S. cerevisiae
aggatccgtttctcccaatgatgat

SEQ ID NO: 6524 - DNA, 25 bp, S. cerevisiae
aggatcacagttacttcgccttatc

SEQ ID NO: 6525 - DNA, 25 bp, S. cerevisiae
aggatcacgttccttctgccaacat

SEQ ID NO: 6526 - DNA, 25 bp, S. cerevisiae
aggtgccattttcatccaaagcgta

SEQ ID NO: 6527 - DNA, 25 bp, S. cerevisiae
aggtagcatggtcgcaacccacaga

SEQ ID NO: 6528 - DNA, 25 bp, S. cerevisiae
agggtgcattgtcgatacgccatca

SEQ ID NO: 6529 - DNA, 25 bp, S. cerevisiae
agggagctcgtttacttcaaggtgg

SEQ ID NO: 6530 - DNA, 25 bp, S. cerevisiae
agggtccagcaatactttgagcctg

SEQ ID NO: 6531 - DNA, 25 bp, S. cerevisiae
agggtcccagtcacagttgagcgaa

SEQ ID NO: 6532 - DNA, 25 bp, S. cerevisiae
aggatttgccatttccagattagaa

SEQ ID NO: 6533 - DNA, 25 bp, S. cerevisiae
aggtaacccttgaatccatggattt

SEQ ID NO: 6534 - DNA, 25 bp, S. cerevisiae
aggtgtcacctcgtggagcaggtta

SEQ ID NO: 6535 - DNA, 25 bp, S. cerevisiae
aggattccatgggtttctgcgtaaa

SEQ ID NO: 6536 - DNA, 25 bp, S. cerevisiae
aggtctaatcaaggccttctccgaa

SEQ ID NO: 6537 - DNA, 25 bp, S. cerevisiae
aggtctaccatggaggttgcccagt

SEQ ID NO: 6538 - DNA, 25 bp, S. cerevisiae
aggtctaccgacaattttcacaatt

SEQ ID NO: 6539 - DNA, 25 bp, S. cerevisiae
aggtcaagccggaacgcttccatat

SEQ ID NO: 6540 - DNA, 25 bp, S. cerevisiae
cggtaccagtggacaagttctagtt

SEQ ID NO: 6541 - DNA, 25 bp, S. cerevisiae
aggtcacacgatgtcaagtttacga

SEQ ID NO: 6542 - DNA, 25 bp, S. cerevisiae
aggtcaacgtcgaaggtttgccaag

SEQ ID NO: 6543 - DNA, 25 bp, S. cerevisiae
aggtcctccaccaggtgttaacaat

SEQ ID NO: 6544 - DNA, 25 bp, S. cerevisiae
aggtcttcctccttattatgatgaa

SEQ ID NO: 6545 - DNA, 25 bp, S. cerevisiae
aggtgcgtcattaccattgttgaaa

SEQ ID NO: 6546 - DNA, 25 bp, S. cerevisiae
agttcaggccctgtttgggacattt

SEQ ID NO: 6547 - DNA, 25 bp, S. cerevisiae
agggtgctgacgaccgtcttgaagc

SEQ ID NO: 6548 - DNA, 25 bp, S. cerevisiae
aggtcttactgatgcgcccgagagc

SEQ ID NO: 6549 - DNA, 25 bp, S. cerevisiae
aggtggtccaatccgcaatttagca

SEQ ID NO: 6550 - DNA, 25 bp, S. cerevisiae
aggtgtttcacccagttgtctagca

SEQ ID NO: 6551 - DNA, 25 bp, S. cerevisiae
aggttgtgcagctgccatggtgctt

SEQ ID NO: 6552 - DNA, 25 bp, S. cerevisiae
aggtcatgccactaccgttattgat

SEQ ID NO: 6553 - DNA, 25 bp, S. cerevisiae
aggtctgctcgaacaaatcgcttga

SEQ ID NO: 6554 - DNA, 25 bp, S. cerevisiae
aggttgccgcaacaacagcagttgt

SEQ ID NO: 6555 - DNA, 25 bp, S. cerevisiae
agtgattaatcctcaacagctgttg

SEQ ID NO: 6556 - DNA, 25 bp, S. cerevisiae
aggttccattgctacattgacgtta

SEQ ID NO: 6557 - DNA, 25 bp, S. cerevisiae
agggcccttctgataacgctacaag

SEQ ID NO: 6558 - DNA, 25 bp, S. cerevisiae
aggtgctgccttcgcttgataaaga

SEQ ID NO: 6559 - DNA, 25 bp, S. cerevisiae
agggcagccttgattttagcagaca

SEQ ID NO: 6560 - DNA, 25 bp, S. cerevisiae
aggttaatacctccgctgagaatgt

SEQ ID NO: 6561 - DNA, 25 bp, S. cerevisiae
aggtgtaaacgcacacggacgtcct

SEQ ID NO: 6562 - DNA, 25 bp, S. cerevisiae
aggttttcaagtggccgatggtccg

SEQ ID NO: 6563 - DNA, 25 bp, S. cerevisiae
aggtttatcatcatcgccgatggct

SEQ ID NO: 6564 - DNA, 25 bp, S. cerevisiae
aggtttatcatttggcagcggcttc

SEQ ID NO: 6565 - DNA, 25 bp, S. cerevisiae
aggtgttcactttgctgacgactat

SEQ ID NO: 6566 - DNA, 25 bp, S. cerevisiae
aggtcgtatcctttcgacagtgtca

SEQ ID NO: 6567 - DNA, 25 bp, S. cerevisiae
aggtcgcttatccaattacttctaa

SEQ ID NO: 6568 - DNA, 25 bp, S. cerevisiae
aggattctttccatgaggcactata

SEQ ID NO: 6569 - DNA, 25 bp, S. cerevisiae
aggtgttttcacagctggaatcaca

SEQ ID NO: 6570 - DNA, 25 bp, S. cerevisiae
aggtttattccatggctttcaacaa

SEQ ID NO: 6571 - DNA, 25 bp, S. cerevisiae
aggtcgctatggtcgtatgttatgc

SEQ ID NO: 6572 - DNA, 25 bp, S. cerevisiae
aggtgtcgcagaacttattccaggt

SEQ ID NO: 6573 - DNA, 25 bp, S. cerevisiae
aggtcgtggtacattcctcagggag

SEQ ID NO: 6574 - DNA, 25 bp, S. cerevisiae
aggtcgttatacaggcccgagctaa

SEQ ID NO: 6575 - DNA, 25 bp, S. cerevisiae
aggtggtgtagcaacgccagccgat

SEQ ID NO: 6576 - DNA, 25 bp, S. cerevisiae
aaactatcaagcacgtcaaggacct

SEQ ID NO: 6577 - DNA, 25 bp, S. cerevisiae
agaagcaacaacaggacttagatcc

SEQ ID NO: 6578 - DNA, 25 bp, S. cerevisiae
aggtctgacatagcggatcttatta

SEQ ID NO: 6579 - DNA, 25 bp, S. cerevisiae
agggctcatcaaaccgagttgactc

SEQ ID NO: 6580 - DNA, 25 bp, S. cerevisiae
agggcatcaaccgaagagcttttac

SEQ ID NO: 6581 - DNA, 25 bp, S. cerevisiae
aggtgtcggtgtcatcttgtgtatc

SEQ ID NO: 6582 - DNA, 25 bp, S. cerevisiae
aggttctgcgttggacttcatgtac

SEQ ID NO: 6583 - DNA, 25 bp, S. cerevisiae
aggtattcctccacgtactattgat

SEQ ID NO: 6584 - DNA, 25 bp, S. cerevisiae
aggttatccggcacaggcagttctg

SEQ ID NO: 6585 - DNA, 25 bp, S. cerevisiae
aggtctaccggcagtcgcaatttgg

SEQ ID NO: 6586 - DNA, 25 bp, S. cerevisiae
agggctccaagcgtttagttgattt

SEQ ID NO: 6587 - DNA, 25 bp, S. cerevisiae
agggtaacgctgttctaattgctgt

SEQ ID NO: 6588 - DNA, 25 bp, S. cerevisiae
aggtacagccgtctacaatgtgtgt

SEQ ID NO: 6589 - DNA, 25 bp, S. cerevisiae
aggtccgcgcccgttaatggtgcga

SEQ ID NO: 6590 - DNA, 25 bp, S. cerevisiae
agggtatttctgtgtttgactctaa

SEQ ID NO: 6591 - DNA, 25 bp, S. cerevisiae
agggttgctatttcgattctgatac

SEQ ID NO: 6592 - DNA, 25 bp, S. cerevisiae
agggtcttcaggacgagatttcaag

SEQ ID NO: 6593 - DNA, 25 bp, S. cerevisiae
aggtgttcaagccatccatgtgcgt

SEQ ID NO: 6594 - DNA, 25 bp, S. cerevisiae
agttggctaaagtctcattcgataa

SEQ ID NO: 6595 - DNA, 25 bp, S. cerevisiae
agtggagattaaccctttgagtgaa

SEQ ID NO: 6596 - DNA, 25 bp, S. cerevisiae
aggtgatgttaaccccaagactggt

SEQ ID NO: 6597 - DNA, 25 bp, S. cerevisiae
aggtgttccctcacacaatagtgtt

SEQ ID NO: 6598 - DNA, 25 bp, S. cerevisiae
aggtgattcgttttaccatcctgtt

SEQ ID NO: 6599 - DNA, 25 bp, S. cerevisiae
agggtgtggctataaacttcattac

SEQ ID NO: 6600 - DNA, 25 bp, S. cerevisiae
agtgggctagtatcaatgcttttta

SEQ ID NO: 6601 - DNA, 25 bp, S. cerevisiae
aggtcctattatccatctgttcttt

SEQ ID NO: 6602 - DNA, 25 bp, S. cerevisiae
agtatcgttacgttcaagggacatt

SEQ ID NO: 6603 - DNA, 25 bp, S. cerevisiae
agtgacgtttgctggacaggcgttc

SEQ ID NO: 6604 - DNA, 25 bp, S. cerevisiae
aggtactgatactggattgccctca

SEQ ID NO: 6605 - DNA, 25 bp, S. cerevisiae
agggaactcgatactttgcagcaaa

SEQ ID NO: 6606 - DNA, 25 bp, S. cerevisiae
agggtactggtacttgccgcgacaa

SEQ ID NO: 6607 - DNA, 25 bp, S. cerevisiae
agggtatctggcacttcggtcacaa

SEQ ID NO: 6608 - DNA, 25 bp, S. cerevisiae
agtgggtctggctttacggctactt

SEQ ID NO: 6609 - DNA, 25 bp, S. cerevisiae
aggtgacttggctggtactgctact

SEQ ID NO: 6610 - DNA, 25 bp, S. cerevisiae
agggatctatttttgctatcggcga

SEQ ID NO: 6611 - DNA, 25 bp, S. cerevisiae
aggtgtccagtatcatcggcggtaa

SEQ ID NO: 6612 - DNA, 25 bp, S. cerevisiae
aggttcacaatactctctgctctaa

SEQ ID NO: 6613 - DNA, 25 bp, S. cerevisiae
aggtatagtcaacttcgcatccact

SEQ ID NO: 6614 - DNA, 25 bp, S. cerevisiae
aggtggtgctaacttcgactcttct

SEQ ID NO: 6615 - DNA, 25 bp, S. cerevisiae
agggtttcgacagagcctttgcaaa

SEQ ID NO: 6616 - DNA, 25 bp, S. cerevisiae
aggtatttcttcttctgctattcca

SEQ ID NO: 6617 - DNA, 25 bp, S. cerevisiae
agtggcggattcgaactggagattc

SEQ ID NO: 6618 - DNA, 25 bp, S. cerevisiae
agggcgaattccacccagtattgtt

SEQ ID NO: 6619 - DNA, 25 bp, S. cerevisiae
agagccacaacccttggactttggt

SEQ ID NO: 6620 - DNA, 25 bp, S. cerevisiae
agtggttctcacgacggaagcatta

SEQ ID NO: 6621 - DNA, 25 bp, S. cerevisiae
agggttgccaaaacgcaagacaaca

SEQ ID NO: 6622 - DNA, 25 bp, S. cerevisiae
agggttccaatcgttgaagatcgtc

SEQ ID NO: 6623 - DNA, 25 bp, S. cerevisiae
agggctcctgaaactttacttgtgc

SEQ ID NO: 6624 - DNA, 25 bp, S. cerevisiae
aggtccctgattttttgcacttgga

SEQ ID NO: 6625 - DNA, 25 bp, S. cerevisiae
agggactatgctgtcttcgaaccag

SEQ ID NO: 6626 - DNA, 25 bp, S. cerevisiae
aggtgacaactcaatcctctaaccc

SEQ ID NO: 6627 - DNA, 25 bp, S. cerevisiae
aggtcacagaatttgctcagcgctt

SEQ ID NO: 6628 - DNA, 25 bp, S. cerevisiae
agtgtaaatgctttgctgcctatcg

SEQ ID NO: 6629 - DNA, 25 bp, S. cerevisiae
agtgctggaatggtccgcgcagatc

SEQ ID NO: 6630 - DNA, 25 bp, S. cerevisiae
agtggtgatagctttgtcgaatttt

SEQ ID NO: 6631 - DNA, 25 bp, S. cerevisiae
agtggttgactggtgtcgaattagc

SEQ ID NO: 6632 - DNA, 25 bp, S. cerevisiae
agtggttgactggtcctcaattggc

SEQ ID NO: 6633 - DNA, 25 bp, S. cerevisiae
agggaagatctaatcgctcttttag

SEQ ID NO: 6634 - DNA, 25 bp, S. cerevisiae
agggaaattcatatctctatgtaaa

SEQ ID NO: 6635 - DNA, 25 bp, S. cerevisiae
agtggactacctttgacgcatgata

SEQ ID NO: 6636 - DNA, 25 bp, S. cerevisiae
agatgaaccgccagtacgtgatccg

SEQ ID NO: 6637 - DNA, 25 bp, S. cerevisiae
agtacctggcgtgatagcggtccat

SEQ ID NO: 6638 - DNA, 25 bp, S. cerevisiae
aggtcactgtggatctcgatgttat

SEQ ID NO: 6639 - DNA, 25 bp, S. cerevisiae
aggtcactgcggttgtggtttcata

SEQ ID NO: 6640 - DNA, 25 bp, S. cerevisiae
aggtaggtggtttttgtctcattga

SEQ ID NO: 6641 - DNA, 25 bp, S. cerevisiae
aggtggcttttctactttatcttca

SEQ ID NO: 6642 - DNA, 25 bp, S. cerevisiae
agtgggattccaaagatttacgctc

SEQ ID NO: 6643 - DNA, 25 bp, S. cerevisiae
agtgggcatatctcacgttgtcacc

SEQ ID NO: 6644 - DNA, 25 bp, S. cerevisiae
aggtgctgatattttccttattcac

SEQ ID NO: 6645 - DNA, 25 bp, S. cerevisiae
taggcctaaaacagcttttcccaag

SEQ ID NO: 6646 - DNA, 25 bp, S. cerevisiae
agggctatttcatgtggctatccat

SEQ ID NO: 6647 - DNA, 25 bp, S. cerevisiae
agggctattttagggttgtgcatac

SEQ ID NO: 6648 - DNA, 25 bp, S. cerevisiae
agggttttcttggtggtgcgtcata

SEQ ID NO: 6649 - DNA, 25 bp, S. cerevisiae
aggtatttctattgatgatcatccg

SEQ ID NO: 6650 - DNA, 25 bp, S. cerevisiae
aggtatgtctgtcgtagcttctcgc

SEQ ID NO: 6651 - DNA, 25 bp, S. cerevisiae
aggtatgccatccagtgggtcctat

SEQ ID NO: 6652 - DNA, 25 bp, S. cerevisiae
aggtctctggagtgagactctgaac

SEQ ID NO: 6653 - DNA, 25 bp, S. cerevisiae
agtgcatctggagaaaactactgat

SEQ ID NO: 6654 - DNA, 25 bp, S. cerevisiae
aggtgctggatcctgaacatgtgca

SEQ ID NO: 6655 - DNA, 25 bp, S. cerevisiae
agggaatgatcaccaacttgcaaag

SEQ ID NO: 6656 - DNA, 25 bp, S. cerevisiae
agggtcatgaccgtaccgaagaggt

SEQ ID NO: 6657 - DNA, 25 bp, S. cerevisiae
cgtggccgaccgaaccgaagatgat

SEQ ID NO: 6658 - DNA, 25 bp, S. cerevisiae
agggcccacaacagacgtcaatgat

SEQ ID NO: 6659 - DNA, 25 bp, S. cerevisiae
ggtgcccaaacgagacagccaggta

SEQ ID NO: 6660 - DNA, 25 bp, S. cerevisiae
agtctggtccacttaatagcgagtt

SEQ ID NO: 6661 - DNA, 25 bp, S. cerevisiae
agtcgggctcacagactttggttga

SEQ ID NO: 6662 - DNA, 25 bp, S. cerevisiae
agtcgggtactcgtggtttgatctt

SEQ ID NO: 6663 - DNA, 25 bp, S. cerevisiae
agtcgagaattttccgttgcggcct

SEQ ID NO: 6664 - DNA, 25 bp, S. cerevisiae
aggtccttccctttcatactatata

SEQ ID NO: 6665 - DNA, 25 bp, S. cerevisiae
aggtccttctttttgctgccaaatt

SEQ ID NO: 6666 - DNA, 25 bp, S. cerevisiae
aggtactgtcagtggtgctccaaag

SEQ ID NO: 6667 - DNA, 25 bp, S. cerevisiae
agtgcaaagttattggctccccaag

SEQ ID NO: 6668 - DNA, 25 bp, S. cerevisiae
agtcagaacctatgttaccccagat

SEQ ID NO: 6669 - DNA, 25 bp, S. cerevisiae
agtggtgtttcgttctggaccaacg

SEQ ID NO: 6670 - DNA, 25 bp, S. cerevisiae
aggtgaccacattatcgagctgaca

SEQ ID NO: 6671 - DNA, 25 bp, S. cerevisiae
aggtagtgtcatacgcttatgcgat

SEQ ID NO: 6672 - DNA, 25 bp, S. cerevisiae
aggtcgctgtctaacgttgcatgca

SEQ ID NO: 6673 - DNA, 25 bp, S. cerevisiae
aggtgcctctatatcttctgcacag

SEQ ID NO: 6674 - DNA, 25 bp, S. cerevisiae
aggtactgtatccacttcagcatca

SEQ ID NO: 6675 - DNA, 25 bp, S. cerevisiae
aggtgatctctacgagcattgccca

SEQ ID NO: 6676 - DNA, 25 bp, S. cerevisiae
aggtgccgatcatacagtccgtgta

SEQ ID NO: 6677 - DNA, 25 bp, S. cerevisiae
agtggcacagacagacgctacggct

SEQ ID NO: 6678 - DNA, 25 bp, S. cerevisiae
agggcgaatactacaccagattttt

SEQ ID NO: 6679 - DNA, 25 bp, S. cerevisiae
aggtccatatactatcagccaactc

SEQ ID NO: 6680 - DNA, 25 bp, S. cerevisiae
agggacgtactttcgaaagcttgtg

SEQ ID NO: 6681 - DNA, 25 bp, S. cerevisiae
aggtcactatgcaagtttggagcgt

SEQ ID NO: 6682 - DNA, 25 bp, S. cerevisiae
agtggcaggaattttgcgaggctac

SEQ ID NO: 6683 - DNA, 25 bp, S. cerevisiae
agggcaggaactccacatgggtcaa

SEQ ID NO: 6684 - DNA, 25 bp, S. cerevisiae
aggtgacgattttacatggttctaa

SEQ ID NO: 6685 - DNA, 25 bp, S. cerevisiae
agtggtgctcttctaatggttgtcg

SEQ ID NO: 6686 - DNA, 25 bp, S. cerevisiae
agggtctcatatgggactggttgat

SEQ ID NO: 6687 - DNA, 25 bp, S. cerevisiae
aggtgtctgcataccgttggtgata

SEQ ID NO: 6688 - DNA, 25 bp, S. cerevisiae
agtgctactgacacgggagctggaa

SEQ ID NO: 6689 - DNA, 25 bp, S. cerevisiae
aggtcgcactgtacgaacggctgtt

SEQ ID NO: 6690 - DNA, 25 bp, S. cerevisiae
aggtcacacttatgcactgcaggga

SEQ ID NO: 6691 - DNA, 25 bp, S. cerevisiae
agggactctttgcacgagacgtata

SEQ ID NO: 6692 - DNA, 25 bp, S. cerevisiae
agggagcttctatccgaggcggaaa

SEQ ID NO: 6693 - DNA, 25 bp, S. cerevisiae
agtggacttcgtttctgagactggt

SEQ ID NO: 6694 - DNA, 25 bp, S. cerevisiae
agaggagtttggtttagaccttgag

SEQ ID NO: 6695 - DNA, 25 bp, S. cerevisiae
agggttcattaatggcaatccttga

SEQ ID NO: 6696 - DNA, 25 bp, S. cerevisiae
agggttctaaatctcatccattcgg

SEQ ID NO: 6697 - DNA, 25 bp, S. cerevisiae
aggtcttatacatgctactcccttt

SEQ ID NO: 6698 - DNA, 25 bp, S. cerevisiae
agtggacccgctacagaaattcgtt

SEQ ID NO: 6699 - DNA, 25 bp, S. cerevisiae
aggtgaccccttcgattataaggct

SEQ ID NO: 6700 - DNA, 25 bp, S. cerevisiae
agggaacctccaagtacaccaagca

SEQ ID NO: 6701 - DNA, 25 bp, S. cerevisiae
agtgaactgcctcttttgaacgatt

SEQ ID NO: 6702 - DNA, 25 bp, S. cerevisiae
agctcggatggcacttgttacgttt

SEQ ID NO: 6703 - DNA, 25 bp, S. cerevisiae
agtgggaagacctttctgagcgctc

SEQ ID NO: 6704 - DNA, 25 bp, S. cerevisiae
aggtgtaacacagctgtcatatggc

SEQ ID NO: 6705 - DNA, 25 bp, S. cerevisiae
aggtgaaaacccatcttgtgtttat

SEQ ID NO: 6706 - DNA, 25 bp, S. cerevisiae
aggtgaacgagcgtcgtttgtcctt

SEQ ID NO: 6707 - DNA, 25 bp, S. cerevisiae
agggacaatctggtggtgctttttc

SEQ ID NO: 6708 - DNA, 25 bp, S. cerevisiae
agttgccaaacggattcgcatggaa

SEQ ID NO: 6709 - DNA, 25 bp, S. cerevisiae
agtgcccaactcagcttccgtaaac

SEQ ID NO: 6710 - DNA, 25 bp, S. cerevisiae
agggcacaaacttcttcaccttcag

SEQ ID NO: 6711 - DNA, 25 bp, S. cerevisiae
agtgagaaaactgtccttccacgtc

SEQ ID NO: 6712 - DNA, 25 bp, S. cerevisiae
agtggcaaagactctcccttatgga

SEQ ID NO: 6713 - DNA, 25 bp, S. cerevisiae
agggataaccgcttacgtgaagagt

SEQ ID NO: 6714 - DNA, 25 bp, S. cerevisiae
agggatatcacaggcttatcggcaa

SEQ ID NO: 6715 - DNA, 25 bp, S. cerevisiae
aggtgctagatgcatttttcggcaa

SEQ ID NO: 6716 - DNA, 25 bp, S. cerevisiae
aggtgccaattctgagtctggacac

SEQ ID NO: 6717 - DNA, 25 bp, S. cerevisiae
aggtgccaattccttgttggatctt

SEQ ID NO: 6718 - DNA, 25 bp, S. cerevisiae
agggccaaggtttgggcaagctctt

SEQ ID NO: 6719 - DNA, 25 bp, S. cerevisiae
aggtctgatcagtgctacaacaaat

SEQ ID NO: 6720 - DNA, 25 bp, S. cerevisiae
agagtcatctagtgtccaaccaact

SEQ ID NO: 6721 - DNA, 25 bp, S. cerevisiae
agatgtcttattcaaaacccctcca

SEQ ID NO: 6722 - DNA, 25 bp, S. cerevisiae
agtctttaagtttgcggccctccat

SEQ ID NO: 6723 - DNA, 25 bp, S. cerevisiae
aggtctgatttctgctctactctga

SEQ ID NO: 6724 - DNA, 25 bp, S. cerevisiae
aggtgtgtctgagcgctctgacaaa

SEQ ID NO: 6725 - DNA, 25 bp, S. cerevisiae
aggtgtccaagtgcctgcaaaacca

SEQ ID NO: 6726 - DNA, 25 bp, S. cerevisiae
agggcccattgcacacgccattaaa

SEQ ID NO: 6727 - DNA, 25 bp, S. cerevisiae
aggtgttttcccatttctgtatgaa

SEQ ID NO: 6728 - DNA, 25 bp, S. cerevisiae
agggttaatctcatttctgctgtaa

SEQ ID NO: 6729 - DNA, 25 bp, S. cerevisiae
agggatttactctttgctctcgaaa

SEQ ID NO: 6730 - DNA, 25 bp, S. cerevisiae
agggcttctacaagtcgcctacgaa

SEQ ID NO: 6731 - DNA, 25 bp, S. cerevisiae
aggtgctctctacaatactataagt

SEQ ID NO: 6732 - DNA, 25 bp, S. cerevisiae
aggtgttcaacgtaccgaagatgtt

SEQ ID NO: 6733 - DNA, 25 bp, S. cerevisiae
aggtgacaatagcataccgcccacg

SEQ ID NO: 6734 - DNA, 25 bp, S. cerevisiae
agggcaaaactatccgcacgctgaa

SEQ ID NO: 6735 - DNA, 25 bp, S. cerevisiae
agggaaacttcttcctccgcatata

SEQ ID NO: 6736 - DNA, 25 bp, S. cerevisiae
agtggactcggacattgagctcgat

SEQ ID NO: 6737 - DNA, 25 bp, S. cerevisiae
agggtcaccataccatgaactctaa

SEQ ID NO: 6738 - DNA, 25 bp, S. cerevisiae
agggcatcaatttccagagtcacga

SEQ ID NO: 6739 - DNA, 25 bp, S. cerevisiae
aggtgaccagtaccagacatctgcg

SEQ ID NO: 6740 - DNA, 25 bp, S. cerevisiae
agggtacagatgacgacaatatcga

SEQ ID NO: 6741 - DNA, 25 bp, S. cerevisiae
agggatcacgaacccaacatggatt

SEQ ID NO: 6742 - DNA, 25 bp, S. cerevisiae
agggatcttgtacctcagacggaat

SEQ ID NO: 6743 - DNA, 25 bp, S. cerevisiae
agggcatttgttggtcatcacgtga

SEQ ID NO: 6744 - DNA, 25 bp, S. cerevisiae
aggtgcttggctatctatcatcagt

SEQ ID NO: 6745 - DNA, 25 bp, S. cerevisiae
agtggcttcctcttctacaagtgag

SEQ ID NO: 6746 - DNA, 25 bp, S. cerevisiae
agggttcattttaccaaggtgccat

SEQ ID NO: 6747 - DNA, 25 bp, S. cerevisiae
agggtatctcactttctaatgctta

SEQ ID NO: 6748 - DNA, 25 bp, S. cerevisiae
aggtgtaccacattgacgagtcatt

SEQ ID NO: 6749 - DNA, 25 bp, S. cerevisiae
aggtccacacggtcaatcgatcatt

SEQ ID NO: 6750 - DNA, 25 bp, S. cerevisiae
cgaactgaaacggaacttgtgggat

SEQ ID NO: 6751 - DNA, 25 bp, S. cerevisiae
agataacgaactgacctttgtggaa

SEQ ID NO: 6752 - DNA, 25 bp, S. cerevisiae
tagtaaagaacgcacccaaaatata

SEQ ID NO: 6753 - DNA, 25 bp, S. cerevisiae
agtaaccaagcgcaccagggaattg

SEQ ID NO: 6754 - DNA, 25 bp, S. cerevisiae
agggaccaagcgctcgcaccgttag

SEQ ID NO: 6755 - DNA, 25 bp, S. cerevisiae
agggaacaagcaggcgcccggctta

SEQ ID NO: 6756 - DNA, 25 bp, S. cerevisiae
aggtgcgttctatggagactcagtc

SEQ ID NO: 6757 - DNA, 25 bp, S. cerevisiae
aggtccatttactgacccattcagt

SEQ ID NO: 6758 - DNA, 25 bp, S. cerevisiae
aggtccatttggttacccttgatat

SEQ ID NO: 6759 - DNA, 25 bp, S. cerevisiae
aggtgcccacctttttcgctgaaat

SEQ ID NO: 6760 - DNA, 25 bp, S. cerevisiae
agggcttacctccatgcatgttaat

SEQ ID NO: 6761 - DNA, 25 bp, S. cerevisiae
agtggttactactacggcggagcct

SEQ ID NO: 6762 - DNA, 25 bp, S. cerevisiae
agtgtgccaatttttcgtgcggaaa

SEQ ID NO: 6763 - DNA, 25 bp, S. cerevisiae
agtgctgaaactgccggtacatttg

SEQ ID NO: 6764 - DNA, 25 bp, S. cerevisiae
aggtgagagttcgtgcggcatccat

SEQ ID NO: 6765 - DNA, 25 bp, S. cerevisiae
agggcaggcccttgagagctcttat

SEQ ID NO: 6766 - DNA, 25 bp, S. cerevisiae
agggatgtggccctagctcatctgt

SEQ ID NO: 6767 - DNA, 25 bp, S. cerevisiae
agggcatttccattacttccataat

SEQ ID NO: 6768 - DNA, 25 bp, S. cerevisiae
agtggagtcgccttatatcatacag

SEQ ID NO: 6769 - DNA, 25 bp, S. cerevisiae
agggattccaattcatatcgtcgat

SEQ ID NO: 6770 - DNA, 25 bp, S. cerevisiae
aggtgattcccaatacactgccgaa

SEQ ID NO: 6771 - DNA, 25 bp, S. cerevisiae
aggtgctacgcctagacttgggaga

SEQ ID NO: 6772 - DNA, 25 bp, S. cerevisiae
aggtgtatcgccgaactcatggaaa

SEQ ID NO: 6773 - DNA, 25 bp, S. cerevisiae
aggtgattcggcaagcttctggcaa

SEQ ID NO: 6774 - DNA, 25 bp, S. cerevisiae
aggtgacttcaaaactcgtgcagat

SEQ ID NO: 6775 - DNA, 25 bp, S. cerevisiae
agggcgagagctttgcttttgcaaa

SEQ ID NO: 6776 - DNA, 25 bp, S. cerevisiae
aggtgtgaatcctgcttctgcgcac

SEQ ID NO: 6777 - DNA, 25 bp, S. cerevisiae
aggtgctaaactagtccgcgatgct

SEQ ID NO: 6778 - DNA, 25 bp, S. cerevisiae
aggtgcgcaatactcttccaggata

SEQ ID NO: 6779 - DNA, 25 bp, S. cerevisiae
agtgcatctttgtatgtcacaacga

SEQ ID NO: 6780 - DNA, 25 bp, S. cerevisiae
agtgcatcactggtctacaagggag

SEQ ID NO: 6781 - DNA, 25 bp, S. cerevisiae
agtgctactccctcaaagttatcag

SEQ ID NO: 6782 - DNA, 25 bp, S. cerevisiae
acttgactccaacactagttaccta

SEQ ID NO: 6783 - DNA, 25 bp, S. cerevisiae
taggaacctacgtgccggtacccag

SEQ ID NO: 6784 - DNA, 25 bp, S. cerevisiae
agtgtaactactgcgccaaataccc

SEQ ID NO: 6785 - DNA, 25 bp, S. cerevisiae
agcgatcaagctatacccaaatttc

SEQ ID NO: 6786 - DNA, 25 bp, S. cerevisiae
agtgcaattaccttagcgtctgaat

SEQ ID NO: 6787 - DNA, 25 bp, S. cerevisiae
aggtgtaactgcaaggctgtcgcta

SEQ ID NO: 6788 - DNA, 25 bp, S. cerevisiae
agggaacccaggaagctcgctgagc

SEQ ID NO: 6789 - DNA, 25 bp, S. cerevisiae
aggtgcttctgcattatttgcctcg

SEQ ID NO: 6790 - DNA, 25 bp, S. cerevisiae
agggtctctcttatttcctggagtc

SEQ ID NO: 6791 - DNA, 25 bp, S. cerevisiae
agggcatttggtattcttgctcaat

SEQ ID NO: 6792 - DNA, 25 bp, S. cerevisiae
agtgttatcgcaatcagctgatcca

SEQ ID NO: 6793 - DNA, 25 bp, S. cerevisiae
agtgtgtacataacctgtcgcctag

SEQ ID NO: 6794 - DNA, 25 bp, S. cerevisiae
aggtgcagactacatctacgctggc

SEQ ID NO: 6795 - DNA, 25 bp, S. cerevisiae
aggtgagtccaggatgtacgctcct

SEQ ID NO: 6796 - DNA, 25 bp, S. cerevisiae
agtctagccgaggtgatgaccactt

SEQ ID NO: 6797 - DNA, 25 bp, S. cerevisiae
agtctggaccatgatatgaccgtta

SEQ ID NO: 6798 - DNA, 25 bp, S. cerevisiae
agtcctgccactgaatcctagttga

SEQ ID NO: 6799 - DNA, 25 bp, S. cerevisiae
agtggctgcggcaccaagctggtta

SEQ ID NO: 6800 - DNA, 25 bp, S. cerevisiae
agggcattgtctactcacgtggtgg

SEQ ID NO: 6801 - DNA, 25 bp, S. cerevisiae
agggcttatcataccaatgcgattc

SEQ ID NO: 6802 - DNA, 25 bp, S. cerevisiae
agggctgtcatctatggttctttaa

SEQ ID NO: 6803 - DNA, 25 bp, S. cerevisiae
agcgacggtcgtctttaagaacaat

SEQ ID NO: 6804 - DNA, 25 bp, S. cerevisiae
agtaccctttcttgctatacgaggt

SEQ ID NO: 6805 - DNA, 25 bp, S. cerevisiae
agtcctagtggcaacgaaagtgtca

SEQ ID NO: 6806 - DNA, 25 bp, S. cerevisiae
agtgctgacattcgcaacaccaaag

SEQ ID NO: 6807 - DNA, 25 bp, S. cerevisiae
agtgccacatcgacatctacatcat

SEQ ID NO: 6808 - DNA, 25 bp, S. cerevisiae
agtgatcgtcatactgcaagccatg

SEQ ID NO: 6809 - DNA, 25 bp, S. cerevisiae
agtgcatcagatacctctagtcgtg

SEQ ID NO: 6810 - DNA, 25 bp, S. cerevisiae
agtgcatgcaattccgagagacgta

SEQ ID NO: 6811 - DNA, 25 bp, S. cerevisiae
agtgacaatgatgcgaactcgaaat

SEQ ID NO: 6812 - DNA, 25 bp, S. cerevisiae
agtgctgacagtgcgtatctagtaa

SEQ ID NO: 6813 - DNA, 25 bp, S. cerevisiae
agtgctggcactgaggttaataata

SEQ ID NO: 6814 - DNA, 25 bp, S. cerevisiae
agtggcccacgcgagttacatgact

SEQ ID NO: 6815 - DNA, 25 bp, S. cerevisiae
agggctctcatccaggtcaattgat

SEQ ID NO: 6816 - DNA, 25 bp, S. cerevisiae
agggccattctggattctattcatg

SEQ ID NO: 6817 - DNA, 25 bp, S. cerevisiae
agggcaattcatgctatggcattca

SEQ ID NO: 6818 - DNA, 25 bp, S. cerevisiae
agggcaatgcagtagaggctgtcaa

SEQ ID NO: 6819 - DNA, 25 bp, S. cerevisiae
acgaccaaatgttgccgttgcacgt

SEQ ID NO: 6820 - DNA, 25 bp, S. cerevisiae
ggtccgatactagcccttcaaaaag

SEQ ID NO: 6821 - DNA, 25 bp, S. cerevisiae
aggtgtagcacgcttttcttcaaaa

SEQ ID NO: 6822 - DNA, 25 bp, S. cerevisiae
agtggtatccgagcgttttcagaaa

SEQ ID NO: 6823 - DNA, 25 bp, S. cerevisiae
agggttcccaccttggcatattaga

SEQ ID NO: 6824 - DNA, 25 bp, S. cerevisiae
agggttcccaccgttgatttatatg

SEQ ID NO: 6825 - DNA, 25 bp, S. cerevisiae
agttttcccacagacttctataatg

SEQ ID NO: 6826 - DNA, 25 bp, S. cerevisiae
agctgccccggatttcacgaataaa

SEQ ID NO: 6827 - DNA, 25 bp, S. cerevisiae
agtgcctcccggtgttacaagaact

SEQ ID NO: 6828 - DNA, 25 bp, S. cerevisiae
agtgccaacggcagtgctttatcga

SEQ ID NO: 6829 - DNA, 25 bp, S. cerevisiae
agtggcgacgattctagtttaaaca

SEQ ID NO: 6830 - DNA, 25 bp, S. cerevisiae
agtggtccaggtttttcatgtgaag

SEQ ID NO: 6831 - DNA, 25 bp, S. cerevisiae
agggccatcggtgcttccattgaaa

SEQ ID NO: 6832 - DNA, 25 bp, S. cerevisiae
agtcgctttggtgcttgccttaaaa

SEQ ID NO: 6833 - DNA, 25 bp, S. cerevisiae
aggtggtgctcaagacaagactgtc

SEQ ID NO: 6834 - DNA, 25 bp, S. cerevisiae
aggtgtgtgctgcagatcgttccac

SEQ ID NO: 6835 - DNA, 25 bp, S. cerevisiae
agtcggctctattactgaaaccctc

SEQ ID NO: 6836 - DNA, 25 bp, S. cerevisiae
ggtaggccaattgggtaaggtacat

SEQ ID NO: 6837 - DNA, 25 bp, S. cerevisiae
agttcgcctgaataaccgtgtctga

SEQ ID NO: 6838 - DNA, 25 bp, S. cerevisiae
agtcccattcgagcatacgggtcta

SEQ ID NO: 6839 - DNA, 25 bp, S. cerevisiae
agtggcatcctacattactgggtaa

SEQ ID NO: 6840 - DNA, 25 bp, S. cerevisiae
agggccctgacgttgacatggacaa

SEQ ID NO: 6841 - DNA, 25 bp, S. cerevisiae
agtggccactatctctcaagaacaa

SEQ ID NO: 6842 - DNA, 25 bp, S. cerevisiae
agtggcagacttcttcgccaagaaa

SEQ ID NO: 6843 - DNA, 25 bp, S. cerevisiae
agtggcaccgcttccactgggaaaa

SEQ ID NO: 6844 - DNA, 25 bp, S. cerevisiae
agggcacagcgctcgacattacaaa

SEQ ID NO: 6845 - DNA, 25 bp, S. cerevisiae
agggagcgctggattggcattcaac

SEQ ID NO: 6846 - DNA, 25 bp, S. cerevisiae
agtgtgtctgagtcttctgcgctta

SEQ ID NO: 6847 - DNA, 25 bp, S. cerevisiae
agtggcttgagatcttcgtcaagca

SEQ ID NO: 6848 - DNA, 25 bp, S. cerevisiae
agtgccgaacatgggctaggtttcc

SEQ ID NO: 6849 - DNA, 25 bp, S. cerevisiae
agtcccacctgggtatggcgtactt

SEQ ID NO: 6850 - DNA, 25 bp, S. cerevisiae
agtatgggaccctggacttccaaga

SEQ ID NO: 6851 - DNA, 25 bp, S. cerevisiae
agggtcattgacgtgtctgatccac

SEQ ID NO: 6852 - DNA, 25 bp, S. cerevisiae
agtgtatcgtcgctggaatctgcta

SEQ ID NO: 6853 - DNA, 25 bp, S. cerevisiae
agtgtttggacaaggcagacatctt

SEQ ID NO: 6854 - DNA, 25 bp, S. cerevisiae
agatgtcgcgcaatgcatcgtactc

SEQ ID NO: 6855 - DNA, 25 bp, S. cerevisiae
agtgtcccatagagcaatgtccctg

SEQ ID NO: 6856 - DNA, 25 bp, S. cerevisiae
agtctgccattcaaccgcaatgtat

SEQ ID NO: 6857 - DNA, 25 bp, S. cerevisiae
gccattgggacattaggactgctag

SEQ ID NO: 6858 - DNA, 25 bp, S. cerevisiae
caaggcgatgcattacaggacgtag

SEQ ID NO: 6859 - DNA, 25 bp, S. cerevisiae
agggcgatctgctacaggaagctat

SEQ ID NO: 6860 - DNA, 25 bp, S. cerevisiae
agggcctctgcccaagagtgtattg

SEQ ID NO: 6861 - DNA, 25 bp, S. cerevisiae
agggaactctcctaatgtgtttgat

SEQ ID NO: 6862 - DNA, 25 bp, S. cerevisiae
agggctcatcctcaaatgttcgtaa

SEQ ID NO: 6863 - DNA, 25 bp, S. cerevisiae
agggaagtgcttcttcattgctgaa

SEQ ID NO: 6864 - DNA, 25 bp, S. cerevisiae
agtggaagtcttcggctcttggaaa

SEQ ID NO: 6865 - DNA, 25 bp, S. cerevisiae
agggatagttcgcacacttggtata

SEQ ID NO: 6866 - DNA, 25 bp, S. cerevisiae
agggatatactcctgaccaaggtgt

SEQ ID NO: 6867 - DNA, 25 bp, S. cerevisiae
agggaatatgctgctatgccgactt

SEQ ID NO: 6868 - DNA, 25 bp, S. cerevisiae
agtggttaaccatacaggcacatta

SEQ ID NO: 6869 - DNA, 25 bp, S. cerevisiae
agggttacctagctgacgacattga

SEQ ID NO: 6870 - DNA, 25 bp, S. cerevisiae
agggtatccgctttagaaactctga

SEQ ID NO: 6871 - DNA, 25 bp, S. cerevisiae
agacgtacggtctcacaacctatga

SEQ ID NO: 6872 - DNA, 25 bp, S. cerevisiae
agtctcggtcctattgtcgtaacaa

SEQ ID NO: 6873 - DNA, 25 bp, S. cerevisiae
agtgggcttattgtttcgacgttca

SEQ ID NO: 6874 - DNA, 25 bp, S. cerevisiae
agggctcttgtctttcatttgaaaa

SEQ ID NO: 6875 - DNA, 25 bp, S. cerevisiae
agtgtgatgctcaggcattcttcga

SEQ ID NO: 6876 - DNA, 25 bp, S. cerevisiae
agtgcaatgtcacggttcattcgcc

SEQ ID NO: 6877 - DNA, 25 bp, S. cerevisiae
agtgaagctacttcttctgccgtcg

SEQ ID NO: 6878 - DNA, 25 bp, S. cerevisiae
agtgtggctattctacctcaattgt

SEQ ID NO: 6879 - DNA, 25 bp, S. cerevisiae
agggcagacaatctaccacttttgc

SEQ ID NO: 6880 - DNA, 25 bp, S. cerevisiae
agggcatcaaagctgcatgcgccat

SEQ ID NO: 6881 - DNA, 25 bp, S. cerevisiae
agggatggctcacgatcaacttcat

SEQ ID NO: 6882 - DNA, 25 bp, S. cerevisiae
agtggctgagcgtagatcatagtat

SEQ ID NO: 6883 - DNA, 25 bp, S. cerevisiae
agtggcaggctatttcaggttcctc

SEQ ID NO: 6884 - DNA, 25 bp, S. cerevisiae
agggcagagctgcttttatttccgc

SEQ ID NO: 6885 - DNA, 25 bp, S. cerevisiae
agtggcgcactaaccttgattctac

SEQ ID NO: 6886 - DNA, 25 bp, S. cerevisiae
agtacgatcttgaggccggcgaaaa

SEQ ID NO: 6887 - DNA, 25 bp, S. cerevisiae
agtccgatttagcagctgcacgcag

SEQ ID NO: 6888 - DNA, 25 bp, S. cerevisiae
agtccggcaagaagagtgagtccaa

SEQ ID NO: 6889 - DNA, 25 bp, S. cerevisiae
agtcctcccaatccaatgattcaag

SEQ ID NO: 6890 - DNA, 25 bp, S. cerevisiae
agggctgcccaatttagcatctcaa

SEQ ID NO: 6891 - DNA, 25 bp, S. cerevisiae
agtcgctagtagctaacattgtaaa

SEQ ID NO: 6892 - DNA, 25 bp, S. cerevisiae
agatcgctaaacctaacacggccaa

SEQ ID NO: 6893 - DNA, 25 bp, S. cerevisiae
ttgtcggaagaacaacgcgctccaa

SEQ ID NO: 6894 - DNA, 25 bp, S. cerevisiae
agggaccttgcagagcatgcggctt

SEQ ID NO: 6895 - DNA, 25 bp, S. cerevisiae
agtggcaccttaaatacgctccggt

SEQ ID NO: 6896 - DNA, 25 bp, S. cerevisiae
agtgaacgtcaaacttgcctcgggt

SEQ ID NO: 6897 - DNA, 25 bp, S. cerevisiae
agtgaagcgtcagcaaccgctgtta

SEQ ID NO: 6898 - DNA, 25 bp, S. cerevisiae
agtgaacatgtcttcgtccgcatca

SEQ ID NO: 6899 - DNA, 25 bp, S. cerevisiae
agtggcacatctctggatgctcaaa

SEQ ID NO: 6900 - DNA, 25 bp, S. cerevisiae
agtgctgaatgccttagtctcgcag

SEQ ID NO: 6901 - DNA, 25 bp, S. cerevisiae
agtgcagattctgtgacatcccaga

SEQ ID NO: 6902 - DNA, 25 bp, S. cerevisiae
agtgatatgtatgaaccctggcccc

SEQ ID NO: 6903 - DNA, 25 bp, S. cerevisiae
agtaattttgtcacacgttccctca

SEQ ID NO: 6904 - DNA, 25 bp, S. cerevisiae
agtgaatttttcaacgacgctccct

SEQ ID NO: 6905 - DNA, 25 bp, S. cerevisiae
agattaatttctcacgcaggttccc

SEQ ID NO: 6906 - DNA, 25 bp, S. cerevisiae
agttgagatcccaggcgaggttcca

SEQ ID NO: 6907 - DNA, 25 bp, S. cerevisiae
agtggcgacaccatatgggcggtca

SEQ ID NO: 6908 - DNA, 25 bp, S. cerevisiae
agtggtgtctcccttgggccaaatg

SEQ ID NO: 6909 - DNA, 25 bp, S. cerevisiae
agggctttccacattgattaccatc

SEQ ID NO: 6910 - DNA, 25 bp, S. cerevisiae
agtgtttcccaactcgttacagatc

SEQ ID NO: 6911 - DNA, 25 bp, S. cerevisiae
agtgattcctcgatacgttgacgct

SEQ ID NO: 6912 - DNA, 25 bp, S. cerevisiae
agtgttcctcaaatccgtgatgtta

SEQ ID NO: 6913 - DNA, 25 bp, S. cerevisiae
agtaccgttagatttgttcccgcat

SEQ ID NO: 6914 - DNA, 25 bp, S. cerevisiae
agtgacgccattccaattgactttg

SEQ ID NO: 6915 - DNA, 25 bp, S. cerevisiae
agtaccctaccaatagacctattag

SEQ ID NO: 6916 - DNA, 25 bp, S. cerevisiae
agtaccctacggcaatgcaccattg

SEQ ID NO: 6917 - DNA, 25 bp, S. cerevisiae
agtgccggcacagcattttacgaaa

SEQ ID NO: 6918 - DNA, 25 bp, S. cerevisiae
agtgctgcggaaatatggcctacaa

SEQ ID NO: 6919 - DNA, 25 bp, S. cerevisiae
agtgctctttagagtgcttgcaaga

SEQ ID NO: 6920 - DNA, 25 bp, S. cerevisiae
agggccatctatttcgtatcttgtg

SEQ ID NO: 6921 - DNA, 25 bp, S. cerevisiae
agggccattttgtttatttctatat

SEQ ID NO: 6922 - DNA, 25 bp, S. cerevisiae
agtgctggtttggacgttttcgaat

SEQ ID NO: 6923 - DNA, 25 bp, S. cerevisiae
agtgatggttctgacgacgatgaca

SEQ ID NO: 6924 - DNA, 25 bp, S. cerevisiae
agtgtggttcttggatagcgtatca

SEQ ID NO: 6925 - DNA, 25 bp, S. cerevisiae
agtcgggcttggaatggatgtatca

SEQ ID NO: 6926 - DNA, 25 bp, S. cerevisiae
agtccggcattaaaggctgatacca

SEQ ID NO: 6927 - DNA, 25 bp, S. cerevisiae
agtcaccgttgaaaagcctatccca

SEQ ID NO: 6928 - DNA, 25 bp, S. cerevisiae
agtcttcagtgcgaaaatttttcca

SEQ ID NO: 6929 - DNA, 25 bp, S. cerevisiae
agtgaacgtggttactctttctcca

SEQ ID NO: 6930 - DNA, 25 bp, S. cerevisiae
agtgcgcaatgtcgttagttctatt

SEQ ID NO: 6931 - DNA, 25 bp, S. cerevisiae
agtggccatcatcgtcattgtgttg

SEQ ID NO: 6932 - DNA, 25 bp, S. cerevisiae
agggcagcacattgtcttgtgtttc

SEQ ID NO: 6933 - DNA, 25 bp, S. cerevisiae
agtgactccatcgagctagtctcta

SEQ ID NO: 6934 - DNA, 25 bp, S. cerevisiae
agtggtcatactgcaatgtcgctaa

SEQ ID NO: 6935 - DNA, 25 bp, S. cerevisiae
agggccacattgtttgtcggcaaga

SEQ ID NO: 6936 - DNA, 25 bp, S. cerevisiae
agtgcgcctactttgtaggtctgac

SEQ ID NO: 6937 - DNA, 25 bp, S. cerevisiae
agtggttgccatttacggtctgatt

SEQ ID NO: 6938 - DNA, 25 bp, S. cerevisiae
agtggtatttacgatctgtctctga

SEQ ID NO: 6939 - DNA, 25 bp, S. cerevisiae
agtggtactgctaggagattcatca

SEQ ID NO: 6940 - DNA, 25 bp, S. cerevisiae
agtgcgtcctatgctctgattattc

SEQ ID NO: 6941 - DNA, 25 bp, S. cerevisiae
agtggctcattatctgtggtttgct

SEQ ID NO: 6942 - DNA, 25 bp, S. cerevisiae
agtgtttatataggctcagtctttc

SEQ ID NO: 6943 - DNA, 25 bp, S. cerevisiae
agacttctaagagggcatattttgc

SEQ ID NO: 6944 - DNA, 25 bp, S. cerevisiae
agaccctacgggatctcatttgttc

SEQ ID NO: 6945 - DNA, 25 bp, S. cerevisiae
agtgctcatctacggaattctcttt

SEQ ID NO: 6946 - DNA, 25 bp, S. cerevisiae
agtgccgcttcgaaatcatctaatc

SEQ ID NO: 6947 - DNA, 25 bp, S. cerevisiae
agtgccgtacacttgatacatgatt

SEQ ID NO: 6948 - DNA, 25 bp, S. cerevisiae
agtgttcttgacatggtactgcgga

SEQ ID NO: 6949 - DNA, 25 bp, S. cerevisiae
agtgattcttccctttcaatgtcaa

SEQ ID NO: 6950 - DNA, 25 bp, S. cerevisiae
agtgttactcctcaattagctttag

SEQ ID NO: 6951 - DNA, 25 bp, S. cerevisiae
agtggcttcgattattgagtccttc

SEQ ID NO: 6952 - DNA, 25 bp, S. cerevisiae
agttaccgtctctgtacaatctgcc

SEQ ID NO: 6953 - DNA, 25 bp, S. cerevisiae
agtgttaacttcctttctacgatat

SEQ ID NO: 6954 - DNA, 25 bp, S. cerevisiae
actggactccaattattacctcgac

SEQ ID NO: 6955 - DNA, 25 bp, S. cerevisiae
agtgatgtcccttatagtagcctcc

SEQ ID NO: 6956 - DNA, 25 bp, S. cerevisiae
agtgcacctgttgccatgggtaaca

SEQ ID NO: 6957 - DNA, 25 bp, S. cerevisiae
agtgttgctgcttatccgagtgatc

SEQ ID NO: 6958 - DNA, 25 bp, S. cerevisiae
agtgtatgtctattgccagtgctgc

SEQ ID NO: 6959 - DNA, 25 bp, S. cerevisiae
agtgagactgacttgttgtccatat

SEQ ID NO: 6960 - DNA, 25 bp, S. cerevisiae
agtcagggcagattcactgctccaa

SEQ ID NO: 6961 - DNA, 25 bp, S. cerevisiae
agtgaactgtcatccaactgttgca

SEQ ID NO: 6962 - DNA, 25 bp, S. cerevisiae
agtgacacggctcaacattctatgc

SEQ ID NO: 6963 - DNA, 25 bp, S. cerevisiae
agtggccaccatgatctctgatata

SEQ ID NO: 6964 - DNA, 25 bp, S. cerevisiae
agtaatcttgatttttgaccgccta

SEQ ID NO: 6965 - DNA, 25 bp, S. cerevisiae
agtgcatcattagcgtcctcagact

SEQ ID NO: 6966 - DNA, 25 bp, S. cerevisiae
agtgtctgggactacttcagatcta

SEQ ID NO: 6967 - DNA, 25 bp, S. cerevisiae
agtgaattccttacaatgggctaga

SEQ ID NO: 6968 - DNA, 25 bp, S. cerevisiae
agtccacttggaagctatcgatttg

SEQ ID NO: 6969 - DNA, 25 bp, S. cerevisiae
agtccgttggtatcatcggtgctta

SEQ ID NO: 6970 - DNA, 25 bp, S. cerevisiae
agtccctcctctcattaggattgta

SEQ ID NO: 6971 - DNA, 25 bp, S. cerevisiae
agtccctccttcgaacagtatgata

SEQ ID NO: 6972 - DNA, 25 bp, S. cerevisiae
agtcgaacaagaacaatcgcttcaa

SEQ ID NO: 6973 - DNA, 25 bp, S. cerevisiae
agtggcatagccaactgcaatcgtt

SEQ ID NO: 6974 - DNA, 25 bp, S. cerevisiae
agtgagctacttttgcaacgtgccc

SEQ ID NO: 6975 - DNA, 25 bp, S. cerevisiae
agtgtctcactttcagaggcaccgc

SEQ ID NO: 6976 - DNA, 25 bp, S. cerevisiae
agtaacttctcctgtaacgctttga

SEQ ID NO: 6977 - DNA, 25 bp, S. cerevisiae
agtacctttcaatggcaatggctta

SEQ ID NO: 6978 - DNA, 25 bp, S. cerevisiae
agtcttttcaaattagccgccgaat

SEQ ID NO: 6979 - DNA, 25 bp, S. cerevisiae
agtgcttatatacgctaactccgga

SEQ ID NO: 6980 - DNA, 25 bp, S. cerevisiae
agtgtcctaaatcagcattcctttc

SEQ ID NO: 6981 - DNA, 25 bp, S. cerevisiae
agtgaccaaccttcagttactcagt

SEQ ID NO: 6982 - DNA, 25 bp, S. cerevisiae
agtcctccaagctcagttttcagtg

SEQ ID NO: 6983 - DNA, 25 bp, S. cerevisiae
agtgattctgttgatagcgctgaac

SEQ ID NO: 6984 - DNA, 25 bp, S. cerevisiae
agtcatatctgatgcctccgtgaat

SEQ ID NO: 6985 - DNA, 25 bp, S. cerevisiae
agtaatgctgacgatggctctgtaa

SEQ ID NO: 6986 - DNA, 25 bp, S. cerevisiae
agtcaaattcacgtctttggcaccg

SEQ ID NO: 6987 - DNA, 25 bp, S. cerevisiae
agtgaaactacttcttctgccgtcg

SEQ ID NO: 6988 - DNA, 25 bp, S. cerevisiae
agtggaacctgcaaactctagccgc

SEQ ID NO: 6989 - DNA, 25 bp, S. cerevisiae
agtagatacccagttcctgacttgc

SEQ ID NO: 6990 - DNA, 25 bp, S. cerevisiae
agctcgaacagttgcgtcgctacga

SEQ ID NO: 6991 - DNA, 25 bp, S. cerevisiae
agtcctgaacaactttctaccttgt

SEQ ID NO: 6992 - DNA, 25 bp, S. cerevisiae
agtcctgtactgtgtgttgtcctgg

SEQ ID NO: 6993 - DNA, 25 bp, S. cerevisiae
agtccttgcgtcgtttatccacgaa

SEQ ID NO: 6994 - DNA, 25 bp, S. cerevisiae
agtctattctgaagctctttctccg

SEQ ID NO: 6995 - DNA, 25 bp, S. cerevisiae
agtggatgaatccttgcccgtcagc

SEQ ID NO: 6996 - DNA, 25 bp, S. cerevisiae
agggccagtatcatgcaccaggtta

SEQ ID NO: 6997 - DNA, 25 bp, S. cerevisiae
agggccaatttacggcgcatgttga

SEQ ID NO: 6998 - DNA, 25 bp, S. cerevisiae
agtggaaattcttaccgcatctggt

SEQ ID NO: 6999 - DNA, 25 bp, S. cerevisiae
agtggaattgtttccggcacttcga

SEQ ID NO: 7000 - DNA, 25 bp, S. cerevisiae
agtaagtactcttcatcaggcaccc

SEQ ID NO: 7001 - DNA, 25 bp, S. cerevisiae
agatatgatgccctacccaagaacg

SEQ ID NO: 7002 - DNA, 25 bp, S. cerevisiae
agtgaatccagcgatccatacgaca

SEQ ID NO: 7003 - DNA, 25 bp, S. cerevisiae
agtgtatgcacacgttcaacggtcg

SEQ ID NO: 7004 - DNA, 25 bp, S. cerevisiae
agtgcttcatatctacggagggcgc

SEQ ID NO: 7005 - DNA, 25 bp, S. cerevisiae
agtgttcagaatcgcacctcataca

SEQ ID NO: 7006 - DNA, 25 bp, S. cerevisiae
agtgctgtcaagtccaactattcat

SEQ ID NO: 7007 - DNA, 25 bp, S. cerevisiae
agtggtgttgatacctatcttcaaa

SEQ ID NO: 7008 - DNA, 25 bp, S. cerevisiae
agtaggttatttcactctggataaa

SEQ ID NO: 7009 - DNA, 25 bp, S. cerevisiae
agtgtactccagtagaccctcaagt

SEQ ID NO: 7010 - DNA, 25 bp, S. cerevisiae
agtgtagatctcaaaactccccttg

SEQ ID NO: 7011 - DNA, 25 bp, S. cerevisiae
agtgtagatggcagaacctcctcga

SEQ ID NO: 7012 - DNA, 25 bp, S. cerevisiae
agtcaaagacatcgctagttccaaa

SEQ ID NO: 7013 - DNA, 25 bp, S. cerevisiae
agtaactgaggccatcattcgtcac

SEQ ID NO: 7014 - DNA, 25 bp, S. cerevisiae
agtacaccagagcatattcagtcaa

SEQ ID NO: 7015 - DNA, 25 bp, S. cerevisiae
agtagagcaacatacattacacaaa

SEQ ID NO: 7016 - DNA, 25 bp, S. cerevisiae
agtccactagacttcgaacagccaa

SEQ ID NO: 7017 - DNA, 25 bp, S. cerevisiae
agtgcctatgcatttttgaccgatt

SEQ ID NO: 7018 - DNA, 25 bp, S. cerevisiae
agtgtcacaggatctcctcgattta

SEQ ID NO: 7019 - DNA, 25 bp, S. cerevisiae
agtgcagaaatttgctcccaactct

SEQ ID NO: 7020 - DNA, 25 bp, S. cerevisiae
agtgcgctacatacgcccgaattag

SEQ ID NO: 7021 - DNA, 25 bp, S. cerevisiae
agtgcgttcacttgctcacaatgtt

SEQ ID NO: 7022 - DNA, 25 bp, S. cerevisiae
aatctggcccggtaaaattgacgat

SEQ ID NO: 7023 - DNA, 25 bp, S. cerevisiae
agattagcccgacaaagcatttggt

SEQ ID NO: 7024 - DNA, 25 bp, S. cerevisiae
gagttactaaaagacgataccgatt

SEQ ID NO: 7025 - DNA, 25 bp, S. cerevisiae
agcttacgaaaaggaccaactagag

SEQ ID NO: 7026 - DNA, 25 bp, S. cerevisiae
ggttgacctaccagaaactgccgga

SEQ ID NO: 7027 - DNA, 25 bp, S. cerevisiae
gccttgagccaacaaaaaagcggtg

SEQ ID NO: 7028 - DNA, 25 bp, S. cerevisiae
cttcgtctcaaactttccaaagcgg

SEQ ID NO: 7029 - DNA, 25 bp, S. cerevisiae
agtgccgttatccttacatatcgaa

SEQ ID NO: 7030 - DNA, 25 bp, S. cerevisiae
agtctgccaatgagaaacttctgaa

SEQ ID NO: 7031 - DNA, 25 bp, S. cerevisiae
agtgacctgtcagattttgcctctt

SEQ ID NO: 7032 - DNA, 25 bp, S. cerevisiae
agtcgctcatccaactgaaacctac

SEQ ID NO: 7033 - DNA, 25 bp, S. cerevisiae
agtcgaattctcgtggctgtacgca

SEQ ID NO: 7034 - DNA, 25 bp, S. cerevisiae
agtgtcgatcctgctactatcaaaa

SEQ ID NO: 7035 - DNA, 25 bp, S. cerevisiae
agatgcggtcgctgtacttaaacaa

SEQ ID NO: 7036 - DNA, 25 bp, S. cerevisiae
agatgcggctgctccagacgtaaaa

SEQ ID NO: 7037 - DNA, 25 bp, S. cerevisiae
agccgtgcgcttcagggacagaaaa

SEQ ID NO: 7038 - DNA, 25 bp, S. cerevisiae
agtaaggctccagatttcgtaattg

SEQ ID NO: 7039 - DNA, 25 bp, S. cerevisiae
agtaaagtcacctcagtcaaagttg

SEQ ID NO: 7040 - DNA, 25 bp, S. cerevisiae
cctaaaccacctaagccaatcaaat

SEQ ID NO: 7041 - DNA, 25 bp, S. cerevisiae
gcagtaaaccccaaaaacacgcaat

SEQ ID NO: 7042 - DNA, 25 bp, S. cerevisiae
agtacattccccagataaggccgtg

SEQ ID NO: 7043 - DNA, 25 bp, S. cerevisiae
agtgcattggtttctctatacgata

SEQ ID NO: 7044 - DNA, 25 bp, S. cerevisiae
agtattcgttttcactcgatcctga

SEQ ID NO: 7045 - DNA, 25 bp, S. cerevisiae
agtcaattgctctatctacctatgg

SEQ ID NO: 7046 - DNA, 25 bp, S. cerevisiae
agtccgtgtcgaattcttggaagac

SEQ ID NO: 7047 - DNA, 25 bp, S. cerevisiae
agtgtctggaccttccttgaaacaa

SEQ ID NO: 7048 - DNA, 25 bp, S. cerevisiae
agtgcctgcacaactcttgaagaaa

SEQ ID NO: 7049 - DNA, 25 bp, S. cerevisiae
agtatcagctgagtaatgccaatag

SEQ ID NO: 7050 - DNA, 25 bp, S. cerevisiae
agtgctatcaacgatgcatccaaag

SEQ ID NO: 7051 - DNA, 25 bp, S. cerevisiae
agtgctataacttcatcttcatcgc

SEQ ID NO: 7052 - DNA, 25 bp, S. cerevisiae
ggtcaatgggtcgacgccttcggaa

SEQ ID NO: 7053 - DNA, 25 bp, S. cerevisiae
agtctctgggtccattccttgaaaa

SEQ ID NO: 7054 - DNA, 25 bp, S. cerevisiae
agttacttgaggtaccagggcacaa

SEQ ID NO: 7055 - DNA, 25 bp, S. cerevisiae
agtgcacaattgatggacgcgttaa

SEQ ID NO: 7056 - DNA, 25 bp, S. cerevisiae
agtgccaatggtagacaccctcaac

SEQ ID NO: 7057 - DNA, 25 bp, S. cerevisiae
agtagtatgtcccattcacgtacac

SEQ ID NO: 7058 - DNA, 25 bp, S. cerevisiae
agtagtcaactgtcagtgccgtcaa

SEQ ID NO: 7059 - DNA, 25 bp, S. cerevisiae
agtgttgacaattttcgcttcccat

SEQ ID NO: 7060 - DNA, 25 bp, S. cerevisiae
agtttccaacttccagctaacgtat

SEQ ID NO: 7061 - DNA, 25 bp, S. cerevisiae
agtcctttcacttccagtaacgaat

SEQ ID NO: 7062 - DNA, 25 bp, S. cerevisiae
agtaatcttcatggtcgactctctc

SEQ ID NO: 7063 - DNA, 25 bp, S. cerevisiae
agtgtattcgaacctttataagcag

SEQ ID NO: 7064 - DNA, 25 bp, S. cerevisiae
agtgtatatcaagccctctgtatcc

SEQ ID NO: 7065 - DNA, 25 bp, S. cerevisiae
agtgctttagaattgggcctcagct

SEQ ID NO: 7066 - DNA, 25 bp, S. cerevisiae
agtccttagtaaattgcccatcatg

SEQ ID NO: 7067 - DNA, 25 bp, S. cerevisiae
agtcgctaaattcccctggtaacag

SEQ ID NO: 7068 - DNA, 25 bp, S. cerevisiae
agtctgctaacttgatggccggtca

SEQ ID NO: 7069 - DNA, 25 bp, S. cerevisiae
agtgcccttgaattgctgcagcatc

SEQ ID NO: 7070 - DNA, 25 bp, S. cerevisiae
agtgttcttgtatccgtcatcatca

SEQ ID NO: 7071 - DNA, 25 bp, S. cerevisiae
agtcttcctgttcccctaatgagga

SEQ ID NO: 7072 - DNA, 25 bp, S. cerevisiae
agtacttcgttcgttccaagagctg

SEQ ID NO: 7073 - DNA, 25 bp, S. cerevisiae
agtcaacggtctcttccagcaggaa

SEQ ID NO: 7074 - DNA, 25 bp, S. cerevisiae
agatgaggcattccgatggcttaga

SEQ ID NO: 7075 - DNA, 25 bp, S. cerevisiae
agtgacgtcgcttactctgttccta

SEQ ID NO: 7076 - DNA, 25 bp, S. cerevisiae
agtgaatcctcaatacctaatcctt

SEQ ID NO: 7077 - DNA, 25 bp, S. cerevisiae
agtgttcctctttctgctaatacag

SEQ ID NO: 7078 - DNA, 25 bp, S. cerevisiae
agtagcattctctctgacggtgaag

SEQ ID NO: 7079 - DNA, 25 bp, S. cerevisiae
agtgactctatctttatggcaggaa

SEQ ID NO: 7080 - DNA, 25 bp, S. cerevisiae
agtcgccagcattgtctctggagag

SEQ ID NO: 7081 - DNA, 25 bp, S. cerevisiae
agtgatcactgaattcggcgctttg

SEQ ID NO: 7082 - DNA, 25 bp, S. cerevisiae
agtcgcactgagagcccgtttgagg

SEQ ID NO: 7083 - DNA, 25 bp, S. cerevisiae
agtcacagtataacccctattcatg

SEQ ID NO: 7084 - DNA, 25 bp, S. cerevisiae
agtgcaagactatccgttcatccaa

SEQ ID NO: 7085 - DNA, 25 bp, S. cerevisiae
agtgacggtgtgtctctttcacaaa

SEQ ID NO: 7086 - DNA, 25 bp, S. cerevisiae
agtgcacagttttcacctgtagcaa

SEQ ID NO: 7087 - DNA, 25 bp, S. cerevisiae
agtgcacttttctttcaatacaatc

SEQ ID NO: 7088 - DNA, 25 bp, S. cerevisiae
agtcctttatgacccagaaccattc

SEQ ID NO: 7089 - DNA, 25 bp, S. cerevisiae
agtccattttacctcagaatcctga

SEQ ID NO: 7090 - DNA, 25 bp, S. cerevisiae
agtccatgtctgtagcctctaaaag

SEQ ID NO: 7091 - DNA, 25 bp, S. cerevisiae
agtgactccgagcaagattctaaag

SEQ ID NO: 7092 - DNA, 25 bp, S. cerevisiae
actacccagaggtgattctcgacgt

SEQ ID NO: 7093 - DNA, 25 bp, S. cerevisiae
agtcctcgaaaagcatccgtgtagt

SEQ ID NO: 7094 - DNA, 25 bp, S. cerevisiae
agtcctctgcgaagaatcatgcctt

SEQ ID NO: 7095 - DNA, 25 bp, S. cerevisiae
agtgcgagtgcgtcgagatcacgtt

SEQ ID NO: 7096 - DNA, 25 bp, S. cerevisiae
agtcgagtcgtggttacaggatatc

SEQ ID NO: 7097 - DNA, 25 bp, S. cerevisiae
agtcgcagacgtaatgtacttggac

SEQ ID NO: 7098 - DNA, 25 bp, S. cerevisiae
agaccctgcctggactgattttaag

SEQ ID NO: 7099 - DNA, 25 bp, S. cerevisiae
agtccctgctcctagtttaaacaat

SEQ ID NO: 7100 - DNA, 25 bp, S. cerevisiae
agtctccgtggaaggtgtcaacgtt

SEQ ID NO: 7101 - DNA, 25 bp, S. cerevisiae
agtagcaccttttgcgtgtcttctt

SEQ ID NO: 7102 - DNA, 25 bp, S. cerevisiae
agtgctggtattagagtttcccctc

SEQ ID NO: 7103 - DNA, 25 bp, S. cerevisiae
agttggtatttctgttcctttccat

SEQ ID NO: 7104 - DNA, 25 bp, S. cerevisiae
agtaatcctttgaaacgcctgttga

SEQ ID NO: 7105 - DNA, 25 bp, S. cerevisiae
agtactattagtcgcaattgccgtc

SEQ ID NO: 7106 - DNA, 25 bp, S. cerevisiae
agtagtgactacagttgcctcgcaa

SEQ ID NO: 7107 - DNA, 25 bp, S. cerevisiae
agtacaacttgctagtcgcgaacgc

SEQ ID NO: 7108 - DNA, 25 bp, S. cerevisiae
agtgaaacctctggtcgttatgcca

SEQ ID NO: 7109 - DNA, 25 bp, S. cerevisiae
agtaaacgtctcgtcgatatcggag

SEQ ID NO: 7110 - DNA, 25 bp, S. cerevisiae
agtgaagccaggcatggacctgaaa

SEQ ID NO: 7111 - DNA, 25 bp, S. cerevisiae
agtaatgctgcatcgtgtaccgaaa

SEQ ID NO: 7112 - DNA, 25 bp, S. cerevisiae
agtcctctgaagctgacaccgagat

SEQ ID NO: 7113 - DNA, 25 bp, S. cerevisiae
agtcgatagctttacgcatccgaaa

SEQ ID NO: 7114 - DNA, 25 bp, S. cerevisiae
agtgactaggtttcagatgcctgaa

SEQ ID NO: 7115 - DNA, 25 bp, S. cerevisiae
agaggctgatgccactccagatgac

SEQ ID NO: 7116 - DNA, 25 bp, S. cerevisiae
agttccgccatcgagaaatcgtcaa

SEQ ID NO: 7117 - DNA, 25 bp, S. cerevisiae
agataccttcctgggctacgtcaga

SEQ ID NO: 7118 - DNA, 25 bp, S. cerevisiae
agtagccataccaacgaacgtcaat

SEQ ID NO: 7119 - DNA, 25 bp, S. cerevisiae
agtcactaaccccagatgagcgttt

SEQ ID NO: 7120 - DNA, 25 bp, S. cerevisiae
agtcagtaacgcctctgctaggtag

SEQ ID NO: 7121 - DNA, 25 bp, S. cerevisiae
agtgcagcctttcagtcattatcta

SEQ ID NO: 7122 - DNA, 25 bp, S. cerevisiae
agtcgtgatgattcagggcttacaa

SEQ ID NO: 7123 - DNA, 25 bp, S. cerevisiae
accagggtaccgaagatgtcagtga

SEQ ID NO: 7124 - DNA, 25 bp, S. cerevisiae
accagtgttacccaaggtcagttgg

SEQ ID NO: 7125 - DNA, 25 bp, S. cerevisiae
agtcgcgattattccgagttgtgta

SEQ ID NO: 7126 - DNA, 25 bp, S. cerevisiae
agtcatgattttgtccctggtaata

SEQ ID NO: 7127 - DNA, 25 bp, S. cerevisiae
agtgcttctgttatacctggtggct

SEQ ID NO: 7128 - DNA, 25 bp, S. cerevisiae
agtaatcaagctttgggcacgtggt

SEQ ID NO: 7129 - DNA, 25 bp, S. cerevisiae
agtcgcaatatggagccgccctggg

SEQ ID NO: 7130 - DNA, 25 bp, S. cerevisiae
agttggaagccctgtcaagtgtcga

SEQ ID NO: 7131 - DNA, 25 bp, S. cerevisiae
agtctgtacccctgaaatttctgat

SEQ ID NO: 7132 - DNA, 25 bp, S. cerevisiae
agtctttcccactcaaaatctttgc

SEQ ID NO: 7133 - DNA, 25 bp, S. cerevisiae
agtaacttccacatttcttttcttg

SEQ ID NO: 7134 - DNA, 25 bp, S. cerevisiae
agtgcccttcaattttttcttgttg

SEQ ID NO: 7135 - DNA, 25 bp, S. cerevisiae
agtagccgtgaatcttttacagaca

SEQ ID NO: 7136 - DNA, 25 bp, S. cerevisiae
agtcggtcatggcttgttttcagca

SEQ ID NO: 7137 - DNA, 25 bp, S. cerevisiae
agtgctgctttcatgtttttctatc

SEQ ID NO: 7138 - DNA, 25 bp, S. cerevisiae
agtcgctgatttggtagtctctttg

SEQ ID NO: 7139 - DNA, 25 bp, S. cerevisiae
agtcgctgcaattggtatggccctt

SEQ ID NO: 7140 - DNA, 25 bp, S. cerevisiae
agacgtaatgaccaaacctcttccg

SEQ ID NO: 7141 - DNA, 25 bp, S. cerevisiae
agtcattccagagagtcggcttcgg

SEQ ID NO: 7142 - DNA, 25 bp, S. cerevisiae
agtgctatcccagatgtcgttgacg

SEQ ID NO: 7143 - DNA, 25 bp, S. cerevisiae
agttgcaacattcttaattctccca

SEQ ID NO: 7144 - DNA, 25 bp, S. cerevisiae
agtcaagaactatggccctttcacc

SEQ ID NO: 7145 - DNA, 25 bp, S. cerevisiae
agtcacgttgagtaggtcgcttatc

SEQ ID NO: 7146 - DNA, 25 bp, S. cerevisiae
agtccctagactatgttgctaatgc

SEQ ID NO: 7147 - DNA, 25 bp, S. cerevisiae
agtcctgccaccaacttttgaagag

SEQ ID NO: 7148 - DNA, 25 bp, S. cerevisiae
tagtccggtctataatatcgtagtg

SEQ ID NO: 7149 - DNA, 25 bp, S. cerevisiae
agtaccttgccatagaatcgttggt

SEQ ID NO: 7150 - DNA, 25 bp, S. cerevisiae
agtaacactaacgattgcagctatg

SEQ ID NO: 7151 - DNA, 25 bp, S. cerevisiae
agtagactatcacgctattccggga

SEQ ID NO: 7152 - DNA, 25 bp, S. cerevisiae
agatagacgacgagcccatgcaggc

SEQ ID NO: 7153 - DNA, 25 bp, S. cerevisiae
agatatacatgtctggcccttggct

SEQ ID NO: 7154 - DNA, 25 bp, S. cerevisiae
agataaccgttgtgcctgttgtggc

SEQ ID NO: 7155 - DNA, 25 bp, S. cerevisiae
agttttcgttactgctgcatttggc

SEQ ID NO: 7156 - DNA, 25 bp, S. cerevisiae
agtagatgacttccaggcacagtga

SEQ ID NO: 7157 - DNA, 25 bp, S. cerevisiae
agatagatatgcttccaccacggtt

SEQ ID NO: 7158 - DNA, 25 bp, S. cerevisiae
agactagatctcacaactgggctgc

SEQ ID NO: 7159 - DNA, 25 bp, S. cerevisiae
agtcaaaccatagagctcagctgct

SEQ ID NO: 7160 - DNA, 25 bp, S. cerevisiae
agtcaaattatacactttcttagct

SEQ ID NO: 7161 - DNA, 25 bp, S. cerevisiae
agtctgctgtgcctttgatgggtac

SEQ ID NO: 7162 - DNA, 25 bp, S. cerevisiae
agtctgctgtacttggttgcgctgc

SEQ ID NO: 7163 - DNA, 25 bp, S. cerevisiae
agccgtttgggttcgagaatttcat

SEQ ID NO: 7164 - DNA, 25 bp, S. cerevisiae
agctggttttggtatcggtgaattc

SEQ ID NO: 7165 - DNA, 25 bp, S. cerevisiae
agtacgctcaagatatcggtgtttt

SEQ ID NO: 7166 - DNA, 25 bp, S. cerevisiae
agtcgagtccagtgattgttctttt

SEQ ID NO: 7167 - DNA, 25 bp, S. cerevisiae
agtcgtgctccacttggtggtttta

SEQ ID NO: 7168 - DNA, 25 bp, S. cerevisiae
agtagcgcgtacatgggtttcctga

SEQ ID NO: 7169 - DNA, 25 bp, S. cerevisiae
agtaccgctggcttgatgtgtttcc

SEQ ID NO: 7170 - DNA, 25 bp, S. cerevisiae
agtcgtattggctttggtttgctct

SEQ ID NO: 7171 - DNA, 25 bp, S. cerevisiae
agtcggtttgagtggtctagctgct

SEQ ID NO: 7172 - DNA, 25 bp, S. cerevisiae
agtcgggttaattctgtctggtgta

SEQ ID NO: 7173 - DNA, 25 bp, S. cerevisiae
actacctgaaccatttgacgtcgtg

SEQ ID NO: 7174 - DNA, 25 bp, S. cerevisiae
agtcgcattagtcctgacgttggta

SEQ ID NO: 7175 - DNA, 25 bp, S. cerevisiae
agtatgtagctattttttccagtcg

SEQ ID NO: 7176 - DNA, 25 bp, S. cerevisiae
agtgcccgctttatctttatctaag

SEQ ID NO: 7177 - DNA, 25 bp, S. cerevisiae
agtcggccgtgtcgttttgatcaaa

SEQ ID NO: 7178 - DNA, 25 bp, S. cerevisiae
agtctgggtgttcttgatgctattt

SEQ ID NO: 7179 - DNA, 25 bp, S. cerevisiae
agtccgctggtgtccaaggttccaa

SEQ ID NO: 7180 - DNA, 25 bp, S. cerevisiae
agtccatcaatatcaagggttctta

SEQ ID NO: 7181 - DNA, 25 bp, S. cerevisiae
agtatatggcttccggtttgatccc

SEQ ID NO: 7182 - DNA, 25 bp, S. cerevisiae
agtctatgccttccagttcttattt

SEQ ID NO: 7183 - DNA, 25 bp, S. cerevisiae
agtccatccaatacatttctctatc

SEQ ID NO: 7184 - DNA, 25 bp, S. cerevisiae
agtccatcgatgagctcttcacaag

SEQ ID NO: 7185 - DNA, 25 bp, S. cerevisiae
agtgccacttactttgatcaactgg

SEQ ID NO: 7186 - DNA, 25 bp, S. cerevisiae
agtgccactgatattgagccctctg

SEQ ID NO: 7187 - DNA, 25 bp, S. cerevisiae
agtgccttatatgataccgcttggt

SEQ ID NO: 7188 - DNA, 25 bp, S. cerevisiae
agtcagcttccttgtgtacctttta

SEQ ID NO: 7189 - DNA, 25 bp, S. cerevisiae
agtcctgttcggtttgctgatactg

SEQ ID NO: 7190 - DNA, 25 bp, S. cerevisiae
agtcatctcacccaagctaagggct

SEQ ID NO: 7191 - DNA, 25 bp, S. cerevisiae
agaggcgtttccttaactgcggcaa

SEQ ID NO: 7192 - DNA, 25 bp, S. cerevisiae
agttggtctacctcagaatgcggaa

SEQ ID NO: 7193 - DNA, 25 bp, S. cerevisiae
agtattttccgcttgcaagatgccc

SEQ ID NO: 7194 - DNA, 25 bp, S. cerevisiae
agttatccatgattactccgggttt

SEQ ID NO: 7195 - DNA, 25 bp, S. cerevisiae
agtccatttggtttctcgacgatgt

SEQ ID NO: 7196 - DNA, 25 bp, S. cerevisiae
agtttctggttcattcaaagctgtc

SEQ ID NO: 7197 - DNA, 25 bp, S. cerevisiae
agtatacgaaggcttaccgcatccc

SEQ ID NO: 7198 - DNA, 25 bp, S. cerevisiae
agatagacttcgatattaccgcccc

SEQ ID NO: 7199 - DNA, 25 bp, S. cerevisiae
agtcatttgtttctgctctggtata

SEQ ID NO: 7200 - DNA, 25 bp, S. cerevisiae
agtaccatccacctcacatttaaag

SEQ ID NO: 7201 - DNA, 25 bp, S. cerevisiae
agtaccatgctacccatattcttca

SEQ ID NO: 7202 - DNA, 25 bp, S. cerevisiae
agtaccttttccatctcttgatttc

SEQ ID NO: 7203 - DNA, 25 bp, S. cerevisiae
agtatctcaaattctatctcgtttt

SEQ ID NO: 7204 - DNA, 25 bp, S. cerevisiae
agtcgatcatccctatccaaatatt

SEQ ID NO: 7205 - DNA, 25 bp, S. cerevisiae
agtcgctgcatcattctctcaagaa

SEQ ID NO: 7206 - DNA, 25 bp, S. cerevisiae
agtcactactatactcatacgccat

SEQ ID NO: 7207 - DNA, 25 bp, S. cerevisiae
agtaccagtgatactgccagtgcca

SEQ ID NO: 7208 - DNA, 25 bp, S. cerevisiae
agtaccgatgctccactattgaagg

SEQ ID NO: 7209 - DNA, 25 bp, S. cerevisiae
agtactatgcgtgctttgaatgcca

SEQ ID NO: 7210 - DNA, 25 bp, S. cerevisiae
agtaccatccgcgttattagtattg

SEQ ID NO: 7211 - DNA, 25 bp, S. cerevisiae
agtctccaatcaaggttgtcggctt

SEQ ID NO: 7212 - DNA, 25 bp, S. cerevisiae
agtctgccaatcagttcctggagat

SEQ ID NO: 7213 - DNA, 25 bp, S. cerevisiae
agtcaccacatctagttccattagt

SEQ ID NO: 7214 - DNA, 25 bp, S. cerevisiae
agtcatgctaccgagatgttctaaa

SEQ ID NO: 7215 - DNA, 25 bp, S. cerevisiae
agtctagagccatgtcgatttcaac

SEQ ID NO: 7216 - DNA, 25 bp, S. cerevisiae
agttatgactggttcgatcggctat

SEQ ID NO: 7217 - DNA, 25 bp, S. cerevisiae
agtaattctggattctcacggcaag

SEQ ID NO: 7218 - DNA, 25 bp, S. cerevisiae
agtctcctcatggtgatgaccgtga

SEQ ID NO: 7219 - DNA, 25 bp, S. cerevisiae
agtcacatctgggtggatccgatta

SEQ ID NO: 7220 - DNA, 25 bp, S. cerevisiae
agtcaattgcgcatgcgtgctcaat

SEQ ID NO: 7221 - DNA, 25 bp, S. cerevisiae
agtaaacccggccatagctggctcc

SEQ ID NO: 7222 - DNA, 25 bp, S. cerevisiae
agaccggatgctacgtagagaacct

SEQ ID NO: 7223 - DNA, 25 bp, S. cerevisiae
agatccgcctcagagctgacaaagg

SEQ ID NO: 7224 - DNA, 25 bp, S. cerevisiae
agtacctcgagctgtgcaaactggc

SEQ ID NO: 7225 - DNA, 25 bp, S. cerevisiae
agtaattggtgacctcggctcctgc

SEQ ID NO: 7226 - DNA, 25 bp, S. cerevisiae
accttggtcaggtttctacaggaag

SEQ ID NO: 7227 - DNA, 25 bp, S. cerevisiae
accattgtaaggtgttccagttcaa

SEQ ID NO: 7228 - DNA, 25 bp, S. cerevisiae
agtcgttactgcaatgcggtttccc

SEQ ID NO: 7229 - DNA, 25 bp, S. cerevisiae
agtcacttccaaagcgttttcctct

SEQ ID NO: 7230 - DNA, 25 bp, S. cerevisiae
agtctctatctcaaaacggtacctc

SEQ ID NO: 7231 - DNA, 25 bp, S. cerevisiae
agttttgccatgcaactggacccca

SEQ ID NO: 7232 - DNA, 25 bp, S. cerevisiae
ctgttttcaacgtactgggaccact

SEQ ID NO: 7233 - DNA, 25 bp, S. cerevisiae
agtatatccaacagcttcgaccgga

SEQ ID NO: 7234 - DNA, 25 bp, S. cerevisiae
agtacatcatcaccaaattcgactg

SEQ ID NO: 7235 - DNA, 25 bp, S. cerevisiae
agtctcacacacagtttctttcaaa

SEQ ID NO: 7236 - DNA, 25 bp, S. cerevisiae
agtttcacgccctttgtctacagaa

SEQ ID NO: 7237 - DNA, 25 bp, S. cerevisiae
agtctaccggcgtgggcagtcaaag

SEQ ID NO: 7238 - DNA, 25 bp, S. cerevisiae
ggtctacccgaatcggaggactcat

SEQ ID NO: 7239 - DNA, 25 bp, S. cerevisiae
agtctattttccagtcactcaaggc

SEQ ID NO: 7240 - DNA, 25 bp, S. cerevisiae
agtcttcttctactggccttgaagg

SEQ ID NO: 7241 - DNA, 25 bp, S. cerevisiae
agtagttacagattcaccttcaccc

SEQ ID NO: 7242 - DNA, 25 bp, S. cerevisiae
agttgtctcccattaaggtgccgga

SEQ ID NO: 7243 - DNA, 25 bp, S. cerevisiae
agaggttcaacacgaaggtgcttat

SEQ ID NO: 7244 - DNA, 25 bp, S. cerevisiae
aagcgccaataatgacggagttact

SEQ ID NO: 7245 - DNA, 25 bp, S. cerevisiae
agagcagccacatcaacagggcaat

SEQ ID NO: 7246 - DNA, 25 bp, S. cerevisiae
agtctcttcgtcttcatctaacatt

SEQ ID NO: 7247 - DNA, 25 bp, S. cerevisiae
agtctcgatcttgtctccaatgata

SEQ ID NO: 7248 - DNA, 25 bp, S. cerevisiae
agtacagcagcggtgtcctacataa

SEQ ID NO: 7249 - DNA, 25 bp, S. cerevisiae
agtctacgactgtggcgaaaggcta

SEQ ID NO: 7250 - DNA, 25 bp, S. cerevisiae
agtttaaacccctacattgctatcg

SEQ ID NO: 7251 - DNA, 25 bp, S. cerevisiae
agttttatcgctgattactccttcg

SEQ ID NO: 7252 - DNA, 25 bp, S. cerevisiae
agttttatcgtctacatcgtccttt

SEQ ID NO: 7253 - DNA, 25 bp, S. cerevisiae
agtttttcatcgcagtcttttatta

SEQ ID NO: 7254 - DNA, 25 bp, S. cerevisiae
agtcattttcaacaagctatctaga

SEQ ID NO: 7255 - DNA, 25 bp, S. cerevisiae
agtctggtttacacgctgcattgaa

SEQ ID NO: 7256 - DNA, 25 bp, S. cerevisiae
agtagtgttttatcagaatcgcaag

SEQ ID NO: 7257 - DNA, 25 bp, S. cerevisiae
agtactctcttggaagtgaactaag

SEQ ID NO: 7258 - DNA, 25 bp, S. cerevisiae
agtactccgtcaaaattctctaatg

SEQ ID NO: 7259 - DNA, 25 bp, S. cerevisiae
agtacaatcggcaaagtcttcttca

SEQ ID NO: 7260 - DNA, 25 bp, S. cerevisiae
agtacaatcggctctgttcctgaaa

SEQ ID NO: 7261 - DNA, 25 bp, S. cerevisiae
agtagattaggctcgagctcccaaa

SEQ ID NO: 7262 - DNA, 25 bp, S. cerevisiae
agtacaataagctcgtcctccaatt

SEQ ID NO: 7263 - DNA, 25 bp, S. cerevisiae
agtaaacaatgttggctcctcacaa

SEQ ID NO: 7264 - DNA, 25 bp, S. cerevisiae
agtatgcaatgactcaagccccacg

SEQ ID NO: 7265 - DNA, 25 bp, S. cerevisiae
agtcagaaggtctccgacagcggaa

SEQ ID NO: 7266 - DNA, 25 bp, S. cerevisiae
agtaccaagacacccgcacgtggaa

SEQ ID NO: 7267 - DNA, 25 bp, S. cerevisiae
agaggcacaaactccagggtgtaga

SEQ ID NO: 7268 - DNA, 25 bp, S. cerevisiae
agttgcaaagcagaccgaggattca

SEQ ID NO: 7269 - DNA, 25 bp, S. cerevisiae
agtacaatctgttctacccagctat

SEQ ID NO: 7270 - DNA, 25 bp, S. cerevisiae
agtaccatcggtaaaactgctcttg

SEQ ID NO: 7271 - DNA, 25 bp, S. cerevisiae
agacccattgggagaaccatttgat

SEQ ID NO: 7272 - DNA, 25 bp, S. cerevisiae
agtatgctcctgtgagtaaccttag

SEQ ID NO: 7273 - DNA, 25 bp, S. cerevisiae
agttcttcgggatggacagcttgaa

SEQ ID NO: 7274 - DNA, 25 bp, S. cerevisiae
agtcgtccggcactcaagaagttta

SEQ ID NO: 7275 - DNA, 25 bp, S. cerevisiae
agtcattacccatccaattgctggt

SEQ ID NO: 7276 - DNA, 25 bp, S. cerevisiae
agtctgaagcgcgtggcaacttgct

SEQ ID NO: 7277 - DNA, 25 bp, S. cerevisiae
agtacggagctgtggacgtctctaa

SEQ ID NO: 7278 - DNA, 25 bp, S. cerevisiae
agtacagaaggatagccgcacttga

SEQ ID NO: 7279 - DNA, 25 bp, S. cerevisiae
agtttcaaagtgaagctcaacggct

SEQ ID NO: 7280 - DNA, 25 bp, S. cerevisiae
agtagatgttccttccaacgacagt

SEQ ID NO: 7281 - DNA, 25 bp, S. cerevisiae
agtatgtcgctagccatgaatctca

SEQ ID NO: 7282 - DNA, 25 bp, S. cerevisiae
agtcatgtcttaccgctatgttcaa

SEQ ID NO: 7283 - DNA, 25 bp, S. cerevisiae
agtagacttagaccgctttcatata

SEQ ID NO: 7284 - DNA, 25 bp, S. cerevisiae
agtatattaactgcactggcgctaa

SEQ ID NO: 7285 - DNA, 25 bp, S. cerevisiae
agtcaattaccttaagccctacagt

SEQ ID NO: 7286 - DNA, 25 bp, S. cerevisiae
agttacttctgctggttccggatgc

SEQ ID NO: 7287 - DNA, 25 bp, S. cerevisiae
agtacattagcagcggtgcccgtat

SEQ ID NO: 7288 - DNA, 25 bp, S. cerevisiae
agttaatccccatgcgtgacaacat

SEQ ID NO: 7289 - DNA, 25 bp, S. cerevisiae
agtctttcccctgggtcagatacaa

SEQ ID NO: 7290 - DNA, 25 bp, S. cerevisiae
agttttccctcaggagccagtagac

SEQ ID NO: 7291 - DNA, 25 bp, S. cerevisiae
agtttcatgcgtacagtgcgccagt

SEQ ID NO: 7292 - DNA, 25 bp, S. cerevisiae
agtttacagctcgttactacacacc

SEQ ID NO: 7293 - DNA, 25 bp, S. cerevisiae
agtcactctttgcagctttaaacga

SEQ ID NO: 7294 - DNA, 25 bp, S. cerevisiae
agtcatacactactgtcacttctga

SEQ ID NO: 7295 - DNA, 25 bp, S. cerevisiae
agttcccttcgtggctttgaataag

SEQ ID NO: 7296 - DNA, 25 bp, S. cerevisiae
agtactatcatcttacccttctaga

SEQ ID NO: 7297 - DNA, 25 bp, S. cerevisiae
agtcagcgactggtaagcttggtaa

SEQ ID NO: 7298 - DNA, 25 bp, S. cerevisiae
agtcatctgggcctacgttacaaga

SEQ ID NO: 7299 - DNA, 25 bp, S. cerevisiae
agttgggaccttgttcacagataat

SEQ ID NO: 7300 - DNA, 25 bp, S. cerevisiae
agtctaagatccaccaccaaatatt

SEQ ID NO: 7301 - DNA, 25 bp, S. cerevisiae
agttccactttataccaagatcatt

SEQ ID NO: 7302 - DNA, 25 bp, S. cerevisiae
agtaacactacttcccacgattcat

SEQ ID NO: 7303 - DNA, 25 bp, S. cerevisiae
agtaagcatacgctccacggatatt

SEQ ID NO: 7304 - DNA, 25 bp, S. cerevisiae
agtacagtcaccaccactggaaagt

SEQ ID NO: 7305 - DNA, 25 bp, S. cerevisiae
agtctacttgactgctgtcttggaa

SEQ ID NO: 7306 - DNA, 25 bp, S. cerevisiae
cttgccacggtcagattttggtaca

SEQ ID NO: 7307 - DNA, 25 bp, S. cerevisiae
agtatgcctgtgttgcaaacctgga

SEQ ID NO: 7308 - DNA, 25 bp, S. cerevisiae
agttcattgttttcccctgtggcca

SEQ ID NO: 7309 - DNA, 25 bp, S. cerevisiae
agttgattaaatctccctatgggaa

SEQ ID NO: 7310 - DNA, 25 bp, S. cerevisiae
agttttccaaggtccgtgatggcga

SEQ ID NO: 7311 - DNA, 25 bp, S. cerevisiae
agtttgcctatatatcagttttcag

SEQ ID NO: 7312 - DNA, 25 bp, S. cerevisiae
agtcttcttcattctttttcctcgt

SEQ ID NO: 7313 - DNA, 25 bp, S. cerevisiae
agtctttactttctgattccggatc

SEQ ID NO: 7314 - DNA, 25 bp, S. cerevisiae
agtattttccttctgttgccaaaat

SEQ ID NO: 7315 - DNA, 25 bp, S. cerevisiae
agtttagcttcaccttttggctcaa

SEQ ID NO: 7316 - DNA, 25 bp, S. cerevisiae
agtattgcacttcttacgttgtata

SEQ ID NO: 7317 - DNA, 25 bp, S. cerevisiae
agtcatttttctcggcggcattaat

SEQ ID NO: 7318 - DNA, 25 bp, S. cerevisiae
agttgttaacatgtccttcggaggt

SEQ ID NO: 7319 - DNA, 25 bp, S. cerevisiae
agttcttcaactatgacggcagcga

SEQ ID NO: 7320 - DNA, 25 bp, S. cerevisiae
agttcatccaggcaagggcgatcag

SEQ ID NO: 7321 - DNA, 25 bp, S. cerevisiae
agttaccatagtacagcgtcctcag

SEQ ID NO: 7322 - DNA, 25 bp, S. cerevisiae
agtttcgtgaaaccacgcaggcctt

SEQ ID NO: 7323 - DNA, 25 bp, S. cerevisiae
agtatgtctggaacaccaaaccctc

SEQ ID NO: 7324 - DNA, 25 bp, S. cerevisiae
agctccgctagaaacgtatacccga

SEQ ID NO: 7325 - DNA, 25 bp, S. cerevisiae
agtactctcataaaggtttgcccga

SEQ ID NO: 7326 - DNA, 25 bp, S. cerevisiae
agtacatctatgaccgcagtttcgc

SEQ ID NO: 7327 - DNA, 25 bp, S. cerevisiae
agtaatcttctaggcgctgcaatag

SEQ ID NO: 7328 - DNA, 25 bp, S. cerevisiae
agtagatctctttccgtctaaggct

SEQ ID NO: 7329 - DNA, 25 bp, S. cerevisiae
agtacgatgctgatgttttggacaa

SEQ ID NO: 7330 - DNA, 25 bp, S. cerevisiae
agttcaacttctatttccatcagcg

SEQ ID NO: 7331 - DNA, 25 bp, S. cerevisiae
agtaggccttttcttcaatcatcga

SEQ ID NO: 7332 - DNA, 25 bp, S. cerevisiae
agtaatgccttttctttactcacgc

SEQ ID NO: 7333 - DNA, 25 bp, S. cerevisiae
agtaagcttatcatccttctggatt

SEQ ID NO: 7334 - DNA, 25 bp, S. cerevisiae
agtacaatctcacccacaacattaa

SEQ ID NO: 7335 - DNA, 25 bp, S. cerevisiae
agtacatttctcaacaagagcttga

SEQ ID NO: 7336 - DNA, 25 bp, S. cerevisiae
agtatccttctccacaacagatgta

SEQ ID NO: 7337 - DNA, 25 bp, S. cerevisiae
agtttcgtttacaaggctggtccat

SEQ ID NO: 7338 - DNA, 25 bp, S. cerevisiae
agtttgctgctgatttggatgctgc

SEQ ID NO: 7339 - DNA, 25 bp, S. cerevisiae
agtcaattcattcttggcatcgccc

SEQ ID NO: 7340 - DNA, 25 bp, S. cerevisiae
agtaatttaatctctgttgctcagc

SEQ ID NO: 7341 - DNA, 25 bp, S. cerevisiae
agtcacaatgttctcagctttgcca

SEQ ID NO: 7342 - DNA, 25 bp, S. cerevisiae
agtagcggattgcatgcgtcttcaa

SEQ ID NO: 7343 - DNA, 25 bp, S. cerevisiae
agtcagtggctgttgatcctcttga

SEQ ID NO: 7344 - DNA, 25 bp, S. cerevisiae
agtcaagttcaaattcaagctccag

SEQ ID NO: 7345 - DNA, 25 bp, S. cerevisiae
agtcatctgttggtactaactccgc

SEQ ID NO: 7346 - DNA, 25 bp, S. cerevisiae
agtcacttcggctaatgaacataca

SEQ ID NO: 7347 - DNA, 25 bp, S. cerevisiae
agttccatggcggtggtttcacaaa

SEQ ID NO: 7348 - DNA, 25 bp, S. cerevisiae
agattacgttccagctttcgatgtc

SEQ ID NO: 7349 - DNA, 25 bp, S. cerevisiae
agtaaagccacgatcgatttctcca

SEQ ID NO: 7350 - DNA, 25 bp, S. cerevisiae
agtacaacaacgattgctgctcctc

SEQ ID NO: 7351 - DNA, 25 bp, S. cerevisiae
agatttgccgatggtttcaggtacg

SEQ ID NO: 7352 - DNA, 25 bp, S. cerevisiae
agttgggccatgttccacttgtgga

SEQ ID NO: 7353 - DNA, 25 bp, S. cerevisiae
agttgttgcccacaatgttgctgga

SEQ ID NO: 7354 - DNA, 25 bp, S. cerevisiae
agtaccactagaactgtcgttgtca

SEQ ID NO: 7355 - DNA, 25 bp, S. cerevisiae
agtaccgctggatccttttgacatt

SEQ ID NO: 7356 - DNA, 25 bp, S. cerevisiae
agttcgcttatctcggatctacatt

SEQ ID NO: 7357 - DNA, 25 bp, S. cerevisiae
agttgcaagctatccaggcgggcca

SEQ ID NO: 7358 - DNA, 25 bp, S. cerevisiae
agttcaagttgctcactggtgggct

SEQ ID NO: 7359 - DNA, 25 bp, S. cerevisiae
agtatcgaattctaccttgggtgta

SEQ ID NO: 7360 - DNA, 25 bp, S. cerevisiae
agtatcggatcttttctggcgggtc

SEQ ID NO: 7361 - DNA, 25 bp, S. cerevisiae
agtagtggagctttagtgccccagt

SEQ ID NO: 7362 - DNA, 25 bp, S. cerevisiae
agtacggatattaaggcatgcccac

SEQ ID NO: 7363 - DNA, 25 bp, S. cerevisiae
agtacttcttattaggatctcctgc

SEQ ID NO: 7364 - DNA, 25 bp, S. cerevisiae
agttctattgtgtgtccaggctgtc

SEQ ID NO: 7365 - DNA, 25 bp, S. cerevisiae
agtactcagcacaatttccgaaggg

SEQ ID NO: 7366 - DNA, 25 bp, S. cerevisiae
agtagacagttcatccctcaataag

SEQ ID NO: 7367 - DNA, 25 bp, S. cerevisiae
agtactaccattgccttccaattaa

SEQ ID NO: 7368 - DNA, 25 bp, S. cerevisiae
agtacattattttgccctccaattc

SEQ ID NO: 7369 - DNA, 25 bp, S. cerevisiae
agtatactcattccctccactatat

SEQ ID NO: 7370 - DNA, 25 bp, S. cerevisiae
agtatatatgtctcctcaagcagaa

SEQ ID NO: 7371 - DNA, 25 bp, S. cerevisiae
agtatagatgatttccacacagcga

SEQ ID NO: 7372 - DNA, 25 bp, S. cerevisiae
agtaggcagcactctgatgtcgcga

SEQ ID NO: 7373 - DNA, 25 bp, S. cerevisiae
agttgtgcgcactatcgaaggccac

SEQ ID NO: 7374 - DNA, 25 bp, S. cerevisiae
agtttgcaagtgtgcgtgagcgaca

SEQ ID NO: 7375 - DNA, 25 bp, S. cerevisiae
actatgaccgagtccttggttttct

SEQ ID NO: 7376 - DNA, 25 bp, S. cerevisiae
agtagaccctgctatcttgagtgtt

SEQ ID NO: 7377 - DNA, 25 bp, S. cerevisiae
agttccagattcttgcacttttcgc

SEQ ID NO: 7378 - DNA, 25 bp, S. cerevisiae
agtttggacacactgcgttcttctg

SEQ ID NO: 7379 - DNA, 25 bp, S. cerevisiae
agttctggcgacgatcaagtcttcg

SEQ ID NO: 7380 - DNA, 25 bp, S. cerevisiae
agtttggcgccaataaccttatcct

SEQ ID NO: 7381 - DNA, 25 bp, S. cerevisiae
agatgattctggatggacacctttc

SEQ ID NO: 7382 - DNA, 25 bp, S. cerevisiae
agtatgcctctactggtgcgcagca

SEQ ID NO: 7383 - DNA, 25 bp, S. cerevisiae
agtattgtcaatgagggcgccgccg

SEQ ID NO: 7384 - DNA, 25 bp, S. cerevisiae
agattgtccaaccaaactttgaggg

SEQ ID NO: 7385 - DNA, 25 bp, S. cerevisiae
agttgccaccatgcaagtttgggat

SEQ ID NO: 7386 - DNA, 25 bp, S. cerevisiae
agttccatccaggtggtacggacat

SEQ ID NO: 7387 - DNA, 25 bp, S. cerevisiae
agtttcacaagccacgcccgtaata

SEQ ID NO: 7388 - DNA, 25 bp, S. cerevisiae
agttccatttggttcctcagctaat

SEQ ID NO: 7389 - DNA, 25 bp, S. cerevisiae
agtttcattgggacgatgctcggcg

SEQ ID NO: 7390 - DNA, 25 bp, S. cerevisiae
agttccattcagactgacgcctaat

SEQ ID NO: 7391 - DNA, 25 bp, S. cerevisiae
agtttaacgcggtcgactatattga

SEQ ID NO: 7392 - DNA, 25 bp, S. cerevisiae
agttttatccagtccaaccagtgtt

SEQ ID NO: 7393 - DNA, 25 bp, S. cerevisiae
agactaaacctaccttcagagattt

SEQ ID NO: 7394 - DNA, 25 bp, S. cerevisiae
agttaacagcgcaccttctaattct

SEQ ID NO: 7395 - DNA, 25 bp, S. cerevisiae
agtttttggcctcattttcgctaga

SEQ ID NO: 7396 - DNA, 25 bp, S. cerevisiae
agttggtgtactgttcattccgtct

SEQ ID NO: 7397 - DNA, 25 bp, S. cerevisiae
agtttgatttcaatgttcccgtggt

SEQ ID NO: 7398 - DNA, 25 bp, S. cerevisiae
agttagattatgttttagccttgaa

SEQ ID NO: 7399 - DNA, 25 bp, S. cerevisiae
agttggattatgttttggctttgaa

SEQ ID NO: 7400 - DNA, 25 bp, S. cerevisiae
agctagacgtcgtgggcgtttccag

SEQ ID NO: 7401 - DNA, 25 bp, S. cerevisiae
agtttctgttccgttgtcgtttgcg

SEQ ID NO: 7402 - DNA, 25 bp, S. cerevisiae
agtttaccgtcccaaacattgtcat

SEQ ID NO: 7403 - DNA, 25 bp, S. cerevisiae
agttttccagaaaagagctgctgtc

SEQ ID NO: 7404 - DNA, 25 bp, S. cerevisiae
agctatctgaagttgtcgaactctt

SEQ ID NO: 7405 - DNA, 25 bp, S. cerevisiae
agtacctcgatgatgtgtctctaga

SEQ ID NO: 7406 - DNA, 25 bp, S. cerevisiae
agtacaaatcattgcttgccaccgc

SEQ ID NO: 7407 - DNA, 25 bp, S. cerevisiae
agtatgcattatgtgttcccctcat

SEQ ID NO: 7408 - DNA, 25 bp, S. cerevisiae
agtacatatgatgctgctgccaccg

SEQ ID NO: 7409 - DNA, 25 bp, S. cerevisiae
agtagcatcatgtttgccactctct

SEQ ID NO: 7410 - DNA, 25 bp, S. cerevisiae
agtagcattggctttactgcctttg

SEQ ID NO: 7411 - DNA, 25 bp, S. cerevisiae
agtacgtatgtgtgaattggcctgc

SEQ ID NO: 7412 - DNA, 25 bp, S. cerevisiae
agtttgtcactgtcaccaatgagcc

SEQ ID NO: 7413 - DNA, 25 bp, S. cerevisiae
agttctttcagaagcccttttgtag

SEQ ID NO: 7414 - DNA, 25 bp, S. cerevisiae
agtatccttatcagcacctttttat

SEQ ID NO: 7415 - DNA, 25 bp, S. cerevisiae
agttcgcgcaatacgccgttagtaa

SEQ ID NO: 7416 - DNA, 25 bp, S. cerevisiae
agttgcggaattggccggatttcca

SEQ ID NO: 7417 - DNA, 25 bp, S. cerevisiae
agttgctggacaaagcacggcttta

SEQ ID NO: 7418 - DNA, 25 bp, S. cerevisiae
agttgattacggcatctcgtcgaat

SEQ ID NO: 7419 - DNA, 25 bp, S. cerevisiae
agttgaagcacggtgtcttggcctt

SEQ ID NO: 7420 - DNA, 25 bp, S. cerevisiae
agtaggacacatttatcccactctc

SEQ ID NO: 7421 - DNA, 25 bp, S. cerevisiae
agatgataccccaattaacttcctt

SEQ ID NO: 7422 - DNA, 25 bp, S. cerevisiae
agtatcctttgaatgtgagcccctc

SEQ ID NO: 7423 - DNA, 25 bp, S. cerevisiae
agttcaatttactaagccgctccgg

SEQ ID NO: 7424 - DNA, 25 bp, S. cerevisiae
agttcatcctagactgtattggcag

SEQ ID NO: 7425 - DNA, 25 bp, S. cerevisiae
agtttccccttttagcggctgcaat

SEQ ID NO: 7426 - DNA, 25 bp, S. cerevisiae
agtatcccggtcatattgcgtgcga

SEQ ID NO: 7427 - DNA, 25 bp, S. cerevisiae
agtttccggtaacttcagtgctgaa

SEQ ID NO: 7428 - DNA, 25 bp, S. cerevisiae
agattgtctcagcttggtttggcga

SEQ ID NO: 7429 - DNA, 25 bp, S. cerevisiae
agttatccagcgattgtttgaacaa

SEQ ID NO: 7430 - DNA, 25 bp, S. cerevisiae
agtttctgagcgatttcttctatag

SEQ ID NO: 7431 - DNA, 25 bp, S. cerevisiae
agtttatccactgcttcttttgaaa

SEQ ID NO: 7432 - DNA, 25 bp, S. cerevisiae
agtttctaaatccttcacagtttga

SEQ ID NO: 7433 - DNA, 25 bp, S. cerevisiae
agttgtcaagctaacgcggtttccg

SEQ ID NO: 7434 - DNA, 25 bp, S. cerevisiae
agttacctgcgaacggttgtctcac

SEQ ID NO: 7435 - DNA, 25 bp, S. cerevisiae
agttgatcctgagaccctaccaaag

SEQ ID NO: 7436 - DNA, 25 bp, S. cerevisiae
agtagatcctgagacctggtcctta

SEQ ID NO: 7437 - DNA, 25 bp, S. cerevisiae
agttcatgctctaaaccgtgaccat

SEQ ID NO: 7438 - DNA, 25 bp, S. cerevisiae
agtttgcacaagacaccctgaagaa

SEQ ID NO: 7439 - DNA, 25 bp, S. cerevisiae
agttatcacaaacgcctctgcatga

SEQ ID NO: 7440 - DNA, 25 bp, S. cerevisiae
agtatacacagtacgatctccatcc

SEQ ID NO: 7441 - DNA, 25 bp, S. cerevisiae
agacctactccacccgagagaggtt

SEQ ID NO: 7442 - DNA, 25 bp, S. cerevisiae
agcactgcttcgcaatgccaaggag

SEQ ID NO: 7443 - DNA, 25 bp, S. cerevisiae
agtatggcttctttctcaagttctc

SEQ ID NO: 7444 - DNA, 25 bp, S. cerevisiae
agtatggtctttttgccgatgctga

SEQ ID NO: 7445 - DNA, 25 bp, S. cerevisiae
agtatagtggttgtcgcgctgctga

SEQ ID NO: 7446 - DNA, 25 bp, S. cerevisiae
agatcaggtggtactatcggcccat

SEQ ID NO: 7447 - DNA, 25 bp, S. cerevisiae
agtagtgggagattccgcattcaaa

SEQ ID NO: 7448 - DNA, 25 bp, S. cerevisiae
agtacgacctgcatccaatatcggt

SEQ ID NO: 7449 - DNA, 25 bp, S. cerevisiae
agatattaccgatccaatcccctta

SEQ ID NO: 7450 - DNA, 25 bp, S. cerevisiae
agttatccggtcaaatctctacgca

SEQ ID NO: 7451 - DNA, 25 bp, S. cerevisiae
agttctttggccgaacacattggca

SEQ ID NO: 7452 - DNA, 25 bp, S. cerevisiae
agttttcttgccaaagcctcgagta

SEQ ID NO: 7453 - DNA, 25 bp, S. cerevisiae
agttttttccaacctgtgctgaaca

SEQ ID NO: 7454 - DNA, 25 bp, S. cerevisiae
agttattgccaagaccgtagattca

SEQ ID NO: 7455 - DNA, 25 bp, S. cerevisiae
agttacaccatagatcacccagttt

SEQ ID NO: 7456 - DNA, 25 bp, S. cerevisiae
agttgacgaattctcccacgaaatc

SEQ ID NO: 7457 - DNA, 25 bp, S. cerevisiae
agttgaccaggtttgcggacagata

SEQ ID NO: 7458 - DNA, 25 bp, S. cerevisiae
agttgcccaagttgattgacacctt

SEQ ID NO: 7459 - DNA, 25 bp, S. cerevisiae
agttgcctcgcagtatttgaagttg

SEQ ID NO: 7460 - DNA, 25 bp, S. cerevisiae
agtttgacagtttcttacattgagg

SEQ ID NO: 7461 - DNA, 25 bp, S. cerevisiae
agttagaccctacttcttatgaagc

SEQ ID NO: 7462 - DNA, 25 bp, S. cerevisiae
agttggacagccagcattcttctac

SEQ ID NO: 7463 - DNA, 25 bp, S. cerevisiae
agtttgtgtacttgcattcgcccaa

SEQ ID NO: 7464 - DNA, 25 bp, S. cerevisiae
agtttcttgcgtcttcattatccta

SEQ ID NO: 7465 - DNA, 25 bp, S. cerevisiae
agtttactatatgcgtctttcacag

SEQ ID NO: 7466 - DNA, 25 bp, S. cerevisiae
agtttgttactaggcttctcttcca

SEQ ID NO: 7467 - DNA, 25 bp, S. cerevisiae
agtttcatattctccagtcttatcc

SEQ ID NO: 7468 - DNA, 25 bp, S. cerevisiae
agtagtggtgcttcaattggcgctc

SEQ ID NO: 7469 - DNA, 25 bp, S. cerevisiae
agtatactggcctttctttgtggct

SEQ ID NO: 7470 - DNA, 25 bp, S. cerevisiae
agtatcgttctcatctttgcattgt

SEQ ID NO: 7471 - DNA, 25 bp, S. cerevisiae
agtatcgcattcgttgtatccgctg

SEQ ID NO: 7472 - DNA, 25 bp, S. cerevisiae
agtttactgatgtctaccgtattga

SEQ ID NO: 7473 - DNA, 25 bp, S. cerevisiae
agtttcttactcaccgacagatggc

SEQ ID NO: 7474 - DNA, 25 bp, S. cerevisiae
agtaggtgtcctgttagatcatctg

SEQ ID NO: 7475 - DNA, 25 bp, S. cerevisiae
agatcacgttctccgcaaatcaagt

SEQ ID NO: 7476 - DNA, 25 bp, S. cerevisiae
agatccgatatctcgtattctagag

SEQ ID NO: 7477 - DNA, 25 bp, S. cerevisiae
agtattgattcacgcgattctttag

SEQ ID NO: 7478 - DNA, 25 bp, S. cerevisiae
agttattggctcctgacatcatacc

SEQ ID NO: 7479 - DNA, 25 bp, S. cerevisiae
agtttccaccgcttcttatagatta

SEQ ID NO: 7480 - DNA, 25 bp, S. cerevisiae
agtatgttgattttggtgctgctaa

SEQ ID NO: 7481 - DNA, 25 bp, S. cerevisiae
agttctgccattgagactgtgcaat

SEQ ID NO: 7482 - DNA, 25 bp, S. cerevisiae
agtttccagacaggcagtttccaca

SEQ ID NO: 7483 - DNA, 25 bp, S. cerevisiae
agtttactacggcactagcggcata

SEQ ID NO: 7484 - DNA, 25 bp, S. cerevisiae
agtttaatctgctttacggctggct

SEQ ID NO: 7485 - DNA, 25 bp, S. cerevisiae
agtttgacctggaaagcgagcgtat

SEQ ID NO: 7486 - DNA, 25 bp, S. cerevisiae
agttcgcacctaccaggaagcgttt

SEQ ID NO: 7487 - DNA, 25 bp, S. cerevisiae
agttcttcacttctgttatcttctg

SEQ ID NO: 7488 - DNA, 25 bp, S. cerevisiae
agttattactgtcgtgctctatctc

SEQ ID NO: 7489 - DNA, 25 bp, S. cerevisiae
agagttctaaagtgccgttcctcat

SEQ ID NO: 7490 - DNA, 25 bp, S. cerevisiae
agtattgccaatatccatccactgt

SEQ ID NO: 7491 - DNA, 25 bp, S. cerevisiae
agttctgaccgagccatatttaatg

SEQ ID NO: 7492 - DNA, 25 bp, S. cerevisiae
agtattctccagtgtctacatctac

SEQ ID NO: 7493 - DNA, 25 bp, S. cerevisiae
agtttcctcagttgtttcatcttcg

SEQ ID NO: 7494 - DNA, 25 bp, S. cerevisiae
agagcttccttggtagttagcccgt

SEQ ID NO: 7495 - DNA, 25 bp, S. cerevisiae
agaggcgccgggaagccgaattctt

SEQ ID NO: 7496 - DNA, 25 bp, S. cerevisiae
actttagtgactgcgccaacggaaa

SEQ ID NO: 7497 - DNA, 25 bp, S. cerevisiae
agttgctactgctgtatcgaaaagt

SEQ ID NO: 7498 - DNA, 25 bp, S. cerevisiae
agttgaacgcgaccgaaatcgagtt

SEQ ID NO: 7499 - DNA, 25 bp, S. cerevisiae
agttgagcaatggaccacccacggt

SEQ ID NO: 7500 - DNA, 25 bp, S. cerevisiae
agataagcaacatccctgacatcgg

SEQ ID NO: 7501 - DNA, 25 bp, S. cerevisiae
agatacaacgagtccctaagcagat

SEQ ID NO: 7502 - DNA, 25 bp, S. cerevisiae
agatctgcgaccactccgaaggttg

SEQ ID NO: 7503 - DNA, 25 bp, S. cerevisiae
agattggatttaccccagagctgac

SEQ ID NO: 7504 - DNA, 25 bp, S. cerevisiae
agttgccaaatcttgacatcctcac

SEQ ID NO: 7505 - DNA, 25 bp, S. cerevisiae
agttttaatcagaccatcctccaag

SEQ ID NO: 7506 - DNA, 25 bp, S. cerevisiae
agttattttcagctgtgttcccggc

SEQ ID NO: 7507 - DNA, 25 bp, S. cerevisiae
agttcatttagcttgagccttcctc

SEQ ID NO: 7508 - DNA, 25 bp, S. cerevisiae
agttttacatgattacctgttgcaa

SEQ ID NO: 7509 - DNA, 25 bp, S. cerevisiae
agttttgagcttaagcacgcctgaa

SEQ ID NO: 7510 - DNA, 25 bp, S. cerevisiae
agatataaattataccgggtgtggt

SEQ ID NO: 7511 - DNA, 25 bp, S. cerevisiae
agtttctttatctactcttgtccct

SEQ ID NO: 7512 - DNA, 25 bp, S. cerevisiae
agatatacataagccgactctcgcc

SEQ ID NO: 7513 - DNA, 25 bp, S. cerevisiae
agataacaaacctgtcctcagcagc

SEQ ID NO: 7514 - DNA, 25 bp, S. cerevisiae
agattaacaccaaaccaaccagttg

SEQ ID NO: 7515 - DNA, 25 bp, S. cerevisiae
agttatcaacacaaacgccgaggat

SEQ ID NO: 7516 - DNA, 25 bp, S. cerevisiae
agatacagcaacaacaacccggcta

SEQ ID NO: 7517 - DNA, 25 bp, S. cerevisiae
agatcatcagaagcccacaaaccta

SEQ ID NO: 7518 - DNA, 25 bp, S. cerevisiae
agatcccggacctagaaacgctatt

SEQ ID NO: 7519 - DNA, 25 bp, S. cerevisiae
agaccactggtagaagaagagctta

SEQ ID NO: 7520 - DNA, 25 bp, S. cerevisiae
agttacctgttaaactcggcctctg

SEQ ID NO: 7521 - DNA, 25 bp, S. cerevisiae
agtttccctgctaaatgcttggttt

SEQ ID NO: 7522 - DNA, 25 bp, S. cerevisiae
agtttataccgtcgactggagtgtc

SEQ ID NO: 7523 - DNA, 25 bp, S. cerevisiae
agttccccgatagaagccatattca

SEQ ID NO: 7524 - DNA, 25 bp, S. cerevisiae
agttcccaaataatcacgctcatac

SEQ ID NO: 7525 - DNA, 25 bp, S. cerevisiae
agtttaccagatatccccaattcat

SEQ ID NO: 7526 - DNA, 25 bp, S. cerevisiae
agtatttccaatatgcctgccatga

SEQ ID NO: 7527 - DNA, 25 bp, S. cerevisiae
agattttccaagtgccagacgtcag

SEQ ID NO: 7528 - DNA, 25 bp, S. cerevisiae
agattatgtaccatcgccaacagta

SEQ ID NO: 7529 - DNA, 25 bp, S. cerevisiae
agattcctaccggtgccgaattaag

SEQ ID NO: 7530 - DNA, 25 bp, S. cerevisiae
agattccttccggtctagtaataga

SEQ ID NO: 7531 - DNA, 25 bp, S. cerevisiae
agttctttgagccaatgcttccaga

SEQ ID NO: 7532 - DNA, 25 bp, S. cerevisiae
agttttcgagtgatgttccagctac

SEQ ID NO: 7533 - DNA, 25 bp, S. cerevisiae
agttttgcgcgtactttagctcctc

SEQ ID NO: 7534 - DNA, 25 bp, S. cerevisiae
agatcagactctcaaaacgcctcaa

SEQ ID NO: 7535 - DNA, 25 bp, S. cerevisiae
agatgacgaagagttgccgccctta

SEQ ID NO: 7536 - DNA, 25 bp, S. cerevisiae
agatatcgagaccagcgggcccata

SEQ ID NO: 7537 - DNA, 25 bp, S. cerevisiae
agttagcgagctacgggaccgactg

SEQ ID NO: 7538 - DNA, 25 bp, S. cerevisiae
agtttctactgcaggtatcccatca

SEQ ID NO: 7539 - DNA, 25 bp, S. cerevisiae
agttcatccccttaatatctcaatc

SEQ ID NO: 7540 - DNA, 25 bp, S. cerevisiae
agttttgcgcctgaatgcactgacc

SEQ ID NO: 7541 - DNA, 25 bp, S. cerevisiae
agttggatgccctagaatgccgtct

SEQ ID NO: 7542 - DNA, 25 bp, S. cerevisiae
agtttcgactcagatgccacttatc

SEQ ID NO: 7543 - DNA, 25 bp, S. cerevisiae
agttatcgattcttattccctatta

SEQ ID NO: 7544 - DNA, 25 bp, S. cerevisiae
agattgaacccattcttgccgactt

SEQ ID NO: 7545 - DNA, 25 bp, S. cerevisiae
agttcatacccttttatcgactctc

SEQ ID NO: 7546 - DNA, 25 bp, S. cerevisiae
agtttcgcacgatcttattttccaa

SEQ ID NO: 7547 - DNA, 25 bp, S. cerevisiae
agaggtggcggatcttttaagaaat

SEQ ID NO: 7548 - DNA, 25 bp, S. cerevisiae
agatgcttactctggtggttctgta

SEQ ID NO: 7549 - DNA, 25 bp, S. cerevisiae
agttaactgttctcatctgtacaag

SEQ ID NO: 7550 - DNA, 25 bp, S. cerevisiae
agattttccataactgggccctttg

SEQ ID NO: 7551 - DNA, 25 bp, S. cerevisiae
agttgttctattgtccgccaccatg

SEQ ID NO: 7552 - DNA, 25 bp, S. cerevisiae
agttcatatgccacaccaacgatac

SEQ ID NO: 7553 - DNA, 25 bp, S. cerevisiae
agttatctaccattcctacaagcat

SEQ ID NO: 7554 - DNA, 25 bp, S. cerevisiae
agttagccattttgatctcagccgc

SEQ ID NO: 7555 - DNA, 25 bp, S. cerevisiae
agttggcgacgctgatatcaccgca

SEQ ID NO: 7556 - DNA, 25 bp, S. cerevisiae
agttcctatttatctaccatgctgc

SEQ ID NO: 7557 - DNA, 25 bp, S. cerevisiae
agttcaccattgaagactccgtcct

SEQ ID NO: 7558 - DNA, 25 bp, S. cerevisiae
agatttggcctttgtcccatggaat

SEQ ID NO: 7559 - DNA, 25 bp, S. cerevisiae
agatattgttttttccctagctgtt

SEQ ID NO: 7560 - DNA, 25 bp, S. cerevisiae
agttcttctgtcgagttacttatca

SEQ ID NO: 7561 - DNA, 25 bp, S. cerevisiae
agttctttgcccctgtaatagacat

SEQ ID NO: 7562 - DNA, 25 bp, S. cerevisiae
agttcattctcagctttggcttcca

SEQ ID NO: 7563 - DNA, 25 bp, S. cerevisiae
agttctaagattgtgttgtcctttt

SEQ ID NO: 7564 - DNA, 25 bp, S. cerevisiae
agttctaagaccaatgtttcgctga

SEQ ID NO: 7565 - DNA, 25 bp, S. cerevisiae
agttcgacaagcctttcgtcatgga

SEQ ID NO: 7566 - DNA, 25 bp, S. cerevisiae
agttcttgaagtccggtgacgctgc

SEQ ID NO: 7567 - DNA, 25 bp, S. cerevisiae
agttctggtaatgtcttggctgccg

SEQ ID NO: 7568 - DNA, 25 bp, S. cerevisiae
agagccattttactcctttcaaatc

SEQ ID NO: 7569 - DNA, 25 bp, S. cerevisiae
agatccctattaccgcagcgaaagt

SEQ ID NO: 7570 - DNA, 25 bp, S. cerevisiae
agatccacttttccttctcaaaggt

SEQ ID NO: 7571 - DNA, 25 bp, S. cerevisiae
agttcatctccccaattttgatcaa

SEQ ID NO: 7572 - DNA, 25 bp, S. cerevisiae
agttcaccaatcctaatattccttc

SEQ ID NO: 7573 - DNA, 25 bp, S. cerevisiae
agttagcctcatggtttataccccg

SEQ ID NO: 7574 - DNA, 25 bp, S. cerevisiae
agattagcgctaagttttgcattgc

SEQ ID NO: 7575 - DNA, 25 bp, S. cerevisiae
agttcagccttggttcttggtgcag

SEQ ID NO: 7576 - DNA, 25 bp, S. cerevisiae
agttgcggctctcattgtgtgttca

SEQ ID NO: 7577 - DNA, 25 bp, S. cerevisiae
agttcgtccttctttgagttcatta

SEQ ID NO: 7578 - DNA, 25 bp, S. cerevisiae
agttccgcattgtcacaaagtttca

SEQ ID NO: 7579 - DNA, 25 bp, S. cerevisiae
agttccgcgtaaataggcccatcca

SEQ ID NO: 7580 - DNA, 25 bp, S. cerevisiae
agttccctgtatgagatggccccgg

SEQ ID NO: 7581 - DNA, 25 bp, S. cerevisiae
agttcatgtttcgatggctttgccc

SEQ ID NO: 7582 - DNA, 25 bp, S. cerevisiae
agttgcctcatctaagactatcgga

SEQ ID NO: 7583 - DNA, 25 bp, S. cerevisiae
agttgcactatctacagcgtttaaa

SEQ ID NO: 7584 - DNA, 25 bp, S. cerevisiae
agttgacatctattgcagcagttcc

SEQ ID NO: 7585 - DNA, 25 bp, S. cerevisiae
agttcagagcttggtgctggcacca

SEQ ID NO: 7586 - DNA, 25 bp, S. cerevisiae
agttcatgattcttactggacgcat

SEQ ID NO: 7587 - DNA, 25 bp, S. cerevisiae
agttgtgctgtatacgtgactgacc

SEQ ID NO: 7588 - DNA, 25 bp, S. cerevisiae
agttcctctgtaatcgtggtaccat

SEQ ID NO: 7589 - DNA, 25 bp, S. cerevisiae
agttctattgcccaatttgacagga

SEQ ID NO: 7590 - DNA, 25 bp, S. cerevisiae
agttcccaatccaatttcttatcga

SEQ ID NO: 7591 - DNA, 25 bp, S. cerevisiae
agttaacacatctcttctcttcaag

SEQ ID NO: 7592 - DNA, 25 bp, S. cerevisiae
agttgaaatgtgtccttcctgataa

SEQ ID NO: 7593 - DNA, 25 bp, S. cerevisiae
agttaaatctgacctcatctgtgag

SEQ ID NO: 7594 - DNA, 25 bp, S. cerevisiae
agttcctatccaactcatttgcgga

SEQ ID NO: 7595 - DNA, 25 bp, S. cerevisiae
agttccacccaaatgcatgctatgc

SEQ ID NO: 7596 - DNA, 25 bp, S. cerevisiae
agattccgccgaatatcgctagctt

SEQ ID NO: 7597 - DNA, 25 bp, S. cerevisiae
agattcccacctttcgtggtataag

SEQ ID NO: 7598 - DNA, 25 bp, S. cerevisiae
agttccaattcgagtgcccatatct

SEQ ID NO: 7599 - DNA, 25 bp, S. cerevisiae
agttccaatttgatggtccacctcc

SEQ ID NO: 7600 - DNA, 25 bp, S. cerevisiae
agttgccaatgatgcttggtcccat

SEQ ID NO: 7601 - DNA, 25 bp, S. cerevisiae
agatacgaacgtttggctgctaaga

SEQ ID NO: 7602 - DNA, 25 bp, S. cerevisiae
agttctgatagcgatcttcctggga

SEQ ID NO: 7603 - DNA, 25 bp, S. cerevisiae
agttgagatctccattcatcctggg

SEQ ID NO: 7604 - DNA, 25 bp, S. cerevisiae
agcacgagcttgcattaccggcagt

SEQ ID NO: 7605 - DNA, 25 bp, S. cerevisiae
agatgggctgggtctaacacaagta

SEQ ID NO: 7606 - DNA, 25 bp, S. cerevisiae
agattggctgggtcggatacactga

SEQ ID NO: 7607 - DNA, 25 bp, S. cerevisiae
agattggtatcgtcgaaatctctcc

SEQ ID NO: 7608 - DNA, 25 bp, S. cerevisiae
agttgatgcgtcttccagaacattg

SEQ ID NO: 7609 - DNA, 25 bp, S. cerevisiae
agttgatttctattccaacactttg

SEQ ID NO: 7610 - DNA, 25 bp, S. cerevisiae
agttatttagtctcatggccatttg

SEQ ID NO: 7611 - DNA, 25 bp, S. cerevisiae
agttcactgactttcccatagaggg

SEQ ID NO: 7612 - DNA, 25 bp, S. cerevisiae
agttcttaaattcctctatgagcgt

SEQ ID NO: 7613 - DNA, 25 bp, S. cerevisiae
agttgattgaaacctccactccaat

SEQ ID NO: 7614 - DNA, 25 bp, S. cerevisiae
agttactgtatgactctcccatgga

SEQ ID NO: 7615 - DNA, 25 bp, S. cerevisiae
agattcttcctgtcaactccgaaga

SEQ ID NO: 7616 - DNA, 25 bp, S. cerevisiae
agatacattatcctcaccgacgaag

SEQ ID NO: 7617 - DNA, 25 bp, S. cerevisiae
agatattcatgcatacgacagtgta

SEQ ID NO: 7618 - DNA, 25 bp, S. cerevisiae
agattcgatgccgatgccaaggaat

SEQ ID NO: 7619 - DNA, 25 bp, S. cerevisiae
agttgctgagcaagttcgtcgtcgt

SEQ ID NO: 7620 - DNA, 25 bp, S. cerevisiae
agttctgcagtgattgctacttggt

SEQ ID NO: 7621 - DNA, 25 bp, S. cerevisiae
agttacctgctaatgctgagtcgga

SEQ ID NO: 7622 - DNA, 25 bp, S. cerevisiae
agatgaagaaggatgcagctgcaac

SEQ ID NO: 7623 - DNA, 25 bp, S. cerevisiae
agatcagaaccgtcctgctgtccat

SEQ ID NO: 7624 - DNA, 25 bp, S. cerevisiae
agatgaaaaggtccgtctcgtacgc

SEQ ID NO: 7625 - DNA, 25 bp, S. cerevisiae
agttctaacattgttctcgtgcgag

SEQ ID NO: 7626 - DNA, 25 bp, S. cerevisiae
agttgggctcttcatttttgcattc

SEQ ID NO: 7627 - DNA, 25 bp, S. cerevisiae
agttgagtcttatggctcctgggat

SEQ ID NO: 7628 - DNA, 25 bp, S. cerevisiae
agttcattctattggtgctgcgctg

SEQ ID NO: 7629 - DNA, 25 bp, S. cerevisiae
agttctattcattcagttcctcagt

SEQ ID NO: 7630 - DNA, 25 bp, S. cerevisiae
agttgattgcaagcggtactctacc

SEQ ID NO: 7631 - DNA, 25 bp, S. cerevisiae
agattttgatgagttttccctacca

SEQ ID NO: 7632 - DNA, 25 bp, S. cerevisiae
agttcttttttagtcacgccaccat

SEQ ID NO: 7633 - DNA, 25 bp, S. cerevisiae
agttgtatttggttctgccttgctt

SEQ ID NO: 7634 - DNA, 25 bp, S. cerevisiae
agttgcatcatatcttgtcgccatt

SEQ ID NO: 7635 - DNA, 25 bp, S. cerevisiae
agttcattgccgactagatcgtcat

SEQ ID NO: 7636 - DNA, 25 bp, S. cerevisiae
catggaatgtagtgcactgactggt

SEQ ID NO: 7637 - DNA, 25 bp, S. cerevisiae
agatttgcatcaccgactgacaggc

SEQ ID NO: 7638 - DNA, 25 bp, S. cerevisiae
agacggaagctcgatgctaacgctt

SEQ ID NO: 7639 - DNA, 25 bp, S. cerevisiae
agatgggtcactctatgaggcctat

SEQ ID NO: 7640 - DNA, 25 bp, S. cerevisiae
agagggccgcctgctatgtgaaatg

SEQ ID NO: 7641 - DNA, 25 bp, S. cerevisiae
agaggccaagccactttgacagtga

SEQ ID NO: 7642 - DNA, 25 bp, S. cerevisiae
agatgtcatcttgcccggtaaggat

SEQ ID NO: 7643 - DNA, 25 bp, S. cerevisiae
agattcgttacccaagttgccattc

SEQ ID NO: 7644 - DNA, 25 bp, S. cerevisiae
agttccttactatattgctccttct

SEQ ID NO: 7645 - DNA, 25 bp, S. cerevisiae
agttgtgggagagcttttcttccgt

SEQ ID NO: 7646 - DNA, 25 bp, S. cerevisiae
agttccggagaggtgctaatttcaa

SEQ ID NO: 7647 - DNA, 25 bp, S. cerevisiae
agttccaagcatatgtgagttctct

SEQ ID NO: 7648 - DNA, 25 bp, S. cerevisiae
agttccaagcgcaacgagatccatt

SEQ ID NO: 7649 - DNA, 25 bp, S. cerevisiae
agattacaacgttcgtgtcgcttcg

SEQ ID NO: 7650 - DNA, 25 bp, S. cerevisiae
agatgttcaacttcggattccttcc

SEQ ID NO: 7651 - DNA, 25 bp, S. cerevisiae
agattcttgcctgtcaagacctgtt

SEQ ID NO: 7652 - DNA, 25 bp, S. cerevisiae
agttccgccgaaggttctgatgtac

SEQ ID NO: 7653 - DNA, 25 bp, S. cerevisiae
agttctcccatgaagcgtcttttca

SEQ ID NO: 7654 - DNA, 25 bp, S. cerevisiae
agttcatgatgtcgtcctgcccaag

SEQ ID NO: 7655 - DNA, 25 bp, S. cerevisiae
agattgctgttcttgacattctaag

SEQ ID NO: 7656 - DNA, 25 bp, S. cerevisiae
agataggttcactgcttccactttc

SEQ ID NO: 7657 - DNA, 25 bp, S. cerevisiae
agatacgttccaagctgtctcagtg

SEQ ID NO: 7658 - DNA, 25 bp, S. cerevisiae
agataagtcatctaccgctgcgaag

SEQ ID NO: 7659 - DNA, 25 bp, S. cerevisiae
agataggcctccatctcagttatct

SEQ ID NO: 7660 - DNA, 25 bp, S. cerevisiae
agttcgttgcatgatggccattctt

SEQ ID NO: 7661 - DNA, 25 bp, S. cerevisiae
agatatcggatgacgggcgctactt

SEQ ID NO: 7662 - DNA, 25 bp, S. cerevisiae
agatccgtatactccgagagggcca

SEQ ID NO: 7663 - DNA, 25 bp, S. cerevisiae
agacaagttactcccaaggatccca

SEQ ID NO: 7664 - DNA, 25 bp, S. cerevisiae
agacggtttctcacaagggctattt

SEQ ID NO: 7665 - DNA, 25 bp, S. cerevisiae
agatcaggtttctcaaagggtcatt

SEQ ID NO: 7666 - DNA, 25 bp, S. cerevisiae
agttcctatgtaccctgtcgtttga

SEQ ID NO: 7667 - DNA, 25 bp, S. cerevisiae
agattcctgtatttgacgttggtag

SEQ ID NO: 7668 - DNA, 25 bp, S. cerevisiae
agttccgtattttggctagtattgc

SEQ ID NO: 7669 - DNA, 25 bp, S. cerevisiae
agttgttgtttttgcctactctaca

SEQ ID NO: 7670 - DNA, 25 bp, S. cerevisiae
agttgtctggtttagttactctctc

SEQ ID NO: 7671 - DNA, 25 bp, S. cerevisiae
agttgttggtattgcaaagcttccc

SEQ ID NO: 7672 - DNA, 25 bp, S. cerevisiae
agatttaactcttccatcggtagaa

SEQ ID NO: 7673 - DNA, 25 bp, S. cerevisiae
agattgaccaactccttgatgatga

SEQ ID NO: 7674 - DNA, 25 bp, S. cerevisiae
agattgacgaacttgcccatgaaaa

SEQ ID NO: 7675 - DNA, 25 bp, S. cerevisiae
agatgggagaacatgccctccactg

SEQ ID NO: 7676 - DNA, 25 bp, S. cerevisiae
agatgaaggccagttgcggtccagt

SEQ ID NO: 7677 - DNA, 25 bp, S. cerevisiae
agattcgcctcttgggtatcaacta

SEQ ID NO: 7678 - DNA, 25 bp, S. cerevisiae
agattacctgcctgttcaagagctg

SEQ ID NO: 7679 - DNA, 25 bp, S. cerevisiae
agttcatcacttttatagcgagcaa

SEQ ID NO: 7680 - DNA, 25 bp, S. cerevisiae
agactcagacttcccaacaggcaga

SEQ ID NO: 7681 - DNA, 25 bp, S. cerevisiae
agattcacctcctcgaatgacagaa

SEQ ID NO: 7682 - DNA, 25 bp, S. cerevisiae
agttgaacccgtcgacatgtacact

SEQ ID NO: 7683 - DNA, 25 bp, S. cerevisiae
agttgcaacggctgagaccactaca

SEQ ID NO: 7684 - DNA, 25 bp, S. cerevisiae
agttgcttctccaatataccttacg

SEQ ID NO: 7685 - DNA, 25 bp, S. cerevisiae
agttgttcgcttttcgatacatcga

SEQ ID NO: 7686 - DNA, 25 bp, S. cerevisiae
agttgattcctttgttgatgcccaa

SEQ ID NO: 7687 - DNA, 25 bp, S. cerevisiae
agttctcaaggattttgtcctccaa

SEQ ID NO: 7688 - DNA, 25 bp, S. cerevisiae
agttctcatagttaatgttgcctcc

SEQ ID NO: 7689 - DNA, 25 bp, S. cerevisiae
agttctctacttacattgctggtgg

SEQ ID NO: 7690 - DNA, 25 bp, S. cerevisiae
agttcccgctcgatttgattcatga

SEQ ID NO: 7691 - DNA, 25 bp, S. cerevisiae
agttgcttgctttcatttctggaga

SEQ ID NO: 7692 - DNA, 25 bp, S. cerevisiae
agttgctagtccaagacctgctgct

SEQ ID NO: 7693 - DNA, 25 bp, S. cerevisiae
agatttagtcttggagctgcttcga

SEQ ID NO: 7694 - DNA, 25 bp, S. cerevisiae
agatgccatagacttagacgctgaa

SEQ ID NO: 7695 - DNA, 25 bp, S. cerevisiae
agatggcctgctcaatgaggcagaa

SEQ ID NO: 7696 - DNA, 25 bp, S. cerevisiae
agattcttgctggactacacgacac

SEQ ID NO: 7697 - DNA, 25 bp, S. cerevisiae
agattctgctgaaagggcacttcaa

SEQ ID NO: 7698 - DNA, 25 bp, S. cerevisiae
agttgatgcttctggtgttgcctca

SEQ ID NO: 7699 - DNA, 25 bp, S. cerevisiae
agatcttcttgctatgtgttacgta

SEQ ID NO: 7700 - DNA, 25 bp, S. cerevisiae
agatttgcggagtctatgggcccat

SEQ ID NO: 7701 - DNA, 25 bp, S. cerevisiae
agatttggatcgtattgccgctcaa

SEQ ID NO: 7702 - DNA, 25 bp, S. cerevisiae
agatttgcatgaacgcttgggtcaa

SEQ ID NO: 7703 - DNA, 25 bp, S. cerevisiae
agatggtaagctggcccaatgtccc

SEQ ID NO: 7704 - DNA, 25 bp, S. cerevisiae
agacgacggcggcatcaaggactac

SEQ ID NO: 7705 - DNA, 25 bp, S. cerevisiae
agagctttgggcgaatcaaggtcta

SEQ ID NO: 7706 - DNA, 25 bp, S. cerevisiae
agatcattttcgacaagacccctac

SEQ ID NO: 7707 - DNA, 25 bp, S. cerevisiae
agatattgttcatcatacgacccat

SEQ ID NO: 7708 - DNA, 25 bp, S. cerevisiae
agttgccacggtatctagggcacaa

SEQ ID NO: 7709 - DNA, 25 bp, S. cerevisiae
agttcgccggtgacttgggatccaa

SEQ ID NO: 7710 - DNA, 25 bp, S. cerevisiae
agatttcacgaaactggtacgatgc

SEQ ID NO: 7711 - DNA, 25 bp, S. cerevisiae
agattggacgatttgctggagagaa

SEQ ID NO: 7712 - DNA, 25 bp, S. cerevisiae
agttccgtgatgaccttgttgcagc

SEQ ID NO: 7713 - DNA, 25 bp, S. cerevisiae
agttgccactggttctttagacacc

SEQ ID NO: 7714 - DNA, 25 bp, S. cerevisiae
agttccaccagttttatcagatgat

SEQ ID NO: 7715 - DNA, 25 bp, S. cerevisiae
agattccagttgacttccatgggcg

SEQ ID NO: 7716 - DNA, 25 bp, S. cerevisiae
agttgtgttgtcattcctttggatt

SEQ ID NO: 7717 - DNA, 25 bp, S. cerevisiae
agttgctattgttgatgccccagaa

SEQ ID NO: 7718 - DNA, 25 bp, S. cerevisiae
agttgtattctatgctcgacgatga

SEQ ID NO: 7719 - DNA, 25 bp, S. cerevisiae
agattcttcgaatgctaggcgtgaa

SEQ ID NO: 7720 - DNA, 25 bp, S. cerevisiae
agattctaatgagggccgttggccg

SEQ ID NO: 7721 - DNA, 25 bp, S. cerevisiae
agattatctcgagtggccttggtcc

SEQ ID NO: 7722 - DNA, 25 bp, S. cerevisiae
agattacaagtctccagtggtcaca

SEQ ID NO: 7723 - DNA, 25 bp, S. cerevisiae
agattgacacagattttgagttcca

SEQ ID NO: 7724 - DNA, 25 bp, S. cerevisiae
agttgcaaggctacgtctgggctca

SEQ ID NO: 7725 - DNA, 25 bp, S. cerevisiae
agattctctagatgccgattcgcca

SEQ ID NO: 7726 - DNA, 25 bp, S. cerevisiae
agatttctacgccacttggtgcggt

SEQ ID NO: 7727 - DNA, 25 bp, S. cerevisiae
agattttgagtaccctttagcgcaa

SEQ ID NO: 7728 - DNA, 25 bp, S. cerevisiae
agatcacaattcaggcgtgttgcca

SEQ ID NO: 7729 - DNA, 25 bp, S. cerevisiae
agacgaagcgcccatcgacgagcaa

SEQ ID NO: 7730 - DNA, 25 bp, S. cerevisiae
agattaggcgttatatggcggatat

SEQ ID NO: 7731 - DNA, 25 bp, S. cerevisiae
agactaaccgctgccgatctggtac

SEQ ID NO: 7732 - DNA, 25 bp, S. cerevisiae
agatcttatgttgccaccattggta

SEQ ID NO: 7733 - DNA, 25 bp, S. cerevisiae
agatattctgtagccagccccttat

SEQ ID NO: 7734 - DNA, 25 bp, S. cerevisiae
agattctctgttctaccagacggtg

SEQ ID NO: 7735 - DNA, 25 bp, S. cerevisiae
agatagtgagcttcgcgattcagaa

SEQ ID NO: 7736 - DNA, 25 bp, S. cerevisiae
agattacgatgctgatgcaatagat

SEQ ID NO: 7737 - DNA, 25 bp, S. cerevisiae
agatccacgatctgaacaagcgaag

SEQ ID NO: 7738 - DNA, 25 bp, S. cerevisiae
agattacaatcacgaccaccggagt

SEQ ID NO: 7739 - DNA, 25 bp, S. cerevisiae
agattaactcaccaccaggcagaga

SEQ ID NO: 7740 - DNA, 25 bp, S. cerevisiae
agattaattccgttgccatcgagaa

SEQ ID NO: 7741 - DNA, 25 bp, S. cerevisiae
agataaccctgcttcaccaaagtag

SEQ ID NO: 7742 - DNA, 25 bp, S. cerevisiae
agatataccctgagaccgaagctat

SEQ ID NO: 7743 - DNA, 25 bp, S. cerevisiae
agatttcgacgcatccaagaactat

SEQ ID NO: 7744 - DNA, 25 bp, S. cerevisiae
agatgctctcgctgcaatacaagaa

SEQ ID NO: 7745 - DNA, 25 bp, S. cerevisiae
agatatgctggatgacttgctagag

SEQ ID NO: 7746 - DNA, 25 bp, S. cerevisiae
agttgatcaacatgcttgcgatgag

SEQ ID NO: 7747 - DNA, 25 bp, S. cerevisiae
agttgcatgaactgccatcggtgga

SEQ ID NO: 7748 - DNA, 25 bp, S. cerevisiae
agatatgtgacctccacgggaagaa

SEQ ID NO: 7749 - DNA, 25 bp, S. cerevisiae
agttgcttctgccaagggtctacaa

SEQ ID NO: 7750 - DNA, 25 bp, S. cerevisiae
agttgctcacgtaaaggatctgatt

SEQ ID NO: 7751 - DNA, 25 bp, S. cerevisiae
agattcgcaaaatcagcgtctctaa

SEQ ID NO: 7752 - DNA, 25 bp, S. cerevisiae
agattcgaaatcacgtctctcaaat

SEQ ID NO: 7753 - DNA, 25 bp, S. cerevisiae
agacctaacaaacggtagcggctca

SEQ ID NO: 7754 - DNA, 25 bp, S. cerevisiae
agattgctagctccagttccaacgg

SEQ ID NO: 7755 - DNA, 25 bp, S. cerevisiae
agattgctgcgggaagtgccaccgt

SEQ ID NO: 7756 - DNA, 25 bp, S. cerevisiae
agattctgtgatgccatgatatcca

SEQ ID NO: 7757 - DNA, 25 bp, S. cerevisiae
agatctgaccatgcctgaatctcaa

SEQ ID NO: 7758 - DNA, 25 bp, S. cerevisiae
agatctaacacggtagtcagctact

SEQ ID NO: 7759 - DNA, 25 bp, S. cerevisiae
agataagtcgcatgaccgtcacggt

SEQ ID NO: 7760 - DNA, 25 bp, S. cerevisiae
agagttgaccccacagaaatctcca

SEQ ID NO: 7761 - DNA, 25 bp, S. cerevisiae
agacttacgccgctgaaattgctca

SEQ ID NO: 7762 - DNA, 25 bp, S. cerevisiae
agatttccaacgctcacaattctga

SEQ ID NO: 7763 - DNA, 25 bp, S. cerevisiae
agattgccaaatcgctgcctgaatt

SEQ ID NO: 7764 - DNA, 25 bp, S. cerevisiae
agatatcgccattgcattggtcaat

SEQ ID NO: 7765 - DNA, 25 bp, S. cerevisiae
agatgcctctaaactgccaagggct

SEQ ID NO: 7766 - DNA, 25 bp, S. cerevisiae
agatcagtcggcctctttcaaatgg

SEQ ID NO: 7767 - DNA, 25 bp, S. cerevisiae
agattaaagccagctatctccaagg

SEQ ID NO: 7768 - DNA, 25 bp, S. cerevisiae
agattaaagccagccatctccagtg

SEQ ID NO: 7769 - DNA, 25 bp, S. cerevisiae
agatcattaagcagctcctaccggg

SEQ ID NO: 7770 - DNA, 25 bp, S. cerevisiae
agatcatataaaacccttccaacat

SEQ ID NO: 7771 - DNA, 25 bp, S. cerevisiae
agatctctgaaaacctttaccgcgg

SEQ ID NO: 7772 - DNA, 25 bp, S. cerevisiae
acatggtgtccatccaaaacccggg

SEQ ID NO: 7773 - DNA, 25 bp, S. cerevisiae
agataatgaggccttcgtcggacca

SEQ ID NO: 7774 - DNA, 25 bp, S. cerevisiae
agattgccaggcctttgagtgtacc

SEQ ID NO: 7775 - DNA, 25 bp, S. cerevisiae
agattgtcgattttccaggctccaa

SEQ ID NO: 7776 - DNA, 25 bp, S. cerevisiae
agcaggtattaattccaagtccggg

SEQ ID NO: 7777 - DNA, 25 bp, S. cerevisiae
agaggctttaaaggcttacaccgag

SEQ ID NO: 7778 - DNA, 25 bp, S. cerevisiae
agaggcgttggcttaacttacctag

SEQ ID NO: 7779 - DNA, 25 bp, S. cerevisiae
agaggcaatattccattactaatgc

SEQ ID NO: 7780 - DNA, 25 bp, S. cerevisiae
agaggcctactgtcataccgattac

SEQ ID NO: 7781 - DNA, 25 bp, S. cerevisiae
agagtttatttatcggttatcatac

SEQ ID NO: 7782 - DNA, 25 bp, S. cerevisiae
agatcaagtttggagcccgttgcgt

SEQ ID NO: 7783 - DNA, 25 bp, S. cerevisiae
agattttttcagcacacttctgcgc

SEQ ID NO: 7784 - DNA, 25 bp, S. cerevisiae
agatcagtattcaggatgccccagc

SEQ ID NO: 7785 - DNA, 25 bp, S. cerevisiae
agagaagagacaccgaccagttcaa

SEQ ID NO: 7786 - DNA, 25 bp, S. cerevisiae
agagacggaaactgccacaacagca

SEQ ID NO: 7787 - DNA, 25 bp, S. cerevisiae
agaacgatcaatgcattcccaccgg

SEQ ID NO: 7788 - DNA, 25 bp, S. cerevisiae
agagagtcacaaccaacccaagggc

SEQ ID NO: 7789 - DNA, 25 bp, S. cerevisiae
agagacacagcagaagaccgtacgg

SEQ ID NO: 7790 - DNA, 25 bp, S. cerevisiae
agaggacgctggactggaaaacttt

SEQ ID NO: 7791 - DNA, 25 bp, S. cerevisiae
agattacgctattttcccatgtgtc

SEQ ID NO: 7792 - DNA, 25 bp, S. cerevisiae
agttgtcctctgaatctgtcattga

SEQ ID NO: 7793 - DNA, 25 bp, S. cerevisiae
agattcactctcatgtgggtgtcag

SEQ ID NO: 7794 - DNA, 25 bp, S. cerevisiae
agatatcccacatgaggcagcgcta

SEQ ID NO: 7795 - DNA, 25 bp, S. cerevisiae
agagattacagccaggctcgcctgt

SEQ ID NO: 7796 - DNA, 25 bp, S. cerevisiae
agattctaccggactactcgattca

SEQ ID NO: 7797 - DNA, 25 bp, S. cerevisiae
agattcgaatagtttcacctccgcc

SEQ ID NO: 7798 - DNA, 25 bp, S. cerevisiae
agatctctaaagttgtgcagccaca

SEQ ID NO: 7799 - DNA, 25 bp, S. cerevisiae
agatcatttacagtggtccccagtg

SEQ ID NO: 7800 - DNA, 25 bp, S. cerevisiae
agattatcatccttcagtggccaat

SEQ ID NO: 7801 - DNA, 25 bp, S. cerevisiae
agattactgcgctcagtacacgcaa

SEQ ID NO: 7802 - DNA, 25 bp, S. cerevisiae
agttgatcatcattgccgctaacac

SEQ ID NO: 7803 - DNA, 25 bp, S. cerevisiae
agatcgacactgttgagtacccctg

SEQ ID NO: 7804 - DNA, 25 bp, S. cerevisiae
agatttgctatgtgtggttcccctc

SEQ ID NO: 7805 - DNA, 25 bp, S. cerevisiae
agatcttctgagtcgagttgtcccg

SEQ ID NO: 7806 - DNA, 25 bp, S. cerevisiae
agattttgtgacgaccattccctga

SEQ ID NO: 7807 - DNA, 25 bp, S. cerevisiae
agattttcagagtcccatttcaatg

SEQ ID NO: 7808 - DNA, 25 bp, S. cerevisiae
agatcagcgccagcaagtaaacccg

SEQ ID NO: 7809 - DNA, 25 bp, S. cerevisiae
agccggtaaagactggcatgactta

SEQ ID NO: 7810 - DNA, 25 bp, S. cerevisiae
agattgccgctcacaactaccagat

SEQ ID NO: 7811 - DNA, 25 bp, S. cerevisiae
agattccctatcgaagtaacgccgg

SEQ ID NO: 7812 - DNA, 25 bp, S. cerevisiae
agagacccttcaggagtactcgacc

SEQ ID NO: 7813 - DNA, 25 bp, S. cerevisiae
agatctgtcggaagagcttgcggct

SEQ ID NO: 7814 - DNA, 25 bp, S. cerevisiae
agatttgacgtgtactccgatgtaa

SEQ ID NO: 7815 - DNA, 25 bp, S. cerevisiae
agatggtcgcctcgttgttgtaaat

SEQ ID NO: 7816 - DNA, 25 bp, S. cerevisiae
agaggttacgcgctggtttaatcga

SEQ ID NO: 7817 - DNA, 25 bp, S. cerevisiae
agaggaataccgtctatgtttgata

SEQ ID NO: 7818 - DNA, 25 bp, S. cerevisiae
agatctattcggcactgtttcagaa

SEQ ID NO: 7819 - DNA, 25 bp, S. cerevisiae
agatacttcgtccaccgttgagaaa

SEQ ID NO: 7820 - DNA, 25 bp, S. cerevisiae
agatgacgtcgaagcaacgctggat

SEQ ID NO: 7821 - DNA, 25 bp, S. cerevisiae
agatgacaccgtgagcaagcttgtt

SEQ ID NO: 7822 - DNA, 25 bp, S. cerevisiae
agttggccgtgtggttttgatcaag

SEQ ID NO: 7823 - DNA, 25 bp, S. cerevisiae
agatctgagttggacagttttgtca

SEQ ID NO: 7824 - DNA, 25 bp, S. cerevisiae
agattcgtcaagaagttcccctcca

SEQ ID NO: 7825 - DNA, 25 bp, S. cerevisiae
agattttattaactcccacacctga

SEQ ID NO: 7826 - DNA, 25 bp, S. cerevisiae
agattttacaaagcgctcacactta

SEQ ID NO: 7827 - DNA, 25 bp, S. cerevisiae
agatatttactatctggcgcagaca

SEQ ID NO: 7828 - DNA, 25 bp, S. cerevisiae
agttgtcatacttcctcatgtgcaa

SEQ ID NO: 7829 - DNA, 25 bp, S. cerevisiae
agatctatgatcctagccattgcca

SEQ ID NO: 7830 - DNA, 25 bp, S. cerevisiae
agatttgattgcttccattgactca

SEQ ID NO: 7831 - DNA, 25 bp, S. cerevisiae
agattgtcaatcaacttcctgccaa

SEQ ID NO: 7832 - DNA, 25 bp, S. cerevisiae
agatctgctgaataactttgccaat

SEQ ID NO: 7833 - DNA, 25 bp, S. cerevisiae
agatcttgtttctttctagcaaata

SEQ ID NO: 7834 - DNA, 25 bp, S. cerevisiae
agatcttattacttcctccaattgg

SEQ ID NO: 7835 - DNA, 25 bp, S. cerevisiae
agatttcttgtctcttccattagga

SEQ ID NO: 7836 - DNA, 25 bp, S. cerevisiae
agatttttctccaagcgactctagt

SEQ ID NO: 7837 - DNA, 25 bp, S. cerevisiae
agatcttttcccaagcgttgctaaa

SEQ ID NO: 7838 - DNA, 25 bp, S. cerevisiae
agatcttttctaaccttgtgtaaca

SEQ ID NO: 7839 - DNA, 25 bp, S. cerevisiae
agattcttctctgtcgcataatgca

SEQ ID NO: 7840 - DNA, 25 bp, S. cerevisiae
agatacttctcttcaccaatatgct

SEQ ID NO: 7841 - DNA, 25 bp, S. cerevisiae
agattttctgcgacttctcgagtga

SEQ ID NO: 7842 - DNA, 25 bp, S. cerevisiae
agatcgatttcgtcattgccggtgc

SEQ ID NO: 7843 - DNA, 25 bp, S. cerevisiae
agattgttgcactcattaccagaag

SEQ ID NO: 7844 - DNA, 25 bp, S. cerevisiae
agattcttcatctctaacccagatt

SEQ ID NO: 7845 - DNA, 25 bp, S. cerevisiae
agattctagatcatctgtacccgct

SEQ ID NO: 7846 - DNA, 25 bp, S. cerevisiae
agatttaacttctccttctgctaac

SEQ ID NO: 7847 - DNA, 25 bp, S. cerevisiae
agatcttacaccatattgggcgaga

SEQ ID NO: 7848 - DNA, 25 bp, S. cerevisiae
agatttatcgtcacatctgcagccg

SEQ ID NO: 7849 - DNA, 25 bp, S. cerevisiae
agattttgagataccggtgcctgat

SEQ ID NO: 7850 - DNA, 25 bp, S. cerevisiae
agattttctcaattagcactggata

SEQ ID NO: 7851 - DNA, 25 bp, S. cerevisiae
agatctacctttattcagagcccac

SEQ ID NO: 7852 - DNA, 25 bp, S. cerevisiae
agattagacttctcttctccaagac

SEQ ID NO: 7853 - DNA, 25 bp, S. cerevisiae
agattccttatttcactctcagcat

SEQ ID NO: 7854 - DNA, 25 bp, S. cerevisiae
agatttgtttccgaacgtgctgttc

SEQ ID NO: 7855 - DNA, 25 bp, S. cerevisiae
agatgtcgatattcccaacggcatt

SEQ ID NO: 7856 - DNA, 25 bp, S. cerevisiae
agatccgtcataccaaaaggccctt

SEQ ID NO: 7857 - DNA, 25 bp, S. cerevisiae
agatgctccagctgccatcagaact

SEQ ID NO: 7858 - DNA, 25 bp, S. cerevisiae
agataattatttggacacagtaagc

SEQ ID NO: 7859 - DNA, 25 bp, S. cerevisiae
agattatacattaccagaactatgg

SEQ ID NO: 7860 - DNA, 25 bp, S. cerevisiae
agattagcacgtaccgcttctgaag

SEQ ID NO: 7861 - DNA, 25 bp, S. cerevisiae
agattccactgctatccgatacgaa

SEQ ID NO: 7862 - DNA, 25 bp, S. cerevisiae
agatttcactgctattctcgggaga

SEQ ID NO: 7863 - DNA, 25 bp, S. cerevisiae
agatggtctatgcatcctccaagga

SEQ ID NO: 7864 - DNA, 25 bp, S. cerevisiae
agatgcgctcttcccaattaaacat

SEQ ID NO: 7865 - DNA, 25 bp, S. cerevisiae
agatgtacgagctgacggatcccat

SEQ ID NO: 7866 - DNA, 25 bp, S. cerevisiae
agatcaagagttcgaccatgtccat

SEQ ID NO: 7867 - DNA, 25 bp, S. cerevisiae
agatcctagaaaatgcactgggctc

SEQ ID NO: 7868 - DNA, 25 bp, S. cerevisiae
agctctctaaggataagggcctgat

SEQ ID NO: 7869 - DNA, 25 bp, S. cerevisiae
agatttccacggttattgaggtcaa

SEQ ID NO: 7870 - DNA, 25 bp, S. cerevisiae
agattttacccactattgcgcgata

SEQ ID NO: 7871 - DNA, 25 bp, S. cerevisiae
agattcattcctcgagatttcgcca

SEQ ID NO: 7872 - DNA, 25 bp, S. cerevisiae
agatctcatctcatggtttactaca

SEQ ID NO: 7873 - DNA, 25 bp, S. cerevisiae
agattctctcttcttcgatcatgat

SEQ ID NO: 7874 - DNA, 25 bp, S. cerevisiae
agattcgctcaaacacatgctcttt

SEQ ID NO: 7875 - DNA, 25 bp, S. cerevisiae
agatacaccagattctgctgcctac

SEQ ID NO: 7876 - DNA, 25 bp, S. cerevisiae
agataccgcgatacttgccaaatcc

SEQ ID NO: 7877 - DNA, 25 bp, S. cerevisiae
agatatttctgcaagctctccaaac

SEQ ID NO: 7878 - DNA, 25 bp, S. cerevisiae
agattgccagccaacttactacaag

SEQ ID NO: 7879 - DNA, 25 bp, S. cerevisiae
agatcgcctacattggtcctgagaa

SEQ ID NO: 7880 - DNA, 25 bp, S. cerevisiae
agatgagcacttttgggcggataat

SEQ ID NO: 7881 - DNA, 25 bp, S. cerevisiae
agatatgatcgattccttgggtaaa

SEQ ID NO: 7882 - DNA, 25 bp, S. cerevisiae
agatatgtactttcactggagctaa

SEQ ID NO: 7883 - DNA, 25 bp, S. cerevisiae
agatttatttctccatgggcaatga

SEQ ID NO: 7884 - DNA, 25 bp, S. cerevisiae
agatatcgattcttctactggagat

SEQ ID NO: 7885 - DNA, 25 bp, S. cerevisiae
agatatgtttgctttgacggagatg

SEQ ID NO: 7886 - DNA, 25 bp, S. cerevisiae
agatacatttgcttttggtgcttgt

SEQ ID NO: 7887 - DNA, 25 bp, S. cerevisiae
agattccattggctgaggtgcttcc

SEQ ID NO: 7888 - DNA, 25 bp, S. cerevisiae
agattctgaggttcggcggtttcca

SEQ ID NO: 7889 - DNA, 25 bp, S. cerevisiae
agatggcaattcacccacgttaaat

SEQ ID NO: 7890 - DNA, 25 bp, S. cerevisiae
agagtcagattaccatccggtgcca

SEQ ID NO: 7891 - DNA, 25 bp, S. cerevisiae
agatatgcaattgaccgcgttccaa

SEQ ID NO: 7892 - DNA, 25 bp, S. cerevisiae
agatagccatttatctggcacccac

SEQ ID NO: 7893 - DNA, 25 bp, S. cerevisiae
agattctcatttaatcccttctgct

SEQ ID NO: 7894 - DNA, 25 bp, S. cerevisiae
agatttcaataaacccgtcactcat

SEQ ID NO: 7895 - DNA, 25 bp, S. cerevisiae
agattttctaagactcaccatcgcc

SEQ ID NO: 7896 - DNA, 25 bp, S. cerevisiae
agatctcgagcgtgaaattctcaag

SEQ ID NO: 7897 - DNA, 25 bp, S. cerevisiae
agatccatactacaattgcccaagt

SEQ ID NO: 7898 - DNA, 25 bp, S. cerevisiae
agatatccagattcaaagccttaga

SEQ ID NO: 7899 - DNA, 25 bp, S. cerevisiae
agattcggactctaactcaaatgat

SEQ ID NO: 7900 - DNA, 25 bp, S. cerevisiae
agacttccgcacctacgagagagat

SEQ ID NO: 7901 - DNA, 25 bp, S. cerevisiae
agatttcactcttccagcaattgca

SEQ ID NO: 7902 - DNA, 25 bp, S. cerevisiae
agatttccattgtcagcgtatcgcc

SEQ ID NO: 7903 - DNA, 25 bp, S. cerevisiae
agattcttcattttgctggctacta

SEQ ID NO: 7904 - DNA, 25 bp, S. cerevisiae
agatatttctgttgctgtggccact

SEQ ID NO: 7905 - DNA, 25 bp, S. cerevisiae
agatatatcttctctcttggactcc

SEQ ID NO: 7906 - DNA, 25 bp, S. cerevisiae
agatcttcatggacgctgttacact

SEQ ID NO: 7907 - DNA, 25 bp, S. cerevisiae
agattttggctctctctcacgtttt

SEQ ID NO: 7908 - DNA, 25 bp, S. cerevisiae
agatcgtcgcggaacctgacatggt

SEQ ID NO: 7909 - DNA, 25 bp, S. cerevisiae
agatatgcatccaattgagcctact

SEQ ID NO: 7910 - DNA, 25 bp, S. cerevisiae
agatatgccgccaggatggatgcct

SEQ ID NO: 7911 - DNA, 25 bp, S. cerevisiae
agatgatgccccagagtacgccatt

SEQ ID NO: 7912 - DNA, 25 bp, S. cerevisiae
agagatcttctcagaacccgttagg

SEQ ID NO: 7913 - DNA, 25 bp, S. cerevisiae
agatgagctaccagagattccgtta

SEQ ID NO: 7914 - DNA, 25 bp, S. cerevisiae
agatagctcaaaaaggtgccgtgaa

SEQ ID NO: 7915 - DNA, 25 bp, S. cerevisiae
agagctgccaatcaaggtgccttgc

SEQ ID NO: 7916 - DNA, 25 bp, S. cerevisiae
agatgacgtagccaagggacttgcc

SEQ ID NO: 7917 - DNA, 25 bp, S. cerevisiae
agatagtgcagacgcgggtacttcc

SEQ ID NO: 7918 - DNA, 25 bp, S. cerevisiae
agcaattcaattccggtcagtgtca

SEQ ID NO: 7919 - DNA, 25 bp, S. cerevisiae
agatatccagattcctgttccttcc

SEQ ID NO: 7920 - DNA, 25 bp, S. cerevisiae
agatctaatattctttcctctcctg

SEQ ID NO: 7921 - DNA, 25 bp, S. cerevisiae
agatacaatagacgtaccgccgctc

SEQ ID NO: 7922 - DNA, 25 bp, S. cerevisiae
agatcgcttacacgagactcatgac

SEQ ID NO: 7923 - DNA, 25 bp, S. cerevisiae
agatggcgaacaggcagactctttc

SEQ ID NO: 7924 - DNA, 25 bp, S. cerevisiae
agatctggcacagaccgttgtcatc

SEQ ID NO: 7925 - DNA, 25 bp, S. cerevisiae
agactagcatagagcctgacggatc

SEQ ID NO: 7926 - DNA, 25 bp, S. cerevisiae
aactcagaaactgctacggtggttc

SEQ ID NO: 7927 - DNA, 25 bp, S. cerevisiae
agatatcaaactcctcttcggttgt

SEQ ID NO: 7928 - DNA, 25 bp, S. cerevisiae
agagtccgaatatcgcgagtttgaa

SEQ ID NO: 7929 - DNA, 25 bp, S. cerevisiae
agatgactctcaaccgtttttcgaa

SEQ ID NO: 7930 - DNA, 25 bp, S. cerevisiae
agagccgtaacccattttctacaga

SEQ ID NO: 7931 - DNA, 25 bp, S. cerevisiae
agatccctgtacagcgtcttgtaac

SEQ ID NO: 7932 - DNA, 25 bp, S. cerevisiae
caggacggcgaaactttaatacgat

SEQ ID NO: 7933 - DNA, 25 bp, S. cerevisiae
agaggagccaacttctgctatttcc

SEQ ID NO: 7934 - DNA, 25 bp, S. cerevisiae
agatttttatgctctctgctcagat

SEQ ID NO: 7935 - DNA, 25 bp, S. cerevisiae
agattttctgactcatttccatccg

SEQ ID NO: 7936 - DNA, 25 bp, S. cerevisiae
agatttgtcaactgcatttgctgag

SEQ ID NO: 7937 - DNA, 25 bp, S. cerevisiae
agattttccatctgcattattaata

SEQ ID NO: 7938 - DNA, 25 bp, S. cerevisiae
agattttcccataccggctattgaa

SEQ ID NO: 7939 - DNA, 25 bp, S. cerevisiae
agatttattccatccgagctttcga

SEQ ID NO: 7940 - DNA, 25 bp, S. cerevisiae
agacttacccatttagacgattcaa

SEQ ID NO: 7941 - DNA, 25 bp, S. cerevisiae
agacggctttaacgacgccttacag

SEQ ID NO: 7942 - DNA, 25 bp, S. cerevisiae
agatcctcctgatgtcattgctttt

SEQ ID NO: 7943 - DNA, 25 bp, S. cerevisiae
agatcaatgagctcactacctatag

SEQ ID NO: 7944 - DNA, 25 bp, S. cerevisiae
agatcgatgacttcaattcttgggt

SEQ ID NO: 7945 - DNA, 25 bp, S. cerevisiae
agatcaggcaattcacctcttgttt

SEQ ID NO: 7946 - DNA, 25 bp, S. cerevisiae
agatgcaagttcaaactctgctgat

SEQ ID NO: 7947 - DNA, 25 bp, S. cerevisiae
agatgaagcgtcgtattcggatgat

SEQ ID NO: 7948 - DNA, 25 bp, S. cerevisiae
agatcattgaatttcgtcgctaagc

SEQ ID NO: 7949 - DNA, 25 bp, S. cerevisiae
agagatggtgcttatcctcatgtct

SEQ ID NO: 7950 - DNA, 25 bp, S. cerevisiae
agacgtggattcaccaatctggacc

SEQ ID NO: 7951 - DNA, 25 bp, S. cerevisiae
agatcatgacaatagaccaatttac

SEQ ID NO: 7952 - DNA, 25 bp, S. cerevisiae
agatcatgcctatttgacctttata

SEQ ID NO: 7953 - DNA, 25 bp, S. cerevisiae
agatcacctggattacctacatacc

SEQ ID NO: 7954 - DNA, 25 bp, S. cerevisiae
agatttgatttctaccacccaagaa

SEQ ID NO: 7955 - DNA, 25 bp, S. cerevisiae
agatcttgctcttcaaccaacaaag

SEQ ID NO: 7956 - DNA, 25 bp, S. cerevisiae
agatttttacatcccaatgcaaggc

SEQ ID NO: 7957 - DNA, 25 bp, S. cerevisiae
agatgtgggtaccttgcagtcaaga

SEQ ID NO: 7958 - DNA, 25 bp, S. cerevisiae
agatgcatgggctcttggcgtcctg

SEQ ID NO: 7959 - DNA, 25 bp, S. cerevisiae
agatcacgcagttttggagcccaaa

SEQ ID NO: 7960 - DNA, 25 bp, S. cerevisiae
agatacccattgaaggtcaccaaga

SEQ ID NO: 7961 - DNA, 25 bp, S. cerevisiae
agatcaccaaagacagttagccaaa

SEQ ID NO: 7962 - DNA, 25 bp, S. cerevisiae
agatcccagagagctatatattgaa

SEQ ID NO: 7963 - DNA, 25 bp, S. cerevisiae
agatggcccagcattacatttaact

SEQ ID NO: 7964 - DNA, 25 bp, S. cerevisiae
agaggctaccactcactttgacaat

SEQ ID NO: 7965 - DNA, 25 bp, S. cerevisiae
agaggcaaccgctctggttacagaa

SEQ ID NO: 7966 - DNA, 25 bp, S. cerevisiae
agatggaaccgctacagggctgaaa

SEQ ID NO: 7967 - DNA, 25 bp, S. cerevisiae
agaggcaaacatgacaccgcgggct

SEQ ID NO: 7968 - DNA, 25 bp, S. cerevisiae
agagcctaactcaagcaaccgatgg

SEQ ID NO: 7969 - DNA, 25 bp, S. cerevisiae
agatcttgataccttcacaccagag

SEQ ID NO: 7970 - DNA, 25 bp, S. cerevisiae
agagcttcgaaacttctggcaggac

SEQ ID NO: 7971 - DNA, 25 bp, S. cerevisiae
agatccttcaggtagatacgccaaa

SEQ ID NO: 7972 - DNA, 25 bp, S. cerevisiae
agatccttctggtagatatgcccaa

SEQ ID NO: 7973 - DNA, 25 bp, S. cerevisiae
agatggtgtttctggtgctgcctcc

SEQ ID NO: 7974 - DNA, 25 bp, S. cerevisiae
agatttgattgtcttcgctgcatcc

SEQ ID NO: 7975 - DNA, 25 bp, S. cerevisiae
agatgtgttgatccaagcttgatag

SEQ ID NO: 7976 - DNA, 25 bp, S. cerevisiae
agatgtcttgactactgttgcaaca

SEQ ID NO: 7977 - DNA, 25 bp, S. cerevisiae
agcatactccgttttttgacgtgga

SEQ ID NO: 7978 - DNA, 25 bp, S. cerevisiae
agagcgttggttttactggccttca

SEQ ID NO: 7979 - DNA, 25 bp, S. cerevisiae
agagtgtcgtcgcagaagctactat

SEQ ID NO: 7980 - DNA, 25 bp, S. cerevisiae
agatgagttgttcgaaggctattaa

SEQ ID NO: 7981 - DNA, 25 bp, S. cerevisiae
agatatgtttggctcaggtcttcct

SEQ ID NO: 7982 - DNA, 25 bp, S. cerevisiae
agatgtattgggatcgcgctggttc

SEQ ID NO: 7983 - DNA, 25 bp, S. cerevisiae
agatctatgctgagacacgccttag

SEQ ID NO: 7984 - DNA, 25 bp, S. cerevisiae
agatctttggagtgctggtgtcata

SEQ ID NO: 7985 - DNA, 25 bp, S. cerevisiae
agatcttgatatgacttccgctacc

SEQ ID NO: 7986 - DNA, 25 bp, S. cerevisiae
agatggaaatctcgcaggccaacaa

SEQ ID NO: 7987 - DNA, 25 bp, S. cerevisiae
agcactaatagctgcgacgatttat

SEQ ID NO: 7988 - DNA, 25 bp, S. cerevisiae
agagctaatatgttcgacgcattaa

SEQ ID NO: 7989 - DNA, 25 bp, S. cerevisiae
agatcactctatttcgagccaataa

SEQ ID NO: 7990 - DNA, 25 bp, S. cerevisiae
agatcaccattcttaacctatcgct

SEQ ID NO: 7991 - DNA, 25 bp, S. cerevisiae
agacatccatatttcaagccacatc

SEQ ID NO: 7992 - DNA, 25 bp, S. cerevisiae
agagaccagagtggcatccatgaac

SEQ ID NO: 7993 - DNA, 25 bp, S. cerevisiae
agacctcagcggcttcaatatatag

SEQ ID NO: 7994 - DNA, 25 bp, S. cerevisiae
agcatggtaccgtctccgattgtgc

SEQ ID NO: 7995 - DNA, 25 bp, S. cerevisiae
agatggatacgctaccagggcagcc

SEQ ID NO: 7996 - DNA, 25 bp, S. cerevisiae
agagtatctggatctcgttgctcgc

SEQ ID NO: 7997 - DNA, 25 bp, S. cerevisiae
agagtcactggtgtgcgctcgagtc

SEQ ID NO: 7998 - DNA, 25 bp, S. cerevisiae
agaggacgatgttccgcgggtcaaa

SEQ ID NO: 7999 - DNA, 25 bp, S. cerevisiae
agaggactctttacgggcagatgct

SEQ ID NO: 8000 - DNA, 25 bp, S. cerevisiae
agatgaccctggttctttggtagat

SEQ ID NO: 8001 - DNA, 25 bp, S. cerevisiae
agataccgttgttatttctgctcaa

SEQ ID NO: 8002 - DNA, 25 bp, S. cerevisiae
agatcggttatgatgccgcttccaa

SEQ ID NO: 8003 - DNA, 25 bp, S. cerevisiae
agatcggtccatcttcgtttgatga

SEQ ID NO: 8004 - DNA, 25 bp, S. cerevisiae
agatagtttcagtagctcggtaaag

SEQ ID NO: 8005 - DNA, 25 bp, S. cerevisiae
agatatgtctcctatactcggcgaa

SEQ ID NO: 8006 - DNA, 25 bp, S. cerevisiae
agaggtatccacagcatcggcggga

SEQ ID NO: 8007 - DNA, 25 bp, S. cerevisiae
agagaattcacagcgccagggcggc

SEQ ID NO: 8008 - DNA, 25 bp, S. cerevisiae
acagtactacagtgggtgccgccca

SEQ ID NO: 8009 - DNA, 25 bp, S. cerevisiae
agagtaccactacaggctagaccca

SEQ ID NO: 8010 - DNA, 25 bp, S. cerevisiae
agaggacatcctgcaaggcggaccg

SEQ ID NO: 8011 - DNA, 25 bp, S. cerevisiae
agagcaaagcgaacagcggcgtacc

SEQ ID NO: 8012 - DNA, 25 bp, S. cerevisiae
agatggcaagcgaatcagtttcccc

SEQ ID NO: 8013 - DNA, 25 bp, S. cerevisiae
agagtttgtcaccagtcccttaaag

SEQ ID NO: 8014 - DNA, 25 bp, S. cerevisiae
agaggattgtcctccaactaccaaa

SEQ ID NO: 8015 - DNA, 25 bp, S. cerevisiae
agaggattgggcttctacagtccaa

SEQ ID NO: 8016 - DNA, 25 bp, S. cerevisiae
agagggatacctttcagctacaaaa

SEQ ID NO: 8017 - DNA, 25 bp, S. cerevisiae
agacgaccccttcagcaaaaaagca

SEQ ID NO: 8018 - DNA, 25 bp, S. cerevisiae
agaaaacctcttctgacctaggaat

SEQ ID NO: 8019 - DNA, 25 bp, S. cerevisiae
agagttactactgcctatatcggta

SEQ ID NO: 8020 - DNA, 25 bp, S. cerevisiae
agatactggttctgctgaaacggaa

SEQ ID NO: 8021 - DNA, 25 bp, S. cerevisiae
agatactggttctcgtttgcagaca

SEQ ID NO: 8022 - DNA, 25 bp, S. cerevisiae
agatactcgtatttgcgcttgctgc

SEQ ID NO: 8023 - DNA, 25 bp, S. cerevisiae
agatgcacccgtgggcataaaggcc

SEQ ID NO: 8024 - DNA, 25 bp, S. cerevisiae
agatcgccctgtgtcatgatagaga

SEQ ID NO: 8025 - DNA, 25 bp, S. cerevisiae
agatcgccgttggtggtattgtcgc

SEQ ID NO: 8026 - DNA, 25 bp, S. cerevisiae
agatcgctcgatttttctgatttaa

SEQ ID NO: 8027 - DNA, 25 bp, S. cerevisiae
agatcactcactaatgcttgctgga

SEQ ID NO: 8028 - DNA, 25 bp, S. cerevisiae
agatacctcgaggtgcatcgatgat

SEQ ID NO: 8029 - DNA, 25 bp, S. cerevisiae
agatgacctgcttgctggccacgat

SEQ ID NO: 8030 - DNA, 25 bp, S. cerevisiae
agagagccagaagtgcctcagcggc

SEQ ID NO: 8031 - DNA, 25 bp, S. cerevisiae
agataccagcaagctactgctgccg

SEQ ID NO: 8032 - DNA, 25 bp, S. cerevisiae
agaggctaatccaccggccagaaag

SEQ ID NO: 8033 - DNA, 25 bp, S. cerevisiae
agcaacgaatttgccatgggcgatt

SEQ ID NO: 8034 - DNA, 25 bp, S. cerevisiae
caagaagaagctaaagttccttttg

SEQ ID NO: 8035 - DNA, 25 bp, S. cerevisiae
agagtaaatcgagatccccgtcatc

SEQ ID NO: 8036 - DNA, 25 bp, S. cerevisiae
agaggagacataacttccgccggat

SEQ ID NO: 8037 - DNA, 25 bp, S. cerevisiae
agatgatactttattccccagcgtg

SEQ ID NO: 8038 - DNA, 25 bp, S. cerevisiae
agagacctgttgagttctccactgg

SEQ ID NO: 8039 - DNA, 25 bp, S. cerevisiae
agatgaattggtccgtttctcctac

SEQ ID NO: 8040 - DNA, 25 bp, S. cerevisiae
agatgcagtaggtgcggttccgtca

SEQ ID NO: 8041 - DNA, 25 bp, S. cerevisiae
agacgctaatcctgacgatccttta

SEQ ID NO: 8042 - DNA, 25 bp, S. cerevisiae
agagcctacaccatggaaactttat

SEQ ID NO: 8043 - DNA, 25 bp, S. cerevisiae
agatgccttgggtaactgtatttaa

SEQ ID NO: 8044 - DNA, 25 bp, S. cerevisiae
agatgcatcgtccagtacacttttt

SEQ ID NO: 8045 - DNA, 25 bp, S. cerevisiae
agaagccgccactaactttttgttg

SEQ ID NO: 8046 - DNA, 25 bp, S. cerevisiae
agaggaacccctccgttttgcattg

SEQ ID NO: 8047 - DNA, 25 bp, S. cerevisiae
agaattaccctccacgttgattgtc

SEQ ID NO: 8048 - DNA, 25 bp, S. cerevisiae
agaacttccgccacaattttgacag

SEQ ID NO: 8049 - DNA, 25 bp, S. cerevisiae
agagaacccttcacacattttgatc

SEQ ID NO: 8050 - DNA, 25 bp, S. cerevisiae
agagaaacgcccattgcattgattt

SEQ ID NO: 8051 - DNA, 25 bp, S. cerevisiae
agatcaacaattgctcttgcttatc

SEQ ID NO: 8052 - DNA, 25 bp, S. cerevisiae
agataatcactcactctttagatga

SEQ ID NO: 8053 - DNA, 25 bp, S. cerevisiae
agatgaatactaccatgctatgcat

SEQ ID NO: 8054 - DNA, 25 bp, S. cerevisiae
agatgaagccgaattctccctgaga

SEQ ID NO: 8055 - DNA, 25 bp, S. cerevisiae
agatgagcgctgcatttttactggc

SEQ ID NO: 8056 - DNA, 25 bp, S. cerevisiae
agagacgatgcctttcttgagagca

SEQ ID NO: 8057 - DNA, 25 bp, S. cerevisiae
agagccattctgtgcttccaaaggt

SEQ ID NO: 8058 - DNA, 25 bp, S. cerevisiae
agaggttccaacttccaaagctcct

SEQ ID NO: 8059 - DNA, 25 bp, S. cerevisiae
agatgtgggtcctttcaccgtctat

SEQ ID NO: 8060 - DNA, 25 bp, S. cerevisiae
agatgatggacagtactcctcctat

SEQ ID NO: 8061 - DNA, 25 bp, S. cerevisiae
agatgagcgttgtgcagttcaagaa

SEQ ID NO: 8062 - DNA, 25 bp, S. cerevisiae
agatgctgcggcaagtgtgttaagc

SEQ ID NO: 8063 - DNA, 25 bp, S. cerevisiae
agaggcgatgacgtagttcagcaat

SEQ ID NO: 8064 - DNA, 25 bp, S. cerevisiae
agagagagcgagctacctccaacaa

SEQ ID NO: 8065 - DNA, 25 bp, S. cerevisiae
agaaggtgcgagaacccctaaccag

SEQ ID NO: 8066 - DNA, 25 bp, S. cerevisiae
agaatgtacgaagcccggaacgcaa

SEQ ID NO: 8067 - DNA, 25 bp, S. cerevisiae
agagtgaactcattctcctcatgga

SEQ ID NO: 8068 - DNA, 25 bp, S. cerevisiae
agatgtgccatatgtctcatgcctc

SEQ ID NO: 8069 - DNA, 25 bp, S. cerevisiae
agatgctgcgcaaggtggacctcca

SEQ ID NO: 8070 - DNA, 25 bp, S. cerevisiae
agatgtgcagcttgatgttgacgtc

SEQ ID NO: 8071 - DNA, 25 bp, S. cerevisiae
agaggcgttatgcaacagtctattg

SEQ ID NO: 8072 - DNA, 25 bp, S. cerevisiae
caggagaacttggaagcctttttca

SEQ ID NO: 8073 - DNA, 25 bp, S. cerevisiae
aagcgaacctggtgccgtgttgaac

SEQ ID NO: 8074 - DNA, 25 bp, S. cerevisiae
agactacccaggtgtcggtccagaa

SEQ ID NO: 8075 - DNA, 25 bp, S. cerevisiae
agatcttacatctttggtggccacg

SEQ ID NO: 8076 - DNA, 25 bp, S. cerevisiae
agatgctcctattcttttggatccc

SEQ ID NO: 8077 - DNA, 25 bp, S. cerevisiae
agatcatctctttccgaattcactg

SEQ ID NO: 8078 - DNA, 25 bp, S. cerevisiae
agatcgtcagctttggaattgtcat

SEQ ID NO: 8079 - DNA, 25 bp, S. cerevisiae
agcgttaataaaaatcctcagccaa

SEQ ID NO: 8080 - DNA, 25 bp, S. cerevisiae
agagccgcccaaaaagccttcagag

SEQ ID NO: 8081 - DNA, 25 bp, S. cerevisiae
agagaaccaagatcaagcctttcat

SEQ ID NO: 8082 - DNA, 25 bp, S. cerevisiae
agaggaacaagatgcaggacccctt

SEQ ID NO: 8083 - DNA, 25 bp, S. cerevisiae
agatgacaccgagttttccagaagt

SEQ ID NO: 8084 - DNA, 25 bp, S. cerevisiae
agagacccagttatgctccatgttg

SEQ ID NO: 8085 - DNA, 25 bp, S. cerevisiae
agagtcctcaattccttgcatctgt

SEQ ID NO: 8086 - DNA, 25 bp, S. cerevisiae
agatgctgtctccactattaacttg

SEQ ID NO: 8087 - DNA, 25 bp, S. cerevisiae
agatggtccttcaatgtgcaacaca

SEQ ID NO: 8088 - DNA, 25 bp, S. cerevisiae
agagatcccaatccattcgttgaga

SEQ ID NO: 8089 - DNA, 25 bp, S. cerevisiae
agagaccacattcgagccagttgaa

SEQ ID NO: 8090 - DNA, 25 bp, S. cerevisiae
agatgctacggaagccttcttgaat

SEQ ID NO: 8091 - DNA, 25 bp, S. cerevisiae
agatgctaaacaccctatcactgtt

SEQ ID NO: 8092 - DNA, 25 bp, S. cerevisiae
agatctttcagcacttatcagccac

SEQ ID NO: 8093 - DNA, 25 bp, S. cerevisiae
agatcattcgagaactcccatgcca

SEQ ID NO: 8094 - DNA, 25 bp, S. cerevisiae
agagcaatcgcgaatcctcactgga

SEQ ID NO: 8095 - DNA, 25 bp, S. cerevisiae
agaggaggcgcttctacagtggcac

SEQ ID NO: 8096 - DNA, 25 bp, S. cerevisiae
agatgggcacttttttcacgcagac

SEQ ID NO: 8097 - DNA, 25 bp, S. cerevisiae
agaggtttcaaagcttcggtggtat

SEQ ID NO: 8098 - DNA, 25 bp, S. cerevisiae
agaggttactttggccagtcaggga

SEQ ID NO: 8099 - DNA, 25 bp, S. cerevisiae
agaggctctgactcgcaaattcgtg

SEQ ID NO: 8100 - DNA, 25 bp, S. cerevisiae
agacctggaaagacaatcacctatg

SEQ ID NO: 8101 - DNA, 25 bp, S. cerevisiae
agaccggtaatcactgaccttttca

SEQ ID NO: 8102 - DNA, 25 bp, S. cerevisiae
agatcctatggtccgttttaacgca

SEQ ID NO: 8103 - DNA, 25 bp, S. cerevisiae
agatccttggatccgtagcattgat

SEQ ID NO: 8104 - DNA, 25 bp, S. cerevisiae
agatcctctgcagccatgggaatgt

SEQ ID NO: 8105 - DNA, 25 bp, S. cerevisiae
agatgccaatgaacctgcggaggat

SEQ ID NO: 8106 - DNA, 25 bp, S. cerevisiae
agatgcgacgttaacctctggtggt

SEQ ID NO: 8107 - DNA, 25 bp, S. cerevisiae
agagaacattttacaccggtggtgg

SEQ ID NO: 8108 - DNA, 25 bp, S. cerevisiae
agaggtcacgtctcagccggtaaag

SEQ ID NO: 8109 - DNA, 25 bp, S. cerevisiae
agaggtactggcacgcacgatggta

SEQ ID NO: 8110 - DNA, 25 bp, S. cerevisiae
agaggttaccgaagagcaagctgaa

SEQ ID NO: 8111 - DNA, 25 bp, S. cerevisiae
agatgagcttgcttccattttcgag

SEQ ID NO: 8112 - DNA, 25 bp, S. cerevisiae
agatgcaggatcgtcaatattttga

SEQ ID NO: 8113 - DNA, 25 bp, S. cerevisiae
agatggccacgtctaattctgttgc

SEQ ID NO: 8114 - DNA, 25 bp, S. cerevisiae
agatgattccttggccacggtgaaa

SEQ ID NO: 8115 - DNA, 25 bp, S. cerevisiae
agatgttcctctagacttcggtaac

SEQ ID NO: 8116 - DNA, 25 bp, S. cerevisiae
agatgattctataagacccggtatc

SEQ ID NO: 8117 - DNA, 25 bp, S. cerevisiae
agatgagatttacggctctctgcgt

SEQ ID NO: 8118 - DNA, 25 bp, S. cerevisiae
agatctattctatttggtagcgaag

SEQ ID NO: 8119 - DNA, 25 bp, S. cerevisiae
agatctatacttttgaccaggtcag

SEQ ID NO: 8120 - DNA, 25 bp, S. cerevisiae
agagtagagctattcgagaacccga

SEQ ID NO: 8121 - DNA, 25 bp, S. cerevisiae
agatgtaactcttcgtctaccacaa

SEQ ID NO: 8122 - DNA, 25 bp, S. cerevisiae
agatgctacccatagtgtatcgcca

SEQ ID NO: 8123 - DNA, 25 bp, S. cerevisiae
agagactctaacttccctgacgaag

SEQ ID NO: 8124 - DNA, 25 bp, S. cerevisiae
agagagtctacatcttcacataaga

SEQ ID NO: 8125 - DNA, 25 bp, S. cerevisiae
agatcccttcgcaattgatattcaa

SEQ ID NO: 8126 - DNA, 25 bp, S. cerevisiae
agatctcgattacatcgtactgcaa

SEQ ID NO: 8127 - DNA, 25 bp, S. cerevisiae
agagtagcttacatcgacctgaata

SEQ ID NO: 8128 - DNA, 25 bp, S. cerevisiae
agcgtagcgttcattggcgtagtca

SEQ ID NO: 8129 - DNA, 25 bp, S. cerevisiae
agagtttgcttcactggttgactgc

SEQ ID NO: 8130 - DNA, 25 bp, S. cerevisiae
agatgatggtttctctttcacccaa

SEQ ID NO: 8131 - DNA, 25 bp, S. cerevisiae
agatgtagtttctttattcgcgaaa

SEQ ID NO: 8132 - DNA, 25 bp, S. cerevisiae
agatcgtttgcacctggtttcattt

SEQ ID NO: 8133 - DNA, 25 bp, S. cerevisiae
agatgagttgtttgacctgctagat

SEQ ID NO: 8134 - DNA, 25 bp, S. cerevisiae
agatgattatgtgcgatggctccat

SEQ ID NO: 8135 - DNA, 25 bp, S. cerevisiae
agatgcattctatctgctgtgttta

SEQ ID NO: 8136 - DNA, 25 bp, S. cerevisiae
agagtgcatcgctcgttggagttgt

SEQ ID NO: 8137 - DNA, 25 bp, S. cerevisiae
agatgtgaccatcctgttacgttag

SEQ ID NO: 8138 - DNA, 25 bp, S. cerevisiae
agatgatgacgacttctttgattag

SEQ ID NO: 8139 - DNA, 25 bp, S. cerevisiae
agagatgtcgctcttttaccgaaag

SEQ ID NO: 8140 - DNA, 25 bp, S. cerevisiae
agagttcaccacttacttccggagg

SEQ ID NO: 8141 - DNA, 25 bp, S. cerevisiae
agagctttgacctttttccaggact

SEQ ID NO: 8142 - DNA, 25 bp, S. cerevisiae
agacctgaaggctccgacgatgaaa

SEQ ID NO: 8143 - DNA, 25 bp, S. cerevisiae
agagcctagggctaacgactcagcg

SEQ ID NO: 8144 - DNA, 25 bp, S. cerevisiae
agatcctatgggtgacggctggcta

SEQ ID NO: 8145 - DNA, 25 bp, S. cerevisiae
agatcctaacactgaccgcatggta

SEQ ID NO: 8146 - DNA, 25 bp, S. cerevisiae
agatcctgcaacgttgaaccaaata

SEQ ID NO: 8147 - DNA, 25 bp, S. cerevisiae
agaccctacttctaagccaagtgca

SEQ ID NO: 8148 - DNA, 25 bp, S. cerevisiae
agaccactcctttaagaaggctgat

SEQ ID NO: 8149 - DNA, 25 bp, S. cerevisiae
agatccacatcctcctttggagtga

SEQ ID NO: 8150 - DNA, 25 bp, S. cerevisiae
agatggagccctgccattgagaact

SEQ ID NO: 8151 - DNA, 25 bp, S. cerevisiae
agaggcagaccttgcactggcgcaa

SEQ ID NO: 8152 - DNA, 25 bp, S. cerevisiae
agaggctacgcaccaagacgtcagt

SEQ ID NO: 8153 - DNA, 25 bp, S. cerevisiae
agagattgcccgcaagcagcgtgtt

SEQ ID NO: 8154 - DNA, 25 bp, S. cerevisiae
agagattgcatcacgtcagacagga

SEQ ID NO: 8155 - DNA, 25 bp, S. cerevisiae
agagcatctatctggcacgaacgca

SEQ ID NO: 8156 - DNA, 25 bp, S. cerevisiae
agagttatcacttggctagacgaaa

SEQ ID NO: 8157 - DNA, 25 bp, S. cerevisiae
agaggcgacctagtgatgacaatga

SEQ ID NO: 8158 - DNA, 25 bp, S. cerevisiae
agatggctcatattgttaacactat

SEQ ID NO: 8159 - DNA, 25 bp, S. cerevisiae
agatgcgctcagtttccagaatttc

SEQ ID NO: 8160 - DNA, 25 bp, S. cerevisiae
agatccttaattgcagaagctacag

SEQ ID NO: 8161 - DNA, 25 bp, S. cerevisiae
agatccacagtggtgtcctgagctc

SEQ ID NO: 8162 - DNA, 25 bp, S. cerevisiae
agaggattctggacatttaatggcc

SEQ ID NO: 8163 - DNA, 25 bp, S. cerevisiae
agaggattcgacgtactcgaggctt

SEQ ID NO: 8164 - DNA, 25 bp, S. cerevisiae
agagaatcattccaactggctccgt

SEQ ID NO: 8165 - DNA, 25 bp, S. cerevisiae
agaccaatttaaccgaacaggcaat

SEQ ID NO: 8166 - DNA, 25 bp, S. cerevisiae
agacccaagactaaccatactcgaa

SEQ ID NO: 8167 - DNA, 25 bp, S. cerevisiae
agatgccgcataccttaaacctgga

SEQ ID NO: 8168 - DNA, 25 bp, S. cerevisiae
agatgccttggtcggattcgctgaa

SEQ ID NO: 8169 - DNA, 25 bp, S. cerevisiae
agatgctttgacagcttccactgaa

SEQ ID NO: 8170 - DNA, 25 bp, S. cerevisiae
agatgctttgactcactgtatcgaa

SEQ ID NO: 8171 - DNA, 25 bp, S. cerevisiae
agatggttgcgattgctggtattac

SEQ ID NO: 8172 - DNA, 25 bp, S. cerevisiae
agatgcctctggtgctgtgattaaa

SEQ ID NO: 8173 - DNA, 25 bp, S. cerevisiae
agatgcacctttcttatcatttgat

SEQ ID NO: 8174 - DNA, 25 bp, S. cerevisiae
agatgagcctgaaagttccgcaaaa

SEQ ID NO: 8175 - DNA, 25 bp, S. cerevisiae
agaggcattgagcagattcggctaa

SEQ ID NO: 8176 - DNA, 25 bp, S. cerevisiae
agatgaattcttaagggttgccaaa

SEQ ID NO: 8177 - DNA, 25 bp, S. cerevisiae
agatgtactttttgggagctctgaa

SEQ ID NO: 8178 - DNA, 25 bp, S. cerevisiae
agatgctcaattttacttgggtaag

SEQ ID NO: 8179 - DNA, 25 bp, S. cerevisiae
agatccatatctggtcttggcgacc

SEQ ID NO: 8180 - DNA, 25 bp, S. cerevisiae
agatgcctactgattctggcagaaa

SEQ ID NO: 8181 - DNA, 25 bp, S. cerevisiae
agatgtccacagtgtgcggtgataa

SEQ ID NO: 8182 - DNA, 25 bp, S. cerevisiae
agagtcaggcagttccgggcattca

SEQ ID NO: 8183 - DNA, 25 bp, S. cerevisiae
agagagagacgttcggccgcattgc

SEQ ID NO: 8184 - DNA, 25 bp, S. cerevisiae
agatggtacagttcctccagatgat

SEQ ID NO: 8185 - DNA, 25 bp, S. cerevisiae
agaggcgtcgaagcttgatccaact

SEQ ID NO: 8186 - DNA, 25 bp, S. cerevisiae
agatgcaggtccatctttttctcct

SEQ ID NO: 8187 - DNA, 25 bp, S. cerevisiae
agagtgtgtccaattacgcgcacgt

SEQ ID NO: 8188 - DNA, 25 bp, S. cerevisiae
agatgccgacggtgactttcaagtg

SEQ ID NO: 8189 - DNA, 25 bp, S. cerevisiae
agatgcctccattgaatccatttct

SEQ ID NO: 8190 - DNA, 25 bp, S. cerevisiae
agacggcgtgcaaaactcatggaag

SEQ ID NO: 8191 - DNA, 25 bp, S. cerevisiae
agaggccgatgacaactgcagcaga

SEQ ID NO: 8192 - DNA, 25 bp, S. cerevisiae
agaggcccagaggatacgagagcaa

SEQ ID NO: 8193 - DNA, 25 bp, S. cerevisiae
agatgttcccacgacaggacacgag

SEQ ID NO: 8194 - DNA, 25 bp, S. cerevisiae
agatgttgcccagcctgatcaagct

SEQ ID NO: 8195 - DNA, 25 bp, S. cerevisiae
agatgttcgccaacgttgccagaat

SEQ ID NO: 8196 - DNA, 25 bp, S. cerevisiae
agatgatatctcacgtgttgccgaa

SEQ ID NO: 8197 - DNA, 25 bp, S. cerevisiae
agagatcaatcagcgcgtttcactt

SEQ ID NO: 8198 - DNA, 25 bp, S. cerevisiae
agagatcaatgagcccttccaatat

SEQ ID NO: 8199 - DNA, 25 bp, S. cerevisiae
agagctcacatagccacttgaagag

SEQ ID NO: 8200 - DNA, 25 bp, S. cerevisiae
agagctgcgaaaggccttcaagtat

SEQ ID NO: 8201 - DNA, 25 bp, S. cerevisiae
agactgcgaaagatttcccgcttgt

SEQ ID NO: 8202 - DNA, 25 bp, S. cerevisiae
agatgggaaactcggtcacccttgc

SEQ ID NO: 8203 - DNA, 25 bp, S. cerevisiae
agagtgcgccacttgtggtgacacc

SEQ ID NO: 8204 - DNA, 25 bp, S. cerevisiae
agacgaatcggttctcgactctgtc

SEQ ID NO: 8205 - DNA, 25 bp, S. cerevisiae
agagctccgatgatgaactacctga

SEQ ID NO: 8206 - DNA, 25 bp, S. cerevisiae
agagcactgcatataccaatgtccc

SEQ ID NO: 8207 - DNA, 25 bp, S. cerevisiae
agagggcttccaacagactagctga

SEQ ID NO: 8208 - DNA, 25 bp, S. cerevisiae
agaggtttcacaacgatcgactgtt

SEQ ID NO: 8209 - DNA, 25 bp, S. cerevisiae
aagtcgtttagaggccaatcttatt

SEQ ID NO: 8210 - DNA, 25 bp, S. cerevisiae
agagtcgtctttgggctacaattct

SEQ ID NO: 8211 - DNA, 25 bp, S. cerevisiae
agagtctctgttgggatctacttcc

SEQ ID NO: 8212 - DNA, 25 bp, S. cerevisiae
agagatactgaatactcccgtccca

SEQ ID NO: 8213 - DNA, 25 bp, S. cerevisiae
agatgatatcactggttcgtcaacc

SEQ ID NO: 8214 - DNA, 25 bp, S. cerevisiae
agagatcatctctgcgtacgcatga

SEQ ID NO: 8215 - DNA, 25 bp, S. cerevisiae
agacggtgtgtatgaaaatatccca

SEQ ID NO: 8216 - DNA, 25 bp, S. cerevisiae
agaccggcttgatgggttatccctt

SEQ ID NO: 8217 - DNA, 25 bp, S. cerevisiae
agaccgtgacgttgtagactatatt

SEQ ID NO: 8218 - DNA, 25 bp, S. cerevisiae
agagggtgtccttgccgtcaaagct

SEQ ID NO: 8219 - DNA, 25 bp, S. cerevisiae
aagctcttatccaccgtcaaagtaa

SEQ ID NO: 8220 - DNA, 25 bp, S. cerevisiae
agatggctgtcctaggatcttaaac

SEQ ID NO: 8221 - DNA, 25 bp, S. cerevisiae
agatgcagcgcaccgggagcttaaa

SEQ ID NO: 8222 - DNA, 25 bp, S. cerevisiae
agatgagctatcgattttttctgca

SEQ ID NO: 8223 - DNA, 25 bp, S. cerevisiae
agagagcctgacttctgggttatca

SEQ ID NO: 8224 - DNA, 25 bp, S. cerevisiae
agaggtgctgcagtactttttgaac

SEQ ID NO: 8225 - DNA, 25 bp, S. cerevisiae
agagtgttgccttccattgttaatg

SEQ ID NO: 8226 - DNA, 25 bp, S. cerevisiae
agagtttattcagcgttttgtcaaa

SEQ ID NO: 8227 - DNA, 25 bp, S. cerevisiae
agaggcatttcgcacgttttaccgg

SEQ ID NO: 8228 - DNA, 25 bp, S. cerevisiae
agaggtgttccaacttctttgacca

SEQ ID NO: 8229 - DNA, 25 bp, S. cerevisiae
agaggtattcatgcctacgtttaca

SEQ ID NO: 8230 - DNA, 25 bp, S. cerevisiae
agaggtattctggtggccctttcca

SEQ ID NO: 8231 - DNA, 25 bp, S. cerevisiae
agaggcaactgtctacctatttcca

SEQ ID NO: 8232 - DNA, 25 bp, S. cerevisiae
agaccagcctgccactagcaatatt

SEQ ID NO: 8233 - DNA, 25 bp, S. cerevisiae
agaggatctcttgccatgttcaaat

SEQ ID NO: 8234 - DNA, 25 bp, S. cerevisiae
agaggagatcttgcctgttctactc

SEQ ID NO: 8235 - DNA, 25 bp, S. cerevisiae
agaggagttatcacattttcaatat

SEQ ID NO: 8236 - DNA, 25 bp, S. cerevisiae
agaggtgttccttatgtttcagtga

SEQ ID NO: 8237 - DNA, 25 bp, S. cerevisiae
agacttcccgatggcggcaacagta

SEQ ID NO: 8238 - DNA, 25 bp, S. cerevisiae
agacttaccaatctgcgcatatcac

SEQ ID NO: 8239 - DNA, 25 bp, S. cerevisiae
agcttctaaaatctggtacgccctt

SEQ ID NO: 8240 - DNA, 25 bp, S. cerevisiae
agccgaaaaatctgagtactccctc

SEQ ID NO: 8241 - DNA, 25 bp, S. cerevisiae
agacgaaaggtcttggctaccacac

SEQ ID NO: 8242 - DNA, 25 bp, S. cerevisiae
agaggcttcgtttgttgctactacc

SEQ ID NO: 8243 - DNA, 25 bp, S. cerevisiae
agaggtgcctacactgacttttcat

SEQ ID NO: 8244 - DNA, 25 bp, S. cerevisiae
agaggcccacaaatgcatacttatt

SEQ ID NO: 8245 - DNA, 25 bp, S. cerevisiae
agagacccaaattgaactgcagttg

SEQ ID NO: 8246 - DNA, 25 bp, S. cerevisiae
agagtcgggcaacacttgagcacgt

SEQ ID NO: 8247 - DNA, 25 bp, S. cerevisiae
agagattggctaagaaggttgctcg

SEQ ID NO: 8248 - DNA, 25 bp, S. cerevisiae
agagttggctctagaaacatcgtct

SEQ ID NO: 8249 - DNA, 25 bp, S. cerevisiae
agatgtctttgaatccgcaccgaat

SEQ ID NO: 8250 - DNA, 25 bp, S. cerevisiae
agagcctcttttgagacagggaaat

SEQ ID NO: 8251 - DNA, 25 bp, S. cerevisiae
agatggccgcgtttacatcgggcaa

SEQ ID NO: 8252 - DNA, 25 bp, S. cerevisiae
gtgacccagggttgcaacgaaataa

SEQ ID NO: 8253 - DNA, 25 bp, S. cerevisiae
agacccggatgatgctttgaacaac

SEQ ID NO: 8254 - DNA, 25 bp, S. cerevisiae
agaggctactacctacattgctcaa

SEQ ID NO: 8255 - DNA, 25 bp, S. cerevisiae
agcactccctttctaggcgagacag

SEQ ID NO: 8256 - DNA, 25 bp, S. cerevisiae
agagctgctggtcacctagtggaaa

SEQ ID NO: 8257 - DNA, 25 bp, S. cerevisiae
agagttgagtcttctgatatccagg

SEQ ID NO: 8258 - DNA, 25 bp, S. cerevisiae
agagttcgtctaatacctcactggc

SEQ ID NO: 8259 - DNA, 25 bp, S. cerevisiae
agagtgtctggcagtagcctcagca

SEQ ID NO: 8260 - DNA, 25 bp, S. cerevisiae
agagcgactaaactactgcacgaaa

SEQ ID NO: 8261 - DNA, 25 bp, S. cerevisiae
agatggcacatctgtttctacaaag

SEQ ID NO: 8262 - DNA, 25 bp, S. cerevisiae
agatggtgttgcattggccactcca

SEQ ID NO: 8263 - DNA, 25 bp, S. cerevisiae
agatggtttggttgtcttgccagat

SEQ ID NO: 8264 - DNA, 25 bp, S. cerevisiae
agatggtttgatatacttgcctgaa

SEQ ID NO: 8265 - DNA, 25 bp, S. cerevisiae
agagggcttgacatgcctgttcaaa

SEQ ID NO: 8266 - DNA, 25 bp, S. cerevisiae
agagggtgccagatgccaatgccta

SEQ ID NO: 8267 - DNA, 25 bp, S. cerevisiae
agatgtttctcgattaagcctgtat

SEQ ID NO: 8268 - DNA, 25 bp, S. cerevisiae
agagttggctcgatcttatgggtac

SEQ ID NO: 8269 - DNA, 25 bp, S. cerevisiae
agatgttacgcttacttctcttcat

SEQ ID NO: 8270 - DNA, 25 bp, S. cerevisiae
agatgtttccgtgatttctcatcgg

SEQ ID NO: 8271 - DNA, 25 bp, S. cerevisiae
agagtttatggctaccccatacacg

SEQ ID NO: 8272 - DNA, 25 bp, S. cerevisiae
agactctttgtccaggttaacagca

SEQ ID NO: 8273 - DNA, 25 bp, S. cerevisiae
agagtcctttcgacctggaagacat

SEQ ID NO: 8274 - DNA, 25 bp, S. cerevisiae
agaggacggtctactgcaaacagtt

SEQ ID NO: 8275 - DNA, 25 bp, S. cerevisiae
agaggcacgtattcctgcacaacat

SEQ ID NO: 8276 - DNA, 25 bp, S. cerevisiae
agagagttgttgtcccacaagcatt

SEQ ID NO: 8277 - DNA, 25 bp, S. cerevisiae
agagctttagacaccgttaccaatg

SEQ ID NO: 8278 - DNA, 25 bp, S. cerevisiae
agagttactggtgccgatgttccaa

SEQ ID NO: 8279 - DNA, 25 bp, S. cerevisiae
agagttattgtttgccgacactccc

SEQ ID NO: 8280 - DNA, 25 bp, S. cerevisiae
agagtctgatgaattgaggccacca

SEQ ID NO: 8281 - DNA, 25 bp, S. cerevisiae
agatgtctatgttcttgcgtcggca

SEQ ID NO: 8282 - DNA, 25 bp, S. cerevisiae
agagtcgctgtttccgatgggcaca

SEQ ID NO: 8283 - DNA, 25 bp, S. cerevisiae
agagctcgctataatctggcggtat

SEQ ID NO: 8284 - DNA, 25 bp, S. cerevisiae
agaggcaattctacaagctttcatt

SEQ ID NO: 8285 - DNA, 25 bp, S. cerevisiae
agagccaattccaaagtcaacgtcg

SEQ ID NO: 8286 - DNA, 25 bp, S. cerevisiae
agagagctcggacacatactgcggc

SEQ ID NO: 8287 - DNA, 25 bp, S. cerevisiae
agaggaatctgcaagggcttttgga

SEQ ID NO: 8288 - DNA, 25 bp, S. cerevisiae
agagagaggccaacgctgatgcttg

SEQ ID NO: 8289 - DNA, 25 bp, S. cerevisiae
agagcagtaccaaccgatgaagcga

SEQ ID NO: 8290 - DNA, 25 bp, S. cerevisiae
agagaacctttggtcttggctaatc

SEQ ID NO: 8291 - DNA, 25 bp, S. cerevisiae
agagacattccaatgcccttggtta

SEQ ID NO: 8292 - DNA, 25 bp, S. cerevisiae
agaggctgctaaagtccctttgcaa

SEQ ID NO: 8293 - DNA, 25 bp, S. cerevisiae
agagcaatcccaggagccctaggtt

SEQ ID NO: 8294 - DNA, 25 bp, S. cerevisiae
agagcattcccaaagcctgatacct

SEQ ID NO: 8295 - DNA, 25 bp, S. cerevisiae
agacctcttcagtggtgtggctcac

SEQ ID NO: 8296 - DNA, 25 bp, S. cerevisiae
agaactgctgtctcgggtgaaactt

SEQ ID NO: 8297 - DNA, 25 bp, S. cerevisiae
agaaacgcctacgtggtctacgatt

SEQ ID NO: 8298 - DNA, 25 bp, S. cerevisiae
agagggcttagctactgtcagtaaa

SEQ ID NO: 8299 - DNA, 25 bp, S. cerevisiae
agatggagtcacctatgaccctcaa

SEQ ID NO: 8300 - DNA, 25 bp, S. cerevisiae
agaggaatagcaatgtatcccatca

SEQ ID NO: 8301 - DNA, 25 bp, S. cerevisiae
agaggtgttccattcaacggtccaa

SEQ ID NO: 8302 - DNA, 25 bp, S. cerevisiae
agaggatgttccttacctgttgcca

SEQ ID NO: 8303 - DNA, 25 bp, S. cerevisiae
agaggtttcttcaggtttggaggat

SEQ ID NO: 8304 - DNA, 25 bp, S. cerevisiae
agaccatgtggtaccgtcgttttgg

SEQ ID NO: 8305 - DNA, 25 bp, S. cerevisiae
agaactgtggtttcgaagtcctcgt

SEQ ID NO: 8306 - DNA, 25 bp, S. cerevisiae
aaattgggtctgctcaaacccagct

SEQ ID NO: 8307 - DNA, 25 bp, S. cerevisiae
acgtctttccctgaaacgcttgaga

SEQ ID NO: 8308 - DNA, 25 bp, S. cerevisiae
tacctcgttgactctgaaaccggaa

SEQ ID NO: 8309 - DNA, 25 bp, S. cerevisiae
agaccgggaacatgataagctcgta

SEQ ID NO: 8310 - DNA, 25 bp, S. cerevisiae
agacctgggaattgcgtttgatcag

SEQ ID NO: 8311 - DNA, 25 bp, S. cerevisiae
agaccccactatatcttacttctgg

SEQ ID NO: 8312 - DNA, 25 bp, S. cerevisiae
agacccggcgttgctatgatggcct

SEQ ID NO: 8313 - DNA, 25 bp, S. cerevisiae
agagttgctctgtggccactgaagg

SEQ ID NO: 8314 - DNA, 25 bp, S. cerevisiae
agagagtgtgctccttggctagaca

SEQ ID NO: 8315 - DNA, 25 bp, S. cerevisiae
agagagccattcagtccgcagaatc

SEQ ID NO: 8316 - DNA, 25 bp, S. cerevisiae
agagagccatttttccatggaacga

SEQ ID NO: 8317 - DNA, 25 bp, S. cerevisiae
agaggtctattctcgtggctacaga

SEQ ID NO: 8318 - DNA, 25 bp, S. cerevisiae
agaggctctgtttactgtgtctcag

SEQ ID NO: 8319 - DNA, 25 bp, S. cerevisiae
agagatctattttagctgctgccca

SEQ ID NO: 8320 - DNA, 25 bp, S. cerevisiae
agagattgaattacattgcgccatg

SEQ ID NO: 8321 - DNA, 25 bp, S. cerevisiae
agagatggtctaatacggccgaaaa

SEQ ID NO: 8322 - DNA, 25 bp, S. cerevisiae
agacatggagttcacctcctgggaa

SEQ ID NO: 8323 - DNA, 25 bp, S. cerevisiae
agaggaactatttattgcacaccat

SEQ ID NO: 8324 - DNA, 25 bp, S. cerevisiae
agagtatactgatttgcccaacaag

SEQ ID NO: 8325 - DNA, 25 bp, S. cerevisiae
agagttagtgatttcctgcccacag

SEQ ID NO: 8326 - DNA, 25 bp, S. cerevisiae
agaggtatgtattcttctccaccag

SEQ ID NO: 8327 - DNA, 25 bp, S. cerevisiae
agaggatagtatccacccctcaaat

SEQ ID NO: 8328 - DNA, 25 bp, S. cerevisiae
agaggttgaccctgcttctttctaa

SEQ ID NO: 8329 - DNA, 25 bp, S. cerevisiae
agagtttacctctgcaccatttaga

SEQ ID NO: 8330 - DNA, 25 bp, S. cerevisiae
agagtttgacctatccgattctaaa

SEQ ID NO: 8331 - DNA, 25 bp, S. cerevisiae
agagttgtaccgagccattattggc

SEQ ID NO: 8332 - DNA, 25 bp, S. cerevisiae
agagttatctcggttcgttcatttc

SEQ ID NO: 8333 - DNA, 25 bp, S. cerevisiae
agagattggcccgaagtttcttcct

SEQ ID NO: 8334 - DNA, 25 bp, S. cerevisiae
agagggcaccttttcttggcgtcct

SEQ ID NO: 8335 - DNA, 25 bp, S. cerevisiae
agagaagcacccatgtttccagttc

SEQ ID NO: 8336 - DNA, 25 bp, S. cerevisiae
agagatggacatgctttcctccaac

SEQ ID NO: 8337 - DNA, 25 bp, S. cerevisiae
agagtacagcctcctagactatata

SEQ ID NO: 8338 - DNA, 25 bp, S. cerevisiae
agagatcacgttctgcagcacttga

SEQ ID NO: 8339 - DNA, 25 bp, S. cerevisiae
agagctatcgatacattcaacggca

SEQ ID NO: 8340 - DNA, 25 bp, S. cerevisiae
agagttccagctttaatcgatcatg

SEQ ID NO: 8341 - DNA, 25 bp, S. cerevisiae
agagcctgcgcactttcaaaatgag

SEQ ID NO: 8342 - DNA, 25 bp, S. cerevisiae
agacgctgcggctctcaagaaagat

SEQ ID NO: 8343 - DNA, 25 bp, S. cerevisiae
agagttggcccctgctgatgcaagg

SEQ ID NO: 8344 - DNA, 25 bp, S. cerevisiae
agagttggtcgtaccgccagagctg

SEQ ID NO: 8345 - DNA, 25 bp, S. cerevisiae
agagggctcatctaatgtctacatt

SEQ ID NO: 8346 - DNA, 25 bp, S. cerevisiae
agagcaggcctctcagcaaatgcaa

SEQ ID NO: 8347 - DNA, 25 bp, S. cerevisiae
agagctcgtgccaatgaggtttctc

SEQ ID NO: 8348 - DNA, 25 bp, S. cerevisiae
agagtcttactcgtgataatgttca

SEQ ID NO: 8349 - DNA, 25 bp, S. cerevisiae
agagatctctacgaagctgtattaa

SEQ ID NO: 8350 - DNA, 25 bp, S. cerevisiae
agagatactcagaaactgccaaaaa

SEQ ID NO: 8351 - DNA, 25 bp, S. cerevisiae
agaattctcgaaacgaaggcaaggc

SEQ ID NO: 8352 - DNA, 25 bp, S. cerevisiae
agagtactcgatatccaagggtggc

SEQ ID NO: 8353 - DNA, 25 bp, S. cerevisiae
agagttgtcgttcctcaagctttga

SEQ ID NO: 8354 - DNA, 25 bp, S. cerevisiae
agactagatcctgggcacagtgctc

SEQ ID NO: 8355 - DNA, 25 bp, S. cerevisiae
agacgtgtctctggagcaactcgac

SEQ ID NO: 8356 - DNA, 25 bp, S. cerevisiae
agaggatctttgctactctctgcaa

SEQ ID NO: 8357 - DNA, 25 bp, S. cerevisiae
agagttcgccatgggtgctgtgtcc

SEQ ID NO: 8358 - DNA, 25 bp, S. cerevisiae
agagttcaactcttgggtgtacgat

SEQ ID NO: 8359 - DNA, 25 bp, S. cerevisiae
agagactctagttgattgggtacca

SEQ ID NO: 8360 - DNA, 25 bp, S. cerevisiae
agagatttgatgaccctatgtgata

SEQ ID NO: 8361 - DNA, 25 bp, S. cerevisiae
agagcgtcatatgccctaatgtcat

SEQ ID NO: 8362 - DNA, 25 bp, S. cerevisiae
agagcggtacatcttctgatccaga

SEQ ID NO: 8363 - DNA, 25 bp, S. cerevisiae
agagtgataatcatctgccacctcg

SEQ ID NO: 8364 - DNA, 25 bp, S. cerevisiae
agagatattgataccggtcccggac

SEQ ID NO: 8365 - DNA, 25 bp, S. cerevisiae
agagcttcaaaaggcacattccgaa

SEQ ID NO: 8366 - DNA, 25 bp, S. cerevisiae
agagtatacttttctacgcctccaa

SEQ ID NO: 8367 - DNA, 25 bp, S. cerevisiae
agagatatcaacaccttgcctgctt

SEQ ID NO: 8368 - DNA, 25 bp, S. cerevisiae
agactaactacatttcgcacttcat

SEQ ID NO: 8369 - DNA, 25 bp, S. cerevisiae
agagcaagagctcactgtcaccttt

SEQ ID NO: 8370 - DNA, 25 bp, S. cerevisiae
agagatgtccaaagagccgtcgaac

SEQ ID NO: 8371 - DNA, 25 bp, S. cerevisiae
agagctgtctgatttgacgttcgaa

SEQ ID NO: 8372 - DNA, 25 bp, S. cerevisiae
agagttccacattgccaggtttaag

SEQ ID NO: 8373 - DNA, 25 bp, S. cerevisiae
agagcaacttttccggcaatcttgg

SEQ ID NO: 8374 - DNA, 25 bp, S. cerevisiae
agagcaaatatctccgacaatcttt

SEQ ID NO: 8375 - DNA, 25 bp, S. cerevisiae
agagagcataactagccccacaatt

SEQ ID NO: 8376 - DNA, 25 bp, S. cerevisiae
agagattcaagatgctgtccacaat

SEQ ID NO: 8377 - DNA, 25 bp, S. cerevisiae
agccgggttggctccagatgctaga

SEQ ID NO: 8378 - DNA, 25 bp, S. cerevisiae
agacgggtttttgcaatccatctcg

SEQ ID NO: 8379 - DNA, 25 bp, S. cerevisiae
agagaagaatgaacccaggtccatc

SEQ ID NO: 8380 - DNA, 25 bp, S. cerevisiae
agaaagagtgctcccgtggactcat

SEQ ID NO: 8381 - DNA, 25 bp, S. cerevisiae
agacatgggtctcaggtctactgca

SEQ ID NO: 8382 - DNA, 25 bp, S. cerevisiae
agacaaggtccgcttctaccatggc

SEQ ID NO: 8383 - DNA, 25 bp, S. cerevisiae
agacctgagtttggtactaccttgc

SEQ ID NO: 8384 - DNA, 25 bp, S. cerevisiae
agaccgagttcgcatcgataccatt

SEQ ID NO: 8385 - DNA, 25 bp, S. cerevisiae
agaccgagctcttggaaaaggcatt

SEQ ID NO: 8386 - DNA, 25 bp, S. cerevisiae
agaactggcctgttgaaaagtacga

SEQ ID NO: 8387 - DNA, 25 bp, S. cerevisiae
agaacttgcctctgagcaaactcca

SEQ ID NO: 8388 - DNA, 25 bp, S. cerevisiae
agacggtttccgtgctgttactcaa

SEQ ID NO: 8389 - DNA, 25 bp, S. cerevisiae
aaattctttgcatcttttgtaccca

SEQ ID NO: 8390 - DNA, 25 bp, S. cerevisiae
agacaactttgcttcttcgttagcc

SEQ ID NO: 8391 - DNA, 25 bp, S. cerevisiae
agaagaaactgctctcctttgacgc

SEQ ID NO: 8392 - DNA, 25 bp, S. cerevisiae
agagattactttggcgcttttacgc

SEQ ID NO: 8393 - DNA, 25 bp, S. cerevisiae
agaattcccgttcgctaaaactgca

SEQ ID NO: 8394 - DNA, 25 bp, S. cerevisiae
agagtttcaccggtatggccataca

SEQ ID NO: 8395 - DNA, 25 bp, S. cerevisiae
agagtattcactcaaggctccaatc

SEQ ID NO: 8396 - DNA, 25 bp, S. cerevisiae
agagccaatcctcaattgttcccag

SEQ ID NO: 8397 - DNA, 25 bp, S. cerevisiae
agacgctatcgttaagttgggccaa

SEQ ID NO: 8398 - DNA, 25 bp, S. cerevisiae
agcccttcttcctgtactggtaaga

SEQ ID NO: 8399 - DNA, 25 bp, S. cerevisiae
agacgttcgtcccaatttgattcaa

SEQ ID NO: 8400 - DNA, 25 bp, S. cerevisiae
aaccttagtcggctctgggtcaaag

SEQ ID NO: 8401 - DNA, 25 bp, S. cerevisiae
acgggtaatcgcagctcgggatcaa

SEQ ID NO: 8402 - DNA, 25 bp, S. cerevisiae
agagaactaacgagccattggataa

SEQ ID NO: 8403 - DNA, 25 bp, S. cerevisiae
agagaacctctcttagccctaataa

SEQ ID NO: 8404 - DNA, 25 bp, S. cerevisiae
agagtaacaccaagaccctcattag

SEQ ID NO: 8405 - DNA, 25 bp, S. cerevisiae
agcatttccccaatgaccagtttat

SEQ ID NO: 8406 - DNA, 25 bp, S. cerevisiae
agagaatccccaatgaaagcgtatt

SEQ ID NO: 8407 - DNA, 25 bp, S. cerevisiae
agagttgctgccgtcgaaaccttat

SEQ ID NO: 8408 - DNA, 25 bp, S. cerevisiae
agagttcatcacaggattatccatt

SEQ ID NO: 8409 - DNA, 25 bp, S. cerevisiae
agagcttatctctaaggctgacatt

SEQ ID NO: 8410 - DNA, 25 bp, S. cerevisiae
agagacagatcctaacctcgcatta

SEQ ID NO: 8411 - DNA, 25 bp, S. cerevisiae
agagtaatccacaaccagcttatac

SEQ ID NO: 8412 - DNA, 25 bp, S. cerevisiae
agactctactccagacacggatgta

SEQ ID NO: 8413 - DNA, 25 bp, S. cerevisiae
agagttttgccttatgctaccgtca

SEQ ID NO: 8414 - DNA, 25 bp, S. cerevisiae
agactacgaatccactaactccaat

SEQ ID NO: 8415 - DNA, 25 bp, S. cerevisiae
agactacgaggccagtgttcccgaa

SEQ ID NO: 8416 - DNA, 25 bp, S. cerevisiae
agactgacgggcactttgacttaat

SEQ ID NO: 8417 - DNA, 25 bp, S. cerevisiae
agacgacgagcctgtttgccttcag

SEQ ID NO: 8418 - DNA, 25 bp, S. cerevisiae
agacgacgacaaggatgccgttgat

SEQ ID NO: 8419 - DNA, 25 bp, S. cerevisiae
agcacgacgtaactgattttgattc

SEQ ID NO: 8420 - DNA, 25 bp, S. cerevisiae
agagagcttccccaaccgattttat

SEQ ID NO: 8421 - DNA, 25 bp, S. cerevisiae
agagatttctccagatccgtggttc

SEQ ID NO: 8422 - DNA, 25 bp, S. cerevisiae
agagatcatcttgccgttcttgagc

SEQ ID NO: 8423 - DNA, 25 bp, S. cerevisiae
agagatctaccctttttgtgtgaag

SEQ ID NO: 8424 - DNA, 25 bp, S. cerevisiae
agagaaccctactttcacactatat

SEQ ID NO: 8425 - DNA, 25 bp, S. cerevisiae
agaattcggtgtcaattcctccgat

SEQ ID NO: 8426 - DNA, 25 bp, S. cerevisiae
agaaatcgccggtttgtccccatat

SEQ ID NO: 8427 - DNA, 25 bp, S. cerevisiae
agagagtggacgtcgttccgcccaa

SEQ ID NO: 8428 - DNA, 25 bp, S. cerevisiae
agagacattgcccagattcccgaaa

SEQ ID NO: 8429 - DNA, 25 bp, S. cerevisiae
agaccaccaccgacaaagtatgcaa

SEQ ID NO: 8430 - DNA, 25 bp, S. cerevisiae
agaccctcccagaaactaacaatgt

SEQ ID NO: 8431 - DNA, 25 bp, S. cerevisiae
agaccactcctccataatatacaag

SEQ ID NO: 8432 - DNA, 25 bp, S. cerevisiae
agacattctcctgaagtcaccaaga

SEQ ID NO: 8433 - DNA, 25 bp, S. cerevisiae
agagcggatcattacctggacaaag

SEQ ID NO: 8434 - DNA, 25 bp, S. cerevisiae
agagcaatgcgttccatatgcgaaa

SEQ ID NO: 8435 - DNA, 25 bp, S. cerevisiae
agagcactcggattctatgtatgaa

SEQ ID NO: 8436 - DNA, 25 bp, S. cerevisiae
agagcagctgcccagtttggccaaa

SEQ ID NO: 8437 - DNA, 25 bp, S. cerevisiae
agagatggcccagtttcaagcgaag

SEQ ID NO: 8438 - DNA, 25 bp, S. cerevisiae
agacatgggtacgttgcaatcacaa

SEQ ID NO: 8439 - DNA, 25 bp, S. cerevisiae
agagcatatgtatcctgtgaatcaa

SEQ ID NO: 8440 - DNA, 25 bp, S. cerevisiae
agagaattatctgcgctatatagct

SEQ ID NO: 8441 - DNA, 25 bp, S. cerevisiae
agagccttcatctcgtatcatgacg

SEQ ID NO: 8442 - DNA, 25 bp, S. cerevisiae
agagagcttgtcttcttatcagccg

SEQ ID NO: 8443 - DNA, 25 bp, S. cerevisiae
agagactagtgctttggactccacc

SEQ ID NO: 8444 - DNA, 25 bp, S. cerevisiae
agagaagcaatggtcgcggctccgc

SEQ ID NO: 8445 - DNA, 25 bp, S. cerevisiae
agagcaagaagatccccatgccatc

SEQ ID NO: 8446 - DNA, 25 bp, S. cerevisiae
agacaaatgcatcaccactcagaat

SEQ ID NO: 8447 - DNA, 25 bp, S. cerevisiae
agacgatcagttttcttggaacaat

SEQ ID NO: 8448 - DNA, 25 bp, S. cerevisiae
agagttggtcattctactgatttcc

SEQ ID NO: 8449 - DNA, 25 bp, S. cerevisiae
agagttatcggtaccttatctcccg

SEQ ID NO: 8450 - DNA, 25 bp, S. cerevisiae
agagattacctgacaacttttcccg

SEQ ID NO: 8451 - DNA, 25 bp, S. cerevisiae
agagatatccctgcaacttttttct

SEQ ID NO: 8452 - DNA, 25 bp, S. cerevisiae
agagcaggtcttgaacgttttgttc

SEQ ID NO: 8453 - DNA, 25 bp, S. cerevisiae
agagcctgctttcaaacttctggga

SEQ ID NO: 8454 - DNA, 25 bp, S. cerevisiae
agagccgttttggatcacatattca

SEQ ID NO: 8455 - DNA, 25 bp, S. cerevisiae
agagctgctgtcttggagacattga

SEQ ID NO: 8456 - DNA, 25 bp, S. cerevisiae
agagcctcatcagggcatgcatcaa

SEQ ID NO: 8457 - DNA, 25 bp, S. cerevisiae
agagctttggctgcatatctatgtg

SEQ ID NO: 8458 - DNA, 25 bp, S. cerevisiae
agagctcttgacgtatcactctgtc

SEQ ID NO: 8459 - DNA, 25 bp, S. cerevisiae
agagccatggtctaacggttacata

SEQ ID NO: 8460 - DNA, 25 bp, S. cerevisiae
agacccctgaagatttggacatgga

SEQ ID NO: 8461 - DNA, 25 bp, S. cerevisiae
agactcctctagattctggaacggt

SEQ ID NO: 8462 - DNA, 25 bp, S. cerevisiae
agagattacattttcttcagaaggc

SEQ ID NO: 8463 - DNA, 25 bp, S. cerevisiae
agagctagacttgtgttcaatgaac

SEQ ID NO: 8464 - DNA, 25 bp, S. cerevisiae
agagatcttcttctatctggatgaa

SEQ ID NO: 8465 - DNA, 25 bp, S. cerevisiae
agagatttgctcctttagcgcctat

SEQ ID NO: 8466 - DNA, 25 bp, S. cerevisiae
agagatcattcttacatttcgtatt

SEQ ID NO: 8467 - DNA, 25 bp, S. cerevisiae
agagaggctttccagttgtttgtaa

SEQ ID NO: 8468 - DNA, 25 bp, S. cerevisiae
agagaacttttcgtttttgcatgaa

SEQ ID NO: 8469 - DNA, 25 bp, S. cerevisiae
agagctacttttggttctatcgaaa

SEQ ID NO: 8470 - DNA, 25 bp, S. cerevisiae
agagctacttatagacagtctttga

SEQ ID NO: 8471 - DNA, 25 bp, S. cerevisiae
agagcgccctctgtttgcaaagcga

SEQ ID NO: 8472 - DNA, 25 bp, S. cerevisiae
agacgatcctgttagtgtacttcca

SEQ ID NO: 8473 - DNA, 25 bp, S. cerevisiae
agagctgttgctgtcgttgttgacc

SEQ ID NO: 8474 - DNA, 25 bp, S. cerevisiae
agagcggtctttcttcttgttctat

SEQ ID NO: 8475 - DNA, 25 bp, S. cerevisiae
agagaggtatgatgcccggtttaac

SEQ ID NO: 8476 - DNA, 25 bp, S. cerevisiae
agagcagttaaatccggtgtcaaat

SEQ ID NO: 8477 - DNA, 25 bp, S. cerevisiae
agacctctactggtatcattgtcca

SEQ ID NO: 8478 - DNA, 25 bp, S. cerevisiae
agagcctctaccaatgatcacattt

SEQ ID NO: 8479 - DNA, 25 bp, S. cerevisiae
agacccaactccagatcagtactgt

SEQ ID NO: 8480 - DNA, 25 bp, S. cerevisiae
agaccccgctgcacagaaaagactg

SEQ ID NO: 8481 - DNA, 25 bp, S. cerevisiae
agagccatcgcccaaagtaaatatt

SEQ ID NO: 8482 - DNA, 25 bp, S. cerevisiae
agagcactcctcaagacaccaatgt

SEQ ID NO: 8483 - DNA, 25 bp, S. cerevisiae
agagactctctctgactgcaagaaa

SEQ ID NO: 8484 - DNA, 25 bp, S. cerevisiae
agagcactcctacctgtgtgactta

SEQ ID NO: 8485 - DNA, 25 bp, S. cerevisiae
agagcactctacaactatggatggt

SEQ ID NO: 8486 - DNA, 25 bp, S. cerevisiae
agagatcttgcagacattcgtggat

SEQ ID NO: 8487 - DNA, 25 bp, S. cerevisiae
agagcctagctggagttcattggaa

SEQ ID NO: 8488 - DNA, 25 bp, S. cerevisiae
agagccccagggttgcattggaaat

SEQ ID NO: 8489 - DNA, 25 bp, S. cerevisiae
agaccgcaaacgttgtccagctaaa

SEQ ID NO: 8490 - DNA, 25 bp, S. cerevisiae
agcaccgcaaacgaggtaccattcg

SEQ ID NO: 8491 - DNA, 25 bp, S. cerevisiae
agaccgctacagaggtaacaccaca

SEQ ID NO: 8492 - DNA, 25 bp, S. cerevisiae
agactcgcttaatggaagaggccga

SEQ ID NO: 8493 - DNA, 25 bp, S. cerevisiae
agagcttactctcgttactttaacg

SEQ ID NO: 8494 - DNA, 25 bp, S. cerevisiae
agagccttccattggctaccttaat

SEQ ID NO: 8495 - DNA, 25 bp, S. cerevisiae
agactcttactctgccggttattac

SEQ ID NO: 8496 - DNA, 25 bp, S. cerevisiae
agacgttcactctcgccgttgttca

SEQ ID NO: 8497 - DNA, 25 bp, S. cerevisiae
agagaattggcctccggtttgtctt

SEQ ID NO: 8498 - DNA, 25 bp, S. cerevisiae
agagaaggactctcctcgcttttta

SEQ ID NO: 8499 - DNA, 25 bp, S. cerevisiae
agagacggtgccatgttccctaatt

SEQ ID NO: 8500 - DNA, 25 bp, S. cerevisiae
agaacagtaacacctgccccaaatt

SEQ ID NO: 8501 - DNA, 25 bp, S. cerevisiae
agaagagataaagaacctgcccttt

SEQ ID NO: 8502 - DNA, 25 bp, S. cerevisiae
agagctattcagagacaacccacgc

SEQ ID NO: 8503 - DNA, 25 bp, S. cerevisiae
agactatgtcacagtaccatccttc

SEQ ID NO: 8504 - DNA, 25 bp, S. cerevisiae
agaccatgacgatagaccaatctac

SEQ ID NO: 8505 - DNA, 25 bp, S. cerevisiae
agacgtgaagatgcatgagctcata

SEQ ID NO: 8506 - DNA, 25 bp, S. cerevisiae
agacgcatccaactgtacactgatt

SEQ ID NO: 8507 - DNA, 25 bp, S. cerevisiae
agactgccgcggatacggtttactg

SEQ ID NO: 8508 - DNA, 25 bp, S. cerevisiae
agagacccgattcctgcaattatat

SEQ ID NO: 8509 - DNA, 25 bp, S. cerevisiae
agacacacggttctgcacaaaatgt

SEQ ID NO: 8510 - DNA, 25 bp, S. cerevisiae
agagcacctgaacttctcctaaatt

SEQ ID NO: 8511 - DNA, 25 bp, S. cerevisiae
agagctctgagcaaggtcccaaaat

SEQ ID NO: 8512 - DNA, 25 bp, S. cerevisiae
agagctctcacaattttacgaatag

SEQ ID NO: 8513 - DNA, 25 bp, S. cerevisiae
agagcacgccactattggacgacga

SEQ ID NO: 8514 - DNA, 25 bp, S. cerevisiae
agagcccaaaattatgccgccgatt

SEQ ID NO: 8515 - DNA, 25 bp, S. cerevisiae
agagcaaccgaatctgtcgccagag

SEQ ID NO: 8516 - DNA, 25 bp, S. cerevisiae
agagaattccagtcagtttctgatt

SEQ ID NO: 8517 - DNA, 25 bp, S. cerevisiae
agagaagtctctcctttttcatctg

SEQ ID NO: 8518 - DNA, 25 bp, S. cerevisiae
agagaccgtgcccaagttgttcgag

SEQ ID NO: 8519 - DNA, 25 bp, S. cerevisiae
agagacctggccaacgtggtgagaa

SEQ ID NO: 8520 - DNA, 25 bp, S. cerevisiae
agacgagtggtcttccttacagaga

SEQ ID NO: 8521 - DNA, 25 bp, S. cerevisiae
aacggtaccactgttactgaaactg

SEQ ID NO: 8522 - DNA, 25 bp, S. cerevisiae
agaccgttcggtatatactggagac

SEQ ID NO: 8523 - DNA, 25 bp, S. cerevisiae
agacgagtctagttcatcttcctcg

SEQ ID NO: 8524 - DNA, 25 bp, S. cerevisiae
agagcaatttgtctgtttcatggca

SEQ ID NO: 8525 - DNA, 25 bp, S. cerevisiae
agagcatttcttttattctccgctg

SEQ ID NO: 8526 - DNA, 25 bp, S. cerevisiae
agacgagctatttgtgaaccaccca

SEQ ID NO: 8527 - DNA, 25 bp, S. cerevisiae
agaccgctggtcttgatgttaatga

SEQ ID NO: 8528 - DNA, 25 bp, S. cerevisiae
agagcacgcgtgttggagtttcaag

SEQ ID NO: 8529 - DNA, 25 bp, S. cerevisiae
agagcacgactttcgtgttccaagc

SEQ ID NO: 8530 - DNA, 25 bp, S. cerevisiae
agagagcgactttgtatgccccaat

SEQ ID NO: 8531 - DNA, 25 bp, S. cerevisiae
agagagaatgttcttgccgccgatc

SEQ ID NO: 8532 - DNA, 25 bp, S. cerevisiae
agagcaacactttttggcccgatat

SEQ ID NO: 8533 - DNA, 25 bp, S. cerevisiae
agaactacgcactctttcaaacgaa

SEQ ID NO: 8534 - DNA, 25 bp, S. cerevisiae
agaaagacacgaacctgaggcctta

SEQ ID NO: 8535 - DNA, 25 bp, S. cerevisiae
agaagagtgaattcggtgcggcccc

SEQ ID NO: 8536 - DNA, 25 bp, S. cerevisiae
agacaagtcttatgggctggcccgc

SEQ ID NO: 8537 - DNA, 25 bp, S. cerevisiae
agaccacgaagctgctggtatcttc

SEQ ID NO: 8538 - DNA, 25 bp, S. cerevisiae
agagcccaaacattgcatgctgtcc

SEQ ID NO: 8539 - DNA, 25 bp, S. cerevisiae
agaccgaaatagttcctctctctaa

SEQ ID NO: 8540 - DNA, 25 bp, S. cerevisiae
agaccaataaacttgctctcactca

SEQ ID NO: 8541 - DNA, 25 bp, S. cerevisiae
agaccacagctatcatcatttccta

SEQ ID NO: 8542 - DNA, 25 bp, S. cerevisiae
agaccatcgtctacatcacatttgt

SEQ ID NO: 8543 - DNA, 25 bp, S. cerevisiae
agagactatcttatcaatcacgtgt

SEQ ID NO: 8544 - DNA, 25 bp, S. cerevisiae
agagacttgtttccactatttgtgt

SEQ ID NO: 8545 - DNA, 25 bp, S. cerevisiae
agagactttcttcgcgttacatgat

SEQ ID NO: 8546 - DNA, 25 bp, S. cerevisiae
agagactttgctacgctggttgagt

SEQ ID NO: 8547 - DNA, 25 bp, S. cerevisiae
agcagcctcttgtcatcgtcgttgg

SEQ ID NO: 8548 - DNA, 25 bp, S. cerevisiae
agacgcgatctgtctgggtcaggaa

SEQ ID NO: 8549 - DNA, 25 bp, S. cerevisiae
agagccagacgacgctgctttggaa

SEQ ID NO: 8550 - DNA, 25 bp, S. cerevisiae
agagccaggtaagtcttgtgatgaa

SEQ ID NO: 8551 - DNA, 25 bp, S. cerevisiae
agagccctacaaatttccatgaatg

SEQ ID NO: 8552 - DNA, 25 bp, S. cerevisiae
agaccgcttgggacttgtgtctatt

SEQ ID NO: 8553 - DNA, 25 bp, S. cerevisiae
agagcatcgcctggaccttatggaa

SEQ ID NO: 8554 - DNA, 25 bp, S. cerevisiae
agagctagcctctttcattagtgca

SEQ ID NO: 8555 - DNA, 25 bp, S. cerevisiae
agcactagccgtatgcatggacctg

SEQ ID NO: 8556 - DNA, 25 bp, S. cerevisiae
agagccattgccttattgaccgcat

SEQ ID NO: 8557 - DNA, 25 bp, S. cerevisiae
agactcttgatctgtggacctgatg

SEQ ID NO: 8558 - DNA, 25 bp, S. cerevisiae
agagcctttcaatttcactcggcaa

SEQ ID NO: 8559 - DNA, 25 bp, S. cerevisiae
agacctttggtccattgacaaaaag

SEQ ID NO: 8560 - DNA, 25 bp, S. cerevisiae
agacgctgttgattcttatgacaaa

SEQ ID NO: 8561 - DNA, 25 bp, S. cerevisiae
agagcgtcttcgatatcgctatcgt

SEQ ID NO: 8562 - DNA, 25 bp, S. cerevisiae
agagcagtctccgtacaggtgatgg

SEQ ID NO: 8563 - DNA, 25 bp, S. cerevisiae
agaattcttcgtccaggtgctgaca

SEQ ID NO: 8564 - DNA, 25 bp, S. cerevisiae
agagcactattggttatgggcgaaa

SEQ ID NO: 8565 - DNA, 25 bp, S. cerevisiae
agagcgtcatccattatggtcccga

SEQ ID NO: 8566 - DNA, 25 bp, S. cerevisiae
agactgtattcgctcaagtccctaa

SEQ ID NO: 8567 - DNA, 25 bp, S. cerevisiae
agaagtttcgtacatctacagcaag

SEQ ID NO: 8568 - DNA, 25 bp, S. cerevisiae
agacgtattcgcagactctaacaat

SEQ ID NO: 8569 - DNA, 25 bp, S. cerevisiae
agacgtggttcaacaatcctaagta

SEQ ID NO: 8570 - DNA, 25 bp, S. cerevisiae
agactctttgttacctgccataaca

SEQ ID NO: 8571 - DNA, 25 bp, S. cerevisiae
agactttgtgtcatccagaatataa

SEQ ID NO: 8572 - DNA, 25 bp, S. cerevisiae
agacctctattaatgctcttaccag

SEQ ID NO: 8573 - DNA, 25 bp, S. cerevisiae
agactccgatttatcatttcaccac

SEQ ID NO: 8574 - DNA, 25 bp, S. cerevisiae
agaattttactacaggctactcctt

SEQ ID NO: 8575 - DNA, 25 bp, S. cerevisiae
agcaatttttggtctagcctacctc

SEQ ID NO: 8576 - DNA, 25 bp, S. cerevisiae
agacgcagttctccacgaggtactt

SEQ ID NO: 8577 - DNA, 25 bp, S. cerevisiae
agaccagttgctttgccatggttct

SEQ ID NO: 8578 - DNA, 25 bp, S. cerevisiae
agacctggtgtcttccatggtgtca

SEQ ID NO: 8579 - DNA, 25 bp, S. cerevisiae
agacgctgagctgtatcacgggcta

SEQ ID NO: 8580 - DNA, 25 bp, S. cerevisiae
agagcagcaagtgttcagacggtaa

SEQ ID NO: 8581 - DNA, 25 bp, S. cerevisiae
agaaaggccgtttaccatgtcaatt

SEQ ID NO: 8582 - DNA, 25 bp, S. cerevisiae
agaaaggcttgctcaaatgggcgtg

SEQ ID NO: 8583 - DNA, 25 bp, S. cerevisiae
agaatccctttacactggtcagttt

SEQ ID NO: 8584 - DNA, 25 bp, S. cerevisiae
agaactcacggtagccttggtcatt

SEQ ID NO: 8585 - DNA, 25 bp, S. cerevisiae
ttggtaccagctgaacttgagtcgt

SEQ ID NO: 8586 - DNA, 25 bp, S. cerevisiae
agactaccagctgaggttgtggagc

SEQ ID NO: 8587 - DNA, 25 bp, S. cerevisiae
agacgaattctagcgttctggccat

SEQ ID NO: 8588 - DNA, 25 bp, S. cerevisiae
agacgagtatcttccgatcatcggc

SEQ ID NO: 8589 - DNA, 25 bp, S. cerevisiae
agagcatttttattcacctgttcaa

SEQ ID NO: 8590 - DNA, 25 bp, S. cerevisiae
agagcattctctaggttctggttct

SEQ ID NO: 8591 - DNA, 25 bp, S. cerevisiae
agcagcaatcatcaagccttgggtt

SEQ ID NO: 8592 - DNA, 25 bp, S. cerevisiae
agagcatctctcaaacaccaatttc

SEQ ID NO: 8593 - DNA, 25 bp, S. cerevisiae
agagcagcagcagaacccacaatga

SEQ ID NO: 8594 - DNA, 25 bp, S. cerevisiae
agagcctgctcatacattacataga

SEQ ID NO: 8595 - DNA, 25 bp, S. cerevisiae
agagctattccttgacttatccaaa

SEQ ID NO: 8596 - DNA, 25 bp, S. cerevisiae
agactgttgctacactgtatgccaa

SEQ ID NO: 8597 - DNA, 25 bp, S. cerevisiae
agacgatccattgagtgctgtgaca

SEQ ID NO: 8598 - DNA, 25 bp, S. cerevisiae
agacgatcctgcgagaaggctctat

SEQ ID NO: 8599 - DNA, 25 bp, S. cerevisiae
agacccgctcggaaggctcaagatt

SEQ ID NO: 8600 - DNA, 25 bp, S. cerevisiae
agaacacctggcgtcagttcaacgt

SEQ ID NO: 8601 - DNA, 25 bp, S. cerevisiae
agaaacggatctgcagttcaacccc

SEQ ID NO: 8602 - DNA, 25 bp, S. cerevisiae
acagaaacccagatgtccgttacca

SEQ ID NO: 8603 - DNA, 25 bp, S. cerevisiae
agagcgaaccttaatcctccgttat

SEQ ID NO: 8604 - DNA, 25 bp, S. cerevisiae
agagctaactagaatacccggtgaa

SEQ ID NO: 8605 - DNA, 25 bp, S. cerevisiae
agacgttgggctctcacacttgtga

SEQ ID NO: 8606 - DNA, 25 bp, S. cerevisiae
agagcgtattccacaggcgcttgga

SEQ ID NO: 8607 - DNA, 25 bp, S. cerevisiae
agagcctttaatgagccctgtgccc

SEQ ID NO: 8608 - DNA, 25 bp, S. cerevisiae
agagcgccttgggaagcttttgcta

SEQ ID NO: 8609 - DNA, 25 bp, S. cerevisiae
agaatttggttgtgtgccatcccga

SEQ ID NO: 8610 - DNA, 25 bp, S. cerevisiae
agaaatgggcaagcgtcggctccaa

SEQ ID NO: 8611 - DNA, 25 bp, S. cerevisiae
agacttgttggcacggagcttgctt

SEQ ID NO: 8612 - DNA, 25 bp, S. cerevisiae
agcacccgcggacagtagtagtata

SEQ ID NO: 8613 - DNA, 25 bp, S. cerevisiae
agaccgcggcatattcatgattcgt

SEQ ID NO: 8614 - DNA, 25 bp, S. cerevisiae
agacgctctaatgctctcattactt

SEQ ID NO: 8615 - DNA, 25 bp, S. cerevisiae
agacggtaacttggctattggtgac

SEQ ID NO: 8616 - DNA, 25 bp, S. cerevisiae
agacgtttatttgggtgtgcgctac

SEQ ID NO: 8617 - DNA, 25 bp, S. cerevisiae
agacgtctgtctttggtgaggccga

SEQ ID NO: 8618 - DNA, 25 bp, S. cerevisiae
agacgttgatcgctgctggtatcat

SEQ ID NO: 8619 - DNA, 25 bp, S. cerevisiae
agaccgttgccggtggtgcttatac

SEQ ID NO: 8620 - DNA, 25 bp, S. cerevisiae
agaccaatttcgatggctctcattc

SEQ ID NO: 8621 - DNA, 25 bp, S. cerevisiae
agaccaatttgggtggcgcatttaa

SEQ ID NO: 8622 - DNA, 25 bp, S. cerevisiae
agacccacattggtgatggtttcca

SEQ ID NO: 8623 - DNA, 25 bp, S. cerevisiae
agacgtattaaagcgctggcgaaat

SEQ ID NO: 8624 - DNA, 25 bp, S. cerevisiae
agacgattttgctggcaggccggaa

SEQ ID NO: 8625 - DNA, 25 bp, S. cerevisiae
agaagatttacccaggcccgcaaga

SEQ ID NO: 8626 - DNA, 25 bp, S. cerevisiae
agacaacaactcgtgggctaccaag

SEQ ID NO: 8627 - DNA, 25 bp, S. cerevisiae
agcaaaaacttggttcacacacggg

SEQ ID NO: 8628 - DNA, 25 bp, S. cerevisiae
accaaaattcagctcttgcacgacg

SEQ ID NO: 8629 - DNA, 25 bp, S. cerevisiae
agaaatttggcgcttctacggcggc

SEQ ID NO: 8630 - DNA, 25 bp, S. cerevisiae
agacctattattggtgcttcagata

SEQ ID NO: 8631 - DNA, 25 bp, S. cerevisiae
agagctcaagcttcttttctattat

SEQ ID NO: 8632 - DNA, 25 bp, S. cerevisiae
agagccctcctcttttattgatgag

SEQ ID NO: 8633 - DNA, 25 bp, S. cerevisiae
agagcgtccacttttctacgtgaga

SEQ ID NO: 8634 - DNA, 25 bp, S. cerevisiae
agacgggcagtgcatctaccgtgaa

SEQ ID NO: 8635 - DNA, 25 bp, S. cerevisiae
agaccagccttgcattgacttgtag

SEQ ID NO: 8636 - DNA, 25 bp, S. cerevisiae
agaccaggacgtccaattctctgat

SEQ ID NO: 8637 - DNA, 25 bp, S. cerevisiae
agaccggatgtggtgcaattgccca

SEQ ID NO: 8638 - DNA, 25 bp, S. cerevisiae
agacctgtagatccgacattgccaa

SEQ ID NO: 8639 - DNA, 25 bp, S. cerevisiae
agactctgtctctccagatagtcaa

SEQ ID NO: 8640 - DNA, 25 bp, S. cerevisiae
agactttggcgtcaagattcctcac

SEQ ID NO: 8641 - DNA, 25 bp, S. cerevisiae
agaattgagcccgatgactacgagg

SEQ ID NO: 8642 - DNA, 25 bp, S. cerevisiae
agacacgattttccccattgagact

SEQ ID NO: 8643 - DNA, 25 bp, S. cerevisiae
agagctcgatctcttccatattttc

SEQ ID NO: 8644 - DNA, 25 bp, S. cerevisiae
agacacagagctagatttagatcta

SEQ ID NO: 8645 - DNA, 25 bp, S. cerevisiae
agacagccgtgccattgacgacaaa

SEQ ID NO: 8646 - DNA, 25 bp, S. cerevisiae
agacgagctgcccaagatcattcaa

SEQ ID NO: 8647 - DNA, 25 bp, S. cerevisiae
agagccgctgcacatgaacattact

SEQ ID NO: 8648 - DNA, 25 bp, S. cerevisiae
agacataagccggtctatcatccgt

SEQ ID NO: 8649 - DNA, 25 bp, S. cerevisiae
agaccaacgtgattcctcatggctt

SEQ ID NO: 8650 - DNA, 25 bp, S. cerevisiae
agactaatcgtatcggaggccagat

SEQ ID NO: 8651 - DNA, 25 bp, S. cerevisiae
agaagaaagctatctcagggtagat

SEQ ID NO: 8652 - DNA, 25 bp, S. cerevisiae
agacgttgatcttggacgggctcac

SEQ ID NO: 8653 - DNA, 25 bp, S. cerevisiae
agacgagagacttgtacccttcagc

SEQ ID NO: 8654 - DNA, 25 bp, S. cerevisiae
agacgacgatatgctctgctttaaa

SEQ ID NO: 8655 - DNA, 25 bp, S. cerevisiae
agacctcctgtcttgatggttccat

SEQ ID NO: 8656 - DNA, 25 bp, S. cerevisiae
agacacttcggtatgggtccacaca

SEQ ID NO: 8657 - DNA, 25 bp, S. cerevisiae
agaacaggccgtgctggtaacacag

SEQ ID NO: 8658 - DNA, 25 bp, S. cerevisiae
agaaacgacgtcatgtggccaaagt

SEQ ID NO: 8659 - DNA, 25 bp, S. cerevisiae
agaccactacttctgatgcggctaa

SEQ ID NO: 8660 - DNA, 25 bp, S. cerevisiae
agaccagatactttagatcctgctt

SEQ ID NO: 8661 - DNA, 25 bp, S. cerevisiae
agactattatctttggtcctgaatg

SEQ ID NO: 8662 - DNA, 25 bp, S. cerevisiae
agactatcgttgaagggcctgcact

SEQ ID NO: 8663 - DNA, 25 bp, S. cerevisiae
agaaatcagattccgggaccgtcct

SEQ ID NO: 8664 - DNA, 25 bp, S. cerevisiae
agctaacaacgggagcgacttatcg

SEQ ID NO: 8665 - DNA, 25 bp, S. cerevisiae
aattcaactttctcgaccccaagat

SEQ ID NO: 8666 - DNA, 25 bp, S. cerevisiae
agaaaccgaaactgaccgtcaagat

SEQ ID NO: 8667 - DNA, 25 bp, S. cerevisiae
agctcaaaaattcttcccctttctg

SEQ ID NO: 8668 - DNA, 25 bp, S. cerevisiae
agacgtttcttcatttgccttgtac

SEQ ID NO: 8669 - DNA, 25 bp, S. cerevisiae
agacgatcttccgttgaatgccgtt

SEQ ID NO: 8670 - DNA, 25 bp, S. cerevisiae
agacgtctcccgcaaggatattttc

SEQ ID NO: 8671 - DNA, 25 bp, S. cerevisiae
agacgtcatttacaagtgctttatt

SEQ ID NO: 8672 - DNA, 25 bp, S. cerevisiae
agacatggctacatcactccagaaa

SEQ ID NO: 8673 - DNA, 25 bp, S. cerevisiae
agacttctgctaagctctccaaaag

SEQ ID NO: 8674 - DNA, 25 bp, S. cerevisiae
agaccagaggtcttacagctacccg

SEQ ID NO: 8675 - DNA, 25 bp, S. cerevisiae
agactgtttcgatgctttcttgcca

SEQ ID NO: 8676 - DNA, 25 bp, S. cerevisiae
agactgtacttaatgtttccgctcc

SEQ ID NO: 8677 - DNA, 25 bp, S. cerevisiae
agacttgagttctatcacttccgtc

SEQ ID NO: 8678 - DNA, 25 bp, S. cerevisiae
agactcgctctactgcatggtcagt

SEQ ID NO: 8679 - DNA, 25 bp, S. cerevisiae
agactctgatcattccatccggtac

SEQ ID NO: 8680 - DNA, 25 bp, S. cerevisiae
agactgcctctattattattggtaa

SEQ ID NO: 8681 - DNA, 25 bp, S. cerevisiae
agacgtcctcaaaaatcggctccag

SEQ ID NO: 8682 - DNA, 25 bp, S. cerevisiae
agacccattatacattcctgctaca

SEQ ID NO: 8683 - DNA, 25 bp, S. cerevisiae
agaccacaatttggacccgctaaat

SEQ ID NO: 8684 - DNA, 25 bp, S. cerevisiae
agaccattggtttacctcctcaagt

SEQ ID NO: 8685 - DNA, 25 bp, S. cerevisiae
agaccactgatgataacgctttaca

SEQ ID NO: 8686 - DNA, 25 bp, S. cerevisiae
agaatcctgacgtaacttttggcca

SEQ ID NO: 8687 - DNA, 25 bp, S. cerevisiae
agaacctagatcacaaatttgggag

SEQ ID NO: 8688 - DNA, 25 bp, S. cerevisiae
aaataacctcgtcgaatttgttgag

SEQ ID NO: 8689 - DNA, 25 bp, S. cerevisiae
agaaaccccattcttgcccaagatg

SEQ ID NO: 8690 - DNA, 25 bp, S. cerevisiae
agaaagctcctctccagaactaaag

SEQ ID NO: 8691 - DNA, 25 bp, S. cerevisiae
agacaattcccctcgaagatgaaga

SEQ ID NO: 8692 - DNA, 25 bp, S. cerevisiae
agaagttaccactcgcaaatcacgt

SEQ ID NO: 8693 - DNA, 25 bp, S. cerevisiae
agacaaatcgccatagtcgcctcta

SEQ ID NO: 8694 - DNA, 25 bp, S. cerevisiae
agaagacttggctgagtactacgaa

SEQ ID NO: 8695 - DNA, 25 bp, S. cerevisiae
agacgtcatctaggttcatttggta

SEQ ID NO: 8696 - DNA, 25 bp, S. cerevisiae
agacgctccctatgcaggtttgtat

SEQ ID NO: 8697 - DNA, 25 bp, S. cerevisiae
agaacctctccagcggtattattca

SEQ ID NO: 8698 - DNA, 25 bp, S. cerevisiae
agaacccttcatgcccattgtaatg

SEQ ID NO: 8699 - DNA, 25 bp, S. cerevisiae
agacctacctcagttgtctttatcg

SEQ ID NO: 8700 - DNA, 25 bp, S. cerevisiae
agactttcttcaccaatactttgta

SEQ ID NO: 8701 - DNA, 25 bp, S. cerevisiae
agacttttgaacaaccatcccaacg

SEQ ID NO: 8702 - DNA, 25 bp, S. cerevisiae
agacatcttggacgcaatggacccc

SEQ ID NO: 8703 - DNA, 25 bp, S. cerevisiae
agaaatgtggatcgcttgtacaagc

SEQ ID NO: 8704 - DNA, 25 bp, S. cerevisiae
agacgtctttgtgttgaatttgcga

SEQ ID NO: 8705 - DNA, 25 bp, S. cerevisiae
agaaatttcctgtttgcgggtgatt

SEQ ID NO: 8706 - DNA, 25 bp, S. cerevisiae
agaacctcctcgactttgaaggcta

SEQ ID NO: 8707 - DNA, 25 bp, S. cerevisiae
agaacccttattatcgggagctcaa

SEQ ID NO: 8708 - DNA, 25 bp, S. cerevisiae
agaagtccttattacgcacgttgct

SEQ ID NO: 8709 - DNA, 25 bp, S. cerevisiae
agacctcccagtttatccgagctaa

SEQ ID NO: 8710 - DNA, 25 bp, S. cerevisiae
agaccctcactgtttattgcgaccg

SEQ ID NO: 8711 - DNA, 25 bp, S. cerevisiae
aaatagcgttggttcacttagaggc

SEQ ID NO: 8712 - DNA, 25 bp, S. cerevisiae
agaccgcctaattggatcatcgaaa

SEQ ID NO: 8713 - DNA, 25 bp, S. cerevisiae
agaccgcactgtttcaactgtgaaa

SEQ ID NO: 8714 - DNA, 25 bp, S. cerevisiae
agactcggcgcatctgatatcatgg

SEQ ID NO: 8715 - DNA, 25 bp, S. cerevisiae
agacaagcggcttcacaatcagtga

SEQ ID NO: 8716 - DNA, 25 bp, S. cerevisiae
agacctgcaggttgagcctctgtta

SEQ ID NO: 8717 - DNA, 25 bp, S. cerevisiae
agaccgagtatttctcacacaatag

SEQ ID NO: 8718 - DNA, 25 bp, S. cerevisiae
agaccgcgcgtttagaggctccgat

SEQ ID NO: 8719 - DNA, 25 bp, S. cerevisiae
agaaatcaggatccgctactcaatt

SEQ ID NO: 8720 - DNA, 25 bp, S. cerevisiae
agacaagtggatccgtactaccgtc

SEQ ID NO: 8721 - DNA, 25 bp, S. cerevisiae
agaacgttagttcatctgatgccag

SEQ ID NO: 8722 - DNA, 25 bp, S. cerevisiae
agacacacgatgtttttcttgccgg

SEQ ID NO: 8723 - DNA, 25 bp, S. cerevisiae
agacaatgcaaattacccactctcc

SEQ ID NO: 8724 - DNA, 25 bp, S. cerevisiae
agacgccattcatattgccttacta

SEQ ID NO: 8725 - DNA, 25 bp, S. cerevisiae
agacgccatgtctcttgtcaatatc

SEQ ID NO: 8726 - DNA, 25 bp, S. cerevisiae
agacgagttgccattgtgcatatac

SEQ ID NO: 8727 - DNA, 25 bp, S. cerevisiae
agacaagttccccttggagatccgt

SEQ ID NO: 8728 - DNA, 25 bp, S. cerevisiae
agaatgttcccgcaattacgcccat

SEQ ID NO: 8729 - DNA, 25 bp, S. cerevisiae
agactttcattgcactttggaccca

SEQ ID NO: 8730 - DNA, 25 bp, S. cerevisiae
agactttctgtggtattttgcaaaa

SEQ ID NO: 8731 - DNA, 25 bp, S. cerevisiae
agacggtcattggaatctttcaaaa

SEQ ID NO: 8732 - DNA, 25 bp, S. cerevisiae
agactggtctatggcaactttatac

SEQ ID NO: 8733 - DNA, 25 bp, S. cerevisiae
agactgtgtataccaacttttgacg

SEQ ID NO: 8734 - DNA, 25 bp, S. cerevisiae
agaccgctaaacgttctgtttcaga

SEQ ID NO: 8735 - DNA, 25 bp, S. cerevisiae
agacagcacagacagcacagccggt

SEQ ID NO: 8736 - DNA, 25 bp, S. cerevisiae
agacagtgatctccaatgctctatc

SEQ ID NO: 8737 - DNA, 25 bp, S. cerevisiae
agactacacacaggcatccgtatgt

SEQ ID NO: 8738 - DNA, 25 bp, S. cerevisiae
agactacactgcttctgtcgttcaa

SEQ ID NO: 8739 - DNA, 25 bp, S. cerevisiae
agaccccagtcaccttagctaaagt

SEQ ID NO: 8740 - DNA, 25 bp, S. cerevisiae
agactcccagtttttcgtaaggcag

SEQ ID NO: 8741 - DNA, 25 bp, S. cerevisiae
agaagttctttctgctgcggaagcg

SEQ ID NO: 8742 - DNA, 25 bp, S. cerevisiae
agacgaatcctttcctgcaataatg

SEQ ID NO: 8743 - DNA, 25 bp, S. cerevisiae
agacgaatcgctttccatggatcaa

SEQ ID NO: 8744 - DNA, 25 bp, S. cerevisiae
agacgtcatcactttacagcagaaa

SEQ ID NO: 8745 - DNA, 25 bp, S. cerevisiae
agacgtccacgtttacgctcaagtt

SEQ ID NO: 8746 - DNA, 25 bp, S. cerevisiae
cagggttccccatacctaaagatgg

SEQ ID NO: 8747 - DNA, 25 bp, S. cerevisiae
agacgttttccaaactctcgaagat

SEQ ID NO: 8748 - DNA, 25 bp, S. cerevisiae
agacgaatacttccctaatgctcac

SEQ ID NO: 8749 - DNA, 25 bp, S. cerevisiae
agacgtgtccatggttggcctagat

SEQ ID NO: 8750 - DNA, 25 bp, S. cerevisiae
agactcctttgaattacctgacgcg

SEQ ID NO: 8751 - DNA, 25 bp, S. cerevisiae
agactgcttttgatttccgatacca

SEQ ID NO: 8752 - DNA, 25 bp, S. cerevisiae
agacgcttacttgcttctcgaaaaa

SEQ ID NO: 8753 - DNA, 25 bp, S. cerevisiae
agacgcttagcgagttgacagaaaa

SEQ ID NO: 8754 - DNA, 25 bp, S. cerevisiae
agacaggtgacttggttaccattca

SEQ ID NO: 8755 - DNA, 25 bp, S. cerevisiae
agacgttgattctgccttacattca

SEQ ID NO: 8756 - DNA, 25 bp, S. cerevisiae
agaagttgtcaacgccgacacggta

SEQ ID NO: 8757 - DNA, 25 bp, S. cerevisiae
agaagtttaatgacgcggaggccaa

SEQ ID NO: 8758 - DNA, 25 bp, S. cerevisiae
agaactggcatctctggaggcgtcg

SEQ ID NO: 8759 - DNA, 25 bp, S. cerevisiae
agaacaatgtcgaccgaggcgtcct

SEQ ID NO: 8760 - DNA, 25 bp, S. cerevisiae
aaagaacgtccctgttgtggcgaat

SEQ ID NO: 8761 - DNA, 25 bp, S. cerevisiae
agaatacctggaaagtattgttcct

SEQ ID NO: 8762 - DNA, 25 bp, S. cerevisiae
agaatcccgcgaaaggccgtatcca

SEQ ID NO: 8763 - DNA, 25 bp, S. cerevisiae
agaaccgctggttaggactctgggc

SEQ ID NO: 8764 - DNA, 25 bp, S. cerevisiae
agaaagtcaccacggcgaactggat

SEQ ID NO: 8765 - DNA, 25 bp, S. cerevisiae
agaacactccagatgtggaagctaa

SEQ ID NO: 8766 - DNA, 25 bp, S. cerevisiae
agaaaccaaattcgcgacactgcca

SEQ ID NO: 8767 - DNA, 25 bp, S. cerevisiae
agacgaaccaacagtccgcacatag

SEQ ID NO: 8768 - DNA, 25 bp, S. cerevisiae
aaacaattgaaactgctaacgccga

SEQ ID NO: 8769 - DNA, 25 bp, S. cerevisiae
agaacgctggtcaagacggtggtat

SEQ ID NO: 8770 - DNA, 25 bp, S. cerevisiae
agacagatgtgtggccaaatatttt

SEQ ID NO: 8771 - DNA, 25 bp, S. cerevisiae
agacgtggtcaagctactgtgtgat

SEQ ID NO: 8772 - DNA, 25 bp, S. cerevisiae
agacatttagcaaccgcactcagtg

SEQ ID NO: 8773 - DNA, 25 bp, S. cerevisiae
agaattaggcatcccagacctcgtg

SEQ ID NO: 8774 - DNA, 25 bp, S. cerevisiae
agaaataccgcttctttcgctggtt

SEQ ID NO: 8775 - DNA, 25 bp, S. cerevisiae
agaaagttgcacctgcttcgttcga

SEQ ID NO: 8776 - DNA, 25 bp, S. cerevisiae
agaaagtacacattgatctcctatg

SEQ ID NO: 8777 - DNA, 25 bp, S. cerevisiae
agaagagcttaactatcccattttt

SEQ ID NO: 8778 - DNA, 25 bp, S. cerevisiae
agaagaagaaatcacctccgctgct

SEQ ID NO: 8779 - DNA, 25 bp, S. cerevisiae
agactgaattatccggagctaccac

SEQ ID NO: 8780 - DNA, 25 bp, S. cerevisiae
agactgtgctaatggcaggctacca

SEQ ID NO: 8781 - DNA, 25 bp, S. cerevisiae
agacatgctctctagaacaggctga

SEQ ID NO: 8782 - DNA, 25 bp, S. cerevisiae
agacgtacgtgatcaagcagcaggt

SEQ ID NO: 8783 - DNA, 25 bp, S. cerevisiae
agaacgacgggctggcagacgatct

SEQ ID NO: 8784 - DNA, 25 bp, S. cerevisiae
agaactggcacaaacctcaatagat

SEQ ID NO: 8785 - DNA, 25 bp, S. cerevisiae
agaagctgaaggtccaactgtcgaa

SEQ ID NO: 8786 - DNA, 25 bp, S. cerevisiae
acaactggaatgtcaggacttggaa

SEQ ID NO: 8787 - DNA, 25 bp, S. cerevisiae
agactcatggaagcgctgtctcctt

SEQ ID NO: 8788 - DNA, 25 bp, S. cerevisiae
agacgatgctaagcttcctctccgt

SEQ ID NO: 8789 - DNA, 25 bp, S. cerevisiae
agaacaaggcccacgtgctgaaatg

SEQ ID NO: 8790 - DNA, 25 bp, S. cerevisiae
agaaccgtcttgaagtctgatgaaa

SEQ ID NO: 8791 - DNA, 25 bp, S. cerevisiae
agacaacttgtacatccaacggcca

SEQ ID NO: 8792 - DNA, 25 bp, S. cerevisiae
agacgatttatttgccaatgacggc

SEQ ID NO: 8793 - DNA, 25 bp, S. cerevisiae
agacatttttctttgggcgtgcgca

SEQ ID NO: 8794 - DNA, 25 bp, S. cerevisiae
agacaataattcgtttcctcctcac

SEQ ID NO: 8795 - DNA, 25 bp, S. cerevisiae
agaaagatttgcctttgcccgtgcc

SEQ ID NO: 8796 - DNA, 25 bp, S. cerevisiae
agaaagaaatccttcactccgtgtc

SEQ ID NO: 8797 - DNA, 25 bp, S. cerevisiae
agaacgtacatcactgttgtctggt

SEQ ID NO: 8798 - DNA, 25 bp, S. cerevisiae
agacagctattgtttcggagccaat

SEQ ID NO: 8799 - DNA, 25 bp, S. cerevisiae
agaaaagttgcaagcgctacctacg

SEQ ID NO: 8800 - DNA, 25 bp, S. cerevisiae
agaaaactgcttaactccacgattg

SEQ ID NO: 8801 - DNA, 25 bp, S. cerevisiae
agaaatattgtctaacccatggaat

SEQ ID NO: 8802 - DNA, 25 bp, S. cerevisiae
agaagctattacatccctatgggat

SEQ ID NO: 8803 - DNA, 25 bp, S. cerevisiae
agaatgctttcaagttccacaccaa

SEQ ID NO: 8804 - DNA, 25 bp, S. cerevisiae
agaagtgcatcttacctaggtccgt

SEQ ID NO: 8805 - DNA, 25 bp, S. cerevisiae
agaaggcactaacgaggcttcctct

SEQ ID NO: 8806 - DNA, 25 bp, S. cerevisiae
agaaagcctaatgcggtatcacctt

SEQ ID NO: 8807 - DNA, 25 bp, S. cerevisiae
agacactgttaatcggttcatccac

SEQ ID NO: 8808 - DNA, 25 bp, S. cerevisiae
agaacttattaacctgtgcctccca

SEQ ID NO: 8809 - DNA, 25 bp, S. cerevisiae
agaaaaactatcactggcccactat

SEQ ID NO: 8810 - DNA, 25 bp, S. cerevisiae
agaaaaactatcatcggccgctgca

SEQ ID NO: 8811 - DNA, 25 bp, S. cerevisiae
agacaaacgaacactggctcactgc

SEQ ID NO: 8812 - DNA, 25 bp, S. cerevisiae
agactctacagtttccattttgcct

SEQ ID NO: 8813 - DNA, 25 bp, S. cerevisiae
agaacttcagaatcccgttgtcttg

SEQ ID NO: 8814 - DNA, 25 bp, S. cerevisiae
agaataccccaagcctgatggtgtg

SEQ ID NO: 8815 - DNA, 25 bp, S. cerevisiae
agacaaagtctcaaggccgttataa

SEQ ID NO: 8816 - DNA, 25 bp, S. cerevisiae
agacaaagttctttcaaggccaaga

SEQ ID NO: 8817 - DNA, 25 bp, S. cerevisiae
agacacggtggttcttatggtcaaa

SEQ ID NO: 8818 - DNA, 25 bp, S. cerevisiae
agcacctgagtttcgcgtatggtca

SEQ ID NO: 8819 - DNA, 25 bp, S. cerevisiae
agacatatggtgaacttcttggaaa

SEQ ID NO: 8820 - DNA, 25 bp, S. cerevisiae
agacacgtccaagttgctcgagaaa

SEQ ID NO: 8821 - DNA, 25 bp, S. cerevisiae
agacagcgactctgatttggagtat

SEQ ID NO: 8822 - DNA, 25 bp, S. cerevisiae
agacacctgaccaagtggcgaactt

SEQ ID NO: 8823 - DNA, 25 bp, S. cerevisiae
agacatcactcttcaacatcgacga

SEQ ID NO: 8824 - DNA, 25 bp, S. cerevisiae
agactccttcattacatctcggcat

SEQ ID NO: 8825 - DNA, 25 bp, S. cerevisiae
agactacattttacatcctacagcc

SEQ ID NO: 8826 - DNA, 25 bp, S. cerevisiae
agacatcacattcacgtgcattccg

SEQ ID NO: 8827 - DNA, 25 bp, S. cerevisiae
agaacagcttggtgatagccctatt

SEQ ID NO: 8828 - DNA, 25 bp, S. cerevisiae
agaacagttcatgataagccaattg

SEQ ID NO: 8829 - DNA, 25 bp, S. cerevisiae
agaaagtttgccaacgcatacggtt

SEQ ID NO: 8830 - DNA, 25 bp, S. cerevisiae
agaatgttgactggcgactacttag

SEQ ID NO: 8831 - DNA, 25 bp, S. cerevisiae
agacagttactgatcgtgctcctag

SEQ ID NO: 8832 - DNA, 25 bp, S. cerevisiae
agaagttatcagttccggttatagt

SEQ ID NO: 8833 - DNA, 25 bp, S. cerevisiae
agaagcgatttttcgtggctaccaa

SEQ ID NO: 8834 - DNA, 25 bp, S. cerevisiae
agaactcatttttcacttccacgac

SEQ ID NO: 8835 - DNA, 25 bp, S. cerevisiae
agacactcttggatacctggctcta

SEQ ID NO: 8836 - DNA, 25 bp, S. cerevisiae
agaattggctggtgtcaagactcta

SEQ ID NO: 8837 - DNA, 25 bp, S. cerevisiae
agaacgatgacgtatccacagaccc

SEQ ID NO: 8838 - DNA, 25 bp, S. cerevisiae
agacaaattcgtttcccaactgctg

SEQ ID NO: 8839 - DNA, 25 bp, S. cerevisiae
agactacgtcgttgtcatgccaaag

SEQ ID NO: 8840 - DNA, 25 bp, S. cerevisiae
agaaatggtgttcgtgctgcttctt

SEQ ID NO: 8841 - DNA, 25 bp, S. cerevisiae
agaaagaggtgtcccaggcgtcatt

SEQ ID NO: 8842 - DNA, 25 bp, S. cerevisiae
agaaagcgttgtcccattgtctaaa

SEQ ID NO: 8843 - DNA, 25 bp, S. cerevisiae
agacaggtattgaggcgttcgcaga

SEQ ID NO: 8844 - DNA, 25 bp, S. cerevisiae
agaacatggcttcttcgtgcaacca

SEQ ID NO: 8845 - DNA, 25 bp, S. cerevisiae
agaaaggtttactcacatcaagctg

SEQ ID NO: 8846 - DNA, 25 bp, S. cerevisiae
agaaaattattacccctcagcactc

SEQ ID NO: 8847 - DNA, 25 bp, S. cerevisiae
agaaagtctttacgccggatcttca

SEQ ID NO: 8848 - DNA, 25 bp, S. cerevisiae
agaaggtatccctccggatcaacag

SEQ ID NO: 8849 - DNA, 25 bp, S. cerevisiae
agcgggcaatttcaggcgtcatagc

SEQ ID NO: 8850 - DNA, 25 bp, S. cerevisiae
agaaaactgttccatggcgctctag

SEQ ID NO: 8851 - DNA, 25 bp, S. cerevisiae
agaaaccggatttgatgctttagca

SEQ ID NO: 8852 - DNA, 25 bp, S. cerevisiae
agaaacgctctttggaatggtggct

SEQ ID NO: 8853 - DNA, 25 bp, S. cerevisiae
agaatcgccgcccaaaagcgtattg

SEQ ID NO: 8854 - DNA, 25 bp, S. cerevisiae
agaatcgcacactcaggaagtctgt

SEQ ID NO: 8855 - DNA, 25 bp, S. cerevisiae
agaagaacccgattgaggcctccca

SEQ ID NO: 8856 - DNA, 25 bp, S. cerevisiae
agaaggatcccgttgtagctaagca

SEQ ID NO: 8857 - DNA, 25 bp, S. cerevisiae
agaagaggcttcgtttcctgaaaga

SEQ ID NO: 8858 - DNA, 25 bp, S. cerevisiae
agaacggttcacaatccctacagat

SEQ ID NO: 8859 - DNA, 25 bp, S. cerevisiae
agaagctgacttcaatcccgtgctt

SEQ ID NO: 8860 - DNA, 25 bp, S. cerevisiae
agaactccttcttttgtcgtctttg

SEQ ID NO: 8861 - DNA, 25 bp, S. cerevisiae
agaactatctacattacgcccgttg

SEQ ID NO: 8862 - DNA, 25 bp, S. cerevisiae
agaacttcctcatgtcttcagatta

SEQ ID NO: 8863 - DNA, 25 bp, S. cerevisiae
agacattctcatatcattgcacgcc

SEQ ID NO: 8864 - DNA, 25 bp, S. cerevisiae
agactatctgcttttatcatcccaa

SEQ ID NO: 8865 - DNA, 25 bp, S. cerevisiae
agaaatcgctggtttgtctccatac

SEQ ID NO: 8866 - DNA, 25 bp, S. cerevisiae
agaaacatcgtctagcagttcagat

SEQ ID NO: 8867 - DNA, 25 bp, S. cerevisiae
agaactgtcccaacgctacgagtag

SEQ ID NO: 8868 - DNA, 25 bp, S. cerevisiae
agaactgctgcccatggcttttggt

SEQ ID NO: 8869 - DNA, 25 bp, S. cerevisiae
agaacctgccctttatttcgcattg

SEQ ID NO: 8870 - DNA, 25 bp, S. cerevisiae
agacatgtcgccatttcatttctgt

SEQ ID NO: 8871 - DNA, 25 bp, S. cerevisiae
agaatccctcgtgtagtgcttttga

SEQ ID NO: 8872 - DNA, 25 bp, S. cerevisiae
agactattttattctcagcacttgt

SEQ ID NO: 8873 - DNA, 25 bp, S. cerevisiae
agacatatctttttcacggcattgg

SEQ ID NO: 8874 - DNA, 25 bp, S. cerevisiae
agacagtttacacagcagcgcttgt

SEQ ID NO: 8875 - DNA, 25 bp, S. cerevisiae
agactttgctactggagcggtggta

SEQ ID NO: 8876 - DNA, 25 bp, S. cerevisiae
agacttggcatactggttcgccgat

SEQ ID NO: 8877 - DNA, 25 bp, S. cerevisiae
agactttgatgttgacttccctata

SEQ ID NO: 8878 - DNA, 25 bp, S. cerevisiae
agctatcgccgggtgtatacttaag

SEQ ID NO: 8879 - DNA, 25 bp, S. cerevisiae
agaagcagtggtcttgccttttcat

SEQ ID NO: 8880 - DNA, 25 bp, S. cerevisiae
agaaactgtgtctcatatctcctct

SEQ ID NO: 8881 - DNA, 25 bp, S. cerevisiae
agaaactttcgttgtctgacatggg

SEQ ID NO: 8882 - DNA, 25 bp, S. cerevisiae
agacttcgcctggtcagccgagaaa

SEQ ID NO: 8883 - DNA, 25 bp, S. cerevisiae
agactattgtctcccagcattgaaa

SEQ ID NO: 8884 - DNA, 25 bp, S. cerevisiae
agacacattgttgccgtggatgaca

SEQ ID NO: 8885 - DNA, 25 bp, S. cerevisiae
agacttatgcaagctgtatttccag

SEQ ID NO: 8886 - DNA, 25 bp, S. cerevisiae
agcactccaatagctgttaccctgt

SEQ ID NO: 8887 - DNA, 25 bp, S. cerevisiae
agacttcacattgtttacctctcta

SEQ ID NO: 8888 - DNA, 25 bp, S. cerevisiae
agacttacttcaattactccgcatt

SEQ ID NO: 8889 - DNA, 25 bp, S. cerevisiae
agacattactactctagctgccaag

SEQ ID NO: 8890 - DNA, 25 bp, S. cerevisiae
agacactatatctctttacgcacca

SEQ ID NO: 8891 - DNA, 25 bp, S. cerevisiae
agaatctcttctccaaatagcccta

SEQ ID NO: 8892 - DNA, 25 bp, S. cerevisiae
agaaatgtctcttcgtatagccgat

SEQ ID NO: 8893 - DNA, 25 bp, S. cerevisiae
agaaacttctctgctaccggtaact

SEQ ID NO: 8894 - DNA, 25 bp, S. cerevisiae
agacaacctcttcatgcttttatat

SEQ ID NO: 8895 - DNA, 25 bp, S. cerevisiae
agacatgtcactttgccagtttctt

SEQ ID NO: 8896 - DNA, 25 bp, S. cerevisiae
agacatgccactttttgagttttag

SEQ ID NO: 8897 - DNA, 25 bp, S. cerevisiae
agaacccatgtttgaagcggcttac

SEQ ID NO: 8898 - DNA, 25 bp, S. cerevisiae
agaattcctggttccatcggcagta

SEQ ID NO: 8899 - DNA, 25 bp, S. cerevisiae
agacttgcacacttattaccatgag

SEQ ID NO: 8900 - DNA, 25 bp, S. cerevisiae
agaacgatccaattgctggtcttaa

SEQ ID NO: 8901 - DNA, 25 bp, S. cerevisiae
agaacgaactcaggttgctccatca

SEQ ID NO: 8902 - DNA, 25 bp, S. cerevisiae
agacactaatctggctgctattcac

SEQ ID NO: 8903 - DNA, 25 bp, S. cerevisiae
agaactgctataggccactgaacga

SEQ ID NO: 8904 - DNA, 25 bp, S. cerevisiae
agacatcttgctttcgcatcacaga

SEQ ID NO: 8905 - DNA, 25 bp, S. cerevisiae
agacatcttggctagcatgaaacaa

SEQ ID NO: 8906 - DNA, 25 bp, S. cerevisiae
agaatgccttgcgtgctggaaccag

SEQ ID NO: 8907 - DNA, 25 bp, S. cerevisiae
agaagtcatgctgctctgggaaatg

SEQ ID NO: 8908 - DNA, 25 bp, S. cerevisiae
agaatttgccccaggaaatcttgca

SEQ ID NO: 8909 - DNA, 25 bp, S. cerevisiae
agcaatttctccaccgcaaaatagc

SEQ ID NO: 8910 - DNA, 25 bp, S. cerevisiae
agaatccatggtacccgaaaacaag

SEQ ID NO: 8911 - DNA, 25 bp, S. cerevisiae
agaaccggttatcacatcaatccaa

SEQ ID NO: 8912 - DNA, 25 bp, S. cerevisiae
agaagccggctgtgctacattatcc

SEQ ID NO: 8913 - DNA, 25 bp, S. cerevisiae
agaagggtctgttgtacatctccag

SEQ ID NO: 8914 - DNA, 25 bp, S. cerevisiae
agaacggtcttctacagatcatgaa

SEQ ID NO: 8915 - DNA, 25 bp, S. cerevisiae
agaactcgctgatgtgatcttcacc

SEQ ID NO: 8916 - DNA, 25 bp, S. cerevisiae
agaagctacaggatgccgtttgcaa

SEQ ID NO: 8917 - DNA, 25 bp, S. cerevisiae
agaagctatcatgggaaccttacat

SEQ ID NO: 8918 - DNA, 25 bp, S. cerevisiae
agacaaccattgatccattcttgga

SEQ ID NO: 8919 - DNA, 25 bp, S. cerevisiae
agacaagctcagtcttctacccgga

SEQ ID NO: 8920 - DNA, 25 bp, S. cerevisiae
agaaagtgactctactacctcaaga

SEQ ID NO: 8921 - DNA, 25 bp, S. cerevisiae
agaatgataatgttccacccgtcca

SEQ ID NO: 8922 - DNA, 25 bp, S. cerevisiae
agaacagcaattcgccttcatctga

SEQ ID NO: 8923 - DNA, 25 bp, S. cerevisiae
agaaatctgacttcgtccaggcaag

SEQ ID NO: 8924 - DNA, 25 bp, S. cerevisiae
agaaatctcactagcagggaccctg

SEQ ID NO: 8925 - DNA, 25 bp, S. cerevisiae
agaaatctccaacgtcaatgctcct

SEQ ID NO: 8926 - DNA, 25 bp, S. cerevisiae
agaagtctcgcaatgggttgtcccc

SEQ ID NO: 8927 - DNA, 25 bp, S. cerevisiae
agaacttcttattcagtggtcctcc

SEQ ID NO: 8928 - DNA, 25 bp, S. cerevisiae
agaacaccctttttatagccactat

SEQ ID NO: 8929 - DNA, 25 bp, S. cerevisiae
agaacacccttcttgttgagacatt

SEQ ID NO: 8930 - DNA, 25 bp, S. cerevisiae
agaaccgtttcatttatcgacagat

SEQ ID NO: 8931 - DNA, 25 bp, S. cerevisiae
agaacacatcttacaacccgtactt

SEQ ID NO: 8932 - DNA, 25 bp, S. cerevisiae
agaacacgcatttgacgaccacaac

SEQ ID NO: 8933 - DNA, 25 bp, S. cerevisiae
agaagcacctttccgaaacagcaga

SEQ ID NO: 8934 - DNA, 25 bp, S. cerevisiae
agaagaaaccacaagcatgccctac

SEQ ID NO: 8935 - DNA, 25 bp, S. cerevisiae
agaagaaacctgctccacctactct

SEQ ID NO: 8936 - DNA, 25 bp, S. cerevisiae
taactagttcctctaacccaactat

SEQ ID NO: 8937 - DNA, 25 bp, S. cerevisiae
aactgaagtactatccaccctttgt

SEQ ID NO: 8938 - DNA, 25 bp, S. cerevisiae
agacagcacgttttctttgggtact

SEQ ID NO: 8939 - DNA, 25 bp, S. cerevisiae
agaaatctctagcttcggtgcttcc

SEQ ID NO: 8940 - DNA, 25 bp, S. cerevisiae
agcaaaggccacagtccggaatttt

SEQ ID NO: 8941 - DNA, 25 bp, S. cerevisiae
agaaaggtcagatccgccgaatatt

SEQ ID NO: 8942 - DNA, 25 bp, S. cerevisiae
agcaaatttccgtacacttgtttat

SEQ ID NO: 8943 - DNA, 25 bp, S. cerevisiae
agaaataattcctacagtgctcatt

SEQ ID NO: 8944 - DNA, 25 bp, S. cerevisiae
agaaatcaactccatactctttccg

SEQ ID NO: 8945 - DNA, 25 bp, S. cerevisiae
agaaaggcgacgtctccaagggcgt

SEQ ID NO: 8946 - DNA, 25 bp, S. cerevisiae
agaaatgggacgtcgcggaacctgc

SEQ ID NO: 8947 - DNA, 25 bp, S. cerevisiae
agaagcgggacctactgcaccagtc

SEQ ID NO: 8948 - DNA, 25 bp, S. cerevisiae
agaagttcagcatctaccactcgta

SEQ ID NO: 8949 - DNA, 25 bp, S. cerevisiae
agaagttgacatttacgcgcacgcc

SEQ ID NO: 8950 - DNA, 25 bp, S. cerevisiae
agacaattcttacagtacgacccat

SEQ ID NO: 8951 - DNA, 25 bp, S. cerevisiae
agacactttctgtggtactcccgaa

SEQ ID NO: 8952 - DNA, 25 bp, S. cerevisiae
agaaatttcgatgcctactccggat

SEQ ID NO: 8953 - DNA, 25 bp, S. cerevisiae
acggtctcaactcaactgacgacaa

SEQ ID NO: 8954 - DNA, 25 bp, S. cerevisiae
aaggccctatcacaacgggtcaaga

SEQ ID NO: 8955 - DNA, 25 bp, S. cerevisiae
agaaattgcgaagacctggtataca

SEQ ID NO: 8956 - DNA, 25 bp, S. cerevisiae
aaagacctggccacttggagttcac

SEQ ID NO: 8957 - DNA, 25 bp, S. cerevisiae
agacacattggacccagctttgctg

SEQ ID NO: 8958 - DNA, 25 bp, S. cerevisiae
agacacagactctccagtttggttt

SEQ ID NO: 8959 - DNA, 25 bp, S. cerevisiae
agaaaggctcttgcgtctgggtttt

SEQ ID NO: 8960 - DNA, 25 bp, S. cerevisiae
agaaagcggtgcatttcccgatcac

SEQ ID NO: 8961 - DNA, 25 bp, S. cerevisiae
agaaaaagtactccgccacatatgc

SEQ ID NO: 8962 - DNA, 25 bp, S. cerevisiae
agaaaccagcgctgatggcggcttt

SEQ ID NO: 8963 - DNA, 25 bp, S. cerevisiae
agcaaaccacgaagcaaggccgtat

SEQ ID NO: 8964 - DNA, 25 bp, S. cerevisiae
agaaatccagctgcgaagagccgaa

SEQ ID NO: 8965 - DNA, 25 bp, S. cerevisiae
agaaatacatctgcccatgcggaaa

SEQ ID NO: 8966 - DNA, 25 bp, S. cerevisiae
agaacgcctccgcttctggcgaaat

SEQ ID NO: 8967 - DNA, 25 bp, S. cerevisiae
agaagtcgcaccagaggtgtttcaa

SEQ ID NO: 8968 - DNA, 25 bp, S. cerevisiae
agaagattgccaccgtctttttcta

SEQ ID NO: 8969 - DNA, 25 bp, S. cerevisiae
agaagtgcatgattctcctttcctt

SEQ ID NO: 8970 - DNA, 25 bp, S. cerevisiae
agaagctatggaccctactgccgat

SEQ ID NO: 8971 - DNA, 25 bp, S. cerevisiae
agaagctttccaactcatatatcaa

SEQ ID NO: 8972 - DNA, 25 bp, S. cerevisiae
agaactgtatcctatcgatctgagt

SEQ ID NO: 8973 - DNA, 25 bp, S. cerevisiae
agaatttatcaccaccacgagtcat

SEQ ID NO: 8974 - DNA, 25 bp, S. cerevisiae
agaaatttctcacggcaagcagctc

SEQ ID NO: 8975 - DNA, 25 bp, S. cerevisiae
agaagacttatccaacctcacatgt

SEQ ID NO: 8976 - DNA, 25 bp, S. cerevisiae
agaaactatcaccaaggccctgagt

SEQ ID NO: 8977 - DNA, 25 bp, S. cerevisiae
agctccgtgaaggacctggatgcca

SEQ ID NO: 8978 - DNA, 25 bp, S. cerevisiae
agctctactgcaagtgtactgcctg

SEQ ID NO: 8979 - DNA, 25 bp, S. cerevisiae
agaaaccgcttgtggtgctgctatc

SEQ ID NO: 8980 - DNA, 25 bp, S. cerevisiae
agaactcaaatatttcggtcgatga

SEQ ID NO: 8981 - DNA, 25 bp, S. cerevisiae
agaacctacatatttggccaacgat

SEQ ID NO: 8982 - DNA, 25 bp, S. cerevisiae
agaaggtaccattgtctccaacgtt

SEQ ID NO: 8983 - DNA, 25 bp, S. cerevisiae
agaagttcgctactgttccaactgg

SEQ ID NO: 8984 - DNA, 25 bp, S. cerevisiae
agaaggtcgcgttcttcaaggtggc

SEQ ID NO: 8985 - DNA, 25 bp, S. cerevisiae
agaaaacttctctaccgcgactaga

SEQ ID NO: 8986 - DNA, 25 bp, S. cerevisiae
agaaaattcactctccgcaacaaat

SEQ ID NO: 8987 - DNA, 25 bp, S. cerevisiae
agaaactgaagcttccatcgaggaa

SEQ ID NO: 8988 - DNA, 25 bp, S. cerevisiae
agaaactgcgctttgactcacctaa

SEQ ID NO: 8989 - DNA, 25 bp, S. cerevisiae
agaacaagccgaagactacctcaag

SEQ ID NO: 8990 - DNA, 25 bp, S. cerevisiae
agaaatggctgcctcttattctcac

SEQ ID NO: 8991 - DNA, 25 bp, S. cerevisiae
agaaatattcttcctactgctcaga

SEQ ID NO: 8992 - DNA, 25 bp, S. cerevisiae
agaaatctgtgcctacttcgtcata

SEQ ID NO: 8993 - DNA, 25 bp, S. cerevisiae
agaaaagaattcacctcccagagga

SEQ ID NO: 8994 - DNA, 25 bp, S. cerevisiae
agaagaagcaacgacgcccaccaat

SEQ ID NO: 8995 - DNA, 25 bp, S. cerevisiae
agaagcaagatcacgcccatattag

SEQ ID NO: 8996 - DNA, 25 bp, S. cerevisiae
agaagaatctttcgcagcagttgca

SEQ ID NO: 8997 - DNA, 25 bp, S. cerevisiae
agaagaatgattctcgcagctatac

SEQ ID NO: 8998 - DNA, 25 bp, S. cerevisiae
agaaaactagaaccgctgcatcagc

SEQ ID NO: 8999 - DNA, 25 bp, S. cerevisiae
agaactcaatggtacctgctccatc

SEQ ID NO: 9000 - DNA, 25 bp, S. cerevisiae
agaaacaatgtcaacaccacctcag

SEQ ID NO: 9001 - DNA, 25 bp, S. cerevisiae
agaaacatagtcctgtgctcacttc

SEQ ID NO: 9002 - DNA, 25 bp, S. cerevisiae
agaaaattatcgctgacccaccctg

SEQ ID NO: 9003 - DNA, 25 bp, S. cerevisiae
agaacactttcggtggtacagccct

SEQ ID NO: 9004 - DNA, 25 bp, S. cerevisiae
agaaactttgcgttacagacctcct

SEQ ID NO: 9005 - DNA, 25 bp, S. cerevisiae
gacaggtcgtttcaggtaacccaga

SEQ ID NO: 9006 - DNA, 25 bp, S. cerevisiae
accaggttttgtactaacatcgcca

SEQ ID NO: 9007 - DNA, 25 bp, S. cerevisiae
agaaggtctttgacgctaacggcga

SEQ ID NO: 9008 - DNA, 25 bp, S. cerevisiae
agaacgcagttacccatcttttgga

SEQ ID NO: 9009 - DNA, 25 bp, S. cerevisiae
agaatctgatccaagggcctttctg

SEQ ID NO: 9010 - DNA, 25 bp, S. cerevisiae
agaatcgtcagagctttcttgattg

SEQ ID NO: 9011 - DNA, 25 bp, S. cerevisiae
agaagcagccttctcaatgcaaaag

SEQ ID NO: 9012 - DNA, 25 bp, S. cerevisiae
agaactgcgtctccacttgaattga

SEQ ID NO: 9013 - DNA, 25 bp, S. cerevisiae
agaaagcggctcctgggccatctga

SEQ ID NO: 9014 - DNA, 25 bp, S. cerevisiae
agaatatgccatgcctgtgaccatt

SEQ ID NO: 9015 - DNA, 25 bp, S. cerevisiae
agaaagcccgtcatgagccaatcat

SEQ ID NO: 9016 - DNA, 25 bp, S. cerevisiae
agaaatggcgcaactcgagagtaat

SEQ ID NO: 9017 - DNA, 25 bp, S. cerevisiae
agaagccgagcagcctaagactgat

SEQ ID NO: 9018 - DNA, 25 bp, S. cerevisiae
agaaccagagcttccgaaacaatat

SEQ ID NO: 9019 - DNA, 25 bp, S. cerevisiae
agaagctagacgttgcaggagtgca

SEQ ID NO: 9020 - DNA, 25 bp, S. cerevisiae
agaactagacatatcctggagcaag

SEQ ID NO: 9021 - DNA, 25 bp, S. cerevisiae
agaactctcagatcttctggccaag

SEQ ID NO: 9022 - DNA, 25 bp, S. cerevisiae
agcagcgaacggtccaaactcaaat

SEQ ID NO: 9023 - DNA, 25 bp, S. cerevisiae
agaatttctctcttaaaccggatat

SEQ ID NO: 9024 - DNA, 25 bp, S. cerevisiae
agaatggttcttccaaacctcgctg

SEQ ID NO: 9025 - DNA, 25 bp, S. cerevisiae
agaagaacaggctgcattagttgca

SEQ ID NO: 9026 - DNA, 25 bp, S. cerevisiae
agaagacctacacgttagcctgcag

SEQ ID NO: 9027 - DNA, 25 bp, S. cerevisiae
agaaggactattccatcgacagtgt

SEQ ID NO: 9028 - DNA, 25 bp, S. cerevisiae
agaacgttacagatgcggcccgtga

SEQ ID NO: 9029 - DNA, 25 bp, S. cerevisiae
agaacttcctttggatgcatgacca

SEQ ID NO: 9030 - DNA, 25 bp, S. cerevisiae
agaatgtattctatcctggactatt

SEQ ID NO: 9031 - DNA, 25 bp, S. cerevisiae
agaagtagtcaagccatcgatgttt

SEQ ID NO: 9032 - DNA, 25 bp, S. cerevisiae
agaaaactttctgttgacctccctg

SEQ ID NO: 9033 - DNA, 25 bp, S. cerevisiae
accgaactaattgaagccttccctg

SEQ ID NO: 9034 - DNA, 25 bp, S. cerevisiae
agaaaaccatttgaagcctcctcct

SEQ ID NO: 9035 - DNA, 25 bp, S. cerevisiae
agaaaagaatttaccgcctccatca

SEQ ID NO: 9036 - DNA, 25 bp, S. cerevisiae
agaagatatggtcaaccgcctcctg

SEQ ID NO: 9037 - DNA, 25 bp, S. cerevisiae
agaagcaccgtcaaatccgttccta

SEQ ID NO: 9038 - DNA, 25 bp, S. cerevisiae
agaatcaactccaacatcgggtcct

SEQ ID NO: 9039 - DNA, 25 bp, S. cerevisiae
agcaacaaggccactccagttcatt

SEQ ID NO: 9040 - DNA, 25 bp, S. cerevisiae
agaatcttccagtttgagacttctg

SEQ ID NO: 9041 - DNA, 25 bp, S. cerevisiae
agaactattgttaaagcgccttgcc

SEQ ID NO: 9042 - DNA, 25 bp, S. cerevisiae
agaacattagtactggctcgccgac

SEQ ID NO: 9043 - DNA, 25 bp, S. cerevisiae
agaactctaggaagcgcgccggaaa

SEQ ID NO: 9044 - DNA, 25 bp, S. cerevisiae
agaactcataaattgtgcgccggat

SEQ ID NO: 9045 - DNA, 25 bp, S. cerevisiae
agaagagcttcatcacggccgacta

SEQ ID NO: 9046 - DNA, 25 bp, S. cerevisiae
agaagaccttacattgctggcttag

SEQ ID NO: 9047 - DNA, 25 bp, S. cerevisiae
agaagcagacccttttgcaggcatt

SEQ ID NO: 9048 - DNA, 25 bp, S. cerevisiae
agaacaatcactcttgctagctcgt

SEQ ID NO: 9049 - DNA, 25 bp, S. cerevisiae
agaaggcctcactatcaagatgcag

SEQ ID NO: 9050 - DNA, 25 bp, S. cerevisiae
agaagtgccccaccaagagttacta

SEQ ID NO: 9051 - DNA, 25 bp, S. cerevisiae
agaatttccgatccaaccttagctg

SEQ ID NO: 9052 - DNA, 25 bp, S. cerevisiae
agaatttacaagaaccctccgctgg

SEQ ID NO: 9053 - DNA, 25 bp, S. cerevisiae
agaattaacaggtcagcctccggct

SEQ ID NO: 9054 - DNA, 25 bp, S. cerevisiae
agaattcaacaactctatctccgcg

SEQ ID NO: 9055 - DNA, 25 bp, S. cerevisiae
agaaaaccacatcttatcctgcgtc

SEQ ID NO: 9056 - DNA, 25 bp, S. cerevisiae
agaaaatctccttgtactcccttgg

SEQ ID NO: 9057 - DNA, 25 bp, S. cerevisiae
agaaaacccttattctctgccttcg

SEQ ID NO: 9058 - DNA, 25 bp, S. cerevisiae
agaaaagtacgctgctgctgctcca

SEQ ID NO: 9059 - DNA, 25 bp, S. cerevisiae
agaaaatgttggcagctccccatca

SEQ ID NO: 9060 - DNA, 25 bp, S. cerevisiae
agcagaataatttggtgccgaccca

SEQ ID NO: 9061 - DNA, 25 bp, S. cerevisiae
agaagtgctcgagaaatgtccaaat

SEQ ID NO: 9062 - DNA, 25 bp, S. cerevisiae
agaacgctgcagtcgttgtcgcaga

SEQ ID NO: 9063 - DNA, 25 bp, S. cerevisiae
agaactgcgctgttggtggcccaga

SEQ ID NO: 9064 - DNA, 25 bp, S. cerevisiae
agaagccaggagagctgccaccgaa

SEQ ID NO: 9065 - DNA, 25 bp, S. cerevisiae
agaagctcaaaaagtcgcctcctca

SEQ ID NO: 9066 - DNA, 25 bp, S. cerevisiae
agaacctcactgaagatcctcatct

SEQ ID NO: 9067 - DNA, 25 bp, S. cerevisiae
agcaacctactttatctcaatcgaa

SEQ ID NO: 9068 - DNA, 25 bp, S. cerevisiae
agaatcctacgtcgcttccatcgaa

SEQ ID NO: 9069 - DNA, 25 bp, S. cerevisiae
agaaggcgcagctccaggtggtttc

SEQ ID NO: 9070 - DNA, 25 bp, S. cerevisiae
agaagacgcacaagcctactgggca

SEQ ID NO: 9071 - DNA, 25 bp, S. cerevisiae
agaagattccaagcttgcagaacaa

SEQ ID NO: 9072 - DNA, 25 bp, S. cerevisiae
agaagcctgcaatccctcagaaaaa

SEQ ID NO: 9073 - DNA, 25 bp, S. cerevisiae
agaaccgtcaacatccaataaagat

SEQ ID NO: 9074 - DNA, 25 bp, S. cerevisiae
agaactcgtcgcattcctgaaaaga

SEQ ID NO: 9075 - DNA, 25 bp, S. cerevisiae
agaactgcctagctctgtcaaatgc

SEQ ID NO: 9076 - DNA, 25 bp, S. cerevisiae
agaaccactccttggtcaaatctac

SEQ ID NO: 9077 - DNA, 25 bp, S. cerevisiae
agaaccaccgtctttctaatggcac

SEQ ID NO: 9078 - DNA, 25 bp, S. cerevisiae
agaaaatcctccttattcactggca

SEQ ID NO: 9079 - DNA, 25 bp, S. cerevisiae
agaactatggtttcgtgggtcgtct

SEQ ID NO: 9080 - DNA, 25 bp, S. cerevisiae
agaagcgtggtttcttgggcctatt

SEQ ID NO: 9081 - DNA, 25 bp, S. cerevisiae
agaatgggctgtatttgggcgcttc

SEQ ID NO: 9082 - DNA, 25 bp, S. cerevisiae
agaagagtttcgcaacctggctgct

SEQ ID NO: 9083 - DNA, 25 bp, S. cerevisiae
agaagcgaatgagcctactgttgat

SEQ ID NO: 9084 - DNA, 25 bp, S. cerevisiae
agaaccagagatgctccacgtgaaa

SEQ ID NO: 9085 - DNA, 25 bp, S. cerevisiae
agaagccgtgatacgcccattgaaa

SEQ ID NO: 9086 - DNA, 25 bp, S. cerevisiae
agaagccacgaaccgcctaataagt

SEQ ID NO: 9087 - DNA, 25 bp, S. cerevisiae
agaactactgaatcccaactgcaca

SEQ ID NO: 9088 - DNA, 25 bp, S. cerevisiae
agcaagaactatatccgaactggca

SEQ ID NO: 9089 - DNA, 25 bp, S. cerevisiae
agaagaactattgcccttgctgcta

SEQ ID NO: 9090 - DNA, 25 bp, S. cerevisiae
agaagtcatcttcccaccaaggtga

SEQ ID NO: 9091 - DNA, 25 bp, S. cerevisiae
agaagctgttgcgtggttggactca

SEQ ID NO: 9092 - DNA, 25 bp, S. cerevisiae
agaacgttggcgtcttggcaggcaa

SEQ ID NO: 9093 - DNA, 25 bp, S. cerevisiae
agaaccgtgtcaccttgcagggcaa

SEQ ID NO: 9094 - DNA, 25 bp, S. cerevisiae
agaacacatgtccactttgggccat

SEQ ID NO: 9095 - DNA, 25 bp, S. cerevisiae
agcaccacatatcccttagttgaag

SEQ ID NO: 9096 - DNA, 25 bp, S. cerevisiae
acttttaccaacagtcattcccata

SEQ ID NO: 9097 - DNA, 25 bp, S. cerevisiae
agccgaggtttatgcgttttcgcga

SEQ ID NO: 9098 - DNA, 25 bp, S. cerevisiae
tagggaagctttacctgtttgggct

SEQ ID NO: 9099 - DNA, 25 bp, S. cerevisiae
actaagactgtcacctctgaggccc

SEQ ID NO: 9100 - DNA, 25 bp, S. cerevisiae
accaaagtgttatctctgagtacct

SEQ ID NO: 9101 - DNA, 25 bp, S. cerevisiae
acgaaagatttgagcctactgaggt

SEQ ID NO: 9102 - DNA, 25 bp, S. cerevisiae
agaaccctagtcaatcagtctccta

SEQ ID NO: 9103 - DNA, 25 bp, S. cerevisiae
agaagctcgtgaaactgctcagtta

SEQ ID NO: 9104 - DNA, 25 bp, S. cerevisiae
agaacccgataactgttgcatgtca

SEQ ID NO: 9105 - DNA, 25 bp, S. cerevisiae
agaatcagcgccaaatgtttcaagc

SEQ ID NO: 9106 - DNA, 25 bp, S. cerevisiae
agaactctgcttttttctcaataag

SEQ ID NO: 9107 - DNA, 25 bp, S. cerevisiae
agaacatctatttctctgtcccatt

SEQ ID NO: 9108 - DNA, 25 bp, S. cerevisiae
agaagattacttggtgtcacaatat

SEQ ID NO: 9109 - DNA, 25 bp, S. cerevisiae
agaactcaactcactggccaaattt

SEQ ID NO: 9110 - DNA, 25 bp, S. cerevisiae
agaactggactctttggccgacttg

SEQ ID NO: 9111 - DNA, 25 bp, S. cerevisiae
agaaccgactccataaaagctttat

SEQ ID NO: 9112 - DNA, 25 bp, S. cerevisiae
agcagctgcactctacacaaaagga

SEQ ID NO: 9113 - DNA, 25 bp, S. cerevisiae
agcacgcaatgaccaacgccaagga

SEQ ID NO: 9114 - DNA, 25 bp, S. cerevisiae
agcaccattgcacacagagacactg

SEQ ID NO: 9115 - DNA, 25 bp, S. cerevisiae
agaagacggctcaagcggatctgaa

SEQ ID NO: 9116 - DNA, 25 bp, S. cerevisiae
agaaccgtgtgcaagcgccaacagc

SEQ ID NO: 9117 - DNA, 25 bp, S. cerevisiae
agaacgtttccggacaatcaccaca

SEQ ID NO: 9118 - DNA, 25 bp, S. cerevisiae
agaattcttgtagggcacgctttaa

SEQ ID NO: 9119 - DNA, 25 bp, S. cerevisiae
agcaatttttgaccaaggacttgaa

SEQ ID NO: 9120 - DNA, 25 bp, S. cerevisiae
agaattttatgtccacgtgcctatg

SEQ ID NO: 9121 - DNA, 25 bp, S. cerevisiae
agaatactcaagcaccttcgcaagc

SEQ ID NO: 9122 - DNA, 25 bp, S. cerevisiae
agcaaatgaacgctcctttcttgga

SEQ ID NO: 9123 - DNA, 25 bp, S. cerevisiae
agcacattggtggtaacagcgattt

SEQ ID NO: 9124 - DNA, 25 bp, S. cerevisiae
agaatgatgggcctagtcagcgtcc

SEQ ID NO: 9125 - DNA, 25 bp, S. cerevisiae
agaattgtgtagaattgcagattcc

SEQ ID NO: 9126 - DNA, 25 bp, S. cerevisiae
aaattgtgtcagcaggcctaaccgt

SEQ ID NO: 9127 - DNA, 25 bp, S. cerevisiae
agaactgtctctgatgtcgcaggac

SEQ ID NO: 9128 - DNA, 25 bp, S. cerevisiae
agaagggattccaccatctcaacaa

SEQ ID NO: 9129 - DNA, 25 bp, S. cerevisiae
agaaggaggcctgcgccatccaaga

SEQ ID NO: 9130 - DNA, 25 bp, S. cerevisiae
agaagatggtctttcctttgtggat

SEQ ID NO: 9131 - DNA, 25 bp, S. cerevisiae
agcaaagtttgctggtttcaccttt

SEQ ID NO: 9132 - DNA, 25 bp, S. cerevisiae
agaagaggccgctgctttacaagca

SEQ ID NO: 9133 - DNA, 25 bp, S. cerevisiae
agaactgatcgtagccatcttccaa

SEQ ID NO: 9134 - DNA, 25 bp, S. cerevisiae
agaactgacgttactgtcctcagga

SEQ ID NO: 9135 - DNA, 25 bp, S. cerevisiae
agaagctttttgtctccactagaga

SEQ ID NO: 9136 - DNA, 25 bp, S. cerevisiae
agcaatggttttacagacgttacga

SEQ ID NO: 9137 - DNA, 25 bp, S. cerevisiae
agcaaagtattgttagccgtctaaa

SEQ ID NO: 9138 - DNA, 25 bp, S. cerevisiae
agaagagagtcgttcggcagtctaa

SEQ ID NO: 9139 - DNA, 25 bp, S. cerevisiae
agaagatgccttaacctgtggtatg

SEQ ID NO: 9140 - DNA, 25 bp, S. cerevisiae
agaagcaccacgacagaccaggttt

SEQ ID NO: 9141 - DNA, 25 bp, S. cerevisiae
agaacccagctgactatgacaagat

SEQ ID NO: 9142 - DNA, 25 bp, S. cerevisiae
agaaggcaccgtaatccagatctcc

SEQ ID NO: 9143 - DNA, 25 bp, S. cerevisiae
agaagcgacccaatctcataatctc

SEQ ID NO: 9144 - DNA, 25 bp, S. cerevisiae
agaacggtgatcttttgccactaga

SEQ ID NO: 9145 - DNA, 25 bp, S. cerevisiae
agcaatacgtggacatctaccccat

SEQ ID NO: 9146 - DNA, 25 bp, S. cerevisiae
agaatatgatgaaaccccacagggt

SEQ ID NO: 9147 - DNA, 25 bp, S. cerevisiae
acacttgaatcctgactacaccata

SEQ ID NO: 9148 - DNA, 25 bp, S. cerevisiae
agctctaatgacagtgaaacccaca

SEQ ID NO: 9149 - DNA, 25 bp, S. cerevisiae
agcagctccagtaagaaaatctcaa

SEQ ID NO: 9150 - DNA, 25 bp, S. cerevisiae
agcagccgcaatagaggcccacaga

SEQ ID NO: 9151 - DNA, 25 bp, S. cerevisiae
agcagcatacaagctagcgctactg

SEQ ID NO: 9152 - DNA, 25 bp, S. cerevisiae
acgaacgattattagtagcgcaaag

SEQ ID NO: 9153 - DNA, 25 bp, S. cerevisiae
agaatgtcccaaatgtcactctcgg

SEQ ID NO: 9154 - DNA, 25 bp, S. cerevisiae
agaatgacgtctctactatccttgg

SEQ ID NO: 9155 - DNA, 25 bp, S. cerevisiae
agaagatctgttcctaatcctgctt

SEQ ID NO: 9156 - DNA, 25 bp, S. cerevisiae
agcagaatcattcccactgagagtc

SEQ ID NO: 9157 - DNA, 25 bp, S. cerevisiae
agaagatcattccaactgctgctgc

SEQ ID NO: 9158 - DNA, 25 bp, S. cerevisiae
agcagatctggaagtctcctaactt

SEQ ID NO: 9159 - DNA, 25 bp, S. cerevisiae
agctttggttgtgttcaatccatta

SEQ ID NO: 9160 - DNA, 25 bp, S. cerevisiae
agcagttggtgttggttccacttta

SEQ ID NO: 9161 - DNA, 25 bp, S. cerevisiae
agcagttttcgatggtacccttcaa

SEQ ID NO: 9162 - DNA, 25 bp, S. cerevisiae
agcaatttcccagcctttattcaaa

SEQ ID NO: 9163 - DNA, 25 bp, S. cerevisiae
agcaacccctttggtattattccag

SEQ ID NO: 9164 - DNA, 25 bp, S. cerevisiae
agaacgctcgctcctggtgatgatc

SEQ ID NO: 9165 - DNA, 25 bp, S. cerevisiae
agaagcctctgtctattgcttgcta

SEQ ID NO: 9166 - DNA, 25 bp, S. cerevisiae
agaaggcgtgtcatggtctgcacct

SEQ ID NO: 9167 - DNA, 25 bp, S. cerevisiae
agaagatccttcgatgttccacctc

SEQ ID NO: 9168 - DNA, 25 bp, S. cerevisiae
agaatgacttccatgttcctgtacc

SEQ ID NO: 9169 - DNA, 25 bp, S. cerevisiae
agaagatttcgctttccctgatact

SEQ ID NO: 9170 - DNA, 25 bp, S. cerevisiae
agaaccggattgtctatcactcaaa

SEQ ID NO: 9171 - DNA, 25 bp, S. cerevisiae
agaacccaatctttgacgctcacag

SEQ ID NO: 9172 - DNA, 25 bp, S. cerevisiae
agaaggacacactactacgctgagg

SEQ ID NO: 9173 - DNA, 25 bp, S. cerevisiae
agaagagggctccaatttctcctta

SEQ ID NO: 9174 - DNA, 25 bp, S. cerevisiae
agaaggtcgtctccatttttcgaag

SEQ ID NO: 9175 - DNA, 25 bp, S. cerevisiae
agaatcatctctttgtcccattttt

SEQ ID NO: 9176 - DNA, 25 bp, S. cerevisiae
agaagtgtacttccgaatcgttcaa

SEQ ID NO: 9177 - DNA, 25 bp, S. cerevisiae
agaagatgcactcaccgatagggat

SEQ ID NO: 9178 - DNA, 25 bp, S. cerevisiae
agcaatatcttttccgaagccgtaa

SEQ ID NO: 9179 - DNA, 25 bp, S. cerevisiae
agcacaagtttctcaaagcgcaaaa

SEQ ID NO: 9180 - DNA, 25 bp, S. cerevisiae
agcaacgtcgtcagcaacacctatg

SEQ ID NO: 9181 - DNA, 25 bp, S. cerevisiae
agcaacccttcaaaagccacattaa

SEQ ID NO: 9182 - DNA, 25 bp, S. cerevisiae
agaaccttttactacaccttgacag

SEQ ID NO: 9183 - DNA, 25 bp, S. cerevisiae
agaatggctatcgttcaaaggcgct

SEQ ID NO: 9184 - DNA, 25 bp, S. cerevisiae
agaagagttctcgtcaacaggcaga

SEQ ID NO: 9185 - DNA, 25 bp, S. cerevisiae
agaagcgcaattgtcccgcaatgaa

SEQ ID NO: 9186 - DNA, 25 bp, S. cerevisiae
agcaccgaaactatctctcaacaaa

SEQ ID NO: 9187 - DNA, 25 bp, S. cerevisiae
agcaacgtctggaaaggcgtgccaa

SEQ ID NO: 9188 - DNA, 25 bp, S. cerevisiae
agaattgtcatgcaagggctcccta

SEQ ID NO: 9189 - DNA, 25 bp, S. cerevisiae
agaagagctctgcacacatcctatg

SEQ ID NO: 9190 - DNA, 25 bp, S. cerevisiae
agcaggactgtgcaattcaccatgt

SEQ ID NO: 9191 - DNA, 25 bp, S. cerevisiae
agcagctcctgttgatagcgacgca

SEQ ID NO: 9192 - DNA, 25 bp, S. cerevisiae
agcatcctgatgagtggcgtctgta

SEQ ID NO: 9193 - DNA, 25 bp, S. cerevisiae
agaagcgatgggacgatcgcaaata

SEQ ID NO: 9194 - DNA, 25 bp, S. cerevisiae
agaagagatgcttgccaaccaccaa

SEQ ID NO: 9195 - DNA, 25 bp, S. cerevisiae
agaaggcagtgtcaacgccgcagca

SEQ ID NO: 9196 - DNA, 25 bp, S. cerevisiae
agaatccaactcaatacctcggcat

SEQ ID NO: 9197 - DNA, 25 bp, S. cerevisiae
agaatgccctaattactctgcccat

SEQ ID NO: 9198 - DNA, 25 bp, S. cerevisiae
agaagaagctaatttgtcacccaaa

SEQ ID NO: 9199 - DNA, 25 bp, S. cerevisiae
agaagctccatggatttccctatca

SEQ ID NO: 9200 - DNA, 25 bp, S. cerevisiae
agcaggctacgatatcagcaccact

SEQ ID NO: 9201 - DNA, 25 bp, S. cerevisiae
agcactgcctagttaacggtcttga

SEQ ID NO: 9202 - DNA, 25 bp, S. cerevisiae
agaatttgttgcttctccagcttta

SEQ ID NO: 9203 - DNA, 25 bp, S. cerevisiae
agaattaccagctacttcgccttat

SEQ ID NO: 9204 - DNA, 25 bp, S. cerevisiae
agaagatcgccatacttgcctttac

SEQ ID NO: 9205 - DNA, 25 bp, S. cerevisiae
agaagtctactatctctgctagaga

SEQ ID NO: 9206 - DNA, 25 bp, S. cerevisiae
agaagatctagtcatcgtctcacca

SEQ ID NO: 9207 - DNA, 25 bp, S. cerevisiae
agaagattctgtagatcctctgccc

SEQ ID NO: 9208 - DNA, 25 bp, S. cerevisiae
agaagtttctatactgcgtcgcctt

SEQ ID NO: 9209 - DNA, 25 bp, S. cerevisiae
agaatgttcttctacagcttctgcc

SEQ ID NO: 9210 - DNA, 25 bp, S. cerevisiae
agaagttcttcacgagctggttcac

SEQ ID NO: 9211 - DNA, 25 bp, S. cerevisiae
agaagagctgcttacggtgtcgtca

SEQ ID NO: 9212 - DNA, 25 bp, S. cerevisiae
agaatgaccatgtctctgggtggaa

SEQ ID NO: 9213 - DNA, 25 bp, S. cerevisiae
agaagacgcatactgctgctgtaaa

SEQ ID NO: 9214 - DNA, 25 bp, S. cerevisiae
agaatgccccttgtgcagacaacac

SEQ ID NO: 9215 - DNA, 25 bp, S. cerevisiae
agaagtcaccatttagcgcacagaa

SEQ ID NO: 9216 - DNA, 25 bp, S. cerevisiae
agcaggtgacgctgtttgggctact

SEQ ID NO: 9217 - DNA, 25 bp, S. cerevisiae
taatctgggctgtggttgacctacc

SEQ ID NO: 9218 - DNA, 25 bp, S. cerevisiae
agcatcttggcttatcggtagcgct

SEQ ID NO: 9219 - DNA, 25 bp, S. cerevisiae
agccatttgtgctcgtactggtttt

SEQ ID NO: 9220 - DNA, 25 bp, S. cerevisiae
actaaggactactcagcttctgatt

SEQ ID NO: 9221 - DNA, 25 bp, S. cerevisiae
agcagcaactccaaaatacctccaa

SEQ ID NO: 9222 - DNA, 25 bp, S. cerevisiae
agcagactatttacttgggattgga

SEQ ID NO: 9223 - DNA, 25 bp, S. cerevisiae
agcatactggtctcttactattgga

SEQ ID NO: 9224 - DNA, 25 bp, S. cerevisiae
agcccacgattatccacattttaat

SEQ ID NO: 9225 - DNA, 25 bp, S. cerevisiae
agcagcaacaattcacaaccatctt

SEQ ID NO: 9226 - DNA, 25 bp, S. cerevisiae
agcacgcagctatttcaactcttgt

SEQ ID NO: 9227 - DNA, 25 bp, S. cerevisiae
agcttggaactaccacttttggcaa

SEQ ID NO: 9228 - DNA, 25 bp, S. cerevisiae
agcatcggaaggtccatcttttcga

SEQ ID NO: 9229 - DNA, 25 bp, S. cerevisiae
agcactagagcttcaacggttccaa

SEQ ID NO: 9230 - DNA, 25 bp, S. cerevisiae
agcacaacgagatcgatcactccga

SEQ ID NO: 9231 - DNA, 25 bp, S. cerevisiae
agcacaacggtactcatcatcagac

SEQ ID NO: 9232 - DNA, 25 bp, S. cerevisiae
agcatacacgcgcagtactaacggt

SEQ ID NO: 9233 - DNA, 25 bp, S. cerevisiae
agcagctatcgaggcttctacgagg

SEQ ID NO: 9234 - DNA, 25 bp, S. cerevisiae
agcagcgcatcttggtccttagcag

SEQ ID NO: 9235 - DNA, 25 bp, S. cerevisiae
agcataattggctctttggctattt

SEQ ID NO: 9236 - DNA, 25 bp, S. cerevisiae
agaatcttatgcttcctttctactc

SEQ ID NO: 9237 - DNA, 25 bp, S. cerevisiae
agcaattgcctgatactttaacatt

SEQ ID NO: 9238 - DNA, 25 bp, S. cerevisiae
agcaacccacagcaccaatgaaaaa

SEQ ID NO: 9239 - DNA, 25 bp, S. cerevisiae
agcaaccccaccacaaatgagaatg

SEQ ID NO: 9240 - DNA, 25 bp, S. cerevisiae
agaagatttcgacccgagctggaaa

SEQ ID NO: 9241 - DNA, 25 bp, S. cerevisiae
acatagattgtctcccacaggtaaa

SEQ ID NO: 9242 - DNA, 25 bp, S. cerevisiae
agcattatatggtacccttgggtta

SEQ ID NO: 9243 - DNA, 25 bp, S. cerevisiae
agaattatcgttaccttctcgccct

SEQ ID NO: 9244 - DNA, 25 bp, S. cerevisiae
agaatacgagcgtccttccaaagga

SEQ ID NO: 9245 - DNA, 25 bp, S. cerevisiae
agaataaagcatgccttccaggaga

SEQ ID NO: 9246 - DNA, 25 bp, S. cerevisiae
agcaattattcgtcatggactccgg

SEQ ID NO: 9247 - DNA, 25 bp, S. cerevisiae
agaattttctcacagaccaggcaga

SEQ ID NO: 9248 - DNA, 25 bp, S. cerevisiae
agaatttcgctgactatacctgtaa

SEQ ID NO: 9249 - DNA, 25 bp, S. cerevisiae
agaaggctccgtttaccgtgaatgg

SEQ ID NO: 9250 - DNA, 25 bp, S. cerevisiae
agaaggcgcccttgtacctgaaaag

SEQ ID NO: 9251 - DNA, 25 bp, S. cerevisiae
agcaagtccccggatatgttcaagg

SEQ ID NO: 9252 - DNA, 25 bp, S. cerevisiae
agaaggctgtcgctatatgtttgca

SEQ ID NO: 9253 - DNA, 25 bp, S. cerevisiae
agaagttggcagaccgcaatcgcaa

SEQ ID NO: 9254 - DNA, 25 bp, S. cerevisiae
agaagtctgccattcatcgaaggaa

SEQ ID NO: 9255 - DNA, 25 bp, S. cerevisiae
agaagtcatctttctcggaggaact

SEQ ID NO: 9256 - DNA, 25 bp, S. cerevisiae
agaatcctctttggcggtaaacttg

SEQ ID NO: 9257 - DNA, 25 bp, S. cerevisiae
agaagtttctcaagctccaagagct

SEQ ID NO: 9258 - DNA, 25 bp, S. cerevisiae
agaagatattcatgtggcactcaaa

SEQ ID NO: 9259 - DNA, 25 bp, S. cerevisiae
agaagatgcattgcgtgggcccacg

SEQ ID NO: 9260 - DNA, 25 bp, S. cerevisiae
agctacgttctttattgtcagatcg

SEQ ID NO: 9261 - DNA, 25 bp, S. cerevisiae
agaatcctagcttgccctggacata

SEQ ID NO: 9262 - DNA, 25 bp, S. cerevisiae
agaatcactgaactgcaagcggaaa

SEQ ID NO: 9263 - DNA, 25 bp, S. cerevisiae
agaattgcaaacttcctcgatgaaa

SEQ ID NO: 9264 - DNA, 25 bp, S. cerevisiae
agaaggcccattactctcagaaaga

SEQ ID NO: 9265 - DNA, 25 bp, S. cerevisiae
agaaggacctgccatgctgctatac

SEQ ID NO: 9266 - DNA, 25 bp, S. cerevisiae
agaaggtcctatcatgctgtacatt

SEQ ID NO: 9267 - DNA, 25 bp, S. cerevisiae
acattgaacttttgtctaccaatat

SEQ ID NO: 9268 - DNA, 25 bp, S. cerevisiae
agcctaccgttgttacaccaagaca

SEQ ID NO: 9269 - DNA, 25 bp, S. cerevisiae
acctactcattacaagcgcgttact

SEQ ID NO: 9270 - DNA, 25 bp, S. cerevisiae
agcgtgacatttcctaagcctttga

SEQ ID NO: 9271 - DNA, 25 bp, S. cerevisiae
cagttgcccgttaaacttccaagag

SEQ ID NO: 9272 - DNA, 25 bp, S. cerevisiae
agcagtacgctcattgatcgcttcc

SEQ ID NO: 9273 - DNA, 25 bp, S. cerevisiae
agaatacttcatcaccgccaatgat

SEQ ID NO: 9274 - DNA, 25 bp, S. cerevisiae
agcaagactgaatatccgcccgtag

SEQ ID NO: 9275 - DNA, 25 bp, S. cerevisiae
agcaataaaaattctccgccctcag

SEQ ID NO: 9276 - DNA, 25 bp, S. cerevisiae
agcaagcaaaacaaacgcccacttc

SEQ ID NO: 9277 - DNA, 25 bp, S. cerevisiae
agcagcatcaaatcagccacggacg

SEQ ID NO: 9278 - DNA, 25 bp, S. cerevisiae
agaatccatgccatccagcttaaag

SEQ ID NO: 9279 - DNA, 25 bp, S. cerevisiae
agaattgcccttgctcttagaagat

SEQ ID NO: 9280 - DNA, 25 bp, S. cerevisiae
agaatatttctgcaccattggataa

SEQ ID NO: 9281 - DNA, 25 bp, S. cerevisiae
agaagttcaagcgtcatcactctga

SEQ ID NO: 9282 - DNA, 25 bp, S. cerevisiae
agaatttctagatacgcagctgatg

SEQ ID NO: 9283 - DNA, 25 bp, S. cerevisiae
agaatgctcttgcaagacctgctgt

SEQ ID NO: 9284 - DNA, 25 bp, S. cerevisiae
agaatgtcgatgtctcagtcgctgt

SEQ ID NO: 9285 - DNA, 25 bp, S. cerevisiae
agaagtcgctgcttttgctcaattc

SEQ ID NO: 9286 - DNA, 25 bp, S. cerevisiae
agaatcctcttctttgcatcattac

SEQ ID NO: 9287 - DNA, 25 bp, S. cerevisiae
agcaacaatttgctattcctccgca

SEQ ID NO: 9288 - DNA, 25 bp, S. cerevisiae
agcaaattgggtaatgccgccattt

SEQ ID NO: 9289 - DNA, 25 bp, S. cerevisiae
agcaaactggctattccttcaacac

SEQ ID NO: 9290 - DNA, 25 bp, S. cerevisiae
agaatttgttttgcatctccatccc

SEQ ID NO: 9291 - DNA, 25 bp, S. cerevisiae
agaatctgggtggtgcatgctttac

SEQ ID NO: 9292 - DNA, 25 bp, S. cerevisiae
agcaacgcctgtcatgttcatgtat

SEQ ID NO: 9293 - DNA, 25 bp, S. cerevisiae
agcaatggtttgcatattcaaggcc

SEQ ID NO: 9294 - DNA, 25 bp, S. cerevisiae
agcaagtcggtgttggtaagttgaa

SEQ ID NO: 9295 - DNA, 25 bp, S. cerevisiae
acgttagactgaaggccaagcaatt

SEQ ID NO: 9296 - DNA, 25 bp, S. cerevisiae
agcattggagactatagcggaagaa

SEQ ID NO: 9297 - DNA, 25 bp, S. cerevisiae
agcattgccacatatgcatcggtca

SEQ ID NO: 9298 - DNA, 25 bp, S. cerevisiae
agcactgctgagaccatagaacttt

SEQ ID NO: 9299 - DNA, 25 bp, S. cerevisiae
agcattattcccagaattttcccct

SEQ ID NO: 9300 - DNA, 25 bp, S. cerevisiae
agcaacctccacaggatattctttc

SEQ ID NO: 9301 - DNA, 25 bp, S. cerevisiae
agaaggctcaactgttagaccagga

SEQ ID NO: 9302 - DNA, 25 bp, S. cerevisiae
agaaggtcaacgttctcgtgtcgtc

SEQ ID NO: 9303 - DNA, 25 bp, S. cerevisiae
agaaggtctatactccatttcctcc

SEQ ID NO: 9304 - DNA, 25 bp, S. cerevisiae
acaaggtttggctctgtccctaggt

SEQ ID NO: 9305 - DNA, 25 bp, S. cerevisiae
agcaactggttcagtttcctacctt

SEQ ID NO: 9306 - DNA, 25 bp, S. cerevisiae
agcacaagtgctagaccatccagta

SEQ ID NO: 9307 - DNA, 25 bp, S. cerevisiae
agcaaattgcggacacactagatga

SEQ ID NO: 9308 - DNA, 25 bp, S. cerevisiae
acaaacgtggccttcaagtacctga

SEQ ID NO: 9309 - DNA, 25 bp, S. cerevisiae
acgaacctcgtggtcaggataccga

SEQ ID NO: 9310 - DNA, 25 bp, S. cerevisiae
acgaattcctggctacgttccagaa

SEQ ID NO: 9311 - DNA, 25 bp, S. cerevisiae
agaatctcaaaatgtaccggcttta

SEQ ID NO: 9312 - DNA, 25 bp, S. cerevisiae
agcccatgaagtgttaccagtgccc

SEQ ID NO: 9313 - DNA, 25 bp, S. cerevisiae
agcaccgaagtttaagtcctgccaa

SEQ ID NO: 9314 - DNA, 25 bp, S. cerevisiae
agcacactgtgatttgaaacccgaa

SEQ ID NO: 9315 - DNA, 25 bp, S. cerevisiae
agcacaggttatcggtatcctcgca

SEQ ID NO: 9316 - DNA, 25 bp, S. cerevisiae
agcacaggtgttgtgtcagcccaat

SEQ ID NO: 9317 - DNA, 25 bp, S. cerevisiae
agcaagcagcttcaacggttcaaat

SEQ ID NO: 9318 - DNA, 25 bp, S. cerevisiae
agaattctgtctcatcttttccaat

SEQ ID NO: 9319 - DNA, 25 bp, S. cerevisiae
agaatcctctccattttatgccaat

SEQ ID NO: 9320 - DNA, 25 bp, S. cerevisiae
agcttaatcccatttttcgcgtttg

SEQ ID NO: 9321 - DNA, 25 bp, S. cerevisiae
agcataacgtttctgatctgggcaa

SEQ ID NO: 9322 - DNA, 25 bp, S. cerevisiae
agaattccccacttgttgcgatcaa

SEQ ID NO: 9323 - DNA, 25 bp, S. cerevisiae
agcaatgctaaaaccttcttctaaa

SEQ ID NO: 9324 - DNA, 25 bp, S. cerevisiae
agcaatcctttcctctttactgaga

SEQ ID NO: 9325 - DNA, 25 bp, S. cerevisiae
agcaatcacctagtcttcttcaagg

SEQ ID NO: 9326 - DNA, 25 bp, S. cerevisiae
agcagaagatttgtatatccagtat

SEQ ID NO: 9327 - DNA, 25 bp, S. cerevisiae
agcaattagtgttccatgctcccgc

SEQ ID NO: 9328 - DNA, 25 bp, S. cerevisiae
agaattggttctggtgctccagtct

SEQ ID NO: 9329 - DNA, 25 bp, S. cerevisiae
agaattgcttctacggacactcaca

SEQ ID NO: 9330 - DNA, 25 bp, S. cerevisiae
agcaagttcaacaagtcgtcatgga

SEQ ID NO: 9331 - DNA, 25 bp, S. cerevisiae
agcaaggctcatacgtatcgtgcat

SEQ ID NO: 9332 - DNA, 25 bp, S. cerevisiae
agcaacagcagctctggtcctcatt

SEQ ID NO: 9333 - DNA, 25 bp, S. cerevisiae
agaatgcgcatctcaggctgccaaa

SEQ ID NO: 9334 - DNA, 25 bp, S. cerevisiae
agaatgctgcacgatttggccaaag

SEQ ID NO: 9335 - DNA, 25 bp, S. cerevisiae
agctaaaggctgacttcccagcgta

SEQ ID NO: 9336 - DNA, 25 bp, S. cerevisiae
agcaacaaagctcggtctcattaga

SEQ ID NO: 9337 - DNA, 25 bp, S. cerevisiae
agcactagaaggagctacttgagat

SEQ ID NO: 9338 - DNA, 25 bp, S. cerevisiae
agcttagacaacatcaacggcgtag

SEQ ID NO: 9339 - DNA, 25 bp, S. cerevisiae
agcatatgaacttcaccaacccttt

SEQ ID NO: 9340 - DNA, 25 bp, S. cerevisiae
agaatgacagcgatgtaccggaact

SEQ ID NO: 9341 - DNA, 25 bp, S. cerevisiae
aactttcgccaatcctaacaggaca

SEQ ID NO: 9342 - DNA, 25 bp, S. cerevisiae
gaaccccgtcaaccgtgatgaacga

SEQ ID NO: 9343 - DNA, 25 bp, S. cerevisiae
agcaccgccgatgattctttgaaca

SEQ ID NO: 9344 - DNA, 25 bp, S. cerevisiae
agcagccccaagtattcattcgaaa

SEQ ID NO: 9345 - DNA, 25 bp, S. cerevisiae
agcagcggttagattgagcacgaaa

SEQ ID NO: 9346 - DNA, 25 bp, S. cerevisiae
agcacgctcattccttcaaaaatac

SEQ ID NO: 9347 - DNA, 25 bp, S. cerevisiae
agcagcttgaggctttcaaccatca

SEQ ID NO: 9348 - DNA, 25 bp, S. cerevisiae
agcaaagtagtcgacttcgccacaa

SEQ ID NO: 9349 - DNA, 25 bp, S. cerevisiae
agcaaactattcaactcccaagcaa

SEQ ID NO: 9350 - DNA, 25 bp, S. cerevisiae
agcattccaggagggccagcttggt

SEQ ID NO: 9351 - DNA, 25 bp, S. cerevisiae
agcgaacaagaacctacctatactg

SEQ ID NO: 9352 - DNA, 25 bp, S. cerevisiae
agcaaaaatattcccttacctgaag

SEQ ID NO: 9353 - DNA, 25 bp, S. cerevisiae
actaaaccacttgcgcttgttattt

SEQ ID NO: 9354 - DNA, 25 bp, S. cerevisiae
agcactctacgacgttttggccaag

SEQ ID NO: 9355 - DNA, 25 bp, S. cerevisiae
agcacctagtgggtttttagcaaga

SEQ ID NO: 9356 - DNA, 25 bp, S. cerevisiae
agcaacctgcttctattttcaacaa

SEQ ID NO: 9357 - DNA, 25 bp, S. cerevisiae
agcacctcttaggttccttcatgaa

SEQ ID NO: 9358 - DNA, 25 bp, S. cerevisiae
agaattgttactggtgccctcgaca

SEQ ID NO: 9359 - DNA, 25 bp, S. cerevisiae
agcggcaaggcctttaactggttat

SEQ ID NO: 9360 - DNA, 25 bp, S. cerevisiae
agctagaaaccgtatccaaggattt

SEQ ID NO: 9361 - DNA, 25 bp, S. cerevisiae
agcaacacctggtctccaagtagta

SEQ ID NO: 9362 - DNA, 25 bp, S. cerevisiae
agcaggagccaagcccaatttgtga

SEQ ID NO: 9363 - DNA, 25 bp, S. cerevisiae
agcgggccatacactaactttgcag

SEQ ID NO: 9364 - DNA, 25 bp, S. cerevisiae
agcggcacctaccacttaaattgtg

SEQ ID NO: 9365 - DNA, 25 bp, S. cerevisiae
agcgcccagcaaaagttacaggttt

SEQ ID NO: 9366 - DNA, 25 bp, S. cerevisiae
agcagttagcggtatgttgcctaaa

SEQ ID NO: 9367 - DNA, 25 bp, S. cerevisiae
agcaatgttagcctatgggtcaata

SEQ ID NO: 9368 - DNA, 25 bp, S. cerevisiae
agcaactgtttcattaggcgacctg

SEQ ID NO: 9369 - DNA, 25 bp, S. cerevisiae
agaattggcttctctaggtaacatt

SEQ ID NO: 9370 - DNA, 25 bp, S. cerevisiae
agcagcaacatattctcccatcgga

SEQ ID NO: 9371 - DNA, 25 bp, S. cerevisiae
agcagcaaggtctcaaggtcaccat

SEQ ID NO: 9372 - DNA, 25 bp, S. cerevisiae
agcagaacggttggcaggcacccat

SEQ ID NO: 9373 - DNA, 25 bp, S. cerevisiae
agcaatgccatttcttggacgttca

SEQ ID NO: 9374 - DNA, 25 bp, S. cerevisiae
agcatatgccttttggcacgtgtcc

SEQ ID NO: 9375 - DNA, 25 bp, S. cerevisiae
agcaagccattgctgctaatgctta

SEQ ID NO: 9376 - DNA, 25 bp, S. cerevisiae
agcaactcatctagtgccaactttg

SEQ ID NO: 9377 - DNA, 25 bp, S. cerevisiae
agcaatgagtactcaccttaccctt

SEQ ID NO: 9378 - DNA, 25 bp, S. cerevisiae
agcagaaagactgtccttgtccctt

SEQ ID NO: 9379 - DNA, 25 bp, S. cerevisiae
agcatactcaccattaggttcccat

SEQ ID NO: 9380 - DNA, 25 bp, S. cerevisiae
agcaattaactttaggtctccacgt

SEQ ID NO: 9381 - DNA, 25 bp, S. cerevisiae
agcaccaattctcccacaaatgata

SEQ ID NO: 9382 - DNA, 25 bp, S. cerevisiae
agcactgcagatgagttgaccacaa

SEQ ID NO: 9383 - DNA, 25 bp, S. cerevisiae
agcacctgcatctgtggagactcaa

SEQ ID NO: 9384 - DNA, 25 bp, S. cerevisiae
agcagtttcactagagatagtcaac

SEQ ID NO: 9385 - DNA, 25 bp, S. cerevisiae
accattgacctctagaagggcacgt

SEQ ID NO: 9386 - DNA, 25 bp, S. cerevisiae
acctgttcctgataaagacacccaa

SEQ ID NO: 9387 - DNA, 25 bp, S. cerevisiae
agcctagttctttaaatgccaccgc

SEQ ID NO: 9388 - DNA, 25 bp, S. cerevisiae
agctggaggcgcttataaaccacct

SEQ ID NO: 9389 - DNA, 25 bp, S. cerevisiae
acttgaggccaaacgtactagctgt

SEQ ID NO: 9390 - DNA, 25 bp, S. cerevisiae
agcacctgtctttcctatatctaaa

SEQ ID NO: 9391 - DNA, 25 bp, S. cerevisiae
agcatcttacgctgttaggctcgat

SEQ ID NO: 9392 - DNA, 25 bp, S. cerevisiae
acctcgaggaacgtctagctttaga

SEQ ID NO: 9393 - DNA, 25 bp, S. cerevisiae
accaccgtgagctcatatttttcaa

SEQ ID NO: 9394 - DNA, 25 bp, S. cerevisiae
accaatcggcgctgtcagtttaaaa

SEQ ID NO: 9395 - DNA, 25 bp, S. cerevisiae
acgagtcgcacgaggaccctgaaaa

SEQ ID NO: 9396 - DNA, 25 bp, S. cerevisiae
agcggccggcgttggaatagctact

SEQ ID NO: 9397 - DNA, 25 bp, S. cerevisiae
agcacgcccagcacttgataattag

SEQ ID NO: 9398 - DNA, 25 bp, S. cerevisiae
agcacagcaacctcgttactatcag

SEQ ID NO: 9399 - DNA, 25 bp, S. cerevisiae
agcacagaactctacttcaagtgat

SEQ ID NO: 9400 - DNA, 25 bp, S. cerevisiae
agcacttcagtgatctcatgattga

SEQ ID NO: 9401 - DNA, 25 bp, S. cerevisiae
agcacattttgcatctctatcagat

SEQ ID NO: 9402 - DNA, 25 bp, S. cerevisiae
agcaccaaagctatccttccaggat

SEQ ID NO: 9403 - DNA, 25 bp, S. cerevisiae
agcatcaaatgagcattcctcccgt

SEQ ID NO: 9404 - DNA, 25 bp, S. cerevisiae
agcatgcatatatctctgtgatttg

SEQ ID NO: 9405 - DNA, 25 bp, S. cerevisiae
agcagcaactgcttctggtgcattt

SEQ ID NO: 9406 - DNA, 25 bp, S. cerevisiae
agcaatctccggtttgtctcaatta

SEQ ID NO: 9407 - DNA, 25 bp, S. cerevisiae
actattccccttcagctaaagttgt

SEQ ID NO: 9408 - DNA, 25 bp, S. cerevisiae
agcaggtgcaacttcatatcaaaca

SEQ ID NO: 9409 - DNA, 25 bp, S. cerevisiae
agcgaggtactgttcttgagcgata

SEQ ID NO: 9410 - DNA, 25 bp, S. cerevisiae
agcacgtttacgaaatagccaagat

SEQ ID NO: 9411 - DNA, 25 bp, S. cerevisiae
agcaagtttctaacacatccaaaat

SEQ ID NO: 9412 - DNA, 25 bp, S. cerevisiae
agcagatgcgttggcagcagcttta

SEQ ID NO: 9413 - DNA, 25 bp, S. cerevisiae
agcatggaggcggacatttcacata

SEQ ID NO: 9414 - DNA, 25 bp, S. cerevisiae
agcaccgcctcataagttgtactgg

SEQ ID NO: 9415 - DNA, 25 bp, S. cerevisiae
agcaagctgagcaaaacaagtacct

SEQ ID NO: 9416 - DNA, 25 bp, S. cerevisiae
agcggcggcgccagtcacttccaaa

SEQ ID NO: 9417 - DNA, 25 bp, S. cerevisiae
agcgtagaggccacatactcatcaa

SEQ ID NO: 9418 - DNA, 25 bp, S. cerevisiae
agcttcgattggctgaatttctacc

SEQ ID NO: 9419 - DNA, 25 bp, S. cerevisiae
agcattggtgggatccatcgctgca

SEQ ID NO: 9420 - DNA, 25 bp, S. cerevisiae
agcagggaattgtttgatctcgcaa

SEQ ID NO: 9421 - DNA, 25 bp, S. cerevisiae
agcatcgtcatgtccagattactga

SEQ ID NO: 9422 - DNA, 25 bp, S. cerevisiae
agctacttgctgtcgtaagccaact

SEQ ID NO: 9423 - DNA, 25 bp, S. cerevisiae
agcagactcgcttccattgagtaac

SEQ ID NO: 9424 - DNA, 25 bp, S. cerevisiae
agcagcaccactccgatgatgaata

SEQ ID NO: 9425 - DNA, 25 bp, S. cerevisiae
agcagcaccacagcaagcatactat

SEQ ID NO: 9426 - DNA, 25 bp, S. cerevisiae
agcatgagctaaataggctattatc

SEQ ID NO: 9427 - DNA, 25 bp, S. cerevisiae
agcaccttttagctcttcagttgga

SEQ ID NO: 9428 - DNA, 25 bp, S. cerevisiae
agcacatcttttacgttcatctttg

SEQ ID NO: 9429 - DNA, 25 bp, S. cerevisiae
agcacaatctttagcgtcatcctta

SEQ ID NO: 9430 - DNA, 25 bp, S. cerevisiae
agcacacactctgttcactgaacaa

SEQ ID NO: 9431 - DNA, 25 bp, S. cerevisiae
agcatacctattcatttatccccta

SEQ ID NO: 9432 - DNA, 25 bp, S. cerevisiae
agcaccggtgcaactggaatatcaa

SEQ ID NO: 9433 - DNA, 25 bp, S. cerevisiae
agcaccatatgcctacgggaagcaa

SEQ ID NO: 9434 - DNA, 25 bp, S. cerevisiae
agcacttataaagcgcgtctagcga

SEQ ID NO: 9435 - DNA, 25 bp, S. cerevisiae
agcagtcttagagcatacgtcagat

SEQ ID NO: 9436 - DNA, 25 bp, S. cerevisiae
agcactcctcaagtactatctgcaa

SEQ ID NO: 9437 - DNA, 25 bp, S. cerevisiae
agcaacctgcatggctagtgttcaa

SEQ ID NO: 9438 - DNA, 25 bp, S. cerevisiae
agcagacgctgctctattgatgcaa

SEQ ID NO: 9439 - DNA, 25 bp, S. cerevisiae
acgatgctgatgcaatagatcatga

SEQ ID NO: 9440 - DNA, 25 bp, S. cerevisiae
agcagccttggctatagctcatact

SEQ ID NO: 9441 - DNA, 25 bp, S. cerevisiae
agcatccctgacttaatcgatcttg

SEQ ID NO: 9442 - DNA, 25 bp, S. cerevisiae
agcgaccagtagaatcagcctcttg

SEQ ID NO: 9443 - DNA, 25 bp, S. cerevisiae
agctatgccattcatttctctattg

SEQ ID NO: 9444 - DNA, 25 bp, S. cerevisiae
agcagttcacataaatctctctttg

SEQ ID NO: 9445 - DNA, 25 bp, S. cerevisiae
agcagtaaatatatctccgttcaag

SEQ ID NO: 9446 - DNA, 25 bp, S. cerevisiae
agctaaggctgcaacttccgtacaa

SEQ ID NO: 9447 - DNA, 25 bp, S. cerevisiae
agcaccaaattcacatcactcgtat

SEQ ID NO: 9448 - DNA, 25 bp, S. cerevisiae
agctattctcctcgagtcaggtgta

SEQ ID NO: 9449 - DNA, 25 bp, S. cerevisiae
agcatgcttgcgaccggtcttagta

SEQ ID NO: 9450 - DNA, 25 bp, S. cerevisiae
agcgatgtcgacgatggttccgtac

SEQ ID NO: 9451 - DNA, 25 bp, S. cerevisiae
agcattgtgctattgtggcttccct

SEQ ID NO: 9452 - DNA, 25 bp, S. cerevisiae
agcactgctaagattgacttcaaca

SEQ ID NO: 9453 - DNA, 25 bp, S. cerevisiae
agctacgctcaagggacggtggact

SEQ ID NO: 9454 - DNA, 25 bp, S. cerevisiae
agcagcagcaacaaccgcagggtaa

SEQ ID NO: 9455 - DNA, 25 bp, S. cerevisiae
agcagtagatgcacgtgaacaaaga

SEQ ID NO: 9456 - DNA, 25 bp, S. cerevisiae
agcagtccagcttttgaagcagcaa

SEQ ID NO: 9457 - DNA, 25 bp, S. cerevisiae
agcatgcatggctcattgtaaccag

SEQ ID NO: 9458 - DNA, 25 bp, S. cerevisiae
agcttggttcttgaaccgtcaaaat

SEQ ID NO: 9459 - DNA, 25 bp, S. cerevisiae
agcactgggccaattgattctttta

SEQ ID NO: 9460 - DNA, 25 bp, S. cerevisiae
agcggcatttactgatcacttcttc

SEQ ID NO: 9461 - DNA, 25 bp, S. cerevisiae
agctgaaggtccaactgtcgaagaa

SEQ ID NO: 9462 - DNA, 25 bp, S. cerevisiae
agcactgctcaacatttggttctga

SEQ ID NO: 9463 - DNA, 25 bp, S. cerevisiae
agcacgagttttcagttcattggat

SEQ ID NO: 9464 - DNA, 25 bp, S. cerevisiae
agcaggcttcggatcagcttattaa

SEQ ID NO: 9465 - DNA, 25 bp, S. cerevisiae
agcttctgccagaccaagatttcac

SEQ ID NO: 9466 - DNA, 25 bp, S. cerevisiae
agcacgtacgctttcaacattcgag

SEQ ID NO: 9467 - DNA, 25 bp, S. cerevisiae
agcaccttcttctttcacagctaaa

SEQ ID NO: 9468 - DNA, 25 bp, S. cerevisiae
agctcgtctacttccctgaaattta

SEQ ID NO: 9469 - DNA, 25 bp, S. cerevisiae
agcagcgcccaatgacacaagtagt

SEQ ID NO: 9470 - DNA, 25 bp, S. cerevisiae
agcagatttcgtcaaccaatgcaga

SEQ ID NO: 9471 - DNA, 25 bp, S. cerevisiae
agcatcgatgttaagacgcccttca

SEQ ID NO: 9472 - DNA, 25 bp, S. cerevisiae
agcttttgaaagacccgctgtgaaa

SEQ ID NO: 9473 - DNA, 25 bp, S. cerevisiae
agcagtatggccttcctttggagat

SEQ ID NO: 9474 - DNA, 25 bp, S. cerevisiae
agcagaagcttacccactatatgaa

SEQ ID NO: 9475 - DNA, 25 bp, S. cerevisiae
agcagatcttgcacccataatagaa

SEQ ID NO: 9476 - DNA, 25 bp, S. cerevisiae
agcagtttgactcgcatattctaga

SEQ ID NO: 9477 - DNA, 25 bp, S. cerevisiae
agcacatatcgagcagctttctaag

SEQ ID NO: 9478 - DNA, 25 bp, S. cerevisiae
agcacagttgccgacatggtcataa

SEQ ID NO: 9479 - DNA, 25 bp, S. cerevisiae
agcatttcttctgcatggtccaagt

SEQ ID NO: 9480 - DNA, 25 bp, S. cerevisiae
agcatattctgctattggcgccatg

SEQ ID NO: 9481 - DNA, 25 bp, S. cerevisiae
agctatcgctcatgatcggagcttt

SEQ ID NO: 9482 - DNA, 25 bp, S. cerevisiae
agcatttttgccttgcatttcgtat

SEQ ID NO: 9483 - DNA, 25 bp, S. cerevisiae
agcatctttaccctcaattagtgaa

SEQ ID NO: 9484 - DNA, 25 bp, S. cerevisiae
agcagctttcggtgtcagtaattct

SEQ ID NO: 9485 - DNA, 25 bp, S. cerevisiae
agcatgtcatttgcaaccgacttcc

SEQ ID NO: 9486 - DNA, 25 bp, S. cerevisiae
agcattatatgtgatctaggccttg

SEQ ID NO: 9487 - DNA, 25 bp, S. cerevisiae
agctctgttgctatcgttggatgga

SEQ ID NO: 9488 - DNA, 25 bp, S. cerevisiae
agcatgttggctctgcctgaggaaa

SEQ ID NO: 9489 - DNA, 25 bp, S. cerevisiae
agcttagactgcgacacggcgaaat

SEQ ID NO: 9490 - DNA, 25 bp, S. cerevisiae
agcttcaaatgggactcggcaatca

SEQ ID NO: 9491 - DNA, 25 bp, S. cerevisiae
agctttgcaagacattctggctaaa

SEQ ID NO: 9492 - DNA, 25 bp, S. cerevisiae
actttggactttgccgagagaactc

SEQ ID NO: 9493 - DNA, 25 bp, S. cerevisiae
agctttggcacgtgtttggagagac

SEQ ID NO: 9494 - DNA, 25 bp, S. cerevisiae
agcttgatcgcccaggaattgaatt

SEQ ID NO: 9495 - DNA, 25 bp, S. cerevisiae
agctgcgatgactgtaggtggtact

SEQ ID NO: 9496 - DNA, 25 bp, S. cerevisiae
agcggcgaacagtggaggctccata

SEQ ID NO: 9497 - DNA, 25 bp, S. cerevisiae
agcaggaaacttggaggcactacaa

SEQ ID NO: 9498 - DNA, 25 bp, S. cerevisiae
agcagggaattttgatggccgtaat

SEQ ID NO: 9499 - DNA, 25 bp, S. cerevisiae
agcaggtttatcatcaggactacta

SEQ ID NO: 9500 - DNA, 25 bp, S. cerevisiae
actttagctgctgaaacgactacca

SEQ ID NO: 9501 - DNA, 25 bp, S. cerevisiae
agctgtccctgttataaccactact

SEQ ID NO: 9502 - DNA, 25 bp, S. cerevisiae
actacagctttttcaaattcctccg

SEQ ID NO: 9503 - DNA, 25 bp, S. cerevisiae
actaggtggttatcccgatgtttct

SEQ ID NO: 9504 - DNA, 25 bp, S. cerevisiae
agcacgaaacattgacaccccgtat

SEQ ID NO: 9505 - DNA, 25 bp, S. cerevisiae
agctacatcaacatccggaggcggt

SEQ ID NO: 9506 - DNA, 25 bp, S. cerevisiae
agcatgtaattcttctcaggcggca

SEQ ID NO: 9507 - DNA, 25 bp, S. cerevisiae
agcaggcttgtaaaattctcagcga

SEQ ID NO: 9508 - DNA, 25 bp, S. cerevisiae
agcacgccctctgaagatgacgatg

SEQ ID NO: 9509 - DNA, 25 bp, S. cerevisiae
agcacgccgctaagatagaccttgt

SEQ ID NO: 9510 - DNA, 25 bp, S. cerevisiae
accagccgctaaaaagacttccact

SEQ ID NO: 9511 - DNA, 25 bp, S. cerevisiae
agccagcccaaaaaagtctaccaag

SEQ ID NO: 9512 - DNA, 25 bp, S. cerevisiae
agctacccgaaatatgttcctgcaa

SEQ ID NO: 9513 - DNA, 25 bp, S. cerevisiae
agcttgccggcaaaatgggatcctg

SEQ ID NO: 9514 - DNA, 25 bp, S. cerevisiae
agcattgccatctttattggcgtcc

SEQ ID NO: 9515 - DNA, 25 bp, S. cerevisiae
agcttgcgactttatttggttcttt

SEQ ID NO: 9516 - DNA, 25 bp, S. cerevisiae
agcttccatttttcttgcaactatc

SEQ ID NO: 9517 - DNA, 25 bp, S. cerevisiae
agcatccaattttttctccttatat

SEQ ID NO: 9518 - DNA, 25 bp, S. cerevisiae
agcatccaaggacaacgccatttat

SEQ ID NO: 9519 - DNA, 25 bp, S. cerevisiae
agcagcgtcggtatcattgtttcac

SEQ ID NO: 9520 - DNA, 25 bp, S. cerevisiae
agcagcgggttctatcttggttaaa

SEQ ID NO: 9521 - DNA, 25 bp, S. cerevisiae
agcagaccctgatgccatggatact

SEQ ID NO: 9522 - DNA, 25 bp, S. cerevisiae
agcagaggtctatccagctatccaa

SEQ ID NO: 9523 - DNA, 25 bp, S. cerevisiae
agctcactattctatatatgcgaag

SEQ ID NO: 9524 - DNA, 25 bp, S. cerevisiae
agcagcaggtggcttatctatccgg

SEQ ID NO: 9525 - DNA, 25 bp, S. cerevisiae
tccgggatagactcgtagaactgaa

SEQ ID NO: 9526 - DNA, 25 bp, S. cerevisiae
accggtaacgctctaggatctgtga

SEQ ID NO: 9527 - DNA, 25 bp, S. cerevisiae
agcggtaatggcgatctcgtcgagc

SEQ ID NO: 9528 - DNA, 25 bp, S. cerevisiae
agcttgacattaatccgcctttagt

SEQ ID NO: 9529 - DNA, 25 bp, S. cerevisiae
agctatgccattatcgcagtcctta

SEQ ID NO: 9530 - DNA, 25 bp, S. cerevisiae
agctatacgctatgggtgtcctgac

SEQ ID NO: 9531 - DNA, 25 bp, S. cerevisiae
agcttgtcgctaatggtgtgccaca

SEQ ID NO: 9532 - DNA, 25 bp, S. cerevisiae
agcagctttgcaactggcctcaaat

SEQ ID NO: 9533 - DNA, 25 bp, S. cerevisiae
agcagattactactgtgcctaagat

SEQ ID NO: 9534 - DNA, 25 bp, S. cerevisiae
agcagtatcgcttcagtggccaatg

SEQ ID NO: 9535 - DNA, 25 bp, S. cerevisiae
agcagacatggttcttgatccggac

SEQ ID NO: 9536 - DNA, 25 bp, S. cerevisiae
agcataagctttgtggaggactcca

SEQ ID NO: 9537 - DNA, 25 bp, S. cerevisiae
agctagacttttatcgcggtccgta

SEQ ID NO: 9538 - DNA, 25 bp, S. cerevisiae
agctcaattagtcttcggtacccca

SEQ ID NO: 9539 - DNA, 25 bp, S. cerevisiae
agctgatgctaaagtggtcgttacc

SEQ ID NO: 9540 - DNA, 25 bp, S. cerevisiae
agcattggccgttttcaggaactct

SEQ ID NO: 9541 - DNA, 25 bp, S. cerevisiae
agctggtttaacattcccagttggt

SEQ ID NO: 9542 - DNA, 25 bp, S. cerevisiae
agctttgtatcgctttggaccaact

SEQ ID NO: 9543 - DNA, 25 bp, S. cerevisiae
agctattacagggttcttcttctaa

SEQ ID NO: 9544 - DNA, 25 bp, S. cerevisiae
agctggaagcgggactttctgactc

SEQ ID NO: 9545 - DNA, 25 bp, S. cerevisiae
agcagtgtctccgacgatttggata

SEQ ID NO: 9546 - DNA, 25 bp, S. cerevisiae
agcatggtcacctactgttcttcta

SEQ ID NO: 9547 - DNA, 25 bp, S. cerevisiae
agcatgatgtactatccactctacc

SEQ ID NO: 9548 - DNA, 25 bp, S. cerevisiae
agcatgctttatacgtcttaccaga

SEQ ID NO: 9549 - DNA, 25 bp, S. cerevisiae
agcagcaactacagtcgtacacgag

SEQ ID NO: 9550 - DNA, 25 bp, S. cerevisiae
agcagtactactcccttatcaatga

SEQ ID NO: 9551 - DNA, 25 bp, S. cerevisiae
agcagaatagtgtcttcctccacaa

SEQ ID NO: 9552 - DNA, 25 bp, S. cerevisiae
agcagtttctgcagttagtcatcaa

SEQ ID NO: 9553 - DNA, 25 bp, S. cerevisiae
agcatattcagcgatcgtttctatt

SEQ ID NO: 9554 - DNA, 25 bp, S. cerevisiae
agctgccgaaggagatgccactgtt

SEQ ID NO: 9555 - DNA, 25 bp, S. cerevisiae
agccggaaaatcaccatctgggttt

SEQ ID NO: 9556 - DNA, 25 bp, S. cerevisiae
agctacaagaaccagtttgcttatg

SEQ ID NO: 9557 - DNA, 25 bp, S. cerevisiae
agcgaactagacgaagccggatttt

SEQ ID NO: 9558 - DNA, 25 bp, S. cerevisiae
agcagagtgtccatctataccagaa

SEQ ID NO: 9559 - DNA, 25 bp, S. cerevisiae
agcatgtcctcctacaacgataaag

SEQ ID NO: 9560 - DNA, 25 bp, S. cerevisiae
agcatcatcctttacaactgtcaga

SEQ ID NO: 9561 - DNA, 25 bp, S. cerevisiae
agctctctcttttcaactgcaaagg

SEQ ID NO: 9562 - DNA, 25 bp, S. cerevisiae
agcaggcacgctcattttcaagaaa

SEQ ID NO: 9563 - DNA, 25 bp, S. cerevisiae
agcaggcatagtgttctttgacggc

SEQ ID NO: 9564 - DNA, 25 bp, S. cerevisiae
agcattcacgagctgggcttcaata

SEQ ID NO: 9565 - DNA, 25 bp, S. cerevisiae
agcataaccagtttgccttcttcac

SEQ ID NO: 9566 - DNA, 25 bp, S. cerevisiae
agctaatcacgtgctcacatcttta

SEQ ID NO: 9567 - DNA, 25 bp, S. cerevisiae
agctaccaaggctgtttctgagcaa

SEQ ID NO: 9568 - DNA, 25 bp, S. cerevisiae
agctctcctaacatatttgtggcga

SEQ ID NO: 9569 - DNA, 25 bp, S. cerevisiae
agctagcaataactattccctccac

SEQ ID NO: 9570 - DNA, 25 bp, S. cerevisiae
agctaaatctgcgtcagctcgtggt

SEQ ID NO: 9571 - DNA, 25 bp, S. cerevisiae
agctaccaccactttatctccatct

SEQ ID NO: 9572 - DNA, 25 bp, S. cerevisiae
tgccgtcccaagtgtccaaactttt

SEQ ID NO: 9573 - DNA, 25 bp, S. cerevisiae
agctgtcccaagtgttcaaactttt

SEQ ID NO: 9574 - DNA, 25 bp, S. cerevisiae
agctgtcccaagtgttcaaactttt

SEQ ID NO: 9575 - DNA, 25 bp, S. cerevisiae
agcatccccaagagtccagacagta

SEQ ID NO: 9576 - DNA, 25 bp, S. cerevisiae
agcatcccggatactataaccaaca

SEQ ID NO: 9577 - DNA, 25 bp, S. cerevisiae
agctggtcactagggagtacggtct

SEQ ID NO: 9578 - DNA, 25 bp, S. cerevisiae
agctgtacacggaaacaatcacggc

SEQ ID NO: 9579 - DNA, 25 bp, S. cerevisiae
agctctggcaggctaaaactggcag

SEQ ID NO: 9580 - DNA, 25 bp, S. cerevisiae
agctccggctttcacaaatagtcga

SEQ ID NO: 9581 - DNA, 25 bp, S. cerevisiae
agcttcctgttcctccaatgaaaaa

SEQ ID NO: 9582 - DNA, 25 bp, S. cerevisiae
agcccttctcccgtaagaaaatcag

SEQ ID NO: 9583 - DNA, 25 bp, S. cerevisiae
agcggcatttccactagactaactt

SEQ ID NO: 9584 - DNA, 25 bp, S. cerevisiae
agcgtcgttgcggttggttagactt

SEQ ID NO: 9585 - DNA, 25 bp, S. cerevisiae
agctttgtgtgctctggtggcataa

SEQ ID NO: 9586 - DNA, 25 bp, S. cerevisiae
agctttgtgctgtatcttggagaac

SEQ ID NO: 9587 - DNA, 25 bp, S. cerevisiae
agcatttggatgcacctgtgggacc

SEQ ID NO: 9588 - DNA, 25 bp, S. cerevisiae
agcatcattgaatcgccgctaaatt

SEQ ID NO: 9589 - DNA, 25 bp, S. cerevisiae
agctttatatcaggccgctgcaaag

SEQ ID NO: 9590 - DNA, 25 bp, S. cerevisiae
agcttcatcttacaagcgcgactcg

SEQ ID NO: 9591 - DNA, 25 bp, S. cerevisiae
agcatgctatttctcaaggcactcc

SEQ ID NO: 9592 - DNA, 25 bp, S. cerevisiae
agcatatccagcttatcgaactacc

SEQ ID NO: 9593 - DNA, 25 bp, S. cerevisiae
agctatctagtattggtgactctac

SEQ ID NO: 9594 - DNA, 25 bp, S. cerevisiae
acttacagccagttgacatcaagcc

SEQ ID NO: 9595 - DNA, 25 bp, S. cerevisiae
agcattagagccactgtcatttccc

SEQ ID NO: 9596 - DNA, 25 bp, S. cerevisiae
agcttcgatggatctcactttacaa

SEQ ID NO: 9597 - DNA, 25 bp, S. cerevisiae
actctagaccattccatttggacga

SEQ ID NO: 9598 - DNA, 25 bp, S. cerevisiae
acgtcaagccatcaacttgggtcaa

SEQ ID NO: 9599 - DNA, 25 bp, S. cerevisiae
agcttaccgtgccagaaccatctaa

SEQ ID NO: 9600 - DNA, 25 bp, S. cerevisiae
agcatctgcttcttcccaaagatga

SEQ ID NO: 9601 - DNA, 25 bp, S. cerevisiae
agcatagctgtcactttccatgaga

SEQ ID NO: 9602 - DNA, 25 bp, S. cerevisiae
agcattcctttcctgagaaggcaga

SEQ ID NO: 9603 - DNA, 25 bp, S. cerevisiae
agctaccgaaactagttctgctgtt

SEQ ID NO: 9604 - DNA, 25 bp, S. cerevisiae
acccctatacttattgaccgtctgt

SEQ ID NO: 9605 - DNA, 25 bp, S. cerevisiae
agcccctgaatctttgttgactggt

SEQ ID NO: 9606 - DNA, 25 bp, S. cerevisiae
agcattctttaaactccacacagca

SEQ ID NO: 9607 - DNA, 25 bp, S. cerevisiae
agcattttgtctagaatccctcgtg

SEQ ID NO: 9608 - DNA, 25 bp, S. cerevisiae
agctgttagtgcacaatgccccgaa

SEQ ID NO: 9609 - DNA, 25 bp, S. cerevisiae
agcattgtggactgcaatttccgaa

SEQ ID NO: 9610 - DNA, 25 bp, S. cerevisiae
agctaaggactttgctttacagaag

SEQ ID NO: 9611 - DNA, 25 bp, S. cerevisiae
agcatgccaaggctctgcttgaaaa

SEQ ID NO: 9612 - DNA, 25 bp, S. cerevisiae
agctgagaaggtcccttacctaaag

SEQ ID NO: 9613 - DNA, 25 bp, S. cerevisiae
agctctactttccatttgagttcaa

SEQ ID NO: 9614 - DNA, 25 bp, S. cerevisiae
agcgataccccattcgatgagagta

SEQ ID NO: 9615 - DNA, 25 bp, S. cerevisiae
agctcagctgctatacgtcaaggtc

SEQ ID NO: 9616 - DNA, 25 bp, S. cerevisiae
agcttcagggctatggtttgttcta

SEQ ID NO: 9617 - DNA, 25 bp, S. cerevisiae
agctcaatggcttactcgtttttca

SEQ ID NO: 9618 - DNA, 25 bp, S. cerevisiae
agctatctgacttgaatcgtttctt

SEQ ID NO: 9619 - DNA, 25 bp, S. cerevisiae
agcttctcctagttccagactgaat

SEQ ID NO: 9620 - DNA, 25 bp, S. cerevisiae
agcctactcggttaacgttgctagt

SEQ ID NO: 9621 - DNA, 25 bp, S. cerevisiae
agctggtacgcggtatgtcacttga

SEQ ID NO: 9622 - DNA, 25 bp, S. cerevisiae
agcggatcctcagtatcattgcagc

SEQ ID NO: 9623 - DNA, 25 bp, S. cerevisiae
agcgcgcagcctagtgtgcaaagct

SEQ ID NO: 9624 - DNA, 25 bp, S. cerevisiae
agcggaactgcttcaacttactgag

SEQ ID NO: 9625 - DNA, 25 bp, S. cerevisiae
agcggcttagtatatgtctgggaca

SEQ ID NO: 9626 - DNA, 25 bp, S. cerevisiae
agcgttcatgaactgcagctgattc

SEQ ID NO: 9627 - DNA, 25 bp, S. cerevisiae
agcttttgagttgctcgatgctttt

SEQ ID NO: 9628 - DNA, 25 bp, S. cerevisiae
agctggtgtggtacctcatgacatt

SEQ ID NO: 9629 - DNA, 25 bp, S. cerevisiae
agcggaggaggagcttgcatcataa

SEQ ID NO: 9630 - DNA, 25 bp, S. cerevisiae
agcgggctagggactctgaatcata

SEQ ID NO: 9631 - DNA, 25 bp, S. cerevisiae
agcgaggaattgacgagtatctgga

SEQ ID NO: 9632 - DNA, 25 bp, S. cerevisiae
agcggcttttcaggcaacgccagta

SEQ ID NO: 9633 - DNA, 25 bp, S. cerevisiae
agctttcttctatgaccagcgcaaa

SEQ ID NO: 9634 - DNA, 25 bp, S. cerevisiae
agctcagctttcaacctttaacggg

SEQ ID NO: 9635 - DNA, 25 bp, S. cerevisiae
agctgtgtggtacatttcttacgga

SEQ ID NO: 9636 - DNA, 25 bp, S. cerevisiae
agctgtcaaacaacagggtcccttg

SEQ ID NO: 9637 - DNA, 25 bp, S. cerevisiae
agcgtgatctgctgtctgacatctt

SEQ ID NO: 9638 - DNA, 25 bp, S. cerevisiae
agctagaattgctttgagacacttg

SEQ ID NO: 9639 - DNA, 25 bp, S. cerevisiae
agcggtaaatctagcagtgcctcat

SEQ ID NO: 9640 - DNA, 25 bp, S. cerevisiae
agcttgctaaaatctgccgcatctg

SEQ ID NO: 9641 - DNA, 25 bp, S. cerevisiae
agcatttgatgagcttgtccttaaa

SEQ ID NO: 9642 - DNA, 25 bp, S. cerevisiae
agctcgtgggccaatactctggaaa

SEQ ID NO: 9643 - DNA, 25 bp, S. cerevisiae
agctcttatgccatggttttcacca

SEQ ID NO: 9644 - DNA, 25 bp, S. cerevisiae
agccgctaacaacgtctttaccaat

SEQ ID NO: 9645 - DNA, 25 bp, S. cerevisiae
agcccaatactacatgttccaagcc

SEQ ID NO: 9646 - DNA, 25 bp, S. cerevisiae
agccctaatcctaatgatccgctag

SEQ ID NO: 9647 - DNA, 25 bp, S. cerevisiae
agcccttcaccgcagtaaataatgg

SEQ ID NO: 9648 - DNA, 25 bp, S. cerevisiae
accaattgcccgacgtacaaggagg

SEQ ID NO: 9649 - DNA, 25 bp, S. cerevisiae
agcttctttctcatccttttagtga

SEQ ID NO: 9650 - DNA, 25 bp, S. cerevisiae
agctaccacgtactttttcacaatg

SEQ ID NO: 9651 - DNA, 25 bp, S. cerevisiae
agcttacactttatacatgaacggt

SEQ ID NO: 9652 - DNA, 25 bp, S. cerevisiae
agcttgggcaattgctgaacatatc

SEQ ID NO: 9653 - DNA, 25 bp, S. cerevisiae
agctcaagagcgtgccaagtctcat

SEQ ID NO: 9654 - DNA, 25 bp, S. cerevisiae
agctcatatatcatctaccagacca

SEQ ID NO: 9655 - DNA, 25 bp, S. cerevisiae
agcattatctgccaattcctcgaat

SEQ ID NO: 9656 - DNA, 25 bp, S. cerevisiae
agctcatctgtatgctttccagaag

SEQ ID NO: 9657 - DNA, 25 bp, S. cerevisiae
agctcacgatgctgcatttccagaa

SEQ ID NO: 9658 - DNA, 25 bp, S. cerevisiae
agcattgctgctggtgaacatcact

SEQ ID NO: 9659 - DNA, 25 bp, S. cerevisiae
agctgcttctgccaagatcgaatct

SEQ ID NO: 9660 - DNA, 25 bp, S. cerevisiae
acgcttcagaagctcgaatcaaggc

SEQ ID NO: 9661 - DNA, 25 bp, S. cerevisiae
agcgtccatgaacccagtactgaag

SEQ ID NO: 9662 - DNA, 25 bp, S. cerevisiae
agcgagatcagttactttgcccatc

SEQ ID NO: 9663 - DNA, 25 bp, S. cerevisiae
agctgcagacaattttgccgtcgtc

SEQ ID NO: 9664 - DNA, 25 bp, S. cerevisiae
agcttcaggtctcgtagtcctagag

SEQ ID NO: 9665 - DNA, 25 bp, S. cerevisiae
agctaggcttgcagaccgtcattag

SEQ ID NO: 9666 - DNA, 25 bp, S. cerevisiae
agcgttttcggacatgcatcattga

SEQ ID NO: 9667 - DNA, 25 bp, S. cerevisiae
agcttcttctcagacattcttatga

SEQ ID NO: 9668 - DNA, 25 bp, S. cerevisiae
agctgctaacgtttctaccaatggt

SEQ ID NO: 9669 - DNA, 25 bp, S. cerevisiae
agctgctaaagcttctcaatctaga

SEQ ID NO: 9670 - DNA, 25 bp, S. cerevisiae
agctccacctttacagtctttgaaa

SEQ ID NO: 9671 - DNA, 25 bp, S. cerevisiae
agcgacaccttcctcggatcaaaat

SEQ ID NO: 9672 - DNA, 25 bp, S. cerevisiae
agctttcgtttgatcaattgtccag

SEQ ID NO: 9673 - DNA, 25 bp, S. cerevisiae
agctttgccgtattctcatttgtag

SEQ ID NO: 9674 - DNA, 25 bp, S. cerevisiae
agcttttggaatctcttagtgttga

SEQ ID NO: 9675 - DNA, 25 bp, S. cerevisiae
agctcaaatatttaccatcctggat

SEQ ID NO: 9676 - DNA, 25 bp, S. cerevisiae
agctgcaagttcttacactcgaggg

SEQ ID NO: 9677 - DNA, 25 bp, S. cerevisiae
actaaacgtgaatctcaacctgccg

SEQ ID NO: 9678 - DNA, 25 bp, S. cerevisiae
actagaacgcatattccaccttgga

SEQ ID NO: 9679 - DNA, 25 bp, S. cerevisiae
agctaagggtatcccaggtcttact

SEQ ID NO: 9680 - DNA, 25 bp, S. cerevisiae
agcggacaggttcacggtatcattc

SEQ ID NO: 9681 - DNA, 25 bp, S. cerevisiae
agcggatggagtactagcggtctat

SEQ ID NO: 9682 - DNA, 25 bp, S. cerevisiae
agctggtgggctatcaggctccatt

SEQ ID NO: 9683 - DNA, 25 bp, S. cerevisiae
agctcgtggttcttatttgcgtgtt

SEQ ID NO: 9684 - DNA, 25 bp, S. cerevisiae
agcttctttgctatgtacctgatga

SEQ ID NO: 9685 - DNA, 25 bp, S. cerevisiae
agcttcctggcaagattatctccac

SEQ ID NO: 9686 - DNA, 25 bp, S. cerevisiae
agctcgtaaacgtggtatgcatgat

SEQ ID NO: 9687 - DNA, 25 bp, S. cerevisiae
agctgttctgactcttaccatatta

SEQ ID NO: 9688 - DNA, 25 bp, S. cerevisiae
agcttctcaactgcaatgatccaag

SEQ ID NO: 9689 - DNA, 25 bp, S. cerevisiae
agctatgccaatgcctatgtcgaca

SEQ ID NO: 9690 - DNA, 25 bp, S. cerevisiae
agcgggacgtcggtcatcgaagtta

SEQ ID NO: 9691 - DNA, 25 bp, S. cerevisiae
agctcattgtcttttctttcttcat

SEQ ID NO: 9692 - DNA, 25 bp, S. cerevisiae
agctcttcgtcgtccagtttgtata

SEQ ID NO: 9693 - DNA, 25 bp, S. cerevisiae
agctgaagttgtctcctaatgcgga

SEQ ID NO: 9694 - DNA, 25 bp, S. cerevisiae
agctaactttcccttatatgcatgc

SEQ ID NO: 9695 - DNA, 25 bp, S. cerevisiae
agcgagcttgaaggcgccacgaaag

SEQ ID NO: 9696 - DNA, 25 bp, S. cerevisiae
agctatctccaaggctctatccaaa

SEQ ID NO: 9697 - DNA, 25 bp, S. cerevisiae
agctatctccaaggctctatccaag

SEQ ID NO: 9698 - DNA, 25 bp, S. cerevisiae
agctactctacaactgggccaggaa

SEQ ID NO: 9699 - DNA, 25 bp, S. cerevisiae
agctatttgccgactctcttagaaa

SEQ ID NO: 9700 - DNA, 25 bp, S. cerevisiae
agctctttagcggtgcgtgtactaa

SEQ ID NO: 9701 - DNA, 25 bp, S. cerevisiae
agctgttaagcttacctacttccaa

SEQ ID NO: 9702 - DNA, 25 bp, S. cerevisiae
agctttgaatattactttgcctccg

SEQ ID NO: 9703 - DNA, 25 bp, S. cerevisiae
accttccaagaagagtgccactgtc

SEQ ID NO: 9704 - DNA, 25 bp, S. cerevisiae
agccttgccaacagggagttcttca

SEQ ID NO: 9705 - DNA, 25 bp, S. cerevisiae
agctttccatgagttgggcattcca

SEQ ID NO: 9706 - DNA, 25 bp, S. cerevisiae
agctttcatttctgcattgtttctt

SEQ ID NO: 9707 - DNA, 25 bp, S. cerevisiae
agctttgtcatttccaagtctctga

SEQ ID NO: 9708 - DNA, 25 bp, S. cerevisiae
agctttgccatttgcactcggtatc

SEQ ID NO: 9709 - DNA, 25 bp, S. cerevisiae
agctgttgactctcattctggttat

SEQ ID NO: 9710 - DNA, 25 bp, S. cerevisiae
agctgcttacttattattggttcaa

SEQ ID NO: 9711 - DNA, 25 bp, S. cerevisiae
agcgtcgtgtattggtttcggcagc

SEQ ID NO: 9712 - DNA, 25 bp, S. cerevisiae
agcgatggtgacaaggtttccctgg

SEQ ID NO: 9713 - DNA, 25 bp, S. cerevisiae
agctggtactactgaatctcctggt

SEQ ID NO: 9714 - DNA, 25 bp, S. cerevisiae
agctcagttttctatttcgtcgtgt

SEQ ID NO: 9715 - DNA, 25 bp, S. cerevisiae
agctggtacttatcacatcgtgttg

SEQ ID NO: 9716 - DNA, 25 bp, S. cerevisiae
agcggaacttctaggccgtgtggac

SEQ ID NO: 9717 - DNA, 25 bp, S. cerevisiae
agcggccgttctttgcatgagtgga

SEQ ID NO: 9718 - DNA, 25 bp, S. cerevisiae
agcgcccgttgtgattgtggtgaac

SEQ ID NO: 9719 - DNA, 25 bp, S. cerevisiae
agctcccttttcgacgtcagaataa

SEQ ID NO: 9720 - DNA, 25 bp, S. cerevisiae
agctatcttaggttcctttctgagg

SEQ ID NO: 9721 - DNA, 25 bp, S. cerevisiae
agctggtttgagtttcttcttggat

SEQ ID NO: 9722 - DNA, 25 bp, S. cerevisiae
agctgatgttcctgatttcttgggt

SEQ ID NO: 9723 - DNA, 25 bp, S. cerevisiae
acgtgctgaagctcaattgccgggc

SEQ ID NO: 9724 - DNA, 25 bp, S. cerevisiae
agctggagatactttcctgggcggt

SEQ ID NO: 9725 - DNA, 25 bp, S. cerevisiae
agcggaatacttacctttgcagtgg

SEQ ID NO: 9726 - DNA, 25 bp, S. cerevisiae
agctgccgattcattcgatttggtt

SEQ ID NO: 9727 - DNA, 25 bp, S. cerevisiae
agccacgaatcctcttttgaaaagc

SEQ ID NO: 9728 - DNA, 25 bp, S. cerevisiae
agctccggaagccttttcgatgaaa

SEQ ID NO: 9729 - DNA, 25 bp, S. cerevisiae
agcgtcgcgtactgtttcagcataa

SEQ ID NO: 9730 - DNA, 25 bp, S. cerevisiae
agctatccattgtttctgcatatga

SEQ ID NO: 9731 - DNA, 25 bp, S. cerevisiae
agctcacccgcgatattctgtatag

SEQ ID NO: 9732 - DNA, 25 bp, S. cerevisiae
agctccacctatcaattatgctagg

SEQ ID NO: 9733 - DNA, 25 bp, S. cerevisiae
agctattcagtataccatccctttt

SEQ ID NO: 9734 - DNA, 25 bp, S. cerevisiae
agctcttattttcaaggcactcctg

SEQ ID NO: 9735 - DNA, 25 bp, S. cerevisiae
agctcgttgtttgagagtcctccaa

SEQ ID NO: 9736 - DNA, 25 bp, S. cerevisiae
agctcctggcgttgaaactgttacc

SEQ ID NO: 9737 - DNA, 25 bp, S. cerevisiae
agctgccgcggaaaagcatcgtgtt

SEQ ID NO: 9738 - DNA, 25 bp, S. cerevisiae
agctggtgccaagtgttgttctgat

SEQ ID NO: 9739 - DNA, 25 bp, S. cerevisiae
agctgcgtggcactccattttagat

SEQ ID NO: 9740 - DNA, 25 bp, S. cerevisiae
agctgcgtcggtgggttctttgaaa

SEQ ID NO: 9741 - DNA, 25 bp, S. cerevisiae
agctgaggacgagtgcttttgcctt

SEQ ID NO: 9742 - DNA, 25 bp, S. cerevisiae
agctcggatgcgtatttgttggtca

SEQ ID NO: 9743 - DNA, 25 bp, S. cerevisiae
agctcaggagccgatacgttacaca

SEQ ID NO: 9744 - DNA, 25 bp, S. cerevisiae
agcctgatctcattgatgctcaaga

SEQ ID NO: 9745 - DNA, 25 bp, S. cerevisiae
agctgttgctattatctgatgagag

SEQ ID NO: 9746 - DNA, 25 bp, S. cerevisiae
agctgctggtcaactccatgagaga

SEQ ID NO: 9747 - DNA, 25 bp, S. cerevisiae
agctgtgaacactaccatcgatgac

SEQ ID NO: 9748 - DNA, 25 bp, S. cerevisiae
agctgtctgatagagtactgtcact

SEQ ID NO: 9749 - DNA, 25 bp, S. cerevisiae
agctgtctgcaatcctgaattcatt

SEQ ID NO: 9750 - DNA, 25 bp, S. cerevisiae
agctgatctgttggcctatgtatat

SEQ ID NO: 9751 - DNA, 25 bp, S. cerevisiae
agcgttaccactgctgtctaagaac

SEQ ID NO: 9752 - DNA, 25 bp, S. cerevisiae
agctgtccaccagtgcttttatgga

SEQ ID NO: 9753 - DNA, 25 bp, S. cerevisiae
agctgagttaccagctctaactctt

SEQ ID NO: 9754 - DNA, 25 bp, S. cerevisiae
agcggattaccttttatacctaatg

SEQ ID NO: 9755 - DNA, 25 bp, S. cerevisiae
gagggcggttccacaatttttgtca

SEQ ID NO: 9756 - DNA, 25 bp, S. cerevisiae
agcgacgttttatgcaatgtttttc

SEQ ID NO: 9757 - DNA, 25 bp, S. cerevisiae
agcgtaggtttatcactcaatcttt

SEQ ID NO: 9758 - DNA, 25 bp, S. cerevisiae
agctgctaaattcgaaacctactta

SEQ ID NO: 9759 - DNA, 25 bp, S. cerevisiae
agctctggcgttgggtagacatctt

SEQ ID NO: 9760 - DNA, 25 bp, S. cerevisiae
agctgctggtttcgctattggtatt

SEQ ID NO: 9761 - DNA, 25 bp, S. cerevisiae
agctgctggtccagcttctgctggc

SEQ ID NO: 9762 - DNA, 25 bp, S. cerevisiae
agcggcttccacgattgagacacag

SEQ ID NO: 9763 - DNA, 25 bp, S. cerevisiae
agcggttccgcattcgcaagaaaca

SEQ ID NO: 9764 - DNA, 25 bp, S. cerevisiae
agcgggcctcctttgcaagagaata

SEQ ID NO: 9765 - DNA, 25 bp, S. cerevisiae
agctctttttgaattatggtgcaca

SEQ ID NO: 9766 - DNA, 25 bp, S. cerevisiae
acgaaattgtcttgtcaggtaactc

SEQ ID NO: 9767 - DNA, 25 bp, S. cerevisiae
agcgaaattaatatcagtgtcaagc

SEQ ID NO: 9768 - DNA, 25 bp, S. cerevisiae
agcggccctaataacagtgttcctc

SEQ ID NO: 9769 - DNA, 25 bp, S. cerevisiae
agcgacgcctattcaacaggttctt

SEQ ID NO: 9770 - DNA, 25 bp, S. cerevisiae
agcgcggcgaggtatacacttcaaa

SEQ ID NO: 9771 - DNA, 25 bp, S. cerevisiae
agcgtttcgaactcatatagtgcca

SEQ ID NO: 9772 - DNA, 25 bp, S. cerevisiae
agcgtgttccagattacttgcttcc

SEQ ID NO: 9773 - DNA, 25 bp, S. cerevisiae
agcggtgtcactggtttattgttca

SEQ ID NO: 9774 - DNA, 25 bp, S. cerevisiae
agcggaggaccatcgtttattgatt

SEQ ID NO: 9775 - DNA, 25 bp, S. cerevisiae
agcggcgtaccatgcgaagatattg

SEQ ID NO: 9776 - DNA, 25 bp, S. cerevisiae
agcgggtttccgatgaatattgtac

SEQ ID NO: 9777 - DNA, 25 bp, S. cerevisiae
agcgttactcccgttatgacaattt

SEQ ID NO: 9778 - DNA, 25 bp, S. cerevisiae
cagttaacttcaactttggcgtttg

SEQ ID NO: 9779 - DNA, 25 bp, S. cerevisiae
agctcaacacgctgttattttggat

SEQ ID NO: 9780 - DNA, 25 bp, S. cerevisiae
agctcaacacgctgtcattttagac

SEQ ID NO: 9781 - DNA, 25 bp, S. cerevisiae
agctcaacggctttctattcaataa

SEQ ID NO: 9782 - DNA, 25 bp, S. cerevisiae
agctctgccagataacttgtcaaat

SEQ ID NO: 9783 - DNA, 25 bp, S. cerevisiae
acgctgctgatataactgatggaaa

SEQ ID NO: 9784 - DNA, 25 bp, S. cerevisiae
agcgagcattctccacttatttatg

SEQ ID NO: 9785 - DNA, 25 bp, S. cerevisiae
agctgactcatctgtgattttccgt

SEQ ID NO: 9786 - DNA, 25 bp, S. cerevisiae
agctgctgctgctatgttgttataa

SEQ ID NO: 9787 - DNA, 25 bp, S. cerevisiae
agctcgtgacaattcccaagttttt

SEQ ID NO: 9788 - DNA, 25 bp, S. cerevisiae
agctctggcaaatttcccatctttt

SEQ ID NO: 9789 - DNA, 25 bp, S. cerevisiae
agcgatggtggtactgcccgtactc

SEQ ID NO: 9790 - DNA, 25 bp, S. cerevisiae
agccatactagccacagttctgaat

SEQ ID NO: 9791 - DNA, 25 bp, S. cerevisiae
agcgaattagccgagatcctacctg

SEQ ID NO: 9792 - DNA, 25 bp, S. cerevisiae
agcgaatacagccaagagccgactt

SEQ ID NO: 9793 - DNA, 25 bp, S. cerevisiae
agcgacataagcctactgataacaa

SEQ ID NO: 9794 - DNA, 25 bp, S. cerevisiae
agcgaccacacttatggctggcaaa

SEQ ID NO: 9795 - DNA, 25 bp, S. cerevisiae
agcccgcatcaatcatggcataatg

SEQ ID NO: 9796 - DNA, 25 bp, S. cerevisiae
agctcctctgcaaggcttcaaggca

SEQ ID NO: 9797 - DNA, 25 bp, S. cerevisiae
agctctcccacgtatccagaggaag

SEQ ID NO: 9798 - DNA, 25 bp, S. cerevisiae
agctgctgccgctgaagaaggtgaa

SEQ ID NO: 9799 - DNA, 25 bp, S. cerevisiae
agctggctgcgaattttactggaaa

SEQ ID NO: 9800 - DNA, 25 bp, S. cerevisiae
acgggagaccttctatggtacccat

SEQ ID NO: 9801 - DNA, 25 bp, S. cerevisiae
agccgaaaccttctctgggacgaag

SEQ ID NO: 9802 - DNA, 25 bp, S. cerevisiae
agcgtatcatcagttggtgccacac

SEQ ID NO: 9803 - DNA, 25 bp, S. cerevisiae
agcgccatatcaccttgcaaataat

SEQ ID NO: 9804 - DNA, 25 bp, S. cerevisiae
agctccagcacaactcctaatataa

SEQ ID NO: 9805 - DNA, 25 bp, S. cerevisiae
agctcttcagccattattgccaatt

SEQ ID NO: 9806 - DNA, 25 bp, S. cerevisiae
agccgctgtgttattaccgttggat

SEQ ID NO: 9807 - DNA, 25 bp, S. cerevisiae
agctcgctaacttcggatactttgg

SEQ ID NO: 9808 - DNA, 25 bp, S. cerevisiae
agctgctgcagttaccgaagtggtt

SEQ ID NO: 9809 - DNA, 25 bp, S. cerevisiae
agctgctcgtcatttaaccggtttg

SEQ ID NO: 9810 - DNA, 25 bp, S. cerevisiae
agctcctccacaaagaccaagattt

SEQ ID NO: 9811 - DNA, 25 bp, S. cerevisiae
agctccacctcaaagaccaagattc

SEQ ID NO: 9812 - DNA, 25 bp, S. cerevisiae
agctccacctcaaagaccaagattc

SEQ ID NO: 9813 - DNA, 25 bp, S. cerevisiae
agctggctccctagctaaagtaaaa

SEQ ID NO: 9814 - DNA, 25 bp, S. cerevisiae
agctggttcagctgctaaagcttct

SEQ ID NO: 9815 - DNA, 25 bp, S. cerevisiae
agcgcctcaagaaaatgatgctgaa

SEQ ID NO: 9816 - DNA, 25 bp, S. cerevisiae
agccactccgagaactttactaggt

SEQ ID NO: 9817 - DNA, 25 bp, S. cerevisiae
agcccaatgctggatttactggccc

SEQ ID NO: 9818 - DNA, 25 bp, S. cerevisiae
agctgctatgggaaccggtgtcaca

SEQ ID NO: 9819 - DNA, 25 bp, S. cerevisiae
agccttggacaagcagagcatgaaa

SEQ ID NO: 9820 - DNA, 25 bp, S. cerevisiae
agcgtactgatctgcacagccaaac

SEQ ID NO: 9821 - DNA, 25 bp, S. cerevisiae
agcgtgtcaaattctggcgcatcca

SEQ ID NO: 9822 - DNA, 25 bp, S. cerevisiae
agcgtacacgtctaggtgcattcaa

SEQ ID NO: 9823 - DNA, 25 bp, S. cerevisiae
agcgattacttcagcgatattcacg

SEQ ID NO: 9824 - DNA, 25 bp, S. cerevisiae
agcgtccagctacagcgttatacta

SEQ ID NO: 9825 - DNA, 25 bp, S. cerevisiae
agctgctacagctacttagttctac

SEQ ID NO: 9826 - DNA, 25 bp, S. cerevisiae
agctctgagcaggacaattctttca

SEQ ID NO: 9827 - DNA, 25 bp, S. cerevisiae
agccaacaccaagatcggtgctaag

SEQ ID NO: 9828 - DNA, 25 bp, S. cerevisiae
agctgcagcttttgaacgacttgat

SEQ ID NO: 9829 - DNA, 25 bp, S. cerevisiae
agctgcctctaaaatatctcctctt

SEQ ID NO: 9830 - DNA, 25 bp, S. cerevisiae
agctgattttacatgggctccatct

SEQ ID NO: 9831 - DNA, 25 bp, S. cerevisiae
agcgatatgttttgcgcaaggccat

SEQ ID NO: 9832 - DNA, 25 bp, S. cerevisiae
agcgatcaagtacgagcaaggcgat

SEQ ID NO: 9833 - DNA, 25 bp, S. cerevisiae
agcgctacaaccaacaagggactta

SEQ ID NO: 9834 - DNA, 25 bp, S. cerevisiae
agccgtaatccaactggacgatctt

SEQ ID NO: 9835 - DNA, 25 bp, S. cerevisiae
agccgttcaattactcacaaccgat

SEQ ID NO: 9836 - DNA, 25 bp, S. cerevisiae
agctgatgttatttcccacatccca

SEQ ID NO: 9837 - DNA, 25 bp, S. cerevisiae
agcggtaccattcccattcgaaaat

SEQ ID NO: 9838 - DNA, 25 bp, S. cerevisiae
agctgctactgggattgcttgtatc

SEQ ID NO: 9839 - DNA, 25 bp, S. cerevisiae
agctgcaaatgcgtactcttatatc

SEQ ID NO: 9840 - DNA, 25 bp, S. cerevisiae
agctgaagttgtgctgctttgtcaa

SEQ ID NO: 9841 - DNA, 25 bp, S. cerevisiae
agctcctcatggcacttacaatggt

SEQ ID NO: 9842 - DNA, 25 bp, S. cerevisiae
agctcctcggctttcaaagtagtct

SEQ ID NO: 9843 - DNA, 25 bp, S. cerevisiae
agcccatagctgtgtcttcttttat

SEQ ID NO: 9844 - DNA, 25 bp, S. cerevisiae
agccggactcagatattgttgcgtt

SEQ ID NO: 9845 - DNA, 25 bp, S. cerevisiae
agccctctcaggacaacgtggatag

SEQ ID NO: 9846 - DNA, 25 bp, S. cerevisiae
agcgctggcatttaatactcgtttc

SEQ ID NO: 9847 - DNA, 25 bp, S. cerevisiae
agcggaattgcatttgacagcgttt

SEQ ID NO: 9848 - DNA, 25 bp, S. cerevisiae
agcgtagtaatttgcgatcctccaa

SEQ ID NO: 9849 - DNA, 25 bp, S. cerevisiae
agctggtgctctttcgttattattt

SEQ ID NO: 9850 - DNA, 25 bp, S. cerevisiae
agctggatgctgctttgttgcaaga

SEQ ID NO: 9851 - DNA, 25 bp, S. cerevisiae
agctggatcgaattcgccatgtatc

SEQ ID NO: 9852 - DNA, 25 bp, S. cerevisiae
agcgatggccaagtccaagctacta

SEQ ID NO: 9853 - DNA, 25 bp, S. cerevisiae
agcgggccatatagcaatacaccaa

SEQ ID NO: 9854 - DNA, 25 bp, S. cerevisiae
agcggttgttcagcgagatcgcacc

SEQ ID NO: 9855 - DNA, 25 bp, S. cerevisiae
actggctatagttgtcggatggcaa

SEQ ID NO: 9856 - DNA, 25 bp, S. cerevisiae
agctgcgtatgtgtggtcttgaatc

SEQ ID NO: 9857 - DNA, 25 bp, S. cerevisiae
agcggctcatgggaagtctctaaat

SEQ ID NO: 9858 - DNA, 25 bp, S. cerevisiae
agcggctatgacgatcgatccttaa

SEQ ID NO: 9859 - DNA, 25 bp, S. cerevisiae
agcgcggttccaagtgctcttaaag

SEQ ID NO: 9860 - DNA, 25 bp, S. cerevisiae
agctgtattatcgtaccctaccaag

SEQ ID NO: 9861 - DNA, 25 bp, S. cerevisiae
agctgttttcaatttagcctccaag

SEQ ID NO: 9862 - DNA, 25 bp, S. cerevisiae
agcgattttcaattttcctgtccga

SEQ ID NO: 9863 - DNA, 25 bp, S. cerevisiae
agcgatgtttgtttggtctcgtcca

SEQ ID NO: 9864 - DNA, 25 bp, S. cerevisiae
agctggttatgtttccttgtatcct

SEQ ID NO: 9865 - DNA, 25 bp, S. cerevisiae
agcggtcaagtttttctgtccatct

SEQ ID NO: 9866 - DNA, 25 bp, S. cerevisiae
acaggtcgagggtctaatgtcctta

SEQ ID NO: 9867 - DNA, 25 bp, S. cerevisiae
cgggatcggctgatagtttctttca

SEQ ID NO: 9868 - DNA, 25 bp, S. cerevisiae
cagcgactcggctctagtttaggga

SEQ ID NO: 9869 - DNA, 25 bp, S. cerevisiae
agctgacaccgccatgagagatttg

SEQ ID NO: 9870 - DNA, 25 bp, S. cerevisiae
agcgactaagcgttgctcatcctgc

SEQ ID NO: 9871 - DNA, 25 bp, S. cerevisiae
agcggcttacgattttcctggttca

SEQ ID NO: 9872 - DNA, 25 bp, S. cerevisiae
agccgtctacgagcaattttcttca

SEQ ID NO: 9873 - DNA, 25 bp, S. cerevisiae
accctccaccacaaagggagctgga

SEQ ID NO: 9874 - DNA, 25 bp, S. cerevisiae
acctgtaccttttgtggaactcctg

SEQ ID NO: 9875 - DNA, 25 bp, S. cerevisiae
agcctaaactttgctctaaagccta

SEQ ID NO: 9876 - DNA, 25 bp, S. cerevisiae
agccgcatatgagttaccgctatta

SEQ ID NO: 9877 - DNA, 25 bp, S. cerevisiae
accaatatacttgtcgcccttgttg

SEQ ID NO: 9878 - DNA, 25 bp, S. cerevisiae
accagaagagtttttgcccgcttgg

SEQ ID NO: 9879 - DNA, 25 bp, S. cerevisiae
actaaaagttcgttcaaggctctga

SEQ ID NO: 9880 - DNA, 25 bp, S. cerevisiae
accaaaagacctgttacgcctgatt

SEQ ID NO: 9881 - DNA, 25 bp, S. cerevisiae
acggttatgcctccggaagtagcca

SEQ ID NO: 9882 - DNA, 25 bp, S. cerevisiae
actggtttggtcagaaagtacgact

SEQ ID NO: 9883 - DNA, 25 bp, S. cerevisiae
cactggtttggtcagaaagtacgac

SEQ ID NO: 9884 - DNA, 25 bp, S. cerevisiae
actccatttggtcttaagtcctgaa

SEQ ID NO: 9885 - DNA, 25 bp, S. cerevisiae
acctctaactctgtttgaacctgac

SEQ ID NO: 9886 - DNA, 25 bp, S. cerevisiae
agcccaactttcctattaagctgcg

SEQ ID NO: 9887 - DNA, 25 bp, S. cerevisiae
agcgcgcagtgcatctttcaaaagt

SEQ ID NO: 9888 - DNA, 25 bp, S. cerevisiae
agccggacgcagacaataacacaca

SEQ ID NO: 9889 - DNA, 25 bp, S. cerevisiae
acggatgaccatgaccccaaaactg

SEQ ID NO: 9890 - DNA, 25 bp, S. cerevisiae
agctgtcggtgtttgcgccacagaa

SEQ ID NO: 9891 - DNA, 25 bp, S. cerevisiae
agcgccatatgctgttctgtcacaa

SEQ ID NO: 9892 - DNA, 25 bp, S. cerevisiae
agccgatagggcgtctgtagaaatt

SEQ ID NO: 9893 - DNA, 25 bp, S. cerevisiae
accaagatcggtgctaagagaattc

SEQ ID NO: 9894 - DNA, 25 bp, S. cerevisiae
accaagaaggctgaagagactattt

SEQ ID NO: 9895 - DNA, 25 bp, S. cerevisiae
acgcaagacaacaggcaaaataatt

SEQ ID NO: 9896 - DNA, 25 bp, S. cerevisiae
agccagtggcaactcctgcaaagaa

SEQ ID NO: 9897 - DNA, 25 bp, S. cerevisiae
agctgacttcaaatttgcaccacaa

SEQ ID NO: 9898 - DNA, 25 bp, S. cerevisiae
agcgttgcagccaattcacaatcaa

SEQ ID NO: 9899 - DNA, 25 bp, S. cerevisiae
agctgtctcagcaatatccacttta

SEQ ID NO: 9900 - DNA, 25 bp, S. cerevisiae
agcggcatagataaccctactcatg

SEQ ID NO: 9901 - DNA, 25 bp, S. cerevisiae
agctgtctatgcataagttcccaaa

SEQ ID NO: 9902 - DNA, 25 bp, S. cerevisiae
agcgctattgttgatgggccgccac

SEQ ID NO: 9903 - DNA, 25 bp, S. cerevisiae
agcgcatatttcatagataccgcgg

SEQ ID NO: 9904 - DNA, 25 bp, S. cerevisiae
agctgtatgattttattcctgcgga

SEQ ID NO: 9905 - DNA, 25 bp, S. cerevisiae
acctgatggtttatcctgggaggag

SEQ ID NO: 9906 - DNA, 25 bp, S. cerevisiae
agcgctctttttctttgttatgttg

SEQ ID NO: 9907 - DNA, 25 bp, S. cerevisiae
agcgatgtctacgtattgttttatg

SEQ ID NO: 9908 - DNA, 25 bp, S. cerevisiae
agcgcttcacgcgaatttttacagg

SEQ ID NO: 9909 - DNA, 25 bp, S. cerevisiae
agcctgcacaggacaacgacttaga

SEQ ID NO: 9910 - DNA, 25 bp, S. cerevisiae
agcctatcggcaatgaccactacaa

SEQ ID NO: 9911 - DNA, 25 bp, S. cerevisiae
agccaacggatgcatgccatacacg

SEQ ID NO: 9912 - DNA, 25 bp, S. cerevisiae
agcgcaagtgctgtcacggatagac

SEQ ID NO: 9913 - DNA, 25 bp, S. cerevisiae
agcgaagttttacggatgcatgcaa

SEQ ID NO: 9914 - DNA, 25 bp, S. cerevisiae
agcgcacccgtaatcaacatcaatg

SEQ ID NO: 9915 - DNA, 25 bp, S. cerevisiae
actgatattcgtgttgggactagaa

SEQ ID NO: 9916 - DNA, 25 bp, S. cerevisiae
acgttacgatagagccagcgggcca

SEQ ID NO: 9917 - DNA, 25 bp, S. cerevisiae
acgtccaagacgctatccgtgatag

SEQ ID NO: 9918 - DNA, 25 bp, S. cerevisiae
acctccactaactaatgctcgtatg

SEQ ID NO: 9919 - DNA, 25 bp, S. cerevisiae
agcctaccttgatcgtgaatgatgt

SEQ ID NO: 9920 - DNA, 25 bp, S. cerevisiae
agccaaaccatggatctgtagattt

SEQ ID NO: 9921 - DNA, 25 bp, S. cerevisiae
accacactagaggaggccgattcat

SEQ ID NO: 9922 - DNA, 25 bp, S. cerevisiae
accgactcagttgaccgcctttgga

SEQ ID NO: 9923 - DNA, 25 bp, S. cerevisiae
agcgacattggttaactcagactta

SEQ ID NO: 9924 - DNA, 25 bp, S. cerevisiae
agccggtggtgatttctcagatcct

SEQ ID NO: 9925 - DNA, 25 bp, S. cerevisiae
agctgggaactttcaaggccccatt

SEQ ID NO: 9926 - DNA, 25 bp, S. cerevisiae
accgtcaagcgtgcttctaaggctt

SEQ ID NO: 9927 - DNA, 25 bp, S. cerevisiae
accaacccaagttcttcatcattta

SEQ ID NO: 9928 - DNA, 25 bp, S. cerevisiae
agcctgatccaagggtcattacact

SEQ ID NO: 9929 - DNA, 25 bp, S. cerevisiae
agcgctttgcaaggtatctctactt

SEQ ID NO: 9930 - DNA, 25 bp, S. cerevisiae
agcctgctctagacgaagctaggga

SEQ ID NO: 9931 - DNA, 25 bp, S. cerevisiae
agccatgcaactactcaccaagggt

SEQ ID NO: 9932 - DNA, 25 bp, S. cerevisiae
actgtaccacattcctcaatgggtt

SEQ ID NO: 9933 - DNA, 25 bp, S. cerevisiae
agccgctcacactccagaaaaaact

SEQ ID NO: 9934 - DNA, 25 bp, S. cerevisiae
acgtgtccgccgcattaaaaagctt

SEQ ID NO: 9935 - DNA, 25 bp, S. cerevisiae
acggccctgggcataaaagatacta

SEQ ID NO: 9936 - DNA, 25 bp, S. cerevisiae
agcggttctggcgtgtttaagcaac

SEQ ID NO: 9937 - DNA, 25 bp, S. cerevisiae
agctggtcttattgcctctttaaaa

SEQ ID NO: 9938 - DNA, 25 bp, S. cerevisiae
agcggtctttcttcttgttctataa

SEQ ID NO: 9939 - DNA, 25 bp, S. cerevisiae
agcggatcttgtttattcgtctata

SEQ ID NO: 9940 - DNA, 25 bp, S. cerevisiae
agctggatcacgcttttcttcataa

SEQ ID NO: 9941 - DNA, 25 bp, S. cerevisiae
agcggctaaggccttcagttgatta

SEQ ID NO: 9942 - DNA, 25 bp, S. cerevisiae
agcggcaagtggatactctcgttac

SEQ ID NO: 9943 - DNA, 25 bp, S. cerevisiae
agcgaagcggagactacaactgtaa

SEQ ID NO: 9944 - DNA, 25 bp, S. cerevisiae
agcgacaagcgaccatagcaaccaa

SEQ ID NO: 9945 - DNA, 25 bp, S. cerevisiae
agcccaaggtggtacgaatcaatcc

SEQ ID NO: 9946 - DNA, 25 bp, S. cerevisiae
agcccaagcgccgtttgatatagac

SEQ ID NO: 9947 - DNA, 25 bp, S. cerevisiae
agcgccaattctcctaaaatcgatc

SEQ ID NO: 9948 - DNA, 25 bp, S. cerevisiae
agcgacttttatgcatgtggttttc

SEQ ID NO: 9949 - DNA, 25 bp, S. cerevisiae
agcgacggtgtcaatcatggatttc

SEQ ID NO: 9950 - DNA, 25 bp, S. cerevisiae
agcgagtttgtcgttgcatctccaa

SEQ ID NO: 9951 - DNA, 25 bp, S. cerevisiae
agccattcctgggttatctgcggga

SEQ ID NO: 9952 - DNA, 25 bp, S. cerevisiae
accatatgaggctagtgtcttacta

SEQ ID NO: 9953 - DNA, 25 bp, S. cerevisiae
agccattagacggtgccaggcaata

SEQ ID NO: 9954 - DNA, 25 bp, S. cerevisiae
agccaagagaccagatcatccatat

SEQ ID NO: 9955 - DNA, 25 bp, S. cerevisiae
agccaatgctactttgatcatccca

SEQ ID NO: 9956 - DNA, 25 bp, S. cerevisiae
accattgccagtaagatgtcccttg

SEQ ID NO: 9957 - DNA, 25 bp, S. cerevisiae
agccgctcaactttccaaggacgaa

SEQ ID NO: 9958 - DNA, 25 bp, S. cerevisiae
agccgctagagctattccaaaccaa

SEQ ID NO: 9959 - DNA, 25 bp, S. cerevisiae
agcctatcccagtggtatacgattt

SEQ ID NO: 9960 - DNA, 25 bp, S. cerevisiae
acgattggccctaacgacttagaga

SEQ ID NO: 9961 - DNA, 25 bp, S. cerevisiae
accttgggatcgtcggatttggcaa

SEQ ID NO: 9962 - DNA, 25 bp, S. cerevisiae
accagcgtatgtgtcgaaggcgtta

SEQ ID NO: 9963 - DNA, 25 bp, S. cerevisiae
agcccggcattcgactcgagggtaa

SEQ ID NO: 9964 - DNA, 25 bp, S. cerevisiae
agcccagtgtaaactcggtgcgtat

SEQ ID NO: 9965 - DNA, 25 bp, S. cerevisiae
agcccagcttcgagtgctgtactta

SEQ ID NO: 9966 - DNA, 25 bp, S. cerevisiae
agcctagctttgaagacgctgcctt

SEQ ID NO: 9967 - DNA, 25 bp, S. cerevisiae
agcgtcactcttatatcaggatcgt

SEQ ID NO: 9968 - DNA, 25 bp, S. cerevisiae
acccggttttatgttcgatgagcac

SEQ ID NO: 9969 - DNA, 25 bp, S. cerevisiae
accaaaatatctgacgttagcggca

SEQ ID NO: 9970 - DNA, 25 bp, S. cerevisiae
agcgcgaatcacacaagcatgcaga

SEQ ID NO: 9971 - DNA, 25 bp, S. cerevisiae
agcgcgttgttgaagattttggtaa

SEQ ID NO: 9972 - DNA, 25 bp, S. cerevisiae
agcctattttactactattgggaca

SEQ ID NO: 9973 - DNA, 25 bp, S. cerevisiae
agcgtatttagaagtttgggcgaca

SEQ ID NO: 9974 - DNA, 25 bp, S. cerevisiae
agcgatctttaaagctcattgggat

SEQ ID NO: 9975 - DNA, 25 bp, S. cerevisiae
agcgagttatcgtccaatatggtgt

SEQ ID NO: 9976 - DNA, 25 bp, S. cerevisiae
agccgctggtcctcaattcgagtaa

SEQ ID NO: 9977 - DNA, 25 bp, S. cerevisiae
acacctctgagttccacgttagtaa

SEQ ID NO: 9978 - DNA, 25 bp, S. cerevisiae
acatcagctgaaaagtgccgtctag

SEQ ID NO: 9979 - DNA, 25 bp, S. cerevisiae
accaattcatgatagctgcccatcg

SEQ ID NO: 9980 - DNA, 25 bp, S. cerevisiae
actaatcaaaaactccctcaaggag

SEQ ID NO: 9981 - DNA, 25 bp, S. cerevisiae
accacacagaatgacacccttgagg

SEQ ID NO: 9982 - DNA, 25 bp, S. cerevisiae
accaaagaagctgccgctgttgctg

SEQ ID NO: 9983 - DNA, 25 bp, S. cerevisiae
acccgaattggccactgttgatttg

SEQ ID NO: 9984 - DNA, 25 bp, S. cerevisiae
agcgtctgagctgggcagtattgcc

SEQ ID NO: 9985 - DNA, 25 bp, S. cerevisiae
agcgcatcatggaggacttggccga

SEQ ID NO: 9986 - DNA, 25 bp, S. cerevisiae
agccatcatggaggaattagttcaa

SEQ ID NO: 9987 - DNA, 25 bp, S. cerevisiae
accacacacggtctgtttcgtcttc

SEQ ID NO: 9988 - DNA, 25 bp, S. cerevisiae
acgaaatgggattctgtcctctggg

SEQ ID NO: 9989 - DNA, 25 bp, S. cerevisiae
agccaccattgaaaagctacctttt

SEQ ID NO: 9990 - DNA, 25 bp, S. cerevisiae
agccattcttacatcctacttgttt

SEQ ID NO: 9991 - DNA, 25 bp, S. cerevisiae
acgtcgggtttgaattattgtccat

SEQ ID NO: 9992 - DNA, 25 bp, S. cerevisiae
accacgcaggccatcgggtttgata

SEQ ID NO: 9993 - DNA, 25 bp, S. cerevisiae
accacggagcctttgatgtttcatt

SEQ ID NO: 9994 - DNA, 25 bp, S. cerevisiae
accacggcatctgacgcattaatga

SEQ ID NO: 9995 - DNA, 25 bp, S. cerevisiae
aacttggaattacctgtacctgaca

SEQ ID NO: 9996 - DNA, 25 bp, S. cerevisiae
acctttgaaatcagcttagccgcac

SEQ ID NO: 9997 - DNA, 25 bp, S. cerevisiae
agcctgatggcatacttgctaaccc

SEQ ID NO: 9998 - DNA, 25 bp, S. cerevisiae
agcgcattggaccttttagccacga

SEQ ID NO: 9999 - DNA, 25 bp, S. cerevisiae
agcgaaatccgtattaccagctgca

SEQ ID NO: 10000 - DNA, 25 bp, S. cerevisiae
acgaagacatctacggctacgggat

SEQ ID NO: 10001 - DNA, 25 bp, S. cerevisiae
agcgaatggtctaagctgcttctag

SEQ ID NO: 10002 - DNA, 25 bp, S. cerevisiae
agcgtttctctcaagtgttccattt

SEQ ID NO: 10003 - DNA, 25 bp, S. cerevisiae
agcgtttgcgtcaactttcttttgt

SEQ ID NO: 10004 - DNA, 25 bp, S. cerevisiae
accatctactatccactcaatttat

SEQ ID NO: 10005 - DNA, 25 bp, S. cerevisiae
agccatctatggagcactttttacc

SEQ ID NO: 10006 - DNA, 25 bp, S. cerevisiae
agcgtctcatccattcaaagatctc

SEQ ID NO: 10007 - DNA, 25 bp, S. cerevisiae
agccatcttttggactttaccagca

SEQ ID NO: 10008 - DNA, 25 bp, S. cerevisiae
agcgcatggttggtgaattggatat

SEQ ID NO: 10009 - DNA, 25 bp, S. cerevisiae
agcgctgagttggtcaattcaatta

SEQ ID NO: 10010 - DNA, 25 bp, S. cerevisiae
agcgcatagcttcgtcgcagattat

SEQ ID NO: 10011 - DNA, 25 bp, S. cerevisiae
cagccgcggtcttgggaagttacgt

SEQ ID NO: 10012 - DNA, 25 bp, S. cerevisiae
agcccttttttccatgtacatcgac

SEQ ID NO: 10013 - DNA, 25 bp, S. cerevisiae
agcgcatctgctaatatctctaacg

SEQ ID NO: 10014 - DNA, 25 bp, S. cerevisiae
agccgctgacaccaatttcgaaaaa

SEQ ID NO: 10015 - DNA, 25 bp, S. cerevisiae
accaaacattattcatccgtccaaa

SEQ ID NO: 10016 - DNA, 25 bp, S. cerevisiae
agccatcaaattaccacggaccaat

SEQ ID NO: 10017 - DNA, 25 bp, S. cerevisiae
accttgactatccacctttagttga

SEQ ID NO: 10018 - DNA, 25 bp, S. cerevisiae
agccctatatactccatttctactg

SEQ ID NO: 10019 - DNA, 25 bp, S. cerevisiae
agcccttaaccaaatcttccaatga

SEQ ID NO: 10020 - DNA, 25 bp, S. cerevisiae
agccacttcattcatgggtgtcgtt

SEQ ID NO: 10021 - DNA, 25 bp, S. cerevisiae
agcctcttgctcaacaggaaccagt

SEQ ID NO: 10022 - DNA, 25 bp, S. cerevisiae
agcgcttggtgcaacggaactgttc

SEQ ID NO: 10023 - DNA, 25 bp, S. cerevisiae
acccatagcagtcgcggtaggtatt

SEQ ID NO: 10024 - DNA, 25 bp, S. cerevisiae
agcctggagttctgcttgtttgtta

SEQ ID NO: 10025 - DNA, 25 bp, S. cerevisiae
agcccggtattcatgcgatttttga

SEQ ID NO: 10026 - DNA, 25 bp, S. cerevisiae
acgtagatgagctatcgattttttc

SEQ ID NO: 10027 - DNA, 25 bp, S. cerevisiae
acctcatgtcactgcgctttatttg

SEQ ID NO: 10028 - DNA, 25 bp, S. cerevisiae
agccagccatgactacttcgtggaa

SEQ ID NO: 10029 - DNA, 25 bp, S. cerevisiae
agccgcgagctgttgattctcaaga

SEQ ID NO: 10030 - DNA, 25 bp, S. cerevisiae
agccctgagcagatgttcgaagata

SEQ ID NO: 10031 - DNA, 25 bp, S. cerevisiae
agccgttccgcaacaaagatcgaca

SEQ ID NO: 10032 - DNA, 25 bp, S. cerevisiae
agcgcagcggctggttcaaacaaaa

SEQ ID NO: 10033 - DNA, 25 bp, S. cerevisiae
agcgctgctggtaacaaggccattc

SEQ ID NO: 10034 - DNA, 25 bp, S. cerevisiae
agcccgtgttgcgtcacaattaggc

SEQ ID NO: 10035 - DNA, 25 bp, S. cerevisiae
agcccgtggctttgcaaattgaaca

SEQ ID NO: 10036 - DNA, 25 bp, S. cerevisiae
accaatgactggagacttgagcaca

SEQ ID NO: 10037 - DNA, 25 bp, S. cerevisiae
agccctcagccgcaatatgatgcta

SEQ ID NO: 10038 - DNA, 25 bp, S. cerevisiae
agccactacgtgaaatctctgatga

SEQ ID NO: 10039 - DNA, 25 bp, S. cerevisiae
agcctgctcgaccaagaacgggcat

SEQ ID NO: 10040 - DNA, 25 bp, S. cerevisiae
agcctgcttgcattaaaatcaccca

SEQ ID NO: 10041 - DNA, 25 bp, S. cerevisiae
agcctcttgttctcagttatccatt

SEQ ID NO: 10042 - DNA, 25 bp, S. cerevisiae
agccattggattactcagctgtatg

SEQ ID NO: 10043 - DNA, 25 bp, S. cerevisiae
agcgcctttctctttgaaactgcaa

SEQ ID NO: 10044 - DNA, 25 bp, S. cerevisiae
accaagccagatctgcttctaacag

SEQ ID NO: 10045 - DNA, 25 bp, S. cerevisiae
acaactttaatcaggcgcatggctt

SEQ ID NO: 10046 - DNA, 25 bp, S. cerevisiae
accacttgacaaaacctctgaggaa

SEQ ID NO: 10047 - DNA, 25 bp, S. cerevisiae
accagccaacacaaaaattggtgct

SEQ ID NO: 10048 - DNA, 25 bp, S. cerevisiae
accagccaacaccaagatcggtgct

SEQ ID NO: 10049 - DNA, 25 bp, S. cerevisiae
accacgtgaagatagcagggcatgc

SEQ ID NO: 10050 - DNA, 25 bp, S. cerevisiae
accacgctaggttaaggacgcacaa

SEQ ID NO: 10051 - DNA, 25 bp, S. cerevisiae
cacgtgggaacctcttgcgaaagtc

SEQ ID NO: 10052 - DNA, 25 bp, S. cerevisiae
agccggctaacctggatgcgataaa

SEQ ID NO: 10053 - DNA, 25 bp, S. cerevisiae
accatatcgtatccacggcggtaaa

SEQ ID NO: 10054 - DNA, 25 bp, S. cerevisiae
accagacgatatcaagtggcacttt

SEQ ID NO: 10055 - DNA, 25 bp, S. cerevisiae
agccgctccgaaaaccgtatttgat

SEQ ID NO: 10056 - DNA, 25 bp, S. cerevisiae
agccgttcgacacaccatatttatc

SEQ ID NO: 10057 - DNA, 25 bp, S. cerevisiae
accagcttctaccatccaaatatta

SEQ ID NO: 10058 - DNA, 25 bp, S. cerevisiae
agcgcagctcctttctcgggaattt

SEQ ID NO: 10059 - DNA, 25 bp, S. cerevisiae
agcccaccagattgttttctatcga

SEQ ID NO: 10060 - DNA, 25 bp, S. cerevisiae
agccgcccagattccgagagattta

SEQ ID NO: 10061 - DNA, 25 bp, S. cerevisiae
agcctgatttatatacgattattgt

SEQ ID NO: 10062 - DNA, 25 bp, S. cerevisiae
agccgattttgaggccgattttcaa

SEQ ID NO: 10063 - DNA, 25 bp, S. cerevisiae
acagcactgtaataacctacccttt

SEQ ID NO: 10064 - DNA, 25 bp, S. cerevisiae
acaggagacgacgaaaccgccactt

SEQ ID NO: 10065 - DNA, 25 bp, S. cerevisiae
acacggaaacaatcacggcaccatt

SEQ ID NO: 10066 - DNA, 25 bp, S. cerevisiae
agccttgaccaattcggattactct

SEQ ID NO: 10067 - DNA, 25 bp, S. cerevisiae
agcgacttctgcatctgccaatgaa

SEQ ID NO: 10068 - DNA, 25 bp, S. cerevisiae
acgatgattcatacggctccagcaa

SEQ ID NO: 10069 - DNA, 25 bp, S. cerevisiae
agcgcagttataccagcaccagaaa

SEQ ID NO: 10070 - DNA, 25 bp, S. cerevisiae
agcgaatttaacaacactgcagatg

SEQ ID NO: 10071 - DNA, 25 bp, S. cerevisiae
agccattttaacatgttctgatgag

SEQ ID NO: 10072 - DNA, 25 bp, S. cerevisiae
agccatactctcaacgtttcggaag

SEQ ID NO: 10073 - DNA, 25 bp, S. cerevisiae
accaagccatcaaggttgtcgaaaa

SEQ ID NO: 10074 - DNA, 25 bp, S. cerevisiae
acctggccgagacggttcgcaaaat

SEQ ID NO: 10075 - DNA, 25 bp, S. cerevisiae
agcctgtgcgcgtcgctaggttaaa

SEQ ID NO: 10076 - DNA, 25 bp, S. cerevisiae
accttgcgaaccacggtgattaatc

SEQ ID NO: 10077 - DNA, 25 bp, S. cerevisiae
agcgcatttatcaccactttctcaa

SEQ ID NO: 10078 - DNA, 25 bp, S. cerevisiae
agccccatcagctcctatatttaat

SEQ ID NO: 10079 - DNA, 25 bp, S. cerevisiae
acgccctaggtggaaacttggatga

SEQ ID NO: 10080 - DNA, 25 bp, S. cerevisiae
accgcttagtggagaagttgtgacc

SEQ ID NO: 10081 - DNA, 25 bp, S. cerevisiae
agccgcttactgaacgaatctgaat

SEQ ID NO: 10082 - DNA, 25 bp, S. cerevisiae
agccgtatacgtagcagatcctcct

SEQ ID NO: 10083 - DNA, 25 bp, S. cerevisiae
agccattaagcgcagagtactttct

SEQ ID NO: 10084 - DNA, 25 bp, S. cerevisiae
agcctaagggcgtggactcatctaa

SEQ ID NO: 10085 - DNA, 25 bp, S. cerevisiae
gacctaatgggctggagacgataca

SEQ ID NO: 10086 - DNA, 25 bp, S. cerevisiae
agccaatccggctcaaattcaggta

SEQ ID NO: 10087 - DNA, 25 bp, S. cerevisiae
agccattccttctccgaatatttga

SEQ ID NO: 10088 - DNA, 25 bp, S. cerevisiae
agccttcgcgttgacgacatttgtg

SEQ ID NO: 10089 - DNA, 25 bp, S. cerevisiae
acctcatcgttatgacgacaattgg

SEQ ID NO: 10090 - DNA, 25 bp, S. cerevisiae
agccgcccacggtacagtaacaaga

SEQ ID NO: 10091 - DNA, 25 bp, S. cerevisiae
agccgtaacttgtcacttccaatag

SEQ ID NO: 10092 - DNA, 25 bp, S. cerevisiae
agccatgctaaattcttcttcttcc

SEQ ID NO: 10093 - DNA, 25 bp, S. cerevisiae
agcctgaatcagctctctgtgttta

SEQ ID NO: 10094 - DNA, 25 bp, S. cerevisiae
agccgatttgctactttgacttaca

SEQ ID NO: 10095 - DNA, 25 bp, S. cerevisiae
agccccagggttatggtcacatctg

SEQ ID NO: 10096 - DNA, 25 bp, S. cerevisiae
agccctatgaggttttgtcccaagc

SEQ ID NO: 10097 - DNA, 25 bp, S. cerevisiae
agcgccggaagtggtcagtacaaaa

SEQ ID NO: 10098 - DNA, 25 bp, S. cerevisiae
agccccaaagatctcctacaagaag

SEQ ID NO: 10099 - DNA, 25 bp, S. cerevisiae
agcccctctagtgtctcttataaga

SEQ ID NO: 10100 - DNA, 25 bp, S. cerevisiae
agccgatgaccacgcttctgttcaa

SEQ ID NO: 10101 - DNA, 25 bp, S. cerevisiae
acctatgctgactctttcgagggtt

SEQ ID NO: 10102 - DNA, 25 bp, S. cerevisiae
agcctattagcatttcccgaggtaa

SEQ ID NO: 10103 - DNA, 25 bp, S. cerevisiae
acaccaaatgcataccgaaggatag

SEQ ID NO: 10104 - DNA, 25 bp, S. cerevisiae
acccaaacaatcctccaagaatcat

SEQ ID NO: 10105 - DNA, 25 bp, S. cerevisiae
agcccgcgagcaataaatccgaaga

SEQ ID NO: 10106 - DNA, 25 bp, S. cerevisiae
agcgccgcagcagtttatgttgcta

SEQ ID NO: 10107 - DNA, 25 bp, S. cerevisiae
agcgccgagccatttgtttcgcaaa

SEQ ID NO: 10108 - DNA, 25 bp, S. cerevisiae
accgcacaggcttacttcaaatcaa

SEQ ID NO: 10109 - DNA, 25 bp, S. cerevisiae
agccacccacttattgacaagtcga

SEQ ID NO: 10110 - DNA, 25 bp, S. cerevisiae
agccaccttcttatactttctttag

SEQ ID NO: 10111 - DNA, 25 bp, S. cerevisiae
agcctacttgttattatcagaattg

SEQ ID NO: 10112 - DNA, 25 bp, S. cerevisiae
accagatgccttaccctaatatgaa

SEQ ID NO: 10113 - DNA, 25 bp, S. cerevisiae
agccgacctagatcacacagtacaa

SEQ ID NO: 10114 - DNA, 25 bp, S. cerevisiae
agcctgtcctaatctgacgtatctt

SEQ ID NO: 10115 - DNA, 25 bp, S. cerevisiae
acacggcactgctaaggctttggct

SEQ ID NO: 10116 - DNA, 25 bp, S. cerevisiae
accagggctagatgctctcgtgaaa

SEQ ID NO: 10117 - DNA, 25 bp, S. cerevisiae
accagggcatactccgcgaatagaa

SEQ ID NO: 10118 - DNA, 25 bp, S. cerevisiae
accaggctcaatttctaatgcttcc

SEQ ID NO: 10119 - DNA, 25 bp, S. cerevisiae
accagtcagatgtgtcaactgttcc

SEQ ID NO: 10120 - DNA, 25 bp, S. cerevisiae
accagtcagatgtgtcaactgttcc

SEQ ID NO: 10121 - DNA, 25 bp, S. cerevisiae
accattgcgatgtgggtgtttgctg

SEQ ID NO: 10122 - DNA, 25 bp, S. cerevisiae
agccttcaggcgtcatttgtagcca

SEQ ID NO: 10123 - DNA, 25 bp, S. cerevisiae
accagcaccacatgggtttggacaa

SEQ ID NO: 10124 - DNA, 25 bp, S. cerevisiae
agccaaccctcacagatttcgaaat

SEQ ID NO: 10125 - DNA, 25 bp, S. cerevisiae
accacctgctcctggttacgagaaa

SEQ ID NO: 10126 - DNA, 25 bp, S. cerevisiae
agcccttgcttgacgctggctgcaa

SEQ ID NO: 10127 - DNA, 25 bp, S. cerevisiae
agccgcatcatgctgttttgcaagc

SEQ ID NO: 10128 - DNA, 25 bp, S. cerevisiae
agccaattcttggtttcaacgcatt

SEQ ID NO: 10129 - DNA, 25 bp, S. cerevisiae
acgctcattgttggttggaaggttt

SEQ ID NO: 10130 - DNA, 25 bp, S. cerevisiae
acccaattgaagttgctgaggccgt

SEQ ID NO: 10131 - DNA, 25 bp, S. cerevisiae
agcctttcccatttcacaacaaata

SEQ ID NO: 10132 - DNA, 25 bp, S. cerevisiae
accggttctcattcgagtggacact

SEQ ID NO: 10133 - DNA, 25 bp, S. cerevisiae
accatggctttagtcgtgtgctcta

SEQ ID NO: 10134 - DNA, 25 bp, S. cerevisiae
agccaggctttaacattccatctaa

SEQ ID NO: 10135 - DNA, 25 bp, S. cerevisiae
agccaactttgtacataccattcag

SEQ ID NO: 10136 - DNA, 25 bp, S. cerevisiae
acctgggtgccctgttaacaacatt

SEQ ID NO: 10137 - DNA, 25 bp, S. cerevisiae
accgggtatctttggtccacaacat

SEQ ID NO: 10138 - DNA, 25 bp, S. cerevisiae
agccggtggccttatgggatactac

SEQ ID NO: 10139 - DNA, 25 bp, S. cerevisiae
accgcagttacgttacatcacttgt

SEQ ID NO: 10140 - DNA, 25 bp, S. cerevisiae
accgaattcatcaactatcacactc

SEQ ID NO: 10141 - DNA, 25 bp, S. cerevisiae
agccgcaatctgcttttaaatttga

SEQ ID NO: 10142 - DNA, 25 bp, S. cerevisiae
agccaccatatgcagttcctattga

SEQ ID NO: 10143 - DNA, 25 bp, S. cerevisiae
agccccatcgaactttccagagaat

SEQ ID NO: 10144 - DNA, 25 bp, S. cerevisiae
accccatcatgctctttcgaaaatt

SEQ ID NO: 10145 - DNA, 25 bp, S. cerevisiae
agccctcatctctcttttaaacgag

SEQ ID NO: 10146 - DNA, 25 bp, S. cerevisiae
agccaatgacggtcgtttcacagga

SEQ ID NO: 10147 - DNA, 25 bp, S. cerevisiae
accacaatccaatttcgtcatcagg

SEQ ID NO: 10148 - DNA, 25 bp, S. cerevisiae
accataatggccatctgcgtcaacg

SEQ ID NO: 10149 - DNA, 25 bp, S. cerevisiae
agccaacagtgtttgctgatgtcaa

SEQ ID NO: 10150 - DNA, 25 bp, S. cerevisiae
agcctacacagcctggcgtgatata

SEQ ID NO: 10151 - DNA, 25 bp, S. cerevisiae
agcccgttgcgaatccaccaaagat

SEQ ID NO: 10152 - DNA, 25 bp, S. cerevisiae
agcccgcactgaatttgccttagga

SEQ ID NO: 10153 - DNA, 25 bp, S. cerevisiae
agccttgtttcgatgctggcgaaca

SEQ ID NO: 10154 - DNA, 25 bp, S. cerevisiae
agccgaattatttgatcttccagaa

SEQ ID NO: 10155 - DNA, 25 bp, S. cerevisiae
agccaactttaatctcttctgactc

SEQ ID NO: 10156 - DNA, 25 bp, S. cerevisiae
accaccatttgttttgctgattctc

SEQ ID NO: 10157 - DNA, 25 bp, S. cerevisiae
agccttatgttggtaatctttctaa

SEQ ID NO: 10158 - DNA, 25 bp, S. cerevisiae
agcctgccttgggtacttgtttgta

SEQ ID NO: 10159 - DNA, 25 bp, S. cerevisiae
agccaattctgttacgtttctgatg

SEQ ID NO: 10160 - DNA, 25 bp, S. cerevisiae
accattgatcggtcatcgtgttttg

SEQ ID NO: 10161 - DNA, 25 bp, S. cerevisiae
agccattaatgccaatcctttcctg

SEQ ID NO: 10162 - DNA, 25 bp, S. cerevisiae
agccattgaaagaaccctctcggtc

SEQ ID NO: 10163 - DNA, 25 bp, S. cerevisiae
agcctttgaaatacttgtccgtgga

SEQ ID NO: 10164 - DNA, 25 bp, S. cerevisiae
accacctgtagatcttgaccgtgag

SEQ ID NO: 10165 - DNA, 25 bp, S. cerevisiae
accagctgctgttgctatgcgtgac

SEQ ID NO: 10166 - DNA, 25 bp, S. cerevisiae
accactgatggtgatgggactttca

SEQ ID NO: 10167 - DNA, 25 bp, S. cerevisiae
acccttggtaatgcggatcctaatt

SEQ ID NO: 10168 - DNA, 25 bp, S. cerevisiae
accgttggtatttgtagcttctaag

SEQ ID NO: 10169 - DNA, 25 bp, S. cerevisiae
acaaaggccctttcgaaggcaacat

SEQ ID NO: 10170 - DNA, 25 bp, S. cerevisiae
aaaagattggtatcgtcgaaatctc

SEQ ID NO: 10171 - DNA, 25 bp, S. cerevisiae
accacagttggttctcgtgaacagt

SEQ ID NO: 10172 - DNA, 25 bp, S. cerevisiae
accccaagagggtcaggctcagagg

SEQ ID NO: 10173 - DNA, 25 bp, S. cerevisiae
accgctacaagtgggaagcctggga

SEQ ID NO: 10174 - DNA, 25 bp, S. cerevisiae
acctctagcctgtggaagttctgga

SEQ ID NO: 10175 - DNA, 25 bp, S. cerevisiae
agccaaactctcctggcgaaattta

SEQ ID NO: 10176 - DNA, 25 bp, S. cerevisiae
accagcactcataccggcagaaaat

SEQ ID NO: 10177 - DNA, 25 bp, S. cerevisiae
acccgctactgacgatgccaaagat

SEQ ID NO: 10178 - DNA, 25 bp, S. cerevisiae
acccagtcattccattccatgaaat

SEQ ID NO: 10179 - DNA, 25 bp, S. cerevisiae
agccatatgtcttttttaccatccc

SEQ ID NO: 10180 - DNA, 25 bp, S. cerevisiae
agccatttatccacttagacactca

SEQ ID NO: 10181 - DNA, 25 bp, S. cerevisiae
acctgcgttttatacaagacccaag

SEQ ID NO: 10182 - DNA, 25 bp, S. cerevisiae
accggtacaaactggtatcgttctg

SEQ ID NO: 10183 - DNA, 25 bp, S. cerevisiae
accaggagtcggtatattactttca

SEQ ID NO: 10184 - DNA, 25 bp, S. cerevisiae
accgggtgtggtattactatgctca

SEQ ID NO: 10185 - DNA, 25 bp, S. cerevisiae
accttaccggctattgagattgtca

SEQ ID NO: 10186 - DNA, 25 bp, S. cerevisiae
acctctaagcaactttgggttctga

SEQ ID NO: 10187 - DNA, 25 bp, S. cerevisiae
accattttccagctacgggatgcca

SEQ ID NO: 10188 - DNA, 25 bp, S. cerevisiae
accattcagttaccgatagtttcaa

SEQ ID NO: 10189 - DNA, 25 bp, S. cerevisiae
accgaggtacgatccaattgctaaa

SEQ ID NO: 10190 - DNA, 25 bp, S. cerevisiae
accgtaccgccatctcaaagtgaag

SEQ ID NO: 10191 - DNA, 25 bp, S. cerevisiae
accaaatgcattcgttttaccaggg

SEQ ID NO: 10192 - DNA, 25 bp, S. cerevisiae
acctgttcttagcttgtaccagagg

SEQ ID NO: 10193 - DNA, 25 bp, S. cerevisiae
agcctattttagacttcttgcctcg

SEQ ID NO: 10194 - DNA, 25 bp, S. cerevisiae
agcctattctttatcattcttctat

SEQ ID NO: 10195 - DNA, 25 bp, S. cerevisiae
accactcctttatcaacgtcaatag

SEQ ID NO: 10196 - DNA, 25 bp, S. cerevisiae
accacttgcagtccaacaacgacaa

SEQ ID NO: 10197 - DNA, 25 bp, S. cerevisiae
agccaagcatctgtagtcgtcgatt

SEQ ID NO: 10198 - DNA, 25 bp, S. cerevisiae
accatacactttggatcgtgccatc

SEQ ID NO: 10199 - DNA, 25 bp, S. cerevisiae
accaccatgcattatcgtctgttct

SEQ ID NO: 10200 - DNA, 25 bp, S. cerevisiae
accacgaagtccaaggttgttcaat

SEQ ID NO: 10201 - DNA, 25 bp, S. cerevisiae
accagtatctgtttgaccatgggat

SEQ ID NO: 10202 - DNA, 25 bp, S. cerevisiae
agccttcatatgtttaatcttggat

SEQ ID NO: 10203 - DNA, 25 bp, S. cerevisiae
accattcggtactttcacatcggaa

SEQ ID NO: 10204 - DNA, 25 bp, S. cerevisiae
agccgtgcttcatatatagacttgt

SEQ ID NO: 10205 - DNA, 25 bp, S. cerevisiae
accggtatgctcttaaacagttcac

SEQ ID NO: 10206 - DNA, 25 bp, S. cerevisiae
acctgcttcggtttggaacatgacg

SEQ ID NO: 10207 - DNA, 25 bp, S. cerevisiae
acgcgatacgggttctggatggact

SEQ ID NO: 10208 - DNA, 25 bp, S. cerevisiae
accaagccggtgtatttactgatgc

SEQ ID NO: 10209 - DNA, 25 bp, S. cerevisiae
agccttccctgattttttggagcga

SEQ ID NO: 10210 - DNA, 25 bp, S. cerevisiae
acgcgcagccttcaaaagtactctt

SEQ ID NO: 10211 - DNA, 25 bp, S. cerevisiae
tacccgggtgtgaaaactggccaag

SEQ ID NO: 10212 - DNA, 25 bp, S. cerevisiae
accctgggtttatagtggagaagag

SEQ ID NO: 10213 - DNA, 25 bp, S. cerevisiae
accatccagcatgcaatacagtgac

SEQ ID NO: 10214 - DNA, 25 bp, S. cerevisiae
accatacaatccatcacatcatatc

SEQ ID NO: 10215 - DNA, 25 bp, S. cerevisiae
accaaggtggtttagtctctgatga

SEQ ID NO: 10216 - DNA, 25 bp, S. cerevisiae
accaaggcaattcaggtctcctgca

SEQ ID NO: 10217 - DNA, 25 bp, S. cerevisiae
accaagtgtgataccaagttccgaa

SEQ ID NO: 10218 - DNA, 25 bp, S. cerevisiae
accagaggctcatccaaaccttaag

SEQ ID NO: 10219 - DNA, 25 bp, S. cerevisiae
acccgcacctatcaacagtttaagt

SEQ ID NO: 10220 - DNA, 25 bp, S. cerevisiae
acccctacttactctatggtatgct

SEQ ID NO: 10221 - DNA, 25 bp, S. cerevisiae
accaccgcacttatctttgtgatag

SEQ ID NO: 10222 - DNA, 25 bp, S. cerevisiae
accatgatcccgaatacgctattgt

SEQ ID NO: 10223 - DNA, 25 bp, S. cerevisiae
accattctagaattcccatttgtaa

SEQ ID NO: 10224 - DNA, 25 bp, S. cerevisiae
accactgtccactctttgactgcta

SEQ ID NO: 10225 - DNA, 25 bp, S. cerevisiae
accaccttcgagcaatcgcaagaag

SEQ ID NO: 10226 - DNA, 25 bp, S. cerevisiae
accagtctcaagattctgtttggga

SEQ ID NO: 10227 - DNA, 25 bp, S. cerevisiae
acctactgcaatattcactcactgg

SEQ ID NO: 10228 - DNA, 25 bp, S. cerevisiae
accattctaataactcttcatcgat

SEQ ID NO: 10229 - DNA, 25 bp, S. cerevisiae
accaacagaaattcctctctcagag

SEQ ID NO: 10230 - DNA, 25 bp, S. cerevisiae
accaaattacgcttgctcttatgca

SEQ ID NO: 10231 - DNA, 25 bp, S. cerevisiae
accatgtcacttgagggttcctgga

SEQ ID NO: 10232 - DNA, 25 bp, S. cerevisiae
acctatttgtcactgggttcagcac

SEQ ID NO: 10233 - DNA, 25 bp, S. cerevisiae
accagcaagtgggttccttggccaa

SEQ ID NO: 10234 - DNA, 25 bp, S. cerevisiae
accaatcgggatattcttcgccata

SEQ ID NO: 10235 - DNA, 25 bp, S. cerevisiae
agccaagcaaggtgttctttcgcaa

SEQ ID NO: 10236 - DNA, 25 bp, S. cerevisiae
agccatgtctttacttcgttttaat

SEQ ID NO: 10237 - DNA, 25 bp, S. cerevisiae
acagcgtacaggtgtttcttttgac

SEQ ID NO: 10238 - DNA, 25 bp, S. cerevisiae
acacttcaggcgagttaaattctac

SEQ ID NO: 10239 - DNA, 25 bp, S. cerevisiae
accttcggtattgtgatgatgactt

SEQ ID NO: 10240 - DNA, 25 bp, S. cerevisiae
accgcactgagtggtaccattgcta

SEQ ID NO: 10241 - DNA, 25 bp, S. cerevisiae
acctcaacagaggatactataatga

SEQ ID NO: 10242 - DNA, 25 bp, S. cerevisiae
agccacagacagctatctctatgaa

SEQ ID NO: 10243 - DNA, 25 bp, S. cerevisiae
accacgcaagccgaatgtagacatt

SEQ ID NO: 10244 - DNA, 25 bp, S. cerevisiae
accaccagcgctctagatacatata

SEQ ID NO: 10245 - DNA, 25 bp, S. cerevisiae
agccacaactttaacttctgcaacc

SEQ ID NO: 10246 - DNA, 25 bp, S. cerevisiae
accaagaaaccttcatttctcaccg

SEQ ID NO: 10247 - DNA, 25 bp, S. cerevisiae
acaaatgaacccatgttatcccctg

SEQ ID NO: 10248 - DNA, 25 bp, S. cerevisiae
aaaataatcctttgggagccggctg

SEQ ID NO: 10249 - DNA, 25 bp, S. cerevisiae
accaagatctccactggtgctgctg

SEQ ID NO: 10250 - DNA, 25 bp, S. cerevisiae
agccaagaccttcggtgcttctgtt

SEQ ID NO: 10251 - DNA, 25 bp, S. cerevisiae
agccaaggcccaaggtgttgctgtc

SEQ ID NO: 10252 - DNA, 25 bp, S. cerevisiae
acctaggcagagcacttgtttttgt

SEQ ID NO: 10253 - DNA, 25 bp, S. cerevisiae
accaaggtatggctctgtttatttc

SEQ ID NO: 10254 - DNA, 25 bp, S. cerevisiae
acctcagtgttggattcgtttcttt

SEQ ID NO: 10255 - DNA, 25 bp, S. cerevisiae
accatcactggtaacgtctttttag

SEQ ID NO: 10256 - DNA, 25 bp, S. cerevisiae
agccattcaggttacggatttctta

SEQ ID NO: 10257 - DNA, 25 bp, S. cerevisiae
agccattcggtgtcctagagtgtgc

SEQ ID NO: 10258 - DNA, 25 bp, S. cerevisiae
accatgatgtggctttgacaaccga

SEQ ID NO: 10259 - DNA, 25 bp, S. cerevisiae
accggtatgttggtcatgcttttgg

SEQ ID NO: 10260 - DNA, 25 bp, S. cerevisiae
accagaagtagatcctgttccatat

SEQ ID NO: 10261 - DNA, 25 bp, S. cerevisiae
acctgccgttcaaggttacacctat

SEQ ID NO: 10262 - DNA, 25 bp, S. cerevisiae
acgctgttaatcatggctactgcct

SEQ ID NO: 10263 - DNA, 25 bp, S. cerevisiae
actgattctattgttaaagcctcca

SEQ ID NO: 10264 - DNA, 25 bp, S. cerevisiae
gaccgtctgcgggaactgaaactcg

SEQ ID NO: 10265 - DNA, 25 bp, S. cerevisiae
accttcgcggaagctgcaaagatac

SEQ ID NO: 10266 - DNA, 25 bp, S. cerevisiae
accttgattggttcactagtggcta

SEQ ID NO: 10267 - DNA, 25 bp, S. cerevisiae
acgtaccatctcgttgtttaccaat

SEQ ID NO: 10268 - DNA, 25 bp, S. cerevisiae
acctgggttggatactttgactgct

SEQ ID NO: 10269 - DNA, 25 bp, S. cerevisiae
acccatctttgaaaactctaacgca

SEQ ID NO: 10270 - DNA, 25 bp, S. cerevisiae
acgccagtgggttgggcctatacca

SEQ ID NO: 10271 - DNA, 25 bp, S. cerevisiae
accagattggttcaggtttcaacga

SEQ ID NO: 10272 - DNA, 25 bp, S. cerevisiae
acctagtctttggttggatctacta

SEQ ID NO: 10273 - DNA, 25 bp, S. cerevisiae
acctgtacttccgtgggattacaag

SEQ ID NO: 10274 - DNA, 25 bp, S. cerevisiae
acctgttcctcctgtggttatccag

SEQ ID NO: 10275 - DNA, 25 bp, S. cerevisiae
accttgctcccttttgtttagtatg

SEQ ID NO: 10276 - DNA, 25 bp, S. cerevisiae
accttgacctccttgcaatttggta

SEQ ID NO: 10277 - DNA, 25 bp, S. cerevisiae
accggatcccgcagatgattcatcg

SEQ ID NO: 10278 - DNA, 25 bp, S. cerevisiae
acctggacacatatggattttgcga

SEQ ID NO: 10279 - DNA, 25 bp, S. cerevisiae
accatatgactacttgggatttcaa

SEQ ID NO: 10280 - DNA, 25 bp, S. cerevisiae
agccagactctgtttcggatttaac

SEQ ID NO: 10281 - DNA, 25 bp, S. cerevisiae
accagcaatctgagggtgacttgaa

SEQ ID NO: 10282 - DNA, 25 bp, S. cerevisiae
accagatccgttcaatatttacagc

SEQ ID NO: 10283 - DNA, 25 bp, S. cerevisiae
accagatccgtctcttctattaaaa

SEQ ID NO: 10284 - DNA, 25 bp, S. cerevisiae
accagtatcggcctctatttataaa

SEQ ID NO: 10285 - DNA, 25 bp, S. cerevisiae
accaatactactgttgctccagtct

SEQ ID NO: 10286 - DNA, 25 bp, S. cerevisiae
acctttgcagttgtttccagctatt

SEQ ID NO: 10287 - DNA, 25 bp, S. cerevisiae
accatttggtgtgtcgacgctgatt

SEQ ID NO: 10288 - DNA, 25 bp, S. cerevisiae
accaaagatcgtccagaagctgcta

SEQ ID NO: 10289 - DNA, 25 bp, S. cerevisiae
accggcattcaggtacaaggataat

SEQ ID NO: 10290 - DNA, 25 bp, S. cerevisiae
acccgtctcagacagcgaggtttat

SEQ ID NO: 10291 - DNA, 25 bp, S. cerevisiae
acccggacgagctaagagttttcat

SEQ ID NO: 10292 - DNA, 25 bp, S. cerevisiae
acccggcaaagttattcgatccaat

SEQ ID NO: 10293 - DNA, 25 bp, S. cerevisiae
accggcgaattcttatttgatccaa

SEQ ID NO: 10294 - DNA, 25 bp, S. cerevisiae
accaggcgacttactgacttgggaa

SEQ ID NO: 10295 - DNA, 25 bp, S. cerevisiae
agccaatgactctttcgacgtttac

SEQ ID NO: 10296 - DNA, 25 bp, S. cerevisiae
accaagactagttcaactctaccac

SEQ ID NO: 10297 - DNA, 25 bp, S. cerevisiae
accaattcgcggtcagcagtaacaa

SEQ ID NO: 10298 - DNA, 25 bp, S. cerevisiae
accgttgccgaacagacagttacct

SEQ ID NO: 10299 - DNA, 25 bp, S. cerevisiae
accatttggtggcattactttccct

SEQ ID NO: 10300 - DNA, 25 bp, S. cerevisiae
accactgtaggtgattacgttgcca

SEQ ID NO: 10301 - DNA, 25 bp, S. cerevisiae
actccgtatcggattccagttcaga

SEQ ID NO: 10302 - DNA, 25 bp, S. cerevisiae
accacacttcctcattctagattag

SEQ ID NO: 10303 - DNA, 25 bp, S. cerevisiae
accacagctgtcatctcaactaaat

SEQ ID NO: 10304 - DNA, 25 bp, S. cerevisiae
accagagcctgcaaccatggttaat

SEQ ID NO: 10305 - DNA, 25 bp, S. cerevisiae
acctgtcttagtattgtgaggccaa

SEQ ID NO: 10306 - DNA, 25 bp, S. cerevisiae
accagtccatatttccgtcaaacta

SEQ ID NO: 10307 - DNA, 25 bp, S. cerevisiae
accgaccctgtggtgctaagatcag

SEQ ID NO: 10308 - DNA, 25 bp, S. cerevisiae
accaaggccgctggtgctaatgtcg

SEQ ID NO: 10309 - DNA, 25 bp, S. cerevisiae
aaaacgtgcccagcgaattcgtgga

SEQ ID NO: 10310 - DNA, 25 bp, S. cerevisiae
accagcttaccatatatgatttcga

SEQ ID NO: 10311 - DNA, 25 bp, S. cerevisiae
acgctggttgcaatgaaaattcgcc

SEQ ID NO: 10312 - DNA, 25 bp, S. cerevisiae
accgtgtcggtgaagtgttcgccaa

SEQ ID NO: 10313 - DNA, 25 bp, S. cerevisiae
accaggtctcgttcaattccagaaa

SEQ ID NO: 10314 - DNA, 25 bp, S. cerevisiae
accaggtgaacctagcgtcagcaga

SEQ ID NO: 10315 - DNA, 25 bp, S. cerevisiae
accactccacatggctcattgagag

SEQ ID NO: 10316 - DNA, 25 bp, S. cerevisiae
accgctgctgccatgatgactagaa

SEQ ID NO: 10317 - DNA, 25 bp, S. cerevisiae
acctcaactaatgctcgttcgaaca

SEQ ID NO: 10318 - DNA, 25 bp, S. cerevisiae
acctcacctataccatcagattcat

SEQ ID NO: 10319 - DNA, 25 bp, S. cerevisiae
acctggattcacttttggttgacca

SEQ ID NO: 10320 - DNA, 25 bp, S. cerevisiae
accgtagtaacgttctgttcatgaa

SEQ ID NO: 10321 - DNA, 25 bp, S. cerevisiae
accgatggtatactagcctgttaca

SEQ ID NO: 10322 - DNA, 25 bp, S. cerevisiae
accgatttatacgactctatctccg

SEQ ID NO: 10323 - DNA, 25 bp, S. cerevisiae
acacgagttgataatacccacccca

SEQ ID NO: 10324 - DNA, 25 bp, S. cerevisiae
accggttgatgtagaagtgccccac

SEQ ID NO: 10325 - DNA, 25 bp, S. cerevisiae
acctgttcctcttgtggttacccat

SEQ ID NO: 10326 - DNA, 25 bp, S. cerevisiae
acccagtcgttaccttcaatcaaga

SEQ ID NO: 10327 - DNA, 25 bp, S. cerevisiae
actccgatgctgctaaccacaataa

SEQ ID NO: 10328 - DNA, 25 bp, S. cerevisiae
accagcagcgatctcaggcaccgta

SEQ ID NO: 10329 - DNA, 25 bp, S. cerevisiae
accagcacgcttactctacggatga

SEQ ID NO: 10330 - DNA, 25 bp, S. cerevisiae
accatgcatcgttctttgacgcagt

SEQ ID NO: 10331 - DNA, 25 bp, S. cerevisiae
acctgacgcccaatatgagctgcaa

SEQ ID NO: 10332 - DNA, 25 bp, S. cerevisiae
accacttctggtcatctttcaagac

SEQ ID NO: 10333 - DNA, 25 bp, S. cerevisiae
acctacggtatctctcaagtcttat

SEQ ID NO: 10334 - DNA, 25 bp, S. cerevisiae
acctctccagtttgtccatttatat

SEQ ID NO: 10335 - DNA, 25 bp, S. cerevisiae
accattttgggttctgactctcgat

SEQ ID NO: 10336 - DNA, 25 bp, S. cerevisiae
acctttggtcttggctaatctcaaa

SEQ ID NO: 10337 - DNA, 25 bp, S. cerevisiae
acctttgttgcagtcgaattctcgt

SEQ ID NO: 10338 - DNA, 25 bp, S. cerevisiae
accatctttgtcgaggatttcccta

SEQ ID NO: 10339 - DNA, 25 bp, S. cerevisiae
acctgtttgagatggtctttcccaa

SEQ ID NO: 10340 - DNA, 25 bp, S. cerevisiae
acctggtgctggtggttatgacgcc

SEQ ID NO: 10341 - DNA, 25 bp, S. cerevisiae
accatagtagcgtccaattcaacct

SEQ ID NO: 10342 - DNA, 25 bp, S. cerevisiae
acacaagaacgtcccagtccacgtc

SEQ ID NO: 10343 - DNA, 25 bp, S. cerevisiae
acacaagaacgttccagttcacgtt

SEQ ID NO: 10344 - DNA, 25 bp, S. cerevisiae
tacctatcggtaaacgacgggctat

SEQ ID NO: 10345 - DNA, 25 bp, S. cerevisiae
accttcgtttcccatcttatataag

SEQ ID NO: 10346 - DNA, 25 bp, S. cerevisiae
acgttttctccccagttgaaagatg

SEQ ID NO: 10347 - DNA, 25 bp, S. cerevisiae
accttcctcggacagtagcaaatta

SEQ ID NO: 10348 - DNA, 25 bp, S. cerevisiae
accccgacggagcaacaactattag

SEQ ID NO: 10349 - DNA, 25 bp, S. cerevisiae
acctccagccggttatatgcaagct

SEQ ID NO: 10350 - DNA, 25 bp, S. cerevisiae
accatcgccgggttttgatgtgctt

SEQ ID NO: 10351 - DNA, 25 bp, S. cerevisiae
accagatggcgtttgttatctcatt

SEQ ID NO: 10352 - DNA, 25 bp, S. cerevisiae
acctctgctggtatcatggaccatg

SEQ ID NO: 10353 - DNA, 25 bp, S. cerevisiae
acctctgctggttatacaggctcag

SEQ ID NO: 10354 - DNA, 25 bp, S. cerevisiae
accaggtgtttactatgttccatat

SEQ ID NO: 10355 - DNA, 25 bp, S. cerevisiae
acccatgtttgagttttccgatagc

SEQ ID NO: 10356 - DNA, 25 bp, S. cerevisiae
accactttaactttgtcatcggacg

SEQ ID NO: 10357 - DNA, 25 bp, S. cerevisiae
acctcacctttagatgctttttcag

SEQ ID NO: 10358 - DNA, 25 bp, S. cerevisiae
accatcccttttgcatttatcagtg

SEQ ID NO: 10359 - DNA, 25 bp, S. cerevisiae
accaccactaatacaactctatcat

SEQ ID NO: 10360 - DNA, 25 bp, S. cerevisiae
accgcaggctccattcatcgaaaat

SEQ ID NO: 10361 - DNA, 25 bp, S. cerevisiae
acctgagtgctctatttgccggaat

SEQ ID NO: 10362 - DNA, 25 bp, S. cerevisiae
acgacagttctagtggcagcttaat

SEQ ID NO: 10363 - DNA, 25 bp, S. cerevisiae
acccaaattgggtactcgattgtat

SEQ ID NO: 10364 - DNA, 25 bp, S. cerevisiae
acctcaatttgggaacgcgatgtca

SEQ ID NO: 10365 - DNA, 25 bp, S. cerevisiae
acaaagataggaaaagggatggcaa

SEQ ID NO: 10366 - DNA, 25 bp, S. cerevisiae
acgacagacctctaaagcctgatct

SEQ ID NO: 10367 - DNA, 25 bp, S. cerevisiae
acgacggccaatacaggcaccattg

SEQ ID NO: 10368 - DNA, 25 bp, S. cerevisiae
acgcatcggccaataagtatacggg

SEQ ID NO: 10369 - DNA, 25 bp, S. cerevisiae
acgctggcggctggtcgataacgaa

SEQ ID NO: 10370 - DNA, 25 bp, S. cerevisiae
actacctggcccaattacaagtgga

SEQ ID NO: 10371 - DNA, 25 bp, S. cerevisiae
accaggttccctgaatcattgttca

SEQ ID NO: 10372 - DNA, 25 bp, S. cerevisiae
acctgattgttagagtccctgtttt

SEQ ID NO: 10373 - DNA, 25 bp, S. cerevisiae
acctgagtgttatacccgcatgttt

SEQ ID NO: 10374 - DNA, 25 bp, S. cerevisiae
accatgccccttgatactgtgaaaa

SEQ ID NO: 10375 - DNA, 25 bp, S. cerevisiae
accttcccaggctatacgatgagca

SEQ ID NO: 10376 - DNA, 25 bp, S. cerevisiae
cagctcgatgaaatacgtgacggat

SEQ ID NO: 10377 - DNA, 25 bp, S. cerevisiae
taccacggacaactcttttggaggt

SEQ ID NO: 10378 - DNA, 25 bp, S. cerevisiae
accacctgcaaactttcttgagcga

SEQ ID NO: 10379 - DNA, 25 bp, S. cerevisiae
accacctttggtattgctgttcaag

SEQ ID NO: 10380 - DNA, 25 bp, S. cerevisiae
accatgatcccgtttgacttgagaa

SEQ ID NO: 10381 - DNA, 25 bp, S. cerevisiae
actggacccgtttgacgtggatgaa

SEQ ID NO: 10382 - DNA, 25 bp, S. cerevisiae
acctccctggctcaaggacttatag

SEQ ID NO: 10383 - DNA, 25 bp, S. cerevisiae
acctttcttcccatgtgacattgac

SEQ ID NO: 10384 - DNA, 25 bp, S. cerevisiae
accctgagcttttgcgcatggatgc

SEQ ID NO: 10385 - DNA, 25 bp, S. cerevisiae
acgagtccttgattggcagcgatgc

SEQ ID NO: 10386 - DNA, 25 bp, S. cerevisiae
accagttcactggtggagccatgaa

SEQ ID NO: 10387 - DNA, 25 bp, S. cerevisiae
accagttgctcgtgaatgtaatacc

SEQ ID NO: 10388 - DNA, 25 bp, S. cerevisiae
accagcttctccaaaggcagatgct

SEQ ID NO: 10389 - DNA, 25 bp, S. cerevisiae
accctctccacgttggaatctagaa

SEQ ID NO: 10390 - DNA, 25 bp, S. cerevisiae
accctaccactgacttaccaagaga

SEQ ID NO: 10391 - DNA, 25 bp, S. cerevisiae
accgctgaccctatcattagttaca

SEQ ID NO: 10392 - DNA, 25 bp, S. cerevisiae
accggagtttgcacaattgccttca

SEQ ID NO: 10393 - DNA, 25 bp, S. cerevisiae
accggcaattctaatcctagccatt

SEQ ID NO: 10394 - DNA, 25 bp, S. cerevisiae
accatggtatttacaccctgcaatt

SEQ ID NO: 10395 - DNA, 25 bp, S. cerevisiae
accatactatttccagccttattac

SEQ ID NO: 10396 - DNA, 25 bp, S. cerevisiae
accatgaacttccatgtaccactac

SEQ ID NO: 10397 - DNA, 25 bp, S. cerevisiae
accaggcagattgtctatggccaat

SEQ ID NO: 10398 - DNA, 25 bp, S. cerevisiae
accgctattgttggtggccgtatac

SEQ ID NO: 10399 - DNA, 25 bp, S. cerevisiae
accattagctgctatcgtagccgga

SEQ ID NO: 10400 - DNA, 25 bp, S. cerevisiae
acctcatatggctatcgaatctccc

SEQ ID NO: 10401 - DNA, 25 bp, S. cerevisiae
acctcatagaggacgggtctcgctg

SEQ ID NO: 10402 - DNA, 25 bp, S. cerevisiae
acccataagcctgcaagatcctgtg

SEQ ID NO: 10403 - DNA, 25 bp, S. cerevisiae
acaggtaatccttcaaatgccacgg

SEQ ID NO: 10404 - DNA, 25 bp, S. cerevisiae
accgctattagctcaatatcgccag

SEQ ID NO: 10405 - DNA, 25 bp, S. cerevisiae
accctattagttgtcaccatctgtt

SEQ ID NO: 10406 - DNA, 25 bp, S. cerevisiae
acctattgggtgtttgcttcgtgtt

SEQ ID NO: 10407 - DNA, 25 bp, S. cerevisiae
accgcatatttgtcatctgttaaga

SEQ ID NO: 10408 - DNA, 25 bp, S. cerevisiae
accggatttgattctatttagtgca

SEQ ID NO: 10409 - DNA, 25 bp, S. cerevisiae
accgtggctcctactacaaatgtgg

SEQ ID NO: 10410 - DNA, 25 bp, S. cerevisiae
accagtggcgctagtcaagtaagtg

SEQ ID NO: 10411 - DNA, 25 bp, S. cerevisiae
accaggcgcagattagcaagtcaat

SEQ ID NO: 10412 - DNA, 25 bp, S. cerevisiae
acgctacgcagcttggcagtgaaat

SEQ ID NO: 10413 - DNA, 25 bp, S. cerevisiae
acctaaggcgattgtcaaggctctt

SEQ ID NO: 10414 - DNA, 25 bp, S. cerevisiae
acgcattcagcggtggtcaagtgtc

SEQ ID NO: 10415 - DNA, 25 bp, S. cerevisiae
acgaatatcgtgagttagcagacaa

SEQ ID NO: 10416 - DNA, 25 bp, S. cerevisiae
accattgacgctaacttcgctgaca

SEQ ID NO: 10417 - DNA, 25 bp, S. cerevisiae
accagtgagcgcgtttctgtggaaa

SEQ ID NO: 10418 - DNA, 25 bp, S. cerevisiae
acgatccaagcggtattctttattc

SEQ ID NO: 10419 - DNA, 25 bp, S. cerevisiae
accctcagacaggtttcttagtagc

SEQ ID NO: 10420 - DNA, 25 bp, S. cerevisiae
accttctcgtcgtgctggtgcaaga

SEQ ID NO: 10421 - DNA, 25 bp, S. cerevisiae
accttcattgtcgttgctgattcaa

SEQ ID NO: 10422 - DNA, 25 bp, S. cerevisiae
acctccagggttttttccaatgcat

SEQ ID NO: 10423 - DNA, 25 bp, S. cerevisiae
acctcctgaggaattttctaacacg

SEQ ID NO: 10424 - DNA, 25 bp, S. cerevisiae
acctcgaactcaatttgtcctgaca

SEQ ID NO: 10425 - DNA, 25 bp, S. cerevisiae
acgctgctgcagtgttttgggatcc

SEQ ID NO: 10426 - DNA, 25 bp, S. cerevisiae
accttcactggtattgtcgttcaat

SEQ ID NO: 10427 - DNA, 25 bp, S. cerevisiae
accttcatctgtccctgttatttta

SEQ ID NO: 10428 - DNA, 25 bp, S. cerevisiae
acctcttacgctgattcaggtctgt

SEQ ID NO: 10429 - DNA, 25 bp, S. cerevisiae
accattgaccttatgttcgcacgat

SEQ ID NO: 10430 - DNA, 25 bp, S. cerevisiae
acccatgttaattcctttgtgccag

SEQ ID NO: 10431 - DNA, 25 bp, S. cerevisiae
acctctgtgtcatatgcttttgtcc

SEQ ID NO: 10432 - DNA, 25 bp, S. cerevisiae
acccatgggcataaggtatcttcct

SEQ ID NO: 10433 - DNA, 25 bp, S. cerevisiae
acctatgtggtttgcttcgttgaac

SEQ ID NO: 10434 - DNA, 25 bp, S. cerevisiae
acaccgttgggtctaagggcacatc

SEQ ID NO: 10435 - DNA, 25 bp, S. cerevisiae
actccctccggatctaaggacaatg

SEQ ID NO: 10436 - DNA, 25 bp, S. cerevisiae
aatgtcttctggttactacttaggt

SEQ ID NO: 10437 - DNA, 25 bp, S. cerevisiae
acctctgtctggttactgtcgaagt

SEQ ID NO: 10438 - DNA, 25 bp, S. cerevisiae
acctatccttgtccctgtggagata

SEQ ID NO: 10439 - DNA, 25 bp, S. cerevisiae
acgcttcctctttcagatggtggga

SEQ ID NO: 10440 - DNA, 25 bp, S. cerevisiae
acctccccttgatgaatgttgtgca

SEQ ID NO: 10441 - DNA, 25 bp, S. cerevisiae
acgccactccacctatggaatggtt

SEQ ID NO: 10442 - DNA, 25 bp, S. cerevisiae
acgcttcagccgagtatggtcaatt

SEQ ID NO: 10443 - DNA, 25 bp, S. cerevisiae
acctactactgggattgcatgaaag

SEQ ID NO: 10444 - DNA, 25 bp, S. cerevisiae
acctgactatgcactgttgtccaac

SEQ ID NO: 10445 - DNA, 25 bp, S. cerevisiae
accttcttctcctttgacaactaat

SEQ ID NO: 10446 - DNA, 25 bp, S. cerevisiae
actaggctacttgttgggtccgata

SEQ ID NO: 10447 - DNA, 25 bp, S. cerevisiae
acgcccttttcgaggatgatccgta

SEQ ID NO: 10448 - DNA, 25 bp, S. cerevisiae
accctcttcctcagagtctaagaaa

SEQ ID NO: 10449 - DNA, 25 bp, S. cerevisiae
accttgttcctagtggcgctaatgg

SEQ ID NO: 10450 - DNA, 25 bp, S. cerevisiae
accgaatccgattttgcagctaagg

SEQ ID NO: 10451 - DNA, 25 bp, S. cerevisiae
acccaagggattttcaccaagcaat

SEQ ID NO: 10452 - DNA, 25 bp, S. cerevisiae
accgttgtcgttgaagaagatgctt

SEQ ID NO: 10453 - DNA, 25 bp, S. cerevisiae
acctgtatgatgtacatggtcctgg

SEQ ID NO: 10454 - DNA, 25 bp, S. cerevisiae
acgctacaatgtacggatccggttc

SEQ ID NO: 10455 - DNA, 25 bp, S. cerevisiae
acgctatcttcaacaggtccgagtg

SEQ ID NO: 10456 - DNA, 25 bp, S. cerevisiae
acagttgcccaagactccggtaaat

SEQ ID NO: 10457 - DNA, 25 bp, S. cerevisiae
acgctcccgttgtacctaaggtgat

SEQ ID NO: 10458 - DNA, 25 bp, S. cerevisiae
acttccgccggatcaactagtggag

SEQ ID NO: 10459 - DNA, 25 bp, S. cerevisiae
acgacccatccgtaagaccaggtga

SEQ ID NO: 10460 - DNA, 25 bp, S. cerevisiae
accggccacgagtacagacctgaag

SEQ ID NO: 10461 - DNA, 25 bp, S. cerevisiae
accttcgtcggtgaatcatctcaag

SEQ ID NO: 10462 - DNA, 25 bp, S. cerevisiae
acctacctttaggactgtcgcatag

SEQ ID NO: 10463 - DNA, 25 bp, S. cerevisiae
accgtcatcaatattacgagtctga

SEQ ID NO: 10464 - DNA, 25 bp, S. cerevisiae
acctttcatttttcatcggcttaga

SEQ ID NO: 10465 - DNA, 25 bp, S. cerevisiae
accgattctattgtcaaggcttcta

SEQ ID NO: 10466 - DNA, 25 bp, S. cerevisiae
acccggcgtcgattacagacttaat

SEQ ID NO: 10467 - DNA, 25 bp, S. cerevisiae
acccttgcccgctaagcagaagacg

SEQ ID NO: 10468 - DNA, 25 bp, S. cerevisiae
acccgccttccgtgagagagacgat

SEQ ID NO: 10469 - DNA, 25 bp, S. cerevisiae
acctccccacggtcgatgagcaaag

SEQ ID NO: 10470 - DNA, 25 bp, S. cerevisiae
acgcccacaattcgatctattgcaa

SEQ ID NO: 10471 - DNA, 25 bp, S. cerevisiae
acctccaaattctgcttcttctata

SEQ ID NO: 10472 - DNA, 25 bp, S. cerevisiae
acctccaaattacctgatcctgaaa

SEQ ID NO: 10473 - DNA, 25 bp, S. cerevisiae
acgcttacaatttgccgaccggtat

SEQ ID NO: 10474 - DNA, 25 bp, S. cerevisiae
acctttctgttggtatcagcgatgg

SEQ ID NO: 10475 - DNA, 25 bp, S. cerevisiae
accttttatgaacgcatctgccgaa

SEQ ID NO: 10476 - DNA, 25 bp, S. cerevisiae
accgacgataaactcattcctgtag

SEQ ID NO: 10477 - DNA, 25 bp, S. cerevisiae
acgccatcgtcatcactaaacttaa

SEQ ID NO: 10478 - DNA, 25 bp, S. cerevisiae
accgcccatcgctttgataatgtat

SEQ ID NO: 10479 - DNA, 25 bp, S. cerevisiae
acctcttcaccctatttcagattat

SEQ ID NO: 10480 - DNA, 25 bp, S. cerevisiae
acctgtctacccgttgaaatcattg

SEQ ID NO: 10481 - DNA, 25 bp, S. cerevisiae
acctccttccgcgtatgttgataat

SEQ ID NO: 10482 - DNA, 25 bp, S. cerevisiae
acctttctcccttgatgagttcaat

SEQ ID NO: 10483 - DNA, 25 bp, S. cerevisiae
actcttcgccggatttactatctaa

SEQ ID NO: 10484 - DNA, 25 bp, S. cerevisiae
acgccagcaattccttgtgcgatgg

SEQ ID NO: 10485 - DNA, 25 bp, S. cerevisiae
acctccaattacatcgacggatttt

SEQ ID NO: 10486 - DNA, 25 bp, S. cerevisiae
acgctacacatatttttgacggctt

SEQ ID NO: 10487 - DNA, 25 bp, S. cerevisiae
acctactctacttccacacgaggaa

SEQ ID NO: 10488 - DNA, 25 bp, S. cerevisiae
acgacaatggtctgcgaagccttat

SEQ ID NO: 10489 - DNA, 25 bp, S. cerevisiae
acgctgaagcagttaccaccatttg

SEQ ID NO: 10490 - DNA, 25 bp, S. cerevisiae
acctgacgctcacaacaacattata

SEQ ID NO: 10491 - DNA, 25 bp, S. cerevisiae
accgaagctgccaagaaatctgaaa

SEQ ID NO: 10492 - DNA, 25 bp, S. cerevisiae
accgaggcggagttgagttgtctaa

SEQ ID NO: 10493 - DNA, 25 bp, S. cerevisiae
caccggcgttgataactatttacaa

SEQ ID NO: 10494 - DNA, 25 bp, S. cerevisiae
accgctgctgggtacaagctgtgtt

SEQ ID NO: 10495 - DNA, 25 bp, S. cerevisiae
acctgctccggtacataggatattg

SEQ ID NO: 10496 - DNA, 25 bp, S. cerevisiae
acccctatgcctgcttaactataag

SEQ ID NO: 10497 - DNA, 25 bp, S. cerevisiae
acgtcgcttccatcgaacaaaccgt

SEQ ID NO: 10498 - DNA, 25 bp, S. cerevisiae
acgctcctcctgcatcaaaagatag

SEQ ID NO: 10499 - DNA, 25 bp, S. cerevisiae
acccagcaatcgctccaatagtaga

SEQ ID NO: 10500 - DNA, 25 bp, S. cerevisiae
acgcaagccatcacccgtggtaaaa

SEQ ID NO: 10501 - DNA, 25 bp, S. cerevisiae
aagaaggacgcagccctagtagggt

SEQ ID NO: 10502 - DNA, 25 bp, S. cerevisiae
acgctattacgatctcctactaagg

SEQ ID NO: 10503 - DNA, 25 bp, S. cerevisiae
acgcttctaaccgtgcattgcaaga

SEQ ID NO: 10504 - DNA, 25 bp, S. cerevisiae
acccatcttgatgctggccaataaa

SEQ ID NO: 10505 - DNA, 25 bp, S. cerevisiae
accccttaacgaccagcattagtag

SEQ ID NO: 10506 - DNA, 25 bp, S. cerevisiae
acccacctggaaatctccaatcgaa

SEQ ID NO: 10507 - DNA, 25 bp, S. cerevisiae
acgccatggcgtattcagtaaagag

SEQ ID NO: 10508 - DNA, 25 bp, S. cerevisiae
acaaagttggacctaatttacatgg

SEQ ID NO: 10509 - DNA, 25 bp, S. cerevisiae
acgccttccgaactttttgatactg

SEQ ID NO: 10510 - DNA, 25 bp, S. cerevisiae
accctttattgaatttttagccatg

SEQ ID NO: 10511 - DNA, 25 bp, S. cerevisiae
acctggctacagtatttcttttcta

SEQ ID NO: 10512 - DNA, 25 bp, S. cerevisiae
acctggtcaaggcaattggcgctct

SEQ ID NO: 10513 - DNA, 25 bp, S. cerevisiae
acctcgcacgcactattttgcagta

SEQ ID NO: 10514 - DNA, 25 bp, S. cerevisiae
accgacaacacttctgatggcagct

SEQ ID NO: 10515 - DNA, 25 bp, S. cerevisiae
accgaagatccgtttatcgctgatt

SEQ ID NO: 10516 - DNA, 25 bp, S. cerevisiae
acctaattgttgttccatttttgca

SEQ ID NO: 10517 - DNA, 25 bp, S. cerevisiae
acctcatgtgtttttcagttctcca

SEQ ID NO: 10518 - DNA, 25 bp, S. cerevisiae
accgcggtggatgctcttcaaaaag

SEQ ID NO: 10519 - DNA, 25 bp, S. cerevisiae
acctgggatcgtgcacttcaattaa

SEQ ID NO: 10520 - DNA, 25 bp, S. cerevisiae
accccagcaattccgattacgatat

SEQ ID NO: 10521 - DNA, 25 bp, S. cerevisiae
acgcggagtgcgaggacaaacctaa

SEQ ID NO: 10522 - DNA, 25 bp, S. cerevisiae
acgccagcattgaactttaacccag

SEQ ID NO: 10523 - DNA, 25 bp, S. cerevisiae
ccgtatcgaagatgttaccccagtt

SEQ ID NO: 10524 - DNA, 25 bp, S. cerevisiae
acggactactgttgattgcatcggt

SEQ ID NO: 10525 - DNA, 25 bp, S. cerevisiae
acgaattgggtactgctgtcggtaa

SEQ ID NO: 10526 - DNA, 25 bp, S. cerevisiae
acgagacgggccagcgttgcgaaat

SEQ ID NO: 10527 - DNA, 25 bp, S. cerevisiae
actggcgatcgcaacaatgctgtca

SEQ ID NO: 10528 - DNA, 25 bp, S. cerevisiae
accggatcagcctaatgtgtcttac

SEQ ID NO: 10529 - DNA, 25 bp, S. cerevisiae
acccgagcttggtgggctatattca

SEQ ID NO: 10530 - DNA, 25 bp, S. cerevisiae
acccagagatgttgttgtcctagtt

SEQ ID NO: 10531 - DNA, 25 bp, S. cerevisiae
acctcgcgttcactattttgcagtt

SEQ ID NO: 10532 - DNA, 25 bp, S. cerevisiae
acctctggttctccatatttggcat

SEQ ID NO: 10533 - DNA, 25 bp, S. cerevisiae
acctgtgggacctattttggttgca

SEQ ID NO: 10534 - DNA, 25 bp, S. cerevisiae
accgttttcaccttcttgatgttga

SEQ ID NO: 10535 - DNA, 25 bp, S. cerevisiae
accggtgtgttatgtgcttgcgtta

SEQ ID NO: 10536 - DNA, 25 bp, S. cerevisiae
accggtgcgtgtttgtttactgatc

SEQ ID NO: 10537 - DNA, 25 bp, S. cerevisiae
acgctagttactgttacttcctgcg

SEQ ID NO: 10538 - DNA, 25 bp, S. cerevisiae
caccttccctaatggcttcaagaat

SEQ ID NO: 10539 - DNA, 25 bp, S. cerevisiae
accggcacgctcttttgaacatgag

SEQ ID NO: 10540 - DNA, 25 bp, S. cerevisiae
acctccgctgctatcattgacaaaa

SEQ ID NO: 10541 - DNA, 25 bp, S. cerevisiae
acctgtgttgattgtaatgacccaa

SEQ ID NO: 10542 - DNA, 25 bp, S. cerevisiae
accgctttgttgtgctacactcaat

SEQ ID NO: 10543 - DNA, 25 bp, S. cerevisiae
acttctgcctttgaacaatttccca

SEQ ID NO: 10544 - DNA, 25 bp, S. cerevisiae
actgcttcctttagcggtaacctga

SEQ ID NO: 10545 - DNA, 25 bp, S. cerevisiae
acgattcacttttgtcttaccctat

SEQ ID NO: 10546 - DNA, 25 bp, S. cerevisiae
acctgcccttgtagatgtcttgttt

SEQ ID NO: 10547 - DNA, 25 bp, S. cerevisiae
acctgtcctgcctatattgttattt

SEQ ID NO: 10548 - DNA, 25 bp, S. cerevisiae
acctgtataggtatttcatcattga

SEQ ID NO: 10549 - DNA, 25 bp, S. cerevisiae
accgtcatgggtgtctttgagcaat

SEQ ID NO: 10550 - DNA, 25 bp, S. cerevisiae
accgcctttggatgctatgtctata

SEQ ID NO: 10551 - DNA, 25 bp, S. cerevisiae
acccgttgttgcagtattttatgaa

SEQ ID NO: 10552 - DNA, 25 bp, S. cerevisiae
acgagcggtaggaaggcacattaca

SEQ ID NO: 10553 - DNA, 25 bp, S. cerevisiae
acgctggtacccgtcacaatgtagg

SEQ ID NO: 10554 - DNA, 25 bp, S. cerevisiae
accgttgcccatgccaaatgataat

SEQ ID NO: 10555 - DNA, 25 bp, S. cerevisiae
actggtagtagctccattaactgca

SEQ ID NO: 10556 - DNA, 25 bp, S. cerevisiae
acctgattctcagacgttcgaaatg

SEQ ID NO: 10557 - DNA, 25 bp, S. cerevisiae
acctgcattagagtagcgctgttga

SEQ ID NO: 10558 - DNA, 25 bp, S. cerevisiae
acaccgtaaggttgtactgtcccag

SEQ ID NO: 10559 - DNA, 25 bp, S. cerevisiae
acgccagaaaggttgtcggtgcctc

SEQ ID NO: 10560 - DNA, 25 bp, S. cerevisiae
acccaagccagatattcgtccttta

SEQ ID NO: 10561 - DNA, 25 bp, S. cerevisiae
accgtcattcagatgtgcattctca

SEQ ID NO: 10562 - DNA, 25 bp, S. cerevisiae
acctgattgtagtctgtgcttcctc

SEQ ID NO: 10563 - DNA, 25 bp, S. cerevisiae
accgttaaggtaaatccgtctgatg

SEQ ID NO: 10564 - DNA, 25 bp, S. cerevisiae
accgtttctgcaaagacggcgagaa

SEQ ID NO: 10565 - DNA, 25 bp, S. cerevisiae
acctgtaccatgttaactgcaccaa

SEQ ID NO: 10566 - DNA, 25 bp, S. cerevisiae
accgccaccaatttacatgacgaat

SEQ ID NO: 10567 - DNA, 25 bp, S. cerevisiae
accctcacttgtatactgatatggc

SEQ ID NO: 10568 - DNA, 25 bp, S. cerevisiae
accggttctttgacatggtctgaca

SEQ ID NO: 10569 - DNA, 25 bp, S. cerevisiae
acctggttctgtatttgtatgtcac

SEQ ID NO: 10570 - DNA, 25 bp, S. cerevisiae
accgtttccgttactgctggcaaag

SEQ ID NO: 10571 - DNA, 25 bp, S. cerevisiae
acctggtctcacgtatatttgccaa

SEQ ID NO: 10572 - DNA, 25 bp, S. cerevisiae
acctgtctccactattttgagccaa

SEQ ID NO: 10573 - DNA, 25 bp, S. cerevisiae
acgatgatacacatttcggtgacga

SEQ ID NO: 10574 - DNA, 25 bp, S. cerevisiae
acgctgccaaggattctagtgaatt

SEQ ID NO: 10575 - DNA, 25 bp, S. cerevisiae
accgcacctgtgatatccaaaactt

SEQ ID NO: 10576 - DNA, 25 bp, S. cerevisiae
actccctttgacgtggtgaaatcca

SEQ ID NO: 10577 - DNA, 25 bp, S. cerevisiae
actcccggtgaggtggcttctaaag

SEQ ID NO: 10578 - DNA, 25 bp, S. cerevisiae
accccgtgctgggtggcacatatat

SEQ ID NO: 10579 - DNA, 25 bp, S. cerevisiae
accgtcgatgacgttatcactcaat

SEQ ID NO: 10580 - DNA, 25 bp, S. cerevisiae
aaggtacggtcaagcttctaagtat

SEQ ID NO: 10581 - DNA, 25 bp, S. cerevisiae
acgttaagtgaatccactcccggtg

SEQ ID NO: 10582 - DNA, 25 bp, S. cerevisiae
acgtaaaatgatgtccttccaggca

SEQ ID NO: 10583 - DNA, 25 bp, S. cerevisiae
acggaaaacgtgtccttgtcacaga

SEQ ID NO: 10584 - DNA, 25 bp, S. cerevisiae
accgaagttcgtagaattgctccaa

SEQ ID NO: 10585 - DNA, 25 bp, S. cerevisiae
accgcttggttagggacatcatctc

SEQ ID NO: 10586 - DNA, 25 bp, S. cerevisiae
accgagcttttagtggatgtcatca

SEQ ID NO: 10587 - DNA, 25 bp, S. cerevisiae
acccaatcgatcttttcaccaaatg

SEQ ID NO: 10588 - DNA, 25 bp, S. cerevisiae
accgcagtaatctggacccactatg

SEQ ID NO: 10589 - DNA, 25 bp, S. cerevisiae
accggtttcactcaccatgtaatgg

SEQ ID NO: 10590 - DNA, 25 bp, S. cerevisiae
acgaatctttcggtttcactggtga

SEQ ID NO: 10591 - DNA, 25 bp, S. cerevisiae
acgattttagcgatgttccccttga

SEQ ID NO: 10592 - DNA, 25 bp, S. cerevisiae
actttgttgggtgaattcgacttga

SEQ ID NO: 10593 - DNA, 25 bp, S. cerevisiae
accgattttattatcctcgtttctg

SEQ ID NO: 10594 - DNA, 25 bp, S. cerevisiae
accgcttccattcattcgtttgatt

SEQ ID NO: 10595 - DNA, 25 bp, S. cerevisiae
acccttactggttgcctgattttat

SEQ ID NO: 10596 - DNA, 25 bp, S. cerevisiae
acgcgttctggtcccaatacttaga

SEQ ID NO: 10597 - DNA, 25 bp, S. cerevisiae
acgacttcgtgcacaaatttattgg

SEQ ID NO: 10598 - DNA, 25 bp, S. cerevisiae
acccgcactgtttggtgtttcgcaa

SEQ ID NO: 10599 - DNA, 25 bp, S. cerevisiae
accgatatactttcacaactcagag

SEQ ID NO: 10600 - DNA, 25 bp, S. cerevisiae
accgatgaagtatacgcagcctggc

SEQ ID NO: 10601 - DNA, 25 bp, S. cerevisiae
accgtcgctgtatcaccaggtgatg

SEQ ID NO: 10602 - DNA, 25 bp, S. cerevisiae
accgttttgcgacagatatttttca

SEQ ID NO: 10603 - DNA, 25 bp, S. cerevisiae
acccgctttgcctgttaatgattta

SEQ ID NO: 10604 - DNA, 25 bp, S. cerevisiae
accgatctccaacttagtgttctta

SEQ ID NO: 10605 - DNA, 25 bp, S. cerevisiae
accgcattgctatgcttctttttga

SEQ ID NO: 10606 - DNA, 25 bp, S. cerevisiae
acccagtctacgttatggccaaact

SEQ ID NO: 10607 - DNA, 25 bp, S. cerevisiae
acgcctttaccatttgcgccaaata

SEQ ID NO: 10608 - DNA, 25 bp, S. cerevisiae
accctgttactatatgtggcactta

SEQ ID NO: 10609 - DNA, 25 bp, S. cerevisiae
acgccttgttagtgcttgttttaca

SEQ ID NO: 10610 - DNA, 25 bp, S. cerevisiae
acgctatgtccgtcgatgacttgaa

SEQ ID NO: 10611 - DNA, 25 bp, S. cerevisiae
acgccagtcctacagatcttgaatg

SEQ ID NO: 10612 - DNA, 25 bp, S. cerevisiae
accgaacttcatccattcgctggat

SEQ ID NO: 10613 - DNA, 25 bp, S. cerevisiae
acaaaatcaggctcaatcctggtaa

SEQ ID NO: 10614 - DNA, 25 bp, S. cerevisiae
actaactcaagttcacatccagaaa

SEQ ID NO: 10615 - DNA, 25 bp, S. cerevisiae
acgagagccaagaccacactggtaa

SEQ ID NO: 10616 - DNA, 25 bp, S. cerevisiae
acgagattcagatttcagcccttgc

SEQ ID NO: 10617 - DNA, 25 bp, S. cerevisiae
actggagtgcagctagaggctctaa

SEQ ID NO: 10618 - DNA, 25 bp, S. cerevisiae
acgctaggcgcttagcagagttcaa

SEQ ID NO: 10619 - DNA, 25 bp, S. cerevisiae
acgtgggcagtagcgcattcggaac

SEQ ID NO: 10620 - DNA, 25 bp, S. cerevisiae
acgctactaccgtcttgtcaagagg

SEQ ID NO: 10621 - DNA, 25 bp, S. cerevisiae
acgcaggtacctgctgctattacaa

SEQ ID NO: 10622 - DNA, 25 bp, S. cerevisiae
acgcggcttatggtgttggtttgtt

SEQ ID NO: 10623 - DNA, 25 bp, S. cerevisiae
actgcagaaactgatcccggtgttc

SEQ ID NO: 10624 - DNA, 25 bp, S. cerevisiae
acgagttacaacgatgcgcggttcc

SEQ ID NO: 10625 - DNA, 25 bp, S. cerevisiae
acgctgtctccatgcgacatgtgta

SEQ ID NO: 10626 - DNA, 25 bp, S. cerevisiae
acgcgtgtccgggtgcatgcatgaa

SEQ ID NO: 10627 - DNA, 25 bp, S. cerevisiae
accgcttccagatttgctgtcaaat

SEQ ID NO: 10628 - DNA, 25 bp, S. cerevisiae
acacctaagcctgccactgaatagg

SEQ ID NO: 10629 - DNA, 25 bp, S. cerevisiae
accccagatgccaccaagattaagg

SEQ ID NO: 10630 - DNA, 25 bp, S. cerevisiae
acccgcctgccaacgtagaaaagat

SEQ ID NO: 10631 - DNA, 25 bp, S. cerevisiae
acgccgcctgctaaagtcaagacaa

SEQ ID NO: 10632 - DNA, 25 bp, S. cerevisiae
accccgattcttgctcatagtcaaa

SEQ ID NO: 10633 - DNA, 25 bp, S. cerevisiae
acgcgaagggcatgacagtgtgtct

SEQ ID NO: 10634 - DNA, 25 bp, S. cerevisiae
acgaggacgggtttggacgcatcaa

SEQ ID NO: 10635 - DNA, 25 bp, S. cerevisiae
acagccttcaatgccacggtggacg

SEQ ID NO: 10636 - DNA, 25 bp, S. cerevisiae
acgtttcattgagccgaggagacct

SEQ ID NO: 10637 - DNA, 25 bp, S. cerevisiae
acgacttcatcgacagccaaatcat

SEQ ID NO: 10638 - DNA, 25 bp, S. cerevisiae
acgccgaccacagcattaatcataa

SEQ ID NO: 10639 - DNA, 25 bp, S. cerevisiae
acccgaaccctcttctgataaagat

SEQ ID NO: 10640 - DNA, 25 bp, S. cerevisiae
acgggaagtcctctctgacaggata

SEQ ID NO: 10641 - DNA, 25 bp, S. cerevisiae
ccgacagtaaatctacaatcagtat

SEQ ID NO: 10642 - DNA, 25 bp, S. cerevisiae
acgacgtcgaagtgcactctagtat

SEQ ID NO: 10643 - DNA, 25 bp, S. cerevisiae
acgttttgtcagtggctttgtattc

SEQ ID NO: 10644 - DNA, 25 bp, S. cerevisiae
acgtcccgtagatatttggtcttct

SEQ ID NO: 10645 - DNA, 25 bp, S. cerevisiae
accctttgtcctgcatgatgcgcat

SEQ ID NO: 10646 - DNA, 25 bp, S. cerevisiae
accgcttttgcatctcagatcagta

SEQ ID NO: 10647 - DNA, 25 bp, S. cerevisiae
accgctttaggttcagacagtgacg

SEQ ID NO: 10648 - DNA, 25 bp, S. cerevisiae
acccttggaagagtcagatcagaga

SEQ ID NO: 10649 - DNA, 25 bp, S. cerevisiae
acgatcatctgttcacgtcgacgaa

SEQ ID NO: 10650 - DNA, 25 bp, S. cerevisiae
acgacatcttgcttgcccaggcaga

SEQ ID NO: 10651 - DNA, 25 bp, S. cerevisiae
acgccataaagtccacagttttgat

SEQ ID NO: 10652 - DNA, 25 bp, S. cerevisiae
accgctaaggcttctttctgttgat

SEQ ID NO: 10653 - DNA, 25 bp, S. cerevisiae
accgctacttcttcatcaattattc

SEQ ID NO: 10654 - DNA, 25 bp, S. cerevisiae
accgctactgttactcagtgcgatg

SEQ ID NO: 10655 - DNA, 25 bp, S. cerevisiae
acgagacgccattacacgatgatga

SEQ ID NO: 10656 - DNA, 25 bp, S. cerevisiae
acgatcacgatgctacatggttgaa

SEQ ID NO: 10657 - DNA, 25 bp, S. cerevisiae
acgcattccctgatctggttgaaac

SEQ ID NO: 10658 - DNA, 25 bp, S. cerevisiae
acgattcatgtatcctgcagttttg

SEQ ID NO: 10659 - DNA, 25 bp, S. cerevisiae
acgccatgtggaatgccttgatgca

SEQ ID NO: 10660 - DNA, 25 bp, S. cerevisiae
acgccattggctccgtatatgtgat

SEQ ID NO: 10661 - DNA, 25 bp, S. cerevisiae
acgccatgtggcttctgttttatta

SEQ ID NO: 10662 - DNA, 25 bp, S. cerevisiae
acccgttcctctatcatttgcgaat

SEQ ID NO: 10663 - DNA, 25 bp, S. cerevisiae
acccgctccccgatcttgatgaaga

SEQ ID NO: 10664 - DNA, 25 bp, S. cerevisiae
acccgcttcctctttatcgaaagat

SEQ ID NO: 10665 - DNA, 25 bp, S. cerevisiae
accccatattgtggctgtttaccaa

SEQ ID NO: 10666 - DNA, 25 bp, S. cerevisiae
acccagcttcttcgagtttgatcac

SEQ ID NO: 10667 - DNA, 25 bp, S. cerevisiae
acgcacgttgcgtagagcttatatc

SEQ ID NO: 10668 - DNA, 25 bp, S. cerevisiae
acgcttgacgcggatgctttaacaa

SEQ ID NO: 10669 - DNA, 25 bp, S. cerevisiae
acgctcgaaggccttttctgatgaa

SEQ ID NO: 10670 - DNA, 25 bp, S. cerevisiae
acgtcaaatctgctttgcctcaaga

SEQ ID NO: 10671 - DNA, 25 bp, S. cerevisiae
acgttaatcgtggacagccccatct

SEQ ID NO: 10672 - DNA, 25 bp, S. cerevisiae
acgttaactttgcaggacctcttcg

SEQ ID NO: 10673 - DNA, 25 bp, S. cerevisiae
acgttgaagcttcccaaattcctga

SEQ ID NO: 10674 - DNA, 25 bp, S. cerevisiae
acagattccgttcacgaactgttga

SEQ ID NO: 10675 - DNA, 25 bp, S. cerevisiae
acgcttccgtatccgagtacttaat

SEQ ID NO: 10676 - DNA, 25 bp, S. cerevisiae
acgctactcgttgctgttactaata

SEQ ID NO: 10677 - DNA, 25 bp, S. cerevisiae
acggcaacaactcttgagcgcttgg

SEQ ID NO: 10678 - DNA, 25 bp, S. cerevisiae
acgtcgcaaagtcttatgccttgga

SEQ ID NO: 10679 - DNA, 25 bp, S. cerevisiae
acgtctgaagttgttgaccctgctg

SEQ ID NO: 10680 - DNA, 25 bp, S. cerevisiae
acgtagacgtcctgtgtgccattag

SEQ ID NO: 10681 - DNA, 25 bp, S. cerevisiae
acgtctacgacaaagttctcttgga

SEQ ID NO: 10682 - DNA, 25 bp, S. cerevisiae
acgcggcgacaatgacttgttttat

SEQ ID NO: 10683 - DNA, 25 bp, S. cerevisiae
accgctgttcaaagcctggttgatc

SEQ ID NO: 10684 - DNA, 25 bp, S. cerevisiae
accgcgtatcaaattctgtgtcgaa

SEQ ID NO: 10685 - DNA, 25 bp, S. cerevisiae
accgcggatctgtctgtctatttga

SEQ ID NO: 10686 - DNA, 25 bp, S. cerevisiae
acgtgcgtgacgtttctaaagccca

SEQ ID NO: 10687 - DNA, 25 bp, S. cerevisiae
gacggttactacattaacgcccaat

SEQ ID NO: 10688 - DNA, 25 bp, S. cerevisiae
acggttgtgccagtgagtacgctaa

SEQ ID NO: 10689 - DNA, 25 bp, S. cerevisiae
acgtggccgccttcgatttggacta

SEQ ID NO: 10690 - DNA, 25 bp, S. cerevisiae
acgctaccgtcattgttttgaacca

SEQ ID NO: 10691 - DNA, 25 bp, S. cerevisiae
acgcaggccttcttggatttgttta

SEQ ID NO: 10692 - DNA, 25 bp, S. cerevisiae
acgcgcacgccaattctacaaatgt

SEQ ID NO: 10693 - DNA, 25 bp, S. cerevisiae
acgaagcatgcgttttatgcgaaga

SEQ ID NO: 10694 - DNA, 25 bp, S. cerevisiae
acggcactggcgttggtggcaaatc

SEQ ID NO: 10695 - DNA, 25 bp, S. cerevisiae
acgaccagggtattgttcacagaga

SEQ ID NO: 10696 - DNA, 25 bp, S. cerevisiae
acgaatctacttttgttccagaggg

SEQ ID NO: 10697 - DNA, 25 bp, S. cerevisiae
accccagttatcatgatcggtccag

SEQ ID NO: 10698 - DNA, 25 bp, S. cerevisiae
acccctgttatatgcactgtacgaa

SEQ ID NO: 10699 - DNA, 25 bp, S. cerevisiae
acccaagcggcatctttcataaatc

SEQ ID NO: 10700 - DNA, 25 bp, S. cerevisiae
accctagcggctgtgagtttagata

SEQ ID NO: 10701 - DNA, 25 bp, S. cerevisiae
acccctgctgggatgacatattaaa

SEQ ID NO: 10702 - DNA, 25 bp, S. cerevisiae
acgcaggctgcacaattacacgaga

SEQ ID NO: 10703 - DNA, 25 bp, S. cerevisiae
acgcttctgagctatgtgtatacga

SEQ ID NO: 10704 - DNA, 25 bp, S. cerevisiae
acgcagacgtgctagtttcgctgaa

SEQ ID NO: 10705 - DNA, 25 bp, S. cerevisiae
acgcagatggtgtaatgtttcaaaa

SEQ ID NO: 10706 - DNA, 25 bp, S. cerevisiae
acagttcgctaatggactcgtcgga

SEQ ID NO: 10707 - DNA, 25 bp, S. cerevisiae
acagctacctaaaacgtcctattca

SEQ ID NO: 10708 - DNA, 25 bp, S. cerevisiae
acgcggagtcgtagcaactgcttca

SEQ ID NO: 10709 - DNA, 25 bp, S. cerevisiae
acgagtgactctggaactatgcttc

SEQ ID NO: 10710 - DNA, 25 bp, S. cerevisiae
actgatacctgtagagaaagcctct

SEQ ID NO: 10711 - DNA, 25 bp, S. cerevisiae
acgtgttcctttgagggctgtcata

SEQ ID NO: 10712 - DNA, 25 bp, S. cerevisiae
acgaatcctttattagggctgataa

SEQ ID NO: 10713 - DNA, 25 bp, S. cerevisiae
acgacagtctctccgataacagtga

SEQ ID NO: 10714 - DNA, 25 bp, S. cerevisiae
acgagccttcggcaacagcattaag

SEQ ID NO: 10715 - DNA, 25 bp, S. cerevisiae
acgaaggtgtgtttcattcccgtcg

SEQ ID NO: 10716 - DNA, 25 bp, S. cerevisiae
acgttggatagtttcattcactaca

SEQ ID NO: 10717 - DNA, 25 bp, S. cerevisiae
acgttctggattcgtacttggtgaa

SEQ ID NO: 10718 - DNA, 25 bp, S. cerevisiae
acgaatttgattgtacctggtgcag

SEQ ID NO: 10719 - DNA, 25 bp, S. cerevisiae
acgagatttgcaaggcctgctctga

SEQ ID NO: 10720 - DNA, 25 bp, S. cerevisiae
acgagattgtgatgcccgtgcccaa

SEQ ID NO: 10721 - DNA, 25 bp, S. cerevisiae
acgcgaattgattccttttgccaaa

SEQ ID NO: 10722 - DNA, 25 bp, S. cerevisiae
acggtcgcttctagaactggtgcag

SEQ ID NO: 10723 - DNA, 25 bp, S. cerevisiae
acgcctcagcgtacgaatctgggtg

SEQ ID NO: 10724 - DNA, 25 bp, S. cerevisiae
acgctccatgggatgcaatctggta

SEQ ID NO: 10725 - DNA, 25 bp, S. cerevisiae
acgctcgctgtcgttgaatctgggc

SEQ ID NO: 10726 - DNA, 25 bp, S. cerevisiae
acgccagctgctaaccaagtcgaaa

SEQ ID NO: 10727 - DNA, 25 bp, S. cerevisiae
acgcgcgctgaatccaagatgtaca

SEQ ID NO: 10728 - DNA, 25 bp, S. cerevisiae
acgtttcactcaaaacttctccatg

SEQ ID NO: 10729 - DNA, 25 bp, S. cerevisiae
acgtgcttttaatgacccaccaggg

SEQ ID NO: 10730 - DNA, 25 bp, S. cerevisiae
acgctgtttctgtttgtccaaatct

SEQ ID NO: 10731 - DNA, 25 bp, S. cerevisiae
acgttatgtcgctggtgtgcaacaa

SEQ ID NO: 10732 - DNA, 25 bp, S. cerevisiae
acgaagatgtcgaactcctgaaaaa

SEQ ID NO: 10733 - DNA, 25 bp, S. cerevisiae
acgataatgctcatattcctccgac

SEQ ID NO: 10734 - DNA, 25 bp, S. cerevisiae
acgaatgtcatttcttcttgcacca

SEQ ID NO: 10735 - DNA, 25 bp, S. cerevisiae
acgttgtgccaattccattgcattt

SEQ ID NO: 10736 - DNA, 25 bp, S. cerevisiae
catcttgggtaatctaacgacttta

SEQ ID NO: 10737 - DNA, 25 bp, S. cerevisiae
actacaggtctgtttaacgagggat

SEQ ID NO: 10738 - DNA, 25 bp, S. cerevisiae
acgtccaacgtcttgagtcgctgga

SEQ ID NO: 10739 - DNA, 25 bp, S. cerevisiae
acggacacttacttggttgctgggt

SEQ ID NO: 10740 - DNA, 25 bp, S. cerevisiae
acgaacttacaaagccttcagggcg

SEQ ID NO: 10741 - DNA, 25 bp, S. cerevisiae
acacaaatttccagtttcagggctt

SEQ ID NO: 10742 - DNA, 25 bp, S. cerevisiae
acgactacttacagtgttttcacaa

SEQ ID NO: 10743 - DNA, 25 bp, S. cerevisiae
acgacgactatctgactttttccaa

SEQ ID NO: 10744 - DNA, 25 bp, S. cerevisiae
acgacgacaactcccatttttgtat

SEQ ID NO: 10745 - DNA, 25 bp, S. cerevisiae
acgaggacccgatagatttgataat

SEQ ID NO: 10746 - DNA, 25 bp, S. cerevisiae
acgcgaatgccggtatgaactcatc

SEQ ID NO: 10747 - DNA, 25 bp, S. cerevisiae
acccacgagggctaacgttgctata

SEQ ID NO: 10748 - DNA, 25 bp, S. cerevisiae
acgccacagccgtcaataatgttgc

SEQ ID NO: 10749 - DNA, 25 bp, S. cerevisiae
acgccatggtggtttactagtctat

SEQ ID NO: 10750 - DNA, 25 bp, S. cerevisiae
acgccgctaggctgtatgataggat

SEQ ID NO: 10751 - DNA, 25 bp, S. cerevisiae
acgacccttcaacgagacatcatta

SEQ ID NO: 10752 - DNA, 25 bp, S. cerevisiae
acgcctccattagacgctgattcta

SEQ ID NO: 10753 - DNA, 25 bp, S. cerevisiae
acgaatcgaaatgccctgatgtcaa

SEQ ID NO: 10754 - DNA, 25 bp, S. cerevisiae
actgaagtacctgcaccagtgcgaa

SEQ ID NO: 10755 - DNA, 25 bp, S. cerevisiae
acgcatcagctttcaccagttttaa

SEQ ID NO: 10756 - DNA, 25 bp, S. cerevisiae
acgtgcatttacctcgtatgattca

SEQ ID NO: 10757 - DNA, 25 bp, S. cerevisiae
acgacgtatgaatgcctcatgttca

SEQ ID NO: 10758 - DNA, 25 bp, S. cerevisiae
acgcttccgatgtttccacttggga

SEQ ID NO: 10759 - DNA, 25 bp, S. cerevisiae
acgattccaatacctctcctaagga

SEQ ID NO: 10760 - DNA, 25 bp, S. cerevisiae
acgatcgactataccgcccaagaat

SEQ ID NO: 10761 - DNA, 25 bp, S. cerevisiae
acgctgtgacagaacccctaaagat

SEQ ID NO: 10762 - DNA, 25 bp, S. cerevisiae
acgaaggtcgtctattcttgattag

SEQ ID NO: 10763 - DNA, 25 bp, S. cerevisiae
acgacggtgcctttgactgtttgag

SEQ ID NO: 10764 - DNA, 25 bp, S. cerevisiae
acgcccttgatcatcgatcttttag

SEQ ID NO: 10765 - DNA, 25 bp, S. cerevisiae
acggccggagttgctttatccgaat

SEQ ID NO: 10766 - DNA, 25 bp, S. cerevisiae
acggtttctaagatcgcgatacttg

SEQ ID NO: 10767 - DNA, 25 bp, S. cerevisiae
acgttttctcaaatatcgggtctct

SEQ ID NO: 10768 - DNA, 25 bp, S. cerevisiae
acgagtttgcctattcttgaaacta

SEQ ID NO: 10769 - DNA, 25 bp, S. cerevisiae
acgcgttgagtgataacagccacat

SEQ ID NO: 10770 - DNA, 25 bp, S. cerevisiae
acgggtggtactttcaccatatcta

SEQ ID NO: 10771 - DNA, 25 bp, S. cerevisiae
acgcctgctaatttattccacattc

SEQ ID NO: 10772 - DNA, 25 bp, S. cerevisiae
acgcaacaacaattctgctgccttt

SEQ ID NO: 10773 - DNA, 25 bp, S. cerevisiae
acccaactgccaccgatttgattga

SEQ ID NO: 10774 - DNA, 25 bp, S. cerevisiae
actcccgtaaccaattttctgacag

SEQ ID NO: 10775 - DNA, 25 bp, S. cerevisiae
actaaacctccgctcatataacgaa

SEQ ID NO: 10776 - DNA, 25 bp, S. cerevisiae
acgataaccaccctttgtatactgt

SEQ ID NO: 10777 - DNA, 25 bp, S. cerevisiae
acgtcaaaccagtcagatgtgtcaa

SEQ ID NO: 10778 - DNA, 25 bp, S. cerevisiae
acgtcaaaccagtcagatgtgtcaa

SEQ ID NO: 10779 - DNA, 25 bp, S. cerevisiae
acgctgtcggactacaatattcaaa

SEQ ID NO: 10780 - DNA, 25 bp, S. cerevisiae
acgggatctacgtcgatttctttca

SEQ ID NO: 10781 - DNA, 25 bp, S. cerevisiae
acgtggaccctgaagtcttgctaaa

SEQ ID NO: 10782 - DNA, 25 bp, S. cerevisiae
acgatctaactcaggtcattgggaa

SEQ ID NO: 10783 - DNA, 25 bp, S. cerevisiae
acgtgtgtcgtctttgaatggtggc

SEQ ID NO: 10784 - DNA, 25 bp, S. cerevisiae
acgatccatgcttggtgcacgtaat

SEQ ID NO: 10785 - DNA, 25 bp, S. cerevisiae
acgctccacttactcctgaaataaa

SEQ ID NO: 10786 - DNA, 25 bp, S. cerevisiae
acgggcgctacttcatttatggttc

SEQ ID NO: 10787 - DNA, 25 bp, S. cerevisiae
acggactttggctgtaatgaatttc

SEQ ID NO: 10788 - DNA, 25 bp, S. cerevisiae
acgattcttcgccagattactttca

SEQ ID NO: 10789 - DNA, 25 bp, S. cerevisiae
acgctattaccaatgggcagctctt

SEQ ID NO: 10790 - DNA, 25 bp, S. cerevisiae
acgaagttcgagtggctgctccgga

SEQ ID NO: 10791 - DNA, 25 bp, S. cerevisiae
acgccgcttggttggtgttcgctaa

SEQ ID NO: 10792 - DNA, 25 bp, S. cerevisiae
acggctggtggtgatggtaccttca

SEQ ID NO: 10793 - DNA, 25 bp, S. cerevisiae
acgatttggcagaaattgatacctc

SEQ ID NO: 10794 - DNA, 25 bp, S. cerevisiae
acgacagctctacgatgcgtacttt

SEQ ID NO: 10795 - DNA, 25 bp, S. cerevisiae
acgctttgcgttcttcagtattgct

SEQ ID NO: 10796 - DNA, 25 bp, S. cerevisiae
acgcttttgttgcttctcttgacga

SEQ ID NO: 10797 - DNA, 25 bp, S. cerevisiae
acgctctatggtgtcggtattacaa

SEQ ID NO: 10798 - DNA, 25 bp, S. cerevisiae
acgggttggctgctggtattcacac

SEQ ID NO: 10799 - DNA, 25 bp, S. cerevisiae
actgcaggcgcaaaggatattttag

SEQ ID NO: 10800 - DNA, 25 bp, S. cerevisiae
acgggcctgaagattgtcattggat

SEQ ID NO: 10801 - DNA, 25 bp, S. cerevisiae
acgctccaggtactattgtcttata

SEQ ID NO: 10802 - DNA, 25 bp, S. cerevisiae
acgcctttgatgagacaagccttat

SEQ ID NO: 10803 - DNA, 25 bp, S. cerevisiae
acgctttcttccgtcacagagatta

SEQ ID NO: 10804 - DNA, 25 bp, S. cerevisiae
acgcctttgggctcatcaagattca

SEQ ID NO: 10805 - DNA, 25 bp, S. cerevisiae
actactttacgctgcaccaatacag

SEQ ID NO: 10806 - DNA, 25 bp, S. cerevisiae
acgttcattacgaccaccatagatc

SEQ ID NO: 10807 - DNA, 25 bp, S. cerevisiae
acgctgcgcatttaggtggctctat

SEQ ID NO: 10808 - DNA, 25 bp, S. cerevisiae
acgatgctgatgttttggacaaata

SEQ ID NO: 10809 - DNA, 25 bp, S. cerevisiae
acgatctgaacgtcatgaggctatt

SEQ ID NO: 10810 - DNA, 25 bp, S. cerevisiae
acgattgatatcactgcgccgtacg

SEQ ID NO: 10811 - DNA, 25 bp, S. cerevisiae
acgactttgatcagactttgaacca

SEQ ID NO: 10812 - DNA, 25 bp, S. cerevisiae
acgactttaccaccttcagttatgg

SEQ ID NO: 10813 - DNA, 25 bp, S. cerevisiae
acgatttctacattgcgttcagaga

SEQ ID NO: 10814 - DNA, 25 bp, S. cerevisiae
acgtgcagttatcgttacacttccg

SEQ ID NO: 10815 - DNA, 25 bp, S. cerevisiae
acgtatggtggtaatccgctggcct

SEQ ID NO: 10816 - DNA, 25 bp, S. cerevisiae
acgctttacgatatgccgtggtttt

SEQ ID NO: 10817 - DNA, 25 bp, S. cerevisiae
acgttgatctagttttggcagctga

SEQ ID NO: 10818 - DNA, 25 bp, S. cerevisiae
acggcatgatgctcggcttcggcga

SEQ ID NO: 10819 - DNA, 25 bp, S. cerevisiae
acgacttgccggacttcttaaatga

SEQ ID NO: 10820 - DNA, 25 bp, S. cerevisiae
acgaattgctggcatttggttacaa

SEQ ID NO: 10821 - DNA, 25 bp, S. cerevisiae
acggttgctgccgaattgggaaaca

SEQ ID NO: 10822 - DNA, 25 bp, S. cerevisiae
acggttgccaccattgctattaaat

SEQ ID NO: 10823 - DNA, 25 bp, S. cerevisiae
acgctttccatttgcactgtattaa

SEQ ID NO: 10824 - DNA, 25 bp, S. cerevisiae
acgctgtcactattcgtaccagaaa

SEQ ID NO: 10825 - DNA, 25 bp, S. cerevisiae
acgtatccaaattatcgccaactct

SEQ ID NO: 10826 - DNA, 25 bp, S. cerevisiae
acggattctgattgtaacgcccttc

SEQ ID NO: 10827 - DNA, 25 bp, S. cerevisiae
acgaaacttctgaaattgcccaagc

SEQ ID NO: 10828 - DNA, 25 bp, S. cerevisiae
acgaatggtcttggtatgtgtcagc

SEQ ID NO: 10829 - DNA, 25 bp, S. cerevisiae
acgaatgggcggttgatatgtctga

SEQ ID NO: 10830 - DNA, 25 bp, S. cerevisiae
acgacgtatctggttatatctctga

SEQ ID NO: 10831 - DNA, 25 bp, S. cerevisiae
acggtcaactgcgtttttcgaatgt

SEQ ID NO: 10832 - DNA, 25 bp, S. cerevisiae
acgctgttcaaggtcttttgccgaa

SEQ ID NO: 10833 - DNA, 25 bp, S. cerevisiae
acgttatcacacaggttatggctat

SEQ ID NO: 10834 - DNA, 25 bp, S. cerevisiae
acgctgctggcatacttcaaaagaa

SEQ ID NO: 10835 - DNA, 25 bp, S. cerevisiae
acgtgtagcgggtctgccaaatgta

SEQ ID NO: 10836 - DNA, 25 bp, S. cerevisiae
acgctcgacgagactgtgctgcaaa

SEQ ID NO: 10837 - DNA, 25 bp, S. cerevisiae
acgtcgcagcaacccattcaataat

SEQ ID NO: 10838 - DNA, 25 bp, S. cerevisiae
acgacccatcaagcatgtgaacgtt

SEQ ID NO: 10839 - DNA, 25 bp, S. cerevisiae
aaatcacctcaagcgttacctttct

SEQ ID NO: 10840 - DNA, 25 bp, S. cerevisiae
aaggttacagatgcgttggccgttc

SEQ ID NO: 10841 - DNA, 25 bp, S. cerevisiae
acgttaaaactcacgcttccttatg

SEQ ID NO: 10842 - DNA, 25 bp, S. cerevisiae
ccggcacgaatagaggagttccttt

SEQ ID NO: 10843 - DNA, 25 bp, S. cerevisiae
acgagacgaaacagggcgctcctac

SEQ ID NO: 10844 - DNA, 25 bp, S. cerevisiae
acgcagttcctgtactggtatcaca

SEQ ID NO: 10845 - DNA, 25 bp, S. cerevisiae
acgatgttatcttcactggtgctaa

SEQ ID NO: 10846 - DNA, 25 bp, S. cerevisiae
acgcagttcattctcgagtcttata

SEQ ID NO: 10847 - DNA, 25 bp, S. cerevisiae
acggcaacattcactgggcctcgtt

SEQ ID NO: 10848 - DNA, 25 bp, S. cerevisiae
acgaaagtttattcagccctgctgc

SEQ ID NO: 10849 - DNA, 25 bp, S. cerevisiae
acgagggatttttagaccatgccaa

SEQ ID NO: 10850 - DNA, 25 bp, S. cerevisiae
acgtggaattttttgagcgctgcat

SEQ ID NO: 10851 - DNA, 25 bp, S. cerevisiae
acgtaggcgatcagtttgcaccggt

SEQ ID NO: 10852 - DNA, 25 bp, S. cerevisiae
acggtttgaaccatgttgtctcttt

SEQ ID NO: 10853 - DNA, 25 bp, S. cerevisiae
acggtttcaaccaggctatcgaact

SEQ ID NO: 10854 - DNA, 25 bp, S. cerevisiae
acgacattggtttccacaagtacag

SEQ ID NO: 10855 - DNA, 25 bp, S. cerevisiae
acgacattggtttccacaagtacag

SEQ ID NO: 10856 - DNA, 25 bp, S. cerevisiae
acgacattggtttcaacaaattcag

SEQ ID NO: 10857 - DNA, 25 bp, S. cerevisiae
acgacgatgccatggtacttctaga

SEQ ID NO: 10858 - DNA, 25 bp, S. cerevisiae
actaccgctggtattttcactaacg

SEQ ID NO: 10859 - DNA, 25 bp, S. cerevisiae
acgagcacttcattcatagggtcca

SEQ ID NO: 10860 - DNA, 25 bp, S. cerevisiae
acgacttacaattggcggatacggc

SEQ ID NO: 10861 - DNA, 25 bp, S. cerevisiae
cacgaccctctattactaggaaggt

SEQ ID NO: 10862 - DNA, 25 bp, S. cerevisiae
acgcatcatccttttactatggtga

SEQ ID NO: 10863 - DNA, 25 bp, S. cerevisiae
acgtcacctatttccgtggtggata

SEQ ID NO: 10864 - DNA, 25 bp, S. cerevisiae
actgcctttacgcaagtggttttga

SEQ ID NO: 10865 - DNA, 25 bp, S. cerevisiae
actggtttcagcatggttggatttg

SEQ ID NO: 10866 - DNA, 25 bp, S. cerevisiae
acggacctgagcctccaataaagag

SEQ ID NO: 10867 - DNA, 25 bp, S. cerevisiae
acgcaacgcatatctctcaagaaaa

SEQ ID NO: 10868 - DNA, 25 bp, S. cerevisiae
acgcttgatgctgcctgtatttttt

SEQ ID NO: 10869 - DNA, 25 bp, S. cerevisiae
acgcttttgcatgtgtgtttacctt

SEQ ID NO: 10870 - DNA, 25 bp, S. cerevisiae
acgcattgttgctctggatagtcaa

SEQ ID NO: 10871 - DNA, 25 bp, S. cerevisiae
actgtggttacggagatagctgcaa

SEQ ID NO: 10872 - DNA, 25 bp, S. cerevisiae
actgttgttgtcgaagaagatgctt

SEQ ID NO: 10873 - DNA, 25 bp, S. cerevisiae
acgatggttgtttgaactttgtcga

SEQ ID NO: 10874 - DNA, 25 bp, S. cerevisiae
acgtgacttgttgggaatgcatttc

SEQ ID NO: 10875 - DNA, 25 bp, S. cerevisiae
acgatgctttttgtctacttttaca

SEQ ID NO: 10876 - DNA, 25 bp, S. cerevisiae
acgattattgtatcttatttttcaa

SEQ ID NO: 10877 - DNA, 25 bp, S. cerevisiae
acgaccgtcttggatcagataagtt

SEQ ID NO: 10878 - DNA, 25 bp, S. cerevisiae
acgagaccgttgctgatgctacgaa

SEQ ID NO: 10879 - DNA, 25 bp, S. cerevisiae
actaaacttatctccctgcgtgata

SEQ ID NO: 10880 - DNA, 25 bp, S. cerevisiae
acggcaattgcgatccgaatggtga

SEQ ID NO: 10881 - DNA, 25 bp, S. cerevisiae
acgaaatgtccacttctgaagcctt

SEQ ID NO: 10882 - DNA, 25 bp, S. cerevisiae
actgctaaacccattagtgcatctt

SEQ ID NO: 10883 - DNA, 25 bp, S. cerevisiae
actggaagacgctgtcgagtggctt

SEQ ID NO: 10884 - DNA, 25 bp, S. cerevisiae
acgatcctgcgctggtgggtaaact

SEQ ID NO: 10885 - DNA, 25 bp, S. cerevisiae
acgtttcacttggtggtaacatcaa

SEQ ID NO: 10886 - DNA, 25 bp, S. cerevisiae
acgtacggcctcgatgagcagcaat

SEQ ID NO: 10887 - DNA, 25 bp, S. cerevisiae
acgcatcaaggcttccataggcaac

SEQ ID NO: 10888 - DNA, 25 bp, S. cerevisiae
acgtcagatcagtcagcaaaggcaa

SEQ ID NO: 10889 - DNA, 25 bp, S. cerevisiae
acgtcgttacgttggcgcaattgca

SEQ ID NO: 10890 - DNA, 25 bp, S. cerevisiae
acgcaatggttgttcggcactgtta

SEQ ID NO: 10891 - DNA, 25 bp, S. cerevisiae
acgatgtcgttattcactctggtgc

SEQ ID NO: 10892 - DNA, 25 bp, S. cerevisiae
acgacctgcgttttctatggctgat

SEQ ID NO: 10893 - DNA, 25 bp, S. cerevisiae
acgatcatcgcgttcttttggagat

SEQ ID NO: 10894 - DNA, 25 bp, S. cerevisiae
acgactcctcatactctattgatgg

SEQ ID NO: 10895 - DNA, 25 bp, S. cerevisiae
acgtgatacggttatttggcttcga

SEQ ID NO: 10896 - DNA, 25 bp, S. cerevisiae
acggacatcgaggaatttgcatctt

SEQ ID NO: 10897 - DNA, 25 bp, S. cerevisiae
acgagtgacgggactatttcaagat

SEQ ID NO: 10898 - DNA, 25 bp, S. cerevisiae
acgatctgttggcactctttaagtc

SEQ ID NO: 10899 - DNA, 25 bp, S. cerevisiae
acgacattgatgctgactctttgga

SEQ ID NO: 10900 - DNA, 25 bp, S. cerevisiae
actgtattgtccctcaaagatgccc

SEQ ID NO: 10901 - DNA, 25 bp, S. cerevisiae
acgtcttgcacccaaacagagctaa

SEQ ID NO: 10902 - DNA, 25 bp, S. cerevisiae
acgtcgtgacaccaaacagcatatt

SEQ ID NO: 10903 - DNA, 25 bp, S. cerevisiae
actgcggaagtatcacgttgtcaat

SEQ ID NO: 10904 - DNA, 25 bp, S. cerevisiae
actggtgaagactccggttgatgat

SEQ ID NO: 10905 - DNA, 25 bp, S. cerevisiae
acgtcgaagcactcaacggcaatga

SEQ ID NO: 10906 - DNA, 25 bp, S. cerevisiae
acgtctgcacaggaattactcgatt

SEQ ID NO: 10907 - DNA, 25 bp, S. cerevisiae
actgttcgttggatcgtggtagctt

SEQ ID NO: 10908 - DNA, 25 bp, S. cerevisiae
acgtagctggtcatacggcctttgc

SEQ ID NO: 10909 - DNA, 25 bp, S. cerevisiae
gaggtcgggccatcaagccggttta

SEQ ID NO: 10910 - DNA, 25 bp, S. cerevisiae
acagcttctgaactggtaactgaac

SEQ ID NO: 10911 - DNA, 25 bp, S. cerevisiae
acgtgctcgcgctatggtacataat

SEQ ID NO: 10912 - DNA, 25 bp, S. cerevisiae
acgatgattcgcgatgttacacaca

SEQ ID NO: 10913 - DNA, 25 bp, S. cerevisiae
acgatattctcccatttccaaagac

SEQ ID NO: 10914 - DNA, 25 bp, S. cerevisiae
acgtgatatgaatcccgctctaata

SEQ ID NO: 10915 - DNA, 25 bp, S. cerevisiae
actgagttaggtgtctccgttaatt

SEQ ID NO: 10916 - DNA, 25 bp, S. cerevisiae
acgagaggtgttccagcttctattt

SEQ ID NO: 10917 - DNA, 25 bp, S. cerevisiae
acgatgaagatgttaccgttccttt

SEQ ID NO: 10918 - DNA, 25 bp, S. cerevisiae
acgggtggattagtcaggtctttat

SEQ ID NO: 10919 - DNA, 25 bp, S. cerevisiae
actggcggactttctcaagggttat

SEQ ID NO: 10920 - DNA, 25 bp, S. cerevisiae
acgttaagatctccatttgctatgc

SEQ ID NO: 10921 - DNA, 25 bp, S. cerevisiae
acgactgagagattctgctttgcaa

SEQ ID NO: 10922 - DNA, 25 bp, S. cerevisiae
acgtctgctggatcttttcaaggtc

SEQ ID NO: 10923 - DNA, 25 bp, S. cerevisiae
acgaccttcgctatttccaagataa

SEQ ID NO: 10924 - DNA, 25 bp, S. cerevisiae
acgatccgtcgtcatttcaatacta

SEQ ID NO: 10925 - DNA, 25 bp, S. cerevisiae
acgacagctctctctatttcaaaat

SEQ ID NO: 10926 - DNA, 25 bp, S. cerevisiae
acgacagtgtcgcatattctaagta

SEQ ID NO: 10927 - DNA, 25 bp, S. cerevisiae
acgtcttatgggttgctggtcaaac

SEQ ID NO: 10928 - DNA, 25 bp, S. cerevisiae
actgttaatgctgggtgacgtcgaa

SEQ ID NO: 10929 - DNA, 25 bp, S. cerevisiae
acgtcagacgttccataacatcgca

SEQ ID NO: 10930 - DNA, 25 bp, S. cerevisiae
acgtcatgcaagatcattaccctga

SEQ ID NO: 10931 - DNA, 25 bp, S. cerevisiae
actgattctagttcgagctcataac

SEQ ID NO: 10932 - DNA, 25 bp, S. cerevisiae
acgtttatttgcgtctgcatgctca

SEQ ID NO: 10933 - DNA, 25 bp, S. cerevisiae
acgtataaatcatgtttcgtctgaa

SEQ ID NO: 10934 - DNA, 25 bp, S. cerevisiae
acgactaccaccttttctatatgaa

SEQ ID NO: 10935 - DNA, 25 bp, S. cerevisiae
acgagcatacgtcggaattattcaa

SEQ ID NO: 10936 - DNA, 25 bp, S. cerevisiae
acggtgctctgtttgcaagttccaa

SEQ ID NO: 10937 - DNA, 25 bp, S. cerevisiae
acgtggttgtagaaatattctgcaa

SEQ ID NO: 10938 - DNA, 25 bp, S. cerevisiae
acggagattctgacggttctataat

SEQ ID NO: 10939 - DNA, 25 bp, S. cerevisiae
acgggctgcctgagtgttttatatc

SEQ ID NO: 10940 - DNA, 25 bp, S. cerevisiae
acggtcatgctgctggtgctttcta

SEQ ID NO: 10941 - DNA, 25 bp, S. cerevisiae
acggttcagtaggtttggctatcca

SEQ ID NO: 10942 - DNA, 25 bp, S. cerevisiae
actggcgtctacgttttggctacaa

SEQ ID NO: 10943 - DNA, 25 bp, S. cerevisiae
actgaggcaaacgttcctggattta

SEQ ID NO: 10944 - DNA, 25 bp, S. cerevisiae
actatgggactggttatgccaagtt

SEQ ID NO: 10945 - DNA, 25 bp, S. cerevisiae
acgataatgacgtcttaaaagttgc

SEQ ID NO: 10946 - DNA, 25 bp, S. cerevisiae
actaccagctcgacctacaagaata

SEQ ID NO: 10947 - DNA, 25 bp, S. cerevisiae
acgatccacagccactctaaaagat

SEQ ID NO: 10948 - DNA, 25 bp, S. cerevisiae
acgagtcctcctttgatgtatttat

SEQ ID NO: 10949 - DNA, 25 bp, S. cerevisiae
acggtcgcacgatatattgaattat

SEQ ID NO: 10950 - DNA, 25 bp, S. cerevisiae
acggcatgccacctcaatttagaaa

SEQ ID NO: 10951 - DNA, 25 bp, S. cerevisiae
actgccgaatacttagtcgcttcta

SEQ ID NO: 10952 - DNA, 25 bp, S. cerevisiae
acggtggtgctcacggtgtcatcaa

SEQ ID NO: 10953 - DNA, 25 bp, S. cerevisiae
acggtggcaccatatcgaacagaat

SEQ ID NO: 10954 - DNA, 25 bp, S. cerevisiae
acgtgggaccagctgcaatacatga

SEQ ID NO: 10955 - DNA, 25 bp, S. cerevisiae
acgtcatgagacgtggccaattcat

SEQ ID NO: 10956 - DNA, 25 bp, S. cerevisiae
acaggccaccaagcaatagacaagt

SEQ ID NO: 10957 - DNA, 25 bp, S. cerevisiae
acaggccccagtgatactactagtc

SEQ ID NO: 10958 - DNA, 25 bp, S. cerevisiae
acgtcccttgtttcttgtggtgctg

SEQ ID NO: 10959 - DNA, 25 bp, S. cerevisiae
acgaccacgttgacatcttctgaat

SEQ ID NO: 10960 - DNA, 25 bp, S. cerevisiae
acgaccatcgataataccagccaat

SEQ ID NO: 10961 - DNA, 25 bp, S. cerevisiae
acgacgccgtgcaatcttcagataa

SEQ ID NO: 10962 - DNA, 25 bp, S. cerevisiae
acggccctgtgatcttggagcaaaa

SEQ ID NO: 10963 - DNA, 25 bp, S. cerevisiae
acggatgcacatctagtagagggaa

SEQ ID NO: 10964 - DNA, 25 bp, S. cerevisiae
acgagcaactcgacagtgaagtgga

SEQ ID NO: 10965 - DNA, 25 bp, S. cerevisiae
actgacacctgctgaaacaacggat

SEQ ID NO: 10966 - DNA, 25 bp, S. cerevisiae
acgacctcttcgaagacccatggtt

SEQ ID NO: 10967 - DNA, 25 bp, S. cerevisiae
acgatattgggtcattctcgcctga

SEQ ID NO: 10968 - DNA, 25 bp, S. cerevisiae
acgattgttactttagtcctggcaa

SEQ ID NO: 10969 - DNA, 25 bp, S. cerevisiae
acgagttccggccaaatcacaaata

SEQ ID NO: 10970 - DNA, 25 bp, S. cerevisiae
acggtcttggattccatcatccaga

SEQ ID NO: 10971 - DNA, 25 bp, S. cerevisiae
acgagtttagcgtttgcatctccaa

SEQ ID NO: 10972 - DNA, 25 bp, S. cerevisiae
acgtgacacacgaaaagggccattt

SEQ ID NO: 10973 - DNA, 25 bp, S. cerevisiae
acggcaaccgcagttatcgttcatt

SEQ ID NO: 10974 - DNA, 25 bp, S. cerevisiae
acggccgattaccaacactatatta

SEQ ID NO: 10975 - DNA, 25 bp, S. cerevisiae
acggtgcttcatcccaaactttaag

SEQ ID NO: 10976 - DNA, 25 bp, S. cerevisiae
acgattattcgattgtttgcctaag

SEQ ID NO: 10977 - DNA, 25 bp, S. cerevisiae
acgaggacactggttttcacgatga

SEQ ID NO: 10978 - DNA, 25 bp, S. cerevisiae
actgacgacttgattggctacggta

SEQ ID NO: 10979 - DNA, 25 bp, S. cerevisiae
acgtagacactgacttgagtatcga

SEQ ID NO: 10980 - DNA, 25 bp, S. cerevisiae
cattgtaacgacaacggccgccggt

SEQ ID NO: 10981 - DNA, 25 bp, S. cerevisiae
actctaatagtaacggccctgggca

SEQ ID NO: 10982 - DNA, 25 bp, S. cerevisiae
actgccgaacagtgtccatttaaag

SEQ ID NO: 10983 - DNA, 25 bp, S. cerevisiae
acttcgattagtaccgcatttagag

SEQ ID NO: 10984 - DNA, 25 bp, S. cerevisiae
actaccttcgaagacatgtccgact

SEQ ID NO: 10985 - DNA, 25 bp, S. cerevisiae
acggccttctcatcctaagggaggt

SEQ ID NO: 10986 - DNA, 25 bp, S. cerevisiae
acgtcgtttcttcttctggagattg

SEQ ID NO: 10987 - DNA, 25 bp, S. cerevisiae
acggcggattttcatttttcaaatg

SEQ ID NO: 10988 - DNA, 25 bp, S. cerevisiae
acgggcgctttgttcaagtcttcaa

SEQ ID NO: 10989 - DNA, 25 bp, S. cerevisiae
acgggtcattggttaaatcattcta

SEQ ID NO: 10990 - DNA, 25 bp, S. cerevisiae
acagagggccagatagaaatttcga

SEQ ID NO: 10991 - DNA, 25 bp, S. cerevisiae
actgccgcgggatacgacatttatg

SEQ ID NO: 10992 - DNA, 25 bp, S. cerevisiae
acgtcgccgaacaatgtagtgccat

SEQ ID NO: 10993 - DNA, 25 bp, S. cerevisiae
acggccttcactagaacaatctcga

SEQ ID NO: 10994 - DNA, 25 bp, S. cerevisiae
acggtacttctttatcatcatccaa

SEQ ID NO: 10995 - DNA, 25 bp, S. cerevisiae
acgttactgctatttctatgaccga

SEQ ID NO: 10996 - DNA, 25 bp, S. cerevisiae
acgataactcaacacggcaccagaa

SEQ ID NO: 10997 - DNA, 25 bp, S. cerevisiae
acgtgaactccatagcagtggccaa

SEQ ID NO: 10998 - DNA, 25 bp, S. cerevisiae
acgtgcctccaaggctttgattgaa

SEQ ID NO: 10999 - DNA, 25 bp, S. cerevisiae
acgtcaattgaaggcctctggtcaa

SEQ ID NO: 11000 - DNA, 25 bp, S. cerevisiae
acgatgtggtgaacgtctctggtca

SEQ ID NO: 11001 - DNA, 25 bp, S. cerevisiae
acgatgcgagtattttctctaggaa

SEQ ID NO: 11002 - DNA, 25 bp, S. cerevisiae
acgattggcgtggaattcgctacaa

SEQ ID NO: 11003 - DNA, 25 bp, S. cerevisiae
acgataccatgggttctcagtggaa

SEQ ID NO: 11004 - DNA, 25 bp, S. cerevisiae
acagttcaatggtatcttccctcag

SEQ ID NO: 11005 - DNA, 25 bp, S. cerevisiae
actttccaggttcagcctcttgaaa

SEQ ID NO: 11006 - DNA, 25 bp, S. cerevisiae
acgtgatccggtaccaatttccata

SEQ ID NO: 11007 - DNA, 25 bp, S. cerevisiae
acggacttcgttacttatgtctcta

SEQ ID NO: 11008 - DNA, 25 bp, S. cerevisiae
acggtgttgttcagcttggttgtat

SEQ ID NO: 11009 - DNA, 25 bp, S. cerevisiae
actcctttttgtgactttcttccat

SEQ ID NO: 11010 - DNA, 25 bp, S. cerevisiae
acggctcatttgcttttttattcct

SEQ ID NO: 11011 - DNA, 25 bp, S. cerevisiae
acgattggagccatatgcttcagat

SEQ ID NO: 11012 - DNA, 25 bp, S. cerevisiae
acgtgttgcaacatatatctgccaa

SEQ ID NO: 11013 - DNA, 25 bp, S. cerevisiae
acggtgatggtttaatctccgccgc

SEQ ID NO: 11014 - DNA, 25 bp, S. cerevisiae
actactgaatctcctggtgaatatt

SEQ ID NO: 11015 - DNA, 25 bp, S. cerevisiae
cactaggtgacgctggttttttctt

SEQ ID NO: 11016 - DNA, 25 bp, S. cerevisiae
actgccacggcacctagattatttg

SEQ ID NO: 11017 - DNA, 25 bp, S. cerevisiae
acggatcttccggtggtgttataag

SEQ ID NO: 11018 - DNA, 25 bp, S. cerevisiae
acgtgcttccactagtattgtcaac

SEQ ID NO: 11019 - DNA, 25 bp, S. cerevisiae
acgtgttgaacagagattttgagcg

SEQ ID NO: 11020 - DNA, 25 bp, S. cerevisiae
acgttgctcctgatgctgaagttag

SEQ ID NO: 11021 - DNA, 25 bp, S. cerevisiae
acgtcacatcgtattgccaggtttg

SEQ ID NO: 11022 - DNA, 25 bp, S. cerevisiae
acgtctcattgctttattcggatat

SEQ ID NO: 11023 - DNA, 25 bp, S. cerevisiae
acgtaatcattaccttgccacattc

SEQ ID NO: 11024 - DNA, 25 bp, S. cerevisiae
acgtacgctgggtcagtttgattca

SEQ ID NO: 11025 - DNA, 25 bp, S. cerevisiae
acgtccatgtgggtcactgttgtta

SEQ ID NO: 11026 - DNA, 25 bp, S. cerevisiae
acgtgccgttggtacattgtgctta

SEQ ID NO: 11027 - DNA, 25 bp, S. cerevisiae
acggttgttctggtgccgatgtcaa

SEQ ID NO: 11028 - DNA, 25 bp, S. cerevisiae
actgttcccgcagaatttttctctg

SEQ ID NO: 11029 - DNA, 25 bp, S. cerevisiae
acgtccacacaggtatagggtttct

SEQ ID NO: 11030 - DNA, 25 bp, S. cerevisiae
actgtcaatcgcaagtaagccggtt

SEQ ID NO: 11031 - DNA, 25 bp, S. cerevisiae
actggcagatccaaatgacctggtt

SEQ ID NO: 11032 - DNA, 25 bp, S. cerevisiae
acggtgagatcgatggcctgttcta

SEQ ID NO: 11033 - DNA, 25 bp, S. cerevisiae
acggtgcttctaatggcgatgttta

SEQ ID NO: 11034 - DNA, 25 bp, S. cerevisiae
acgatagctgctgtcttttctgtac

SEQ ID NO: 11035 - DNA, 25 bp, S. cerevisiae
acgtcaccggtgaagctttagttca

SEQ ID NO: 11036 - DNA, 25 bp, S. cerevisiae
actattcggtggtgttggttccaat

SEQ ID NO: 11037 - DNA, 25 bp, S. cerevisiae
actgatttggttggccttgtttcca

SEQ ID NO: 11038 - DNA, 25 bp, S. cerevisiae
acgttagtggtgtgtatttgtctca

SEQ ID NO: 11039 - DNA, 25 bp, S. cerevisiae
actgcttaagcgtcagggtcggtta

SEQ ID NO: 11040 - DNA, 25 bp, S. cerevisiae
acgtcttcaagatctctggtggtaa

SEQ ID NO: 11041 - DNA, 25 bp, S. cerevisiae
actgtgggtataacatcctcgtatg

SEQ ID NO: 11042 - DNA, 25 bp, S. cerevisiae
acgggactttaatcgctgaatgcac

SEQ ID NO: 11043 - DNA, 25 bp, S. cerevisiae
actgagggcctttctattcatgaag

SEQ ID NO: 11044 - DNA, 25 bp, S. cerevisiae
acgggtgtcttcttagccaatggta

SEQ ID NO: 11045 - DNA, 25 bp, S. cerevisiae
actgatgtggctgcgattaccttac

SEQ ID NO: 11046 - DNA, 25 bp, S. cerevisiae
acgtggtatacgttcccattacata

SEQ ID NO: 11047 - DNA, 25 bp, S. cerevisiae
actgggtttcagttcctttgatcta

SEQ ID NO: 11048 - DNA, 25 bp, S. cerevisiae
acatggcgcattcaatggacccaaa

SEQ ID NO: 11049 - DNA, 25 bp, S. cerevisiae
actagtgatatctcatgatgacgcc

SEQ ID NO: 11050 - DNA, 25 bp, S. cerevisiae
acgtgacacatttagcgctttggaa

SEQ ID NO: 11051 - DNA, 25 bp, S. cerevisiae
acggtcaattcaccactctgtggga

SEQ ID NO: 11052 - DNA, 25 bp, S. cerevisiae
acggtttcttgattcactctggtca

SEQ ID NO: 11053 - DNA, 25 bp, S. cerevisiae
acggtattcattctgcaactgttca

SEQ ID NO: 11054 - DNA, 25 bp, S. cerevisiae
acggttcttcaaaagccgctctgaa

SEQ ID NO: 11055 - DNA, 25 bp, S. cerevisiae
acgttgatctacttgaaccctcagt

SEQ ID NO: 11056 - DNA, 25 bp, S. cerevisiae
acgtatgattgatttggcgcccgca

SEQ ID NO: 11057 - DNA, 25 bp, S. cerevisiae
acgtaattagattggctcctgctcc

SEQ ID NO: 11058 - DNA, 25 bp, S. cerevisiae
acgtatttcagtgtggccgcatcgc

SEQ ID NO: 11059 - DNA, 25 bp, S. cerevisiae
acgtcttttgttgtccatgcttatt

SEQ ID NO: 11060 - DNA, 25 bp, S. cerevisiae
acgtttacaaatctctctggttgga

SEQ ID NO: 11061 - DNA, 25 bp, S. cerevisiae
acgtgtctcagggatgttcttgggt

SEQ ID NO: 11062 - DNA, 25 bp, S. cerevisiae
acgtagttgttcttgcgttaccagg

SEQ ID NO: 11063 - DNA, 25 bp, S. cerevisiae
acgggtccatcataaattcggcttt

SEQ ID NO: 11064 - DNA, 25 bp, S. cerevisiae
acgggacgaatcaaccatctcggtt

SEQ ID NO: 11065 - DNA, 25 bp, S. cerevisiae
acgtgatgtcaagcccaaccaggat

SEQ ID NO: 11066 - DNA, 25 bp, S. cerevisiae
actgaattaactgttcaatctgaaa

SEQ ID NO: 11067 - DNA, 25 bp, S. cerevisiae
acggagtatccttgattcggtggaa

SEQ ID NO: 11068 - DNA, 25 bp, S. cerevisiae
acggctgttcgttattccctggaag

SEQ ID NO: 11069 - DNA, 25 bp, S. cerevisiae
acggcattgtcggtttctctcaagg

SEQ ID NO: 11070 - DNA, 25 bp, S. cerevisiae
actggacgctaggtatccttatgga

SEQ ID NO: 11071 - DNA, 25 bp, S. cerevisiae
acggttcctgcacatagcttagaca

SEQ ID NO: 11072 - DNA, 25 bp, S. cerevisiae
acgtctcccaatcatggtttcatgg

SEQ ID NO: 11073 - DNA, 25 bp, S. cerevisiae
acgtctcccgatatcagtctagaag

SEQ ID NO: 11074 - DNA, 25 bp, S. cerevisiae
acgtctttcctgactcagatcatag

SEQ ID NO: 11075 - DNA, 25 bp, S. cerevisiae
acgtattaactgaatcgctcatttt

SEQ ID NO: 11076 - DNA, 25 bp, S. cerevisiae
acggtttcacaaatgactcgcctga

SEQ ID NO: 11077 - DNA, 25 bp, S. cerevisiae
acggaatatccgtatactgccctca

SEQ ID NO: 11078 - DNA, 25 bp, S. cerevisiae
actggaagtacgaatccgccactgc

SEQ ID NO: 11079 - DNA, 25 bp, S. cerevisiae
actggaacaaaggatgctcccgcat

SEQ ID NO: 11080 - DNA, 25 bp, S. cerevisiae
acatgacgaaaacatctctcctgcc

SEQ ID NO: 11081 - DNA, 25 bp, S. cerevisiae
acacgtacacggctaattggttcaa

SEQ ID NO: 11082 - DNA, 25 bp, S. cerevisiae
cagccttgaccgttttaggtgctac

SEQ ID NO: 11083 - DNA, 25 bp, S. cerevisiae
actatcgaccagtttttgacattac

SEQ ID NO: 11084 - DNA, 25 bp, S. cerevisiae
acggcaaccatacttttcatttcca

SEQ ID NO: 11085 - DNA, 25 bp, S. cerevisiae
acggctgcacgggtgtcatgagata

SEQ ID NO: 11086 - DNA, 25 bp, S. cerevisiae
actggtaccgccgttgggcatgagc

SEQ ID NO: 11087 - DNA, 25 bp, S. cerevisiae
actggtatccctattggtagttcga

SEQ ID NO: 11088 - DNA, 25 bp, S. cerevisiae
acgtcttgccttcgttgagtagatt

SEQ ID NO: 11089 - DNA, 25 bp, S. cerevisiae
acgtatggtcatttcttcttcagat

SEQ ID NO: 11090 - DNA, 25 bp, S. cerevisiae
actgcttctgtcaaagagtttcgtt

SEQ ID NO: 11091 - DNA, 25 bp, S. cerevisiae
actgtagctgctgagacgattacca

SEQ ID NO: 11092 - DNA, 25 bp, S. cerevisiae
actgagaatactagccctaacccgg

SEQ ID NO: 11093 - DNA, 25 bp, S. cerevisiae
actggtgctaaacgtgctcaattca

SEQ ID NO: 11094 - DNA, 25 bp, S. cerevisiae
acgggctaataatttgagttcactg

SEQ ID NO: 11095 - DNA, 25 bp, S. cerevisiae
acggtattgttatgtggttcctaga

SEQ ID NO: 11096 - DNA, 25 bp, S. cerevisiae
acggtattttctccggttcagcaag

SEQ ID NO: 11097 - DNA, 25 bp, S. cerevisiae
acgggttttcctcatcttcagatga

SEQ ID NO: 11098 - DNA, 25 bp, S. cerevisiae
actggcagttttgttgatcccgtta

SEQ ID NO: 11099 - DNA, 25 bp, S. cerevisiae
actgggttatttgtacttctggcta

SEQ ID NO: 11100 - DNA, 25 bp, S. cerevisiae
actgaggttctttcaaacacacttg

SEQ ID NO: 11101 - DNA, 25 bp, S. cerevisiae
acgtacttatcgtcaccaaagcttc

SEQ ID NO: 11102 - DNA, 25 bp, S. cerevisiae
acgggctctgtttactactacacat

SEQ ID NO: 11103 - DNA, 25 bp, S. cerevisiae
acggattccatgtcgcctcaggaga

SEQ ID NO: 11104 - DNA, 25 bp, S. cerevisiae
actggtataagctactctcagccac

SEQ ID NO: 11105 - DNA, 25 bp, S. cerevisiae
actggcctaacattcatacatctgc

SEQ ID NO: 11106 - DNA, 25 bp, S. cerevisiae
actggtgagcctttgccgatcaaaa

SEQ ID NO: 11107 - DNA, 25 bp, S. cerevisiae
acggaagtacatctgctgatacatt

SEQ ID NO: 11108 - DNA, 25 bp, S. cerevisiae
acggtatgttcgttgtgaaatccat

SEQ ID NO: 11109 - DNA, 25 bp, S. cerevisiae
acggtgattcgtcttcaaatgttgg

SEQ ID NO: 11110 - DNA, 25 bp, S. cerevisiae
acgtgttacgcattttggtgcttaa

SEQ ID NO: 11111 - DNA, 25 bp, S. cerevisiae
actccattcctgttccatttttgga

SEQ ID NO: 11112 - DNA, 25 bp, S. cerevisiae
actccaatcttcaccattacttgta

SEQ ID NO: 11113 - DNA, 25 bp, S. cerevisiae
acggaattactatcaatcacctgtg

SEQ ID NO: 11114 - DNA, 25 bp, S. cerevisiae
gaggtccttgacagggaacccgatg

SEQ ID NO: 11115 - DNA, 25 bp, S. cerevisiae
aagacccgaagtgcggaccggcatg

SEQ ID NO: 11116 - DNA, 25 bp, S. cerevisiae
aaaccccaatgttacaatcgcccat

SEQ ID NO: 11117 - DNA, 25 bp, S. cerevisiae
actgaccccagtgttgattgcgcct

SEQ ID NO: 11118 - DNA, 25 bp, S. cerevisiae
actgtccgacagttttgttttctat

SEQ ID NO: 11119 - DNA, 25 bp, S. cerevisiae
actcccctgcgaaggaatgccattg

SEQ ID NO: 11120 - DNA, 25 bp, S. cerevisiae
actagggcgtgattccaatggattt

SEQ ID NO: 11121 - DNA, 25 bp, S. cerevisiae
actacggcaaacttcaacgatttct

SEQ ID NO: 11122 - DNA, 25 bp, S. cerevisiae
actgattcagagtacgtaaccaaat

SEQ ID NO: 11123 - DNA, 25 bp, S. cerevisiae
actgatgtgatgctacgttaccgta

SEQ ID NO: 11124 - DNA, 25 bp, S. cerevisiae
actgtggtggttctctatcaaggat

SEQ ID NO: 11125 - DNA, 25 bp, S. cerevisiae
actgtggttgttttttgacggctca

SEQ ID NO: 11126 - DNA, 25 bp, S. cerevisiae
acggtgttggttactcctggatcga

SEQ ID NO: 11127 - DNA, 25 bp, S. cerevisiae
actccaagctttgttgacgttcata

SEQ ID NO: 11128 - DNA, 25 bp, S. cerevisiae
acatccacatttttgctttcgtttt

SEQ ID NO: 11129 - DNA, 25 bp, S. cerevisiae
acgtgcagcgatcacttgctagcaa

SEQ ID NO: 11130 - DNA, 25 bp, S. cerevisiae
actggacgcatgcatctgatataga

SEQ ID NO: 11131 - DNA, 25 bp, S. cerevisiae
actggaccatgcctataatctgtgt

SEQ ID NO: 11132 - DNA, 25 bp, S. cerevisiae
acggacctgagccatataattctga

SEQ ID NO: 11133 - DNA, 25 bp, S. cerevisiae
acggcacttgcaggcttcgatttga

SEQ ID NO: 11134 - DNA, 25 bp, S. cerevisiae
acgtgattgatctagttccgcatga

SEQ ID NO: 11135 - DNA, 25 bp, S. cerevisiae
actgctgactacgatgctttggaca

SEQ ID NO: 11136 - DNA, 25 bp, S. cerevisiae
actgatactgatactgacgctgaaa

SEQ ID NO: 11137 - DNA, 25 bp, S. cerevisiae
actgctactgatgattcctacacca

SEQ ID NO: 11138 - DNA, 25 bp, S. cerevisiae
actgtacaccggtcatgcttttgtc

SEQ ID NO: 11139 - DNA, 25 bp, S. cerevisiae
actccaaacggaggcttgtgttcat

SEQ ID NO: 11140 - DNA, 25 bp, S. cerevisiae
actccagaatcgtgcggtgactatt

SEQ ID NO: 11141 - DNA, 25 bp, S. cerevisiae
acataagaactgtgacctcggtcag

SEQ ID NO: 11142 - DNA, 25 bp, S. cerevisiae
actcaacaacgggtaccagtggcat

SEQ ID NO: 11143 - DNA, 25 bp, S. cerevisiae
actaggcaacctgaagcacatttaa

SEQ ID NO: 11144 - DNA, 25 bp, S. cerevisiae
acggctgaccctgaaactgtaacat

SEQ ID NO: 11145 - DNA, 25 bp, S. cerevisiae
acggtgagccacttgattacgatga

SEQ ID NO: 11146 - DNA, 25 bp, S. cerevisiae
actgggccacagtctggatacagat

SEQ ID NO: 11147 - DNA, 25 bp, S. cerevisiae
actgggtcacagtcagctgaacaga

SEQ ID NO: 11148 - DNA, 25 bp, S. cerevisiae
actggtgtccctagtgaaaattaca

SEQ ID NO: 11149 - DNA, 25 bp, S. cerevisiae
actctgagacccgtgcaaaacatta

SEQ ID NO: 11150 - DNA, 25 bp, S. cerevisiae
actgatgcatcaggcccataaagac

SEQ ID NO: 11151 - DNA, 25 bp, S. cerevisiae
cactgctgcagttccacaacagaat

SEQ ID NO: 11152 - DNA, 25 bp, S. cerevisiae
actgcctaattcaagggcctccaga

SEQ ID NO: 11153 - DNA, 25 bp, S. cerevisiae
acgggtattttcatcattcagttgg

SEQ ID NO: 11154 - DNA, 25 bp, S. cerevisiae
acgtgtgctttcttattgcattcgt

SEQ ID NO: 11155 - DNA, 25 bp, S. cerevisiae
acggtggatctctctcagtccagag

SEQ ID NO: 11156 - DNA, 25 bp, S. cerevisiae
acagtggaactcctctttgcaggcg

SEQ ID NO: 11157 - DNA, 25 bp, S. cerevisiae
acggcgaattgcgtttgctcaacga

SEQ ID NO: 11158 - DNA, 25 bp, S. cerevisiae
acggtataaggcatctcatctggga

SEQ ID NO: 11159 - DNA, 25 bp, S. cerevisiae
acggtctcaacgttcttgatgatat

SEQ ID NO: 11160 - DNA, 25 bp, S. cerevisiae
actgcgttgcaactacttttgactg

SEQ ID NO: 11161 - DNA, 25 bp, S. cerevisiae
actgctttagcgttttacgacggct

SEQ ID NO: 11162 - DNA, 25 bp, S. cerevisiae
actgttaagcaattagacgggccct

SEQ ID NO: 11163 - DNA, 25 bp, S. cerevisiae
acagtctacgaagaaggcgcctcct

SEQ ID NO: 11164 - DNA, 25 bp, S. cerevisiae
acaatgtatcatcagcgctagggag

SEQ ID NO: 11165 - DNA, 25 bp, S. cerevisiae
acacgtttccgcctatggaatggtc

SEQ ID NO: 11166 - DNA, 25 bp, S. cerevisiae
acggtggtgccgcaatcgatatctt

SEQ ID NO: 11167 - DNA, 25 bp, S. cerevisiae
acggctattacatcaccaatctcat

SEQ ID NO: 11168 - DNA, 25 bp, S. cerevisiae
acggctacaacaacaacgactacgg

SEQ ID NO: 11169 - DNA, 25 bp, S. cerevisiae
actggctagcaaatacaacggcatt

SEQ ID NO: 11170 - DNA, 25 bp, S. cerevisiae
actgcttcagaaatccaacggacta

SEQ ID NO: 11171 - DNA, 25 bp, S. cerevisiae
actagtcgaagtttccagcaaattg

SEQ ID NO: 11172 - DNA, 25 bp, S. cerevisiae
actaacgacctaaccagacatcttg

SEQ ID NO: 11173 - DNA, 25 bp, S. cerevisiae
actcactcgaatgaacgcaacgctt

SEQ ID NO: 11174 - DNA, 25 bp, S. cerevisiae
actgctgaagaaaagcaaccctatg

SEQ ID NO: 11175 - DNA, 25 bp, S. cerevisiae
acgtgtccactgaagaatcctctat

SEQ ID NO: 11176 - DNA, 25 bp, S. cerevisiae
actcgactgcgccaactaacaagaa

SEQ ID NO: 11177 - DNA, 25 bp, S. cerevisiae
actggctccaagtaccttgcaagat

SEQ ID NO: 11178 - DNA, 25 bp, S. cerevisiae
acggtccatcagaacattccgaatg

SEQ ID NO: 11179 - DNA, 25 bp, S. cerevisiae
acggaaatggtcctatctcttcttt

SEQ ID NO: 11180 - DNA, 25 bp, S. cerevisiae
acggatacggtagattgcagtgcat

SEQ ID NO: 11181 - DNA, 25 bp, S. cerevisiae
actagaatcgaatccagtgtggcat

SEQ ID NO: 11182 - DNA, 25 bp, S. cerevisiae
actcgaacgttattgcaggatcctt

SEQ ID NO: 11183 - DNA, 25 bp, S. cerevisiae
actgccaaggtttccaagtcatctt

SEQ ID NO: 11184 - DNA, 25 bp, S. cerevisiae
actgccactggttactcaatggtga

SEQ ID NO: 11185 - DNA, 25 bp, S. cerevisiae
acatctcctggagcagcataagtga

SEQ ID NO: 11186 - DNA, 25 bp, S. cerevisiae
actcaccatcgcctatgcaagggat

SEQ ID NO: 11187 - DNA, 25 bp, S. cerevisiae
actactcatccttatgcttcggaag

SEQ ID NO: 11188 - DNA, 25 bp, S. cerevisiae
actcaatatccctaccattctaaat

SEQ ID NO: 11189 - DNA, 25 bp, S. cerevisiae
actccgaacatctaccaattcattc

SEQ ID NO: 11190 - DNA, 25 bp, S. cerevisiae
actgcactgtctgcggctgaatcga

SEQ ID NO: 11191 - DNA, 25 bp, S. cerevisiae
acggtgttgctgttccatctaagga

SEQ ID NO: 11192 - DNA, 25 bp, S. cerevisiae
acggtgctgtgggtaatctctttga

SEQ ID NO: 11193 - DNA, 25 bp, S. cerevisiae
acggcgtggtcgtacatcgtgacga

SEQ ID NO: 11194 - DNA, 25 bp, S. cerevisiae
acgggaacgtggtatctgcatatat

SEQ ID NO: 11195 - DNA, 25 bp, S. cerevisiae
acgggagactgcctgacgctgataa

SEQ ID NO: 11196 - DNA, 25 bp, S. cerevisiae
acggcggatctaatactggcatgca

SEQ ID NO: 11197 - DNA, 25 bp, S. cerevisiae
acggcgtcacacattcgttggatga

SEQ ID NO: 11198 - DNA, 25 bp, S. cerevisiae
actgagatcaatgtggtccgaatac

SEQ ID NO: 11199 - DNA, 25 bp, S. cerevisiae
actgccgtcacttggtcaacaaaaa

SEQ ID NO: 11200 - DNA, 25 bp, S. cerevisiae
actccattactttggctactcataa

SEQ ID NO: 11201 - DNA, 25 bp, S. cerevisiae
actgtcacttctgaagctcctaaag

SEQ ID NO: 11202 - DNA, 25 bp, S. cerevisiae
cactgacttgattgctgaagctcgc

SEQ ID NO: 11203 - DNA, 25 bp, S. cerevisiae
actggtgctgctgctaaggctttgc

SEQ ID NO: 11204 - DNA, 25 bp, S. cerevisiae
actcgcgttctatctttgtcggtaa

SEQ ID NO: 11205 - DNA, 25 bp, S. cerevisiae
actctagtaatagcgttccagctga

SEQ ID NO: 11206 - DNA, 25 bp, S. cerevisiae
actaagtcgtttggtgctgctggtg

SEQ ID NO: 11207 - DNA, 25 bp, S. cerevisiae
actaccttgtttggtttgcctgaag

SEQ ID NO: 11208 - DNA, 25 bp, S. cerevisiae
actgtcttcatggttggttttggtg

SEQ ID NO: 11209 - DNA, 25 bp, S. cerevisiae
acggcctatattccgagtctcagga

SEQ ID NO: 11210 - DNA, 25 bp, S. cerevisiae
acggccttgattctgaggtggcaaa

SEQ ID NO: 11211 - DNA, 25 bp, S. cerevisiae
acggagcagctttcggtgtcagtaa

SEQ ID NO: 11212 - DNA, 25 bp, S. cerevisiae
actgggcgttgaggtgttcaatccc

SEQ ID NO: 11213 - DNA, 25 bp, S. cerevisiae
acagcagtaggtttgtagaactaga

SEQ ID NO: 11214 - DNA, 25 bp, S. cerevisiae
acggtccgtcgtatgaagatctcat

SEQ ID NO: 11215 - DNA, 25 bp, S. cerevisiae
actagatccctgtattggcaacgca

SEQ ID NO: 11216 - DNA, 25 bp, S. cerevisiae
actactacctgaacaccgacgaaga

SEQ ID NO: 11217 - DNA, 25 bp, S. cerevisiae
actgacttaaagttcctggacggca

SEQ ID NO: 11218 - DNA, 25 bp, S. cerevisiae
actcacaatttattcggtccacacg

SEQ ID NO: 11219 - DNA, 25 bp, S. cerevisiae
acggctgcaatatgacgaacttctg

SEQ ID NO: 11220 - DNA, 25 bp, S. cerevisiae
acggtaatcctgacgatgacttgca

SEQ ID NO: 11221 - DNA, 25 bp, S. cerevisiae
acggtcgttggattgtggccatgaa

SEQ ID NO: 11222 - DNA, 25 bp, S. cerevisiae
actggcaagaatgtcgtgctcctaa

SEQ ID NO: 11223 - DNA, 25 bp, S. cerevisiae
acggtcaacattccatatcttctag

SEQ ID NO: 11224 - DNA, 25 bp, S. cerevisiae
acggctattctagattgtgtcaatg

SEQ ID NO: 11225 - DNA, 25 bp, S. cerevisiae
acggattttttcatctcttgttcat

SEQ ID NO: 11226 - DNA, 25 bp, S. cerevisiae
actccgttctttgccagatactaga

SEQ ID NO: 11227 - DNA, 25 bp, S. cerevisiae
actgccattttcatgaccgatacac

SEQ ID NO: 11228 - DNA, 25 bp, S. cerevisiae
acggcagtttttggcgctatgacac

SEQ ID NO: 11229 - DNA, 25 bp, S. cerevisiae
actggcgttagtactggcattagca

SEQ ID NO: 11230 - DNA, 25 bp, S. cerevisiae
actggcttctatggcaagctctttt

SEQ ID NO: 11231 - DNA, 25 bp, S. cerevisiae
acggccaatgtttgagattactttc

SEQ ID NO: 11232 - DNA, 25 bp, S. cerevisiae
actgtgatactaacgggcaactacc

SEQ ID NO: 11233 - DNA, 25 bp, S. cerevisiae
actggctttggtcgttaccatgatt

SEQ ID NO: 11234 - DNA, 25 bp, S. cerevisiae
acggccatgctgttttagtttcact

SEQ ID NO: 11235 - DNA, 25 bp, S. cerevisiae
acggctctcatttttgggtccactg

SEQ ID NO: 11236 - DNA, 25 bp, S. cerevisiae
actacctatttgattggaacgatgt

SEQ ID NO: 11237 - DNA, 25 bp, S. cerevisiae
acggcggtgtttgcaacattaccat

SEQ ID NO: 11238 - DNA, 25 bp, S. cerevisiae
actggtggtggttcattacctacga

SEQ ID NO: 11239 - DNA, 25 bp, S. cerevisiae
actggcgggttatatggctctccta

SEQ ID NO: 11240 - DNA, 25 bp, S. cerevisiae
actgttcccgaagtcattgttgcaa

SEQ ID NO: 11241 - DNA, 25 bp, S. cerevisiae
actgtaacccaaatctttctgctga

SEQ ID NO: 11242 - DNA, 25 bp, S. cerevisiae
actgtgtatcctgattttacgctta

SEQ ID NO: 11243 - DNA, 25 bp, S. cerevisiae
acggctagtgtctctcgatacggtg

SEQ ID NO: 11244 - DNA, 25 bp, S. cerevisiae
aatggtaggctctctggaaggtgaa

SEQ ID NO: 11245 - DNA, 25 bp, S. cerevisiae
aagttagcccaaaggaggccgcaag

SEQ ID NO: 11246 - DNA, 25 bp, S. cerevisiae
caattgcaagattcatcggcgggtg

SEQ ID NO: 11247 - DNA, 25 bp, S. cerevisiae
actactcattcggtggcctcttaat

SEQ ID NO: 11248 - DNA, 25 bp, S. cerevisiae
actactattgggaccggcttggata

SEQ ID NO: 11249 - DNA, 25 bp, S. cerevisiae
actacataatgtccccagtcggtaa

SEQ ID NO: 11250 - DNA, 25 bp, S. cerevisiae
actccgtttgcctgcagttggtgta

SEQ ID NO: 11251 - DNA, 25 bp, S. cerevisiae
acatgggcgttttattgttcaaata

SEQ ID NO: 11252 - DNA, 25 bp, S. cerevisiae
acggcgagctaggatttttgattct

SEQ ID NO: 11253 - DNA, 25 bp, S. cerevisiae
acggcggttgctacttgattttcca

SEQ ID NO: 11254 - DNA, 25 bp, S. cerevisiae
acggagtctactagcggttcttgca

SEQ ID NO: 11255 - DNA, 25 bp, S. cerevisiae
actcaagtctacaagctaggtttag

SEQ ID NO: 11256 - DNA, 25 bp, S. cerevisiae
actgagggcgtgtttagactgtgca

SEQ ID NO: 11257 - DNA, 25 bp, S. cerevisiae
actgtccgttccttcttcattgaga

SEQ ID NO: 11258 - DNA, 25 bp, S. cerevisiae
actttacttcgattctgacactgga

SEQ ID NO: 11259 - DNA, 25 bp, S. cerevisiae
actttcctgggattctagatacgac

SEQ ID NO: 11260 - DNA, 25 bp, S. cerevisiae
actcttcctcgagacatagttcgca

SEQ ID NO: 11261 - DNA, 25 bp, S. cerevisiae
gaattaggccaaatcccgttcgagt

SEQ ID NO: 11262 - DNA, 25 bp, S. cerevisiae
acaatatggtggacgcccgtacgga

SEQ ID NO: 11263 - DNA, 25 bp, S. cerevisiae
acagacaccatatctttcctaaagg

SEQ ID NO: 11264 - DNA, 25 bp, S. cerevisiae
acatacgttatactattttacaccg

SEQ ID NO: 11265 - DNA, 25 bp, S. cerevisiae
acatacgttatactattttacaccg

SEQ ID NO: 11266 - DNA, 25 bp, S. cerevisiae
actgacctggaacttcctcatgaat

SEQ ID NO: 11267 - DNA, 25 bp, S. cerevisiae
actgatgccggttattttgatgact

SEQ ID NO: 11268 - DNA, 25 bp, S. cerevisiae
actgacccagtcttgtcttctaaat

SEQ ID NO: 11269 - DNA, 25 bp, S. cerevisiae
acggcgacctttcattgcattcaat

SEQ ID NO: 11270 - DNA, 25 bp, S. cerevisiae
actgacgagttgctattcgattgga

SEQ ID NO: 11271 - DNA, 25 bp, S. cerevisiae
acatgtacgttgatgttcccggaga

SEQ ID NO: 11272 - DNA, 25 bp, S. cerevisiae
actgtacgcaggacttttccaggga

SEQ ID NO: 11273 - DNA, 25 bp, S. cerevisiae
acattcccagttgcataatcccaaa

SEQ ID NO: 11274 - DNA, 25 bp, S. cerevisiae
actccaccgctttcatattctaaaa

SEQ ID NO: 11275 - DNA, 25 bp, S. cerevisiae
cactactggcgtgggtttggattcc

SEQ ID NO: 11276 - DNA, 25 bp, S. cerevisiae
actctgtagtactctttccaaggga

SEQ ID NO: 11277 - DNA, 25 bp, S. cerevisiae
cacggaattatctttttaccactgg

SEQ ID NO: 11278 - DNA, 25 bp, S. cerevisiae
acggcaagttggtttatgagctgtt

SEQ ID NO: 11279 - DNA, 25 bp, S. cerevisiae
actcgactcttggtttatggctgat

SEQ ID NO: 11280 - DNA, 25 bp, S. cerevisiae
actcaatcagcttggtttgcacctt

SEQ ID NO: 11281 - DNA, 25 bp, S. cerevisiae
actaaccttgattttgacgcttttg

SEQ ID NO: 11282 - DNA, 25 bp, S. cerevisiae
actgaaccactgattaatgctgcat

SEQ ID NO: 11283 - DNA, 25 bp, S. cerevisiae
actggcaccttacttcaaaaactgt

SEQ ID NO: 11284 - DNA, 25 bp, S. cerevisiae
actgcagtcgctacacttctaaaag

SEQ ID NO: 11285 - DNA, 25 bp, S. cerevisiae
actggtgttgtttccaagactgcac

SEQ ID NO: 11286 - DNA, 25 bp, S. cerevisiae
actgctgcttatgccagaactatcg

SEQ ID NO: 11287 - DNA, 25 bp, S. cerevisiae
actgctgctttactccaagatttga

SEQ ID NO: 11288 - DNA, 25 bp, S. cerevisiae
actccagctactttgggtgctttga

SEQ ID NO: 11289 - DNA, 25 bp, S. cerevisiae
actattgttacatcgacgggtcctt

SEQ ID NO: 11290 - DNA, 25 bp, S. cerevisiae
actgtacaatggagcctgcgacttt

SEQ ID NO: 11291 - DNA, 25 bp, S. cerevisiae
acttcagaggagagggctgccatct

SEQ ID NO: 11292 - DNA, 25 bp, S. cerevisiae
actggctctcagtagggcatttagt

SEQ ID NO: 11293 - DNA, 25 bp, S. cerevisiae
actggtccagtcttcgatttgtgtt

SEQ ID NO: 11294 - DNA, 25 bp, S. cerevisiae
actggaggcacttttgtcatttttg

SEQ ID NO: 11295 - DNA, 25 bp, S. cerevisiae
actcctgccctactattggatgtat

SEQ ID NO: 11296 - DNA, 25 bp, S. cerevisiae
actgctaccgtcaatgatgtcgtta

SEQ ID NO: 11297 - DNA, 25 bp, S. cerevisiae
actcaagccgtcgaatcatctacat

SEQ ID NO: 11298 - DNA, 25 bp, S. cerevisiae
actagtctcagtgcaaccaatcatg

SEQ ID NO: 11299 - DNA, 25 bp, S. cerevisiae
actggtcatcgaaatggccattctg

SEQ ID NO: 11300 - DNA, 25 bp, S. cerevisiae
actgttttgttgacgcatgttccat

SEQ ID NO: 11301 - DNA, 25 bp, S. cerevisiae
acttttttctcgctatataccgtcg

SEQ ID NO: 11302 - DNA, 25 bp, S. cerevisiae
actgtgtatggtgtggttgttccaa

SEQ ID NO: 11303 - DNA, 25 bp, S. cerevisiae
actttatggtcggtgctatgggtct

SEQ ID NO: 11304 - DNA, 25 bp, S. cerevisiae
actctttgctacagtttcggtctaa

SEQ ID NO: 11305 - DNA, 25 bp, S. cerevisiae
actttggctaacaacgtcgaatcca

SEQ ID NO: 11306 - DNA, 25 bp, S. cerevisiae
actgccccatatgcaattggcgaca

SEQ ID NO: 11307 - DNA, 25 bp, S. cerevisiae
actggcgcctatacaactatcggat

SEQ ID NO: 11308 - DNA, 25 bp, S. cerevisiae
acggcgactatgtcaaccgcagtta

SEQ ID NO: 11309 - DNA, 25 bp, S. cerevisiae
actggtggatcaacttagcgtctta

SEQ ID NO: 11310 - DNA, 25 bp, S. cerevisiae
actcctctaatgtgttcaggcacca

SEQ ID NO: 11311 - DNA, 25 bp, S. cerevisiae
actcccgagatggatgcgttggcac

SEQ ID NO: 11312 - DNA, 25 bp, S. cerevisiae
actgctctgcagttggctttatctt

SEQ ID NO: 11313 - DNA, 25 bp, S. cerevisiae
actggtcgttgggttgtatgctgtt

SEQ ID NO: 11314 - DNA, 25 bp, S. cerevisiae
actgtgtttgttgtaccgtttctga

SEQ ID NO: 11315 - DNA, 25 bp, S. cerevisiae
actggtttattgttagccgggattg

SEQ ID NO: 11316 - DNA, 25 bp, S. cerevisiae
actgggctatctcacaggcttagaa

SEQ ID NO: 11317 - DNA, 25 bp, S. cerevisiae
actgggcattttccatggtttgaac

SEQ ID NO: 11318 - DNA, 25 bp, S. cerevisiae
actggtatcgcctgatgctggtggt

SEQ ID NO: 11319 - DNA, 25 bp, S. cerevisiae
actggctatttcaattacgtctcta

SEQ ID NO: 11320 - DNA, 25 bp, S. cerevisiae
actggtttgtgttgctgtgccaata

SEQ ID NO: 11321 - DNA, 25 bp, S. cerevisiae
actgtggtaagtgtcattccgtcta

SEQ ID NO: 11322 - DNA, 25 bp, S. cerevisiae
actctactttggctcaattgacctc

SEQ ID NO: 11323 - DNA, 25 bp, S. cerevisiae
actggtgtacctttgaacgctcatt

SEQ ID NO: 11324 - DNA, 25 bp, S. cerevisiae
actgtgagctactgtttacccattc

SEQ ID NO: 11325 - DNA, 25 bp, S. cerevisiae
acttggctaaatctgttaccgtcga

SEQ ID NO: 11326 - DNA, 25 bp, S. cerevisiae
actgactccgaaccttctttggtga

SEQ ID NO: 11327 - DNA, 25 bp, S. cerevisiae
actacttatcactattactgggcgt

SEQ ID NO: 11328 - DNA, 25 bp, S. cerevisiae
actcaccttcacttatattgatggg

SEQ ID NO: 11329 - DNA, 25 bp, S. cerevisiae
actcaatcctatctcaatcttacaa

SEQ ID NO: 11330 - DNA, 25 bp, S. cerevisiae
actggttccagcatctgcatcatta

SEQ ID NO: 11331 - DNA, 25 bp, S. cerevisiae
actgcgttcttcgattgtcacatga

SEQ ID NO: 11332 - DNA, 25 bp, S. cerevisiae
actcctctattggtagaactgccca

SEQ ID NO: 11333 - DNA, 25 bp, S. cerevisiae
actgggaaccagtctatatcggata

SEQ ID NO: 11334 - DNA, 25 bp, S. cerevisiae
actcctgccatgcattggtctggga

SEQ ID NO: 11335 - DNA, 25 bp, S. cerevisiae
actgcattccgggtgtgctactatg

SEQ ID NO: 11336 - DNA, 25 bp, S. cerevisiae
actatatcccgtttgccaattactg

SEQ ID NO: 11337 - DNA, 25 bp, S. cerevisiae
actcttgccctttttgtcgtacttg

SEQ ID NO: 11338 - DNA, 25 bp, S. cerevisiae
actcttgcacaactggctttgggat

SEQ ID NO: 11339 - DNA, 25 bp, S. cerevisiae
actattgccattgccattgctacag

SEQ ID NO: 11340 - DNA, 25 bp, S. cerevisiae
actgttccaatccagcatttagcgg

SEQ ID NO: 11341 - DNA, 25 bp, S. cerevisiae
actgtgcgcctgatactgatatacg

SEQ ID NO: 11342 - DNA, 25 bp, S. cerevisiae
actgccaccagcattcgaaacgaat

SEQ ID NO: 11343 - DNA, 25 bp, S. cerevisiae
actcggccaggtccagcaacaaaat

SEQ ID NO: 11344 - DNA, 25 bp, S. cerevisiae
acatcggcaaggtcgtgtttaactt

SEQ ID NO: 11345 - DNA, 25 bp, S. cerevisiae
actgggaatgtgttgctgtcttaaa

SEQ ID NO: 11346 - DNA, 25 bp, S. cerevisiae
actgggtatccaatcgctatgtaaa

SEQ ID NO: 11347 - DNA, 25 bp, S. cerevisiae
actgaggattttgcccatgtaacat

SEQ ID NO: 11348 - DNA, 25 bp, S. cerevisiae
acatggagtgtccactacggtacct

SEQ ID NO: 11349 - DNA, 25 bp, S. cerevisiae
ttgacgcagtttgtccggtacctag

SEQ ID NO: 11350 - DNA, 25 bp, S. cerevisiae
ttaccagttttcacggaccgtggag

SEQ ID NO: 11351 - DNA, 25 bp, S. cerevisiae
gtatcggtttacacggactcgtatt

SEQ ID NO: 11352 - DNA, 25 bp, S. cerevisiae
actcggtatgttatctattggcggt

SEQ ID NO: 11353 - DNA, 25 bp, S. cerevisiae
actcggttgtgtcgttatgctagca

SEQ ID NO: 11354 - DNA, 25 bp, S. cerevisiae
actcacgtagtgaagtccctagcgt

SEQ ID NO: 11355 - DNA, 25 bp, S. cerevisiae
actactgtattaactccaaatggtg

SEQ ID NO: 11356 - DNA, 25 bp, S. cerevisiae
actgtcacatttgtcccaagagctt

SEQ ID NO: 11357 - DNA, 25 bp, S. cerevisiae
actgacctttctcaatgggacacga

SEQ ID NO: 11358 - DNA, 25 bp, S. cerevisiae
actagtccaataagtcgtgcgcctc

SEQ ID NO: 11359 - DNA, 25 bp, S. cerevisiae
actcctccatctacggttactgata

SEQ ID NO: 11360 - DNA, 25 bp, S. cerevisiae
actgatgaatccatgctgctttaca

SEQ ID NO: 11361 - DNA, 25 bp, S. cerevisiae
acttgatcattccatggcctaaacc

SEQ ID NO: 11362 - DNA, 25 bp, S. cerevisiae
actcagatgctgtgatggcggaaca

SEQ ID NO: 11363 - DNA, 25 bp, S. cerevisiae
actcaacaatcttccgtatcatcgg

SEQ ID NO: 11364 - DNA, 25 bp, S. cerevisiae
actccaatgatgcttttcgtcgcta

SEQ ID NO: 11365 - DNA, 25 bp, S. cerevisiae
actacaaatggttcttctgcctcta

SEQ ID NO: 11366 - DNA, 25 bp, S. cerevisiae
actgatcatagtatttcgcaccctg

SEQ ID NO: 11367 - DNA, 25 bp, S. cerevisiae
actgccaaatttatctaccaccttg

SEQ ID NO: 11368 - DNA, 25 bp, S. cerevisiae
actgttttgatcttgctagctggcc

SEQ ID NO: 11369 - DNA, 25 bp, S. cerevisiae
actactttgtgatgcagacgacccc

SEQ ID NO: 11370 - DNA, 25 bp, S. cerevisiae
actacttttgcccatttggacgcta

SEQ ID NO: 11371 - DNA, 25 bp, S. cerevisiae
actgccatagtgtccgctttgtatt

SEQ ID NO: 11372 - DNA, 25 bp, S. cerevisiae
actctatcatcaagaacttccacgc

SEQ ID NO: 11373 - DNA, 25 bp, S. cerevisiae
actctaccagagtaagtccgtcgct

SEQ ID NO: 11374 - DNA, 25 bp, S. cerevisiae
actttcgcaaggtggagccttctat

SEQ ID NO: 11375 - DNA, 25 bp, S. cerevisiae
actttggcaaaatctgcgccatttt

SEQ ID NO: 11376 - DNA, 25 bp, S. cerevisiae
actgtattctgttgtaccccatatt

SEQ ID NO: 11377 - DNA, 25 bp, S. cerevisiae
actgccatttgtttatcccatctta

SEQ ID NO: 11378 - DNA, 25 bp, S. cerevisiae
actgtttgttggttgatcgctgcct

SEQ ID NO: 11379 - DNA, 25 bp, S. cerevisiae
actgtattgctgtgaattccggttc

SEQ ID NO: 11380 - DNA, 25 bp, S. cerevisiae
actgttgctgctttgagattcactg

SEQ ID NO: 11381 - DNA, 25 bp, S. cerevisiae
actgtgtatcttttggttcgtcttc

SEQ ID NO: 11382 - DNA, 25 bp, S. cerevisiae
actgttttctctttggaagctctta

SEQ ID NO: 11383 - DNA, 25 bp, S. cerevisiae
actgttactttcatgggtgatctca

SEQ ID NO: 11384 - DNA, 25 bp, S. cerevisiae
actgcttcacttctcttggtggaaa

SEQ ID NO: 11385 - DNA, 25 bp, S. cerevisiae
actgctctcttgaagttcttgggaa

SEQ ID NO: 11386 - DNA, 25 bp, S. cerevisiae
actagcttagcatcgtttttgtttc

SEQ ID NO: 11387 - DNA, 25 bp, S. cerevisiae
actcaaattcttatgccagcgtgca

SEQ ID NO: 11388 - DNA, 25 bp, S. cerevisiae
actgcaaagtgtttattagcgccaa

SEQ ID NO: 11389 - DNA, 25 bp, S. cerevisiae
actacatcggatatgtctggcggat

SEQ ID NO: 11390 - DNA, 25 bp, S. cerevisiae
actatatgttgcctttcggagcgtg

SEQ ID NO: 11391 - DNA, 25 bp, S. cerevisiae
actcaagggtgttgtcgtcgctgga

SEQ ID NO: 11392 - DNA, 25 bp, S. cerevisiae
actccagaaggatttgcgccgtcga

SEQ ID NO: 11393 - DNA, 25 bp, S. cerevisiae
actcctgaaagtttgagctcatgct

SEQ ID NO: 11394 - DNA, 25 bp, S. cerevisiae
actgatctgaccttttacgatgcta

SEQ ID NO: 11395 - DNA, 25 bp, S. cerevisiae
actgctccagtcttgtttgcatgga

SEQ ID NO: 11396 - DNA, 25 bp, S. cerevisiae
actgctgcctcggtgttcaaagaat

SEQ ID NO: 11397 - DNA, 25 bp, S. cerevisiae
actgctgccgcctcaaataatagat

SEQ ID NO: 11398 - DNA, 25 bp, S. cerevisiae
actgccgctggccaaaagatcgatt

SEQ ID NO: 11399 - DNA, 25 bp, S. cerevisiae
actcaagcagccagccaagtaagcg

SEQ ID NO: 11400 - DNA, 25 bp, S. cerevisiae
actgaacttcttcgcacaggtggaa

SEQ ID NO: 11401 - DNA, 25 bp, S. cerevisiae
actgttctatatttaccgatgcgga

SEQ ID NO: 11402 - DNA, 25 bp, S. cerevisiae
actgttgctaataatgtccctggaa

SEQ ID NO: 11403 - DNA, 25 bp, S. cerevisiae
actgtttctattttcatgctgccaa

SEQ ID NO: 11404 - DNA, 25 bp, S. cerevisiae
acaccagattacatagcgccggaag

SEQ ID NO: 11405 - DNA, 25 bp, S. cerevisiae
acaagacaacttggcggctgcgacg

SEQ ID NO: 11406 - DNA, 25 bp, S. cerevisiae
actacaacagtagcgccatggcatc

SEQ ID NO: 11407 - DNA, 25 bp, S. cerevisiae
actacatcactgaatgcgcgccatg

SEQ ID NO: 11408 - DNA, 25 bp, S. cerevisiae
actgctttggattacgttgatgacc

SEQ ID NO: 11409 - DNA, 25 bp, S. cerevisiae
actgcttttagtgttggtgccgttc

SEQ ID NO: 11410 - DNA, 25 bp, S. cerevisiae
acaagttacggaaggcggagctaat

SEQ ID NO: 11411 - DNA, 25 bp, S. cerevisiae
actcgagaactggatcaagggacta

SEQ ID NO: 11412 - DNA, 25 bp, S. cerevisiae
gacttcaaaagtgtttagtacagca

SEQ ID NO: 11413 - DNA, 25 bp, S. cerevisiae
acttgagaaagttgccccatttatt

SEQ ID NO: 11414 - DNA, 25 bp, S. cerevisiae
actgattctggtgatactggcttta

SEQ ID NO: 11415 - DNA, 25 bp, S. cerevisiae
actgcaattttccagggctctaatg

SEQ ID NO: 11416 - DNA, 25 bp, S. cerevisiae
actaattgctcatcagggtccacaa

SEQ ID NO: 11417 - DNA, 25 bp, S. cerevisiae
actacatgtgctgacaaccaaacca

SEQ ID NO: 11418 - DNA, 25 bp, S. cerevisiae
actacattcccaccagattaactca

SEQ ID NO: 11419 - DNA, 25 bp, S. cerevisiae
actacctctccgcaattgcaagaaa

SEQ ID NO: 11420 - DNA, 25 bp, S. cerevisiae
actcgtctctcgcaatttgccaaag

SEQ ID NO: 11421 - DNA, 25 bp, S. cerevisiae
actgctgctactggtctagatgctt

SEQ ID NO: 11422 - DNA, 25 bp, S. cerevisiae
actgcattgtcaagattaggtctaa

SEQ ID NO: 11423 - DNA, 25 bp, S. cerevisiae
actgctatggtattgtgtggttcta

SEQ ID NO: 11424 - DNA, 25 bp, S. cerevisiae
acttctgtgcctcatgcggtggaca

SEQ ID NO: 11425 - DNA, 25 bp, S. cerevisiae
acttccgtcatattggcagggcaca

SEQ ID NO: 11426 - DNA, 25 bp, S. cerevisiae
actcgcttgtcacatgccagttgaa

SEQ ID NO: 11427 - DNA, 25 bp, S. cerevisiae
actcgtctgtcaatctgcacaattt

SEQ ID NO: 11428 - DNA, 25 bp, S. cerevisiae
actcctgattctagctcaaactcta

SEQ ID NO: 11429 - DNA, 25 bp, S. cerevisiae
actccagatctggtgcccaattgaa

SEQ ID NO: 11430 - DNA, 25 bp, S. cerevisiae
actgcgagttcgaatcatctatgga

SEQ ID NO: 11431 - DNA, 25 bp, S. cerevisiae
actgcttcatttgttcaggttctga

SEQ ID NO: 11432 - DNA, 25 bp, S. cerevisiae
actcttttcggtgctggtatcatgg

SEQ ID NO: 11433 - DNA, 25 bp, S. cerevisiae
actccaggattgtcgactttgcatg

SEQ ID NO: 11434 - DNA, 25 bp, S. cerevisiae
acacaggagaatcgcaaggttttgc

SEQ ID NO: 11435 - DNA, 25 bp, S. cerevisiae
actcgcgacactcaatggttttcaa

SEQ ID NO: 11436 - DNA, 25 bp, S. cerevisiae
actgccggactctgggttatacaac

SEQ ID NO: 11437 - DNA, 25 bp, S. cerevisiae
actacctctactaaggctgctgcat

SEQ ID NO: 11438 - DNA, 25 bp, S. cerevisiae
acttcttactcctgaaatgtgcgat

SEQ ID NO: 11439 - DNA, 25 bp, S. cerevisiae
acttattttctctgtacttgcttta

SEQ ID NO: 11440 - DNA, 25 bp, S. cerevisiae
acttgatttttgttgtaccggcgcg

SEQ ID NO: 11441 - DNA, 25 bp, S. cerevisiae
actgctgctgtcgttggtgttaagg

SEQ ID NO: 11442 - DNA, 25 bp, S. cerevisiae
actgctgcttccattgataacaagg

SEQ ID NO: 11443 - DNA, 25 bp, S. cerevisiae
actgctttcgttccaaacgatggtt

SEQ ID NO: 11444 - DNA, 25 bp, S. cerevisiae
acttcattgggatatgcaggcgttc

SEQ ID NO: 11445 - DNA, 25 bp, S. cerevisiae
actcgtcgcgaatatgataggttga

SEQ ID NO: 11446 - DNA, 25 bp, S. cerevisiae
actcgtggcgagcaatttcaattga

SEQ ID NO: 11447 - DNA, 25 bp, S. cerevisiae
actacagcctacgttttattctata

SEQ ID NO: 11448 - DNA, 25 bp, S. cerevisiae
acatggcatccaacttctgaagaac

SEQ ID NO: 11449 - DNA, 25 bp, S. cerevisiae
actgcagctcaaacctctggaacag

SEQ ID NO: 11450 - DNA, 25 bp, S. cerevisiae
actacatcgaatgcagctggaactg

SEQ ID NO: 11451 - DNA, 25 bp, S. cerevisiae
actctatccgcagcagctggagatt

SEQ ID NO: 11452 - DNA, 25 bp, S. cerevisiae
actctcagcaaaaacgtctcaacaa

SEQ ID NO: 11453 - DNA, 25 bp, S. cerevisiae
actaccatcttatatcgtttacaaa

SEQ ID NO: 11454 - DNA, 25 bp, S. cerevisiae
actacgccacgcagttgtgtctaaa

SEQ ID NO: 11455 - DNA, 25 bp, S. cerevisiae
actcctgattacattgctcctgaag

SEQ ID NO: 11456 - DNA, 25 bp, S. cerevisiae
actcctagtgaattagctctgtacg

SEQ ID NO: 11457 - DNA, 25 bp, S. cerevisiae
actacacgtagatgagctatcgatt

SEQ ID NO: 11458 - DNA, 25 bp, S. cerevisiae
actacaagctagttggtcatccaat

SEQ ID NO: 11459 - DNA, 25 bp, S. cerevisiae
actaaagctatgtggcctgtgtata

SEQ ID NO: 11460 - DNA, 25 bp, S. cerevisiae
acttacagtattcaccgtcaacggt

SEQ ID NO: 11461 - DNA, 25 bp, S. cerevisiae
acttcagtaaggtaattgtcaggtt

SEQ ID NO: 11462 - DNA, 25 bp, S. cerevisiae
acttggtcaacgttgaggctccgga

SEQ ID NO: 11463 - DNA, 25 bp, S. cerevisiae
acacgcttgaagtttcaggctcctg

SEQ ID NO: 11464 - DNA, 25 bp, S. cerevisiae
actgccgtcgatttttagatgttta

SEQ ID NO: 11465 - DNA, 25 bp, S. cerevisiae
actctggataatttagctgcaacac

SEQ ID NO: 11466 - DNA, 25 bp, S. cerevisiae
actcccgcatatttagctcaatcag

SEQ ID NO: 11467 - DNA, 25 bp, S. cerevisiae
actccctgttgttttctatcattgc

SEQ ID NO: 11468 - DNA, 25 bp, S. cerevisiae
actctcctggcgaaatttattgttt

SEQ ID NO: 11469 - DNA, 25 bp, S. cerevisiae
actgccaatggtgcaaattcctctt

SEQ ID NO: 11470 - DNA, 25 bp, S. cerevisiae
acttctacccatataccactaatta

SEQ ID NO: 11471 - DNA, 25 bp, S. cerevisiae
acttgtaccgtaccaacactgatac

SEQ ID NO: 11472 - DNA, 25 bp, S. cerevisiae
acttgttcttcttccaaatgctgca

SEQ ID NO: 11473 - DNA, 25 bp, S. cerevisiae
actttttctgtctaccaatcgcaat

SEQ ID NO: 11474 - DNA, 25 bp, S. cerevisiae
acttcttacctgctagcgacgagag

SEQ ID NO: 11475 - DNA, 25 bp, S. cerevisiae
actacttatcgggatctggcacgaa

SEQ ID NO: 11476 - DNA, 25 bp, S. cerevisiae
actacttaggcggtcgaatgctcga

SEQ ID NO: 11477 - DNA, 25 bp, S. cerevisiae
actctcaagggtgaatggtcatcag

SEQ ID NO: 11478 - DNA, 25 bp, S. cerevisiae
actcatcaaagtctactggccactg

SEQ ID NO: 11479 - DNA, 25 bp, S. cerevisiae
acttctgccaaagtttccatcaggt

SEQ ID NO: 11480 - DNA, 25 bp, S. cerevisiae
actcgagcgttattgttccgcaatt

SEQ ID NO: 11481 - DNA, 25 bp, S. cerevisiae
actcagggcttattggaatcttcca

SEQ ID NO: 11482 - DNA, 25 bp, S. cerevisiae
actcatctggatcacaacttcctaa

SEQ ID NO: 11483 - DNA, 25 bp, S. cerevisiae
actatatgcgagcaaatcccctcac

SEQ ID NO: 11484 - DNA, 25 bp, S. cerevisiae
actagctaagctcgaatcacatcct

SEQ ID NO: 11485 - DNA, 25 bp, S. cerevisiae
actctgtttacatgggttctgctgc

SEQ ID NO: 11486 - DNA, 25 bp, S. cerevisiae
actcgctcttccagttgtattctaa

SEQ ID NO: 11487 - DNA, 25 bp, S. cerevisiae
actgctgcaggtgttgccgttggta

SEQ ID NO: 11488 - DNA, 25 bp, S. cerevisiae
actctgctagaaagctacgtgtcca

SEQ ID NO: 11489 - DNA, 25 bp, S. cerevisiae
actcctctactgaatatcgccgaat

SEQ ID NO: 11490 - DNA, 25 bp, S. cerevisiae
actcacctactaaatctgcatcata

SEQ ID NO: 11491 - DNA, 25 bp, S. cerevisiae
actgccatttcttggactgcatatg

SEQ ID NO: 11492 - DNA, 25 bp, S. cerevisiae
actctattatcttttcgccggttat

SEQ ID NO: 11493 - DNA, 25 bp, S. cerevisiae
actttatattttacagccggtgcat

SEQ ID NO: 11494 - DNA, 25 bp, S. cerevisiae
actgcctttggtatgacctggtgca

SEQ ID NO: 11495 - DNA, 25 bp, S. cerevisiae
actcccctggtgatgatcctaacat

SEQ ID NO: 11496 - DNA, 25 bp, S. cerevisiae
actcactgggtgatgctgacgctaa

SEQ ID NO: 11497 - DNA, 25 bp, S. cerevisiae
acttggtgtacatcttgggctcgtc

SEQ ID NO: 11498 - DNA, 25 bp, S. cerevisiae
actcttcttcatccttgacaggata

SEQ ID NO: 11499 - DNA, 25 bp, S. cerevisiae
actcccctcatctttatatgtcata

SEQ ID NO: 11500 - DNA, 25 bp, S. cerevisiae
actaccaatttgactccatcatcga

SEQ ID NO: 11501 - DNA, 25 bp, S. cerevisiae
acttccacatttcgtccatttaggg

SEQ ID NO: 11502 - DNA, 25 bp, S. cerevisiae
actttgccaatgtgattccttctag

SEQ ID NO: 11503 - DNA, 25 bp, S. cerevisiae
aatcttgaatggtctgaatggtctc

SEQ ID NO: 11504 - DNA, 25 bp, S. cerevisiae
acttgatgacgcctctaatagcctc

SEQ ID NO: 11505 - DNA, 25 bp, S. cerevisiae
acttgctaggcatttactccaaaga

SEQ ID NO: 11506 - DNA, 25 bp, S. cerevisiae
acttggtcgggcttcatcttgaatt

SEQ ID NO: 11507 - DNA, 25 bp, S. cerevisiae
actacgcgcaggcaacattgtaaat

SEQ ID NO: 11508 - DNA, 25 bp, S. cerevisiae
actccttatatctactttcatctca

SEQ ID NO: 11509 - DNA, 25 bp, S. cerevisiae
actccttctacaatttctgctgatc

SEQ ID NO: 11510 - DNA, 25 bp, S. cerevisiae
actttccctcaaccttatggtgatg

SEQ ID NO: 11511 - DNA, 25 bp, S. cerevisiae
actcttcaccttgtcttgaggttga

SEQ ID NO: 11512 - DNA, 25 bp, S. cerevisiae
actttcctgcattctcctttgaaaa

SEQ ID NO: 11513 - DNA, 25 bp, S. cerevisiae
actcgttcatcgctctttatggtaa

SEQ ID NO: 11514 - DNA, 25 bp, S. cerevisiae
actctctaacctcttcgctaaagtt

SEQ ID NO: 11515 - DNA, 25 bp, S. cerevisiae
acttataacgctcctttccaaacat

SEQ ID NO: 11516 - DNA, 25 bp, S. cerevisiae
actctaagacttactctacaccaaa

SEQ ID NO: 11517 - DNA, 25 bp, S. cerevisiae
acttcctatggtactttcagttggg

SEQ ID NO: 11518 - DNA, 25 bp, S. cerevisiae
actattcgcagtttacacctttctc

SEQ ID NO: 11519 - DNA, 25 bp, S. cerevisiae
acagattggccttctaccaagtcac

SEQ ID NO: 11520 - DNA, 25 bp, S. cerevisiae
acatggttatgtgctaaaggacggc

SEQ ID NO: 11521 - DNA, 25 bp, S. cerevisiae
acatttatgggttcgcaattcttcc

SEQ ID NO: 11522 - DNA, 25 bp, S. cerevisiae
actagtctgtgcataaacggcgaac

SEQ ID NO: 11523 - DNA, 25 bp, S. cerevisiae
acatttctggcaatagcaacgggca

SEQ ID NO: 11524 - DNA, 25 bp, S. cerevisiae
actctcgtaatatggatcgctggac

SEQ ID NO: 11525 - DNA, 25 bp, S. cerevisiae
actccgctagaaagttgcgtgtcca

SEQ ID NO: 11526 - DNA, 25 bp, S. cerevisiae
acttgccggcaaggttgggtctata

SEQ ID NO: 11527 - DNA, 25 bp, S. cerevisiae
acttccggaggttcttggtagcaga

SEQ ID NO: 11528 - DNA, 25 bp, S. cerevisiae
acttttactcaactccagcgtggaa

SEQ ID NO: 11529 - DNA, 25 bp, S. cerevisiae
acttctgtagatcaccaatggcgga

SEQ ID NO: 11530 - DNA, 25 bp, S. cerevisiae
cactacccggaagacgctttgtgta

SEQ ID NO: 11531 - DNA, 25 bp, S. cerevisiae
actaaccgtcatttattgcatttgg

SEQ ID NO: 11532 - DNA, 25 bp, S. cerevisiae
actaagccagctatcagaagattag

SEQ ID NO: 11533 - DNA, 25 bp, S. cerevisiae
actactgattccgtggaggctgttt

SEQ ID NO: 11534 - DNA, 25 bp, S. cerevisiae
acaactttggaggtcgtgtcgtcga

SEQ ID NO: 11535 - DNA, 25 bp, S. cerevisiae
actatgcttctatgttctggttgac

SEQ ID NO: 11536 - DNA, 25 bp, S. cerevisiae
actctgttcaagtcgcattgtttcg

SEQ ID NO: 11537 - DNA, 25 bp, S. cerevisiae
actctactcagtatggcgttcaagt

SEQ ID NO: 11538 - DNA, 25 bp, S. cerevisiae
actcagtttgattacgacttctaca

SEQ ID NO: 11539 - DNA, 25 bp, S. cerevisiae
actctgtttatagcgttgtcttcac

SEQ ID NO: 11540 - DNA, 25 bp, S. cerevisiae
actctgtatttgtgggtctttcgct

SEQ ID NO: 11541 - DNA, 25 bp, S. cerevisiae
actctaaggttgatcgttctgccgc

SEQ ID NO: 11542 - DNA, 25 bp, S. cerevisiae
actattatcgatggtacgccttccg

SEQ ID NO: 11543 - DNA, 25 bp, S. cerevisiae
actctttcagtggtaagtactctca

SEQ ID NO: 11544 - DNA, 25 bp, S. cerevisiae
acttgttagcatgtgggtccagcgc

SEQ ID NO: 11545 - DNA, 25 bp, S. cerevisiae
actacttactgtttggatgccacct

SEQ ID NO: 11546 - DNA, 25 bp, S. cerevisiae
acttctgcgcttgtgtaacgcacat

SEQ ID NO: 11547 - DNA, 25 bp, S. cerevisiae
acatttcgtatttaaagcgcaagag

SEQ ID NO: 11548 - DNA, 25 bp, S. cerevisiae
actagtcttttggatcgcgttaatt

SEQ ID NO: 11549 - DNA, 25 bp, S. cerevisiae
acattattagatgcatccaccatta

SEQ ID NO: 11550 - DNA, 25 bp, S. cerevisiae
acttctgtgagtgcaaccgcatcaa

SEQ ID NO: 11551 - DNA, 25 bp, S. cerevisiae
actatggatttgcatgcttcccaaa

SEQ ID NO: 11552 - DNA, 25 bp, S. cerevisiae
acttggaagtcggtgtcgctacaaa

SEQ ID NO: 11553 - DNA, 25 bp, S. cerevisiae
actattgaaaagtattcggtcagac

SEQ ID NO: 11554 - DNA, 25 bp, S. cerevisiae
actcatattttggatttcgttcaga

SEQ ID NO: 11555 - DNA, 25 bp, S. cerevisiae
actcagactttgaattcttccgcaa

SEQ ID NO: 11556 - DNA, 25 bp, S. cerevisiae
actcgattgttcatattcctgcttc

SEQ ID NO: 11557 - DNA, 25 bp, S. cerevisiae
actcgcatgtggtgttgtcattttc

SEQ ID NO: 11558 - DNA, 25 bp, S. cerevisiae
actctgctgctgttatctgtgttaa

SEQ ID NO: 11559 - DNA, 25 bp, S. cerevisiae
actatggatccaactgcagctgctg

SEQ ID NO: 11560 - DNA, 25 bp, S. cerevisiae
actatgatatgcatggctcgcctgg

SEQ ID NO: 11561 - DNA, 25 bp, S. cerevisiae
acatgatgacatctggtccggtaga

SEQ ID NO: 11562 - DNA, 25 bp, S. cerevisiae
acagcagaagcttaacacgcgattg

SEQ ID NO: 11563 - DNA, 25 bp, S. cerevisiae
acaaatcgcgtatgcaagccatgga

SEQ ID NO: 11564 - DNA, 25 bp, S. cerevisiae
acatcgacacagacggccggcagga

SEQ ID NO: 11565 - DNA, 25 bp, S. cerevisiae
acatcgccagatagccgccgttgaa

SEQ ID NO: 11566 - DNA, 25 bp, S. cerevisiae
acatagtatgatttcgccgacgcaa

SEQ ID NO: 11567 - DNA, 25 bp, S. cerevisiae
actagcgaatttggccatggacact

SEQ ID NO: 11568 - DNA, 25 bp, S. cerevisiae
actctggatttggacgatgtacact

SEQ ID NO: 11569 - DNA, 25 bp, S. cerevisiae
actagcattcttaccaaggccagtg

SEQ ID NO: 11570 - DNA, 25 bp, S. cerevisiae
acataatgtttgtcccactccaggt

SEQ ID NO: 11571 - DNA, 25 bp, S. cerevisiae
acataattcttgtttcacttgattg

SEQ ID NO: 11572 - DNA, 25 bp, S. cerevisiae
actaaggcttctgtactatgtttta

SEQ ID NO: 11573 - DNA, 25 bp, S. cerevisiae
acaaaagatccgctaccggtgccaa

SEQ ID NO: 11574 - DNA, 25 bp, S. cerevisiae
actagagagtgccagcgaaccgcgt

SEQ ID NO: 11575 - DNA, 25 bp, S. cerevisiae
actacagctgtccagagtgaagggt

SEQ ID NO: 11576 - DNA, 25 bp, S. cerevisiae
actacagtgactatatgggcggtta

SEQ ID NO: 11577 - DNA, 25 bp, S. cerevisiae
actacagtggccaatttcgcttgtt

SEQ ID NO: 11578 - DNA, 25 bp, S. cerevisiae
actctaggatccacttctgttttga

SEQ ID NO: 11579 - DNA, 25 bp, S. cerevisiae
actaagccttccttgtctatgacaa

SEQ ID NO: 11580 - DNA, 25 bp, S. cerevisiae
actatgcctgcgacggcgacgaaaa

SEQ ID NO: 11581 - DNA, 25 bp, S. cerevisiae
actctgcggctactaatatcacttg

SEQ ID NO: 11582 - DNA, 25 bp, S. cerevisiae
actttcgtggccttatacactgttg

SEQ ID NO: 11583 - DNA, 25 bp, S. cerevisiae
acagtccttccgctagaattgtggt

SEQ ID NO: 11584 - DNA, 25 bp, S. cerevisiae
acactactcccgcattaactgattt

SEQ ID NO: 11585 - DNA, 25 bp, S. cerevisiae
actctatagtgcagtcccaacagac

SEQ ID NO: 11586 - DNA, 25 bp, S. cerevisiae
actcattccaagattttagcgtatt

SEQ ID NO: 11587 - DNA, 25 bp, S. cerevisiae
acattccaaatgctattagaggtat

SEQ ID NO: 11588 - DNA, 25 bp, S. cerevisiae
acttccctcagttcattaccgtgga

SEQ ID NO: 11589 - DNA, 25 bp, S. cerevisiae
actatggctgtttacaaactcgtac

SEQ ID NO: 11590 - DNA, 25 bp, S. cerevisiae
acttgtttgtacgatctttagctag

SEQ ID NO: 11591 - DNA, 25 bp, S. cerevisiae
actctctttgttctgcttcaactaa

SEQ ID NO: 11592 - DNA, 25 bp, S. cerevisiae
actctattattctccttcgttcaag

SEQ ID NO: 11593 - DNA, 25 bp, S. cerevisiae
actttgtactatcccttcggtcaat

SEQ ID NO: 11594 - DNA, 25 bp, S. cerevisiae
actactggtagcaacggtcgttcaa

SEQ ID NO: 11595 - DNA, 25 bp, S. cerevisiae
acagggtttatgcagggtgcccaac

SEQ ID NO: 11596 - DNA, 25 bp, S. cerevisiae
acacaggttttacgtgcggccaaga

SEQ ID NO: 11597 - DNA, 25 bp, S. cerevisiae
actacagtttgctcagtcgcggaaa

SEQ ID NO: 11598 - DNA, 25 bp, S. cerevisiae
actacttgttgaacgatcagcggtt

SEQ ID NO: 11599 - DNA, 25 bp, S. cerevisiae
actacattattttcgccacaggcta

SEQ ID NO: 11600 - DNA, 25 bp, S. cerevisiae
actatcacttataccgagagggcga

SEQ ID NO: 11601 - DNA, 25 bp, S. cerevisiae
actactgcgtcctcgaatgggcaaa

SEQ ID NO: 11602 - DNA, 25 bp, S. cerevisiae
actactttgcaagctattctgcaga

SEQ ID NO: 11603 - DNA, 25 bp, S. cerevisiae
actacttgttgtgctgtgtcatgga

SEQ ID NO: 11604 - DNA, 25 bp, S. cerevisiae
actattcgatttctggtatgccttg

SEQ ID NO: 11605 - DNA, 25 bp, S. cerevisiae
acatctactgtttggtggctaccgt

SEQ ID NO: 11606 - DNA, 25 bp, S. cerevisiae
actaataatcgtggtggctcaccgt

SEQ ID NO: 11607 - DNA, 25 bp, S. cerevisiae
acatcaataatgctgggtctaggag

SEQ ID NO: 11608 - DNA, 25 bp, S. cerevisiae
acatcacattctcggtaattacggt

SEQ ID NO: 11609 - DNA, 25 bp, S. cerevisiae
aaccacctcggcatcagtaacaagg

SEQ ID NO: 11610 - DNA, 25 bp, S. cerevisiae
acagaagtcccagtaggtacacttt

SEQ ID NO: 11611 - DNA, 25 bp, S. cerevisiae
actacaatctgcttctggttctgca

SEQ ID NO: 11612 - DNA, 25 bp, S. cerevisiae
acacactatatggtcacgttgctgc

SEQ ID NO: 11613 - DNA, 25 bp, S. cerevisiae
acaggtatacggtctgctttacaac

SEQ ID NO: 11614 - DNA, 25 bp, S. cerevisiae
acattgttagcgcagtcgttaaggc

SEQ ID NO: 11615 - DNA, 25 bp, S. cerevisiae
acttttgggtttgatcatgctgcgt

SEQ ID NO: 11616 - DNA, 25 bp, S. cerevisiae
acttcgaagttatattggttgatcc

SEQ ID NO: 11617 - DNA, 25 bp, S. cerevisiae
acttcttgtgcgctgaactttattg

SEQ ID NO: 11618 - DNA, 25 bp, S. cerevisiae
acatttttggtaccgctatcgttgc

SEQ ID NO: 11619 - DNA, 25 bp, S. cerevisiae
acttacgacaaaagcagcccaactg

SEQ ID NO: 11620 - DNA, 25 bp, S. cerevisiae
actacggcatcgactatggcttaca

SEQ ID NO: 11621 - DNA, 25 bp, S. cerevisiae
actacaccctacaagtgcattacac

SEQ ID NO: 11622 - DNA, 25 bp, S. cerevisiae
actaccacctcaccagagcttataa

SEQ ID NO: 11623 - DNA, 25 bp, S. cerevisiae
actagtcggcaattatcactacttc

SEQ ID NO: 11624 - DNA, 25 bp, S. cerevisiae
acattggtgcgtacagaatttctga

SEQ ID NO: 11625 - DNA, 25 bp, S. cerevisiae
acttcgcgcctcaaggaattagaac

SEQ ID NO: 11626 - DNA, 25 bp, S. cerevisiae
acatttgctcggtgtgttggtccaa

SEQ ID NO: 11627 - DNA, 25 bp, S. cerevisiae
actttgcgtggctgtgtcgagattt

SEQ ID NO: 11628 - DNA, 25 bp, S. cerevisiae
actactgccatttccaaggcttcta

SEQ ID NO: 11629 - DNA, 25 bp, S. cerevisiae
actacccattgctacaaggcttaca

SEQ ID NO: 11630 - DNA, 25 bp, S. cerevisiae
actacgccttgattaagggtgccaa

SEQ ID NO: 11631 - DNA, 25 bp, S. cerevisiae
actacctcttgattttgcacttggc

SEQ ID NO: 11632 - DNA, 25 bp, S. cerevisiae
actacgtttgtcctatccatgttca

SEQ ID NO: 11633 - DNA, 25 bp, S. cerevisiae
acatccatagatcagttccgtggga

SEQ ID NO: 11634 - DNA, 25 bp, S. cerevisiae
acatccagacttttacgggtggcaa

SEQ ID NO: 11635 - DNA, 25 bp, S. cerevisiae
acatgaagcgttgttctgacgaccc

SEQ ID NO: 11636 - DNA, 25 bp, S. cerevisiae
acttcaactatatgccttcgagaat

SEQ ID NO: 11637 - DNA, 25 bp, S. cerevisiae
acttccgttggcgtgtgggtctaca

SEQ ID NO: 11638 - DNA, 25 bp, S. cerevisiae
acttggctttggcttgcggtaacaa

SEQ ID NO: 11639 - DNA, 25 bp, S. cerevisiae
actatcacaataccacgtttcactg

SEQ ID NO: 11640 - DNA, 25 bp, S. cerevisiae
acttacagatacgtttctgtctctg

SEQ ID NO: 11641 - DNA, 25 bp, S. cerevisiae
acatttggaactatttccatcggga

SEQ ID NO: 11642 - DNA, 25 bp, S. cerevisiae
actttcgccactaatggtccaaggg

SEQ ID NO: 11643 - DNA, 25 bp, S. cerevisiae
acttgtccagtaatagcgtcgattg

SEQ ID NO: 11644 - DNA, 25 bp, S. cerevisiae
actaccagtatgttatcatgtacgg

SEQ ID NO: 11645 - DNA, 25 bp, S. cerevisiae
acatcggctattgatatctggtcag

SEQ ID NO: 11646 - DNA, 25 bp, S. cerevisiae
acatcgtgtcggtagagctggtaga

SEQ ID NO: 11647 - DNA, 25 bp, S. cerevisiae
acattgattcgggagacctggcgct

SEQ ID NO: 11648 - DNA, 25 bp, S. cerevisiae
acttgatatctcgtgatctggcaga

SEQ ID NO: 11649 - DNA, 25 bp, S. cerevisiae
acttcattctgggatgcctatcaaa

SEQ ID NO: 11650 - DNA, 25 bp, S. cerevisiae
actacattatctcaatctgacgaaa

SEQ ID NO: 11651 - DNA, 25 bp, S. cerevisiae
acaaaaccaacgaccagctcataat

SEQ ID NO: 11652 - DNA, 25 bp, S. cerevisiae
acaggtgcgtgaacgttccggtgca

SEQ ID NO: 11653 - DNA, 25 bp, S. cerevisiae
acaggccagtaatgtacccagtgaa

SEQ ID NO: 11654 - DNA, 25 bp, S. cerevisiae
acaggactctaatccagccaattac

SEQ ID NO: 11655 - DNA, 25 bp, S. cerevisiae
acattgaacaatggcgacagctaat

SEQ ID NO: 11656 - DNA, 25 bp, S. cerevisiae
acatgtttcaattgccatcgctagc

SEQ ID NO: 11657 - DNA, 25 bp, S. cerevisiae
acttcttcaggtccgatgcatacag

SEQ ID NO: 11658 - DNA, 25 bp, S. cerevisiae
actatgtttcggattcgctactcac

SEQ ID NO: 11659 - DNA, 25 bp, S. cerevisiae
acatcttaactcaaggagggcacat

SEQ ID NO: 11660 - DNA, 25 bp, S. cerevisiae
acatctctaacatgtcgcaaggtga

SEQ ID NO: 11661 - DNA, 25 bp, S. cerevisiae
acttcagagctctatgtaccggtga

SEQ ID NO: 11662 - DNA, 25 bp, S. cerevisiae
acttccccttctgtggtttcagata

SEQ ID NO: 11663 - DNA, 25 bp, S. cerevisiae
acttccacgttcaggttattcacta

SEQ ID NO: 11664 - DNA, 25 bp, S. cerevisiae
acttgaaggcttctggtgctttcac

SEQ ID NO: 11665 - DNA, 25 bp, S. cerevisiae
acttaaatgattccaaggctccttt

SEQ ID NO: 11666 - DNA, 25 bp, S. cerevisiae
acttccaagttgtccagagctatcc

SEQ ID NO: 11667 - DNA, 25 bp, S. cerevisiae
actattgctcatcgattaaggtcag

SEQ ID NO: 11668 - DNA, 25 bp, S. cerevisiae
acatgtatgcctggagaacggccga

SEQ ID NO: 11669 - DNA, 25 bp, S. cerevisiae
acatatatgctccattgtacgctcc

SEQ ID NO: 11670 - DNA, 25 bp, S. cerevisiae
actattgatcgttatagccgcccta

SEQ ID NO: 11671 - DNA, 25 bp, S. cerevisiae
actatttccgcttctggtgccgcaa

SEQ ID NO: 11672 - DNA, 25 bp, S. cerevisiae
actagaaatcaacacgcctgcactg

SEQ ID NO: 11673 - DNA, 25 bp, S. cerevisiae
catcggaaactcctactgaacattt

SEQ ID NO: 11674 - DNA, 25 bp, S. cerevisiae
acaggagactgaagctggcgaatct

SEQ ID NO: 11675 - DNA, 25 bp, S. cerevisiae
acagggctgccaccatactatgatg

SEQ ID NO: 11676 - DNA, 25 bp, S. cerevisiae
acaggcagcctaccagatgaatatg

SEQ ID NO: 11677 - DNA, 25 bp, S. cerevisiae
acatcgggtcatttagcaaggcata

SEQ ID NO: 11678 - DNA, 25 bp, S. cerevisiae
acaaggttattatcaacaaggtcca

SEQ ID NO: 11679 - DNA, 25 bp, S. cerevisiae
acttggtttttgagctttgtctgcc

SEQ ID NO: 11680 - DNA, 25 bp, S. cerevisiae
acttcccctaagttccagtgatgag

SEQ ID NO: 11681 - DNA, 25 bp, S. cerevisiae
acttagaccccgaacactgtgatga

SEQ ID NO: 11682 - DNA, 25 bp, S. cerevisiae
actttggctcatcacggtatcattt

SEQ ID NO: 11683 - DNA, 25 bp, S. cerevisiae
acttctgggcaggtaggatttctcc

SEQ ID NO: 11684 - DNA, 25 bp, S. cerevisiae
acaacggtcgcaaagtcagcttcca

SEQ ID NO: 11685 - DNA, 25 bp, S. cerevisiae
actagcgccgaattgttgctccaac

SEQ ID NO: 11686 - DNA, 25 bp, S. cerevisiae
actactctttccaagctgctcaccc

SEQ ID NO: 11687 - DNA, 25 bp, S. cerevisiae
actactctttccaagtcgctcatcc

SEQ ID NO: 11688 - DNA, 25 bp, S. cerevisiae
acatctctttttaggtgggtcgctc

SEQ ID NO: 11689 - DNA, 25 bp, S. cerevisiae
acttgttttcgttggaggctctatt

SEQ ID NO: 11690 - DNA, 25 bp, S. cerevisiae
acttttgatcccatggaggctcttt

SEQ ID NO: 11691 - DNA, 25 bp, S. cerevisiae
acttttgtggccagtagttctctgc

SEQ ID NO: 11692 - DNA, 25 bp, S. cerevisiae
acatttttaccttcactttgccagt

SEQ ID NO: 11693 - DNA, 25 bp, S. cerevisiae
actttcgcaccacgaatccattaga

SEQ ID NO: 11694 - DNA, 25 bp, S. cerevisiae
actttggctccaagtgcaccagtaa

SEQ ID NO: 11695 - DNA, 25 bp, S. cerevisiae
actttggtgctcatagaacagtcat

SEQ ID NO: 11696 - DNA, 25 bp, S. cerevisiae
actttcgcgctaccaagcaagtata

SEQ ID NO: 11697 - DNA, 25 bp, S. cerevisiae
acttgcggcggactatttgagtata

SEQ ID NO: 11698 - DNA, 25 bp, S. cerevisiae
acttcggtcttcttgatgctcgtga

SEQ ID NO: 11699 - DNA, 25 bp, S. cerevisiae
actttgcagtttgtcatccaggaaa

SEQ ID NO: 11700 - DNA, 25 bp, S. cerevisiae
actataccagtttcatgcaatcgtg

SEQ ID NO: 11701 - DNA, 25 bp, S. cerevisiae
actaccttgcgtgtattgaggctga

SEQ ID NO: 11702 - DNA, 25 bp, S. cerevisiae
actatccttggcgtcattgatgaac

SEQ ID NO: 11703 - DNA, 25 bp, S. cerevisiae
actatagtccgccttgtgagagcac

SEQ ID NO: 11704 - DNA, 25 bp, S. cerevisiae
actattccatcgacagtgttgagat

SEQ ID NO: 11705 - DNA, 25 bp, S. cerevisiae
acatatcacgctatcgttgtgggat

SEQ ID NO: 11706 - DNA, 25 bp, S. cerevisiae
actttgcccaataccatcgacaatg

SEQ ID NO: 11707 - DNA, 25 bp, S. cerevisiae
actaggcgatttggcgtctttgaaa

SEQ ID NO: 11708 - DNA, 25 bp, S. cerevisiae
actatcagagattgtggcgccttta

SEQ ID NO: 11709 - DNA, 25 bp, S. cerevisiae
acttcaaatgcaatctggccaccat

SEQ ID NO: 11710 - DNA, 25 bp, S. cerevisiae
acatgtcaaagcactggcagttcgt

SEQ ID NO: 11711 - DNA, 25 bp, S. cerevisiae
acatgccccacaagaacgtatcgtt

SEQ ID NO: 11712 - DNA, 25 bp, S. cerevisiae
acattcgcgcagacaactagttcag

SEQ ID NO: 11713 - DNA, 25 bp, S. cerevisiae
acttcttctgtctcgcaatgcgaaa

SEQ ID NO: 11714 - DNA, 25 bp, S. cerevisiae
aactagctcatgtgacagtaccaaa

SEQ ID NO: 11715 - DNA, 25 bp, S. cerevisiae
acttcctcatcaacacttcgatata

SEQ ID NO: 11716 - DNA, 25 bp, S. cerevisiae
acttcctgcaagttcctctgaaatt

SEQ ID NO: 11717 - DNA, 25 bp, S. cerevisiae
acatgggaaatggtcaacttgatac

SEQ ID NO: 11718 - DNA, 25 bp, S. cerevisiae
acatgggagacgctgacctggctac

SEQ ID NO: 11719 - DNA, 25 bp, S. cerevisiae
acaggtggcacatagcagccgacta

SEQ ID NO: 11720 - DNA, 25 bp, S. cerevisiae
acaggttgccttgccaggacgaata

SEQ ID NO: 11721 - DNA, 25 bp, S. cerevisiae
acatactttgtcactgcagcatacg

SEQ ID NO: 11722 - DNA, 25 bp, S. cerevisiae
acttctgaagctcctgaagccacaa

SEQ ID NO: 11723 - DNA, 25 bp, S. cerevisiae
acttcagaagcttctagtgccgcca

SEQ ID NO: 11724 - DNA, 25 bp, S. cerevisiae
actagagcagctttctgagtcacta

SEQ ID NO: 11725 - DNA, 25 bp, S. cerevisiae
actatggtgtgctctttgggctcca

SEQ ID NO: 11726 - DNA, 25 bp, S. cerevisiae
actttgctatgctaggattgggccc

SEQ ID NO: 11727 - DNA, 25 bp, S. cerevisiae
actagtctatgcttagtctcggcca

SEQ ID NO: 11728 - DNA, 25 bp, S. cerevisiae
actatgttttaaatgtgtccgctat

SEQ ID NO: 11729 - DNA, 25 bp, S. cerevisiae
acttgggtgacgttactgcatctat

SEQ ID NO: 11730 - DNA, 25 bp, S. cerevisiae
actatgccaattgagatgccagaca

SEQ ID NO: 11731 - DNA, 25 bp, S. cerevisiae
acttgccttctttgctgccaagaga

SEQ ID NO: 11732 - DNA, 25 bp, S. cerevisiae
actattttggcgcattgatctcatt

SEQ ID NO: 11733 - DNA, 25 bp, S. cerevisiae
acttgtttattgttccctgtgttct

SEQ ID NO: 11734 - DNA, 25 bp, S. cerevisiae
acttcattttggcatcttttgttca

SEQ ID NO: 11735 - DNA, 25 bp, S. cerevisiae
acatggctttgaccggttacactgg

SEQ ID NO: 11736 - DNA, 25 bp, S. cerevisiae
actttctcagagcattttatcatcg

SEQ ID NO: 11737 - DNA, 25 bp, S. cerevisiae
acttgtctagtccttgcattacaca

SEQ ID NO: 11738 - DNA, 25 bp, S. cerevisiae
acattctaacacactgacctgtcaa

SEQ ID NO: 11739 - DNA, 25 bp, S. cerevisiae
actatcacgtccactttgctgctaa

SEQ ID NO: 11740 - DNA, 25 bp, S. cerevisiae
acattcgcaacaacattcattctcc

SEQ ID NO: 11741 - DNA, 25 bp, S. cerevisiae
actttccaatggtttcttgtttgca

SEQ ID NO: 11742 - DNA, 25 bp, S. cerevisiae
acttcccatatgatcctttgtttct

SEQ ID NO: 11743 - DNA, 25 bp, S. cerevisiae
acttccacttttgtttgatccatcg

SEQ ID NO: 11744 - DNA, 25 bp, S. cerevisiae
actatcgcagcttcatttttaacca

SEQ ID NO: 11745 - DNA, 25 bp, S. cerevisiae
actatcgatgagctttttcaactga

SEQ ID NO: 11746 - DNA, 25 bp, S. cerevisiae
acttatgcgctgcagaagcctctat

SEQ ID NO: 11747 - DNA, 25 bp, S. cerevisiae
acttagcccaatactacatgttcca

SEQ ID NO: 11748 - DNA, 25 bp, S. cerevisiae
acttttccacggatattccaattgt

SEQ ID NO: 11749 - DNA, 25 bp, S. cerevisiae
acttttccctcaaatgcatctggta

SEQ ID NO: 11750 - DNA, 25 bp, S. cerevisiae
acttttgcacattctcttgcatctg

SEQ ID NO: 11751 - DNA, 25 bp, S. cerevisiae
actttatcacctggcttgctgagta

SEQ ID NO: 11752 - DNA, 25 bp, S. cerevisiae
acagcaataaccagtctccagagac

SEQ ID NO: 11753 - DNA, 25 bp, S. cerevisiae
actttctttgttgctcttggtaatg

SEQ ID NO: 11754 - DNA, 25 bp, S. cerevisiae
actttacgtcggcatttcacattaa

SEQ ID NO: 11755 - DNA, 25 bp, S. cerevisiae
actttactttgcctattaccgctca

SEQ ID NO: 11756 - DNA, 25 bp, S. cerevisiae
acagttagtttctgcgataccgcaa

SEQ ID NO: 11757 - DNA, 25 bp, S. cerevisiae
acaactggttgcctctacaatggta

SEQ ID NO: 11758 - DNA, 25 bp, S. cerevisiae
acttccaatgatctccaatacactg

SEQ ID NO: 11759 - DNA, 25 bp, S. cerevisiae
actatcaaagtctcgaccacatctt

SEQ ID NO: 11760 - DNA, 25 bp, S. cerevisiae
acatttatagtaccccaacatctta

SEQ ID NO: 11761 - DNA, 25 bp, S. cerevisiae
acttcttatcccaatatcgactttc

SEQ ID NO: 11762 - DNA, 25 bp, S. cerevisiae
acttagctgttcacgttcttatgta

SEQ ID NO: 11763 - DNA, 25 bp, S. cerevisiae
acttgagtctggtgaaaatgggcta

SEQ ID NO: 11764 - DNA, 25 bp, S. cerevisiae
acagtggtcgtgtcctccaagggta

SEQ ID NO: 11765 - DNA, 25 bp, S. cerevisiae
acagtcgtcagtacagttgcggtgg

SEQ ID NO: 11766 - DNA, 25 bp, S. cerevisiae
acagtcggcgctctattgggtgcta

SEQ ID NO: 11767 - DNA, 25 bp, S. cerevisiae
acttccaccagacaggctggttacg

SEQ ID NO: 11768 - DNA, 25 bp, S. cerevisiae
acagttcatatggaatacgagagat

SEQ ID NO: 11769 - DNA, 25 bp, S. cerevisiae
acagagcacacggattacgcgatat

SEQ ID NO: 11770 - DNA, 25 bp, S. cerevisiae
aaggtcatcctatcgcggaagggtt

SEQ ID NO: 11771 - DNA, 25 bp, S. cerevisiae
acaggtttgtttgcggtatcggtgc

SEQ ID NO: 11772 - DNA, 25 bp, S. cerevisiae
acattgtttgtctcgggtattattc

SEQ ID NO: 11773 - DNA, 25 bp, S. cerevisiae
acagatgttcccattagtctttccc

SEQ ID NO: 11774 - DNA, 25 bp, S. cerevisiae
acttctgtccgatgttgtgtctaca

SEQ ID NO: 11775 - DNA, 25 bp, S. cerevisiae
actttgcaaagttcgctatctgcga

SEQ ID NO: 11776 - DNA, 25 bp, S. cerevisiae
acatctgtaatatctttccccattg

SEQ ID NO: 11777 - DNA, 25 bp, S. cerevisiae
acttgtacagaggtgtcttcccatt

SEQ ID NO: 11778 - DNA, 25 bp, S. cerevisiae
acagctttaatttttgcctcaggga

SEQ ID NO: 11779 - DNA, 25 bp, S. cerevisiae
actttctattgttttgatctcgttg

SEQ ID NO: 11780 - DNA, 25 bp, S. cerevisiae
cacttttccacggatattccaattg

SEQ ID NO: 11781 - DNA, 25 bp, S. cerevisiae
acttcttccacagctattgctacaa

SEQ ID NO: 11782 - DNA, 25 bp, S. cerevisiae
acttcgttcagctctcaagctcaaa

SEQ ID NO: 11783 - DNA, 25 bp, S. cerevisiae
acatttttctagcactcatccaagg

SEQ ID NO: 11784 - DNA, 25 bp, S. cerevisiae
acatgatacattgttccgtggtaac

SEQ ID NO: 11785 - DNA, 25 bp, S. cerevisiae
acatgatagatgagcccgactggaa

SEQ ID NO: 11786 - DNA, 25 bp, S. cerevisiae
acagtaattcccctgcagcgaaata

SEQ ID NO: 11787 - DNA, 25 bp, S. cerevisiae
acatcgatgcgggtcactgggtaaa

SEQ ID NO: 11788 - DNA, 25 bp, S. cerevisiae
acatttcgcggccttactaatagga

SEQ ID NO: 11789 - DNA, 25 bp, S. cerevisiae
acttacagcggcctttcattgtgaa

SEQ ID NO: 11790 - DNA, 25 bp, S. cerevisiae
acttgttcaacgcttcagtgaaact

SEQ ID NO: 11791 - DNA, 25 bp, S. cerevisiae
acatttctaacccattcagtgacca

SEQ ID NO: 11792 - DNA, 25 bp, S. cerevisiae
acttactgttggaatatcggcgtca

SEQ ID NO: 11793 - DNA, 25 bp, S. cerevisiae
acatctcactggaagttacaggccc

SEQ ID NO: 11794 - DNA, 25 bp, S. cerevisiae
acatgtctgttttcaatgtactcaa

SEQ ID NO: 11795 - DNA, 25 bp, S. cerevisiae
acattgtgattttgatactgtccaa

SEQ ID NO: 11796 - DNA, 25 bp, S. cerevisiae
acatattcatttgggactgcctaat

SEQ ID NO: 11797 - DNA, 25 bp, S. cerevisiae
acatcttatgttggagccgcttcag

SEQ ID NO: 11798 - DNA, 25 bp, S. cerevisiae
acatcatatatcacaccacgttcag

SEQ ID NO: 11799 - DNA, 25 bp, S. cerevisiae
acatcatatcctgccaatgcactat

SEQ ID NO: 11800 - DNA, 25 bp, S. cerevisiae
acagtctacatgacccctggtgatt

SEQ ID NO: 11801 - DNA, 25 bp, S. cerevisiae
acagagctaatgtctccaaggatga

SEQ ID NO: 11802 - DNA, 25 bp, S. cerevisiae
acttatttgctatccttttggcggc

SEQ ID NO: 11803 - DNA, 25 bp, S. cerevisiae
acagggtcctaaaaggcccacatct

SEQ ID NO: 11804 - DNA, 25 bp, S. cerevisiae
acagggtcgctgaactaattcctca

SEQ ID NO: 11805 - DNA, 25 bp, S. cerevisiae
cacgccggccaagatgacttaggta

SEQ ID NO: 11806 - DNA, 25 bp, S. cerevisiae
acaccggtccatggagaaactggta

SEQ ID NO: 11807 - DNA, 25 bp, S. cerevisiae
acaccgttgccagacttggcggaga

SEQ ID NO: 11808 - DNA, 25 bp, S. cerevisiae
acagggttccattcctagacgaaat

SEQ ID NO: 11809 - DNA, 25 bp, S. cerevisiae
acatcgtcagcatctcgtgttattg

SEQ ID NO: 11810 - DNA, 25 bp, S. cerevisiae
acatgtgggcattgaagctggaata

SEQ ID NO: 11811 - DNA, 25 bp, S. cerevisiae
acagctggctgctgcggcgaaaaga

SEQ ID NO: 11812 - DNA, 25 bp, S. cerevisiae
acttgcctgctatttggttgctaaa

SEQ ID NO: 11813 - DNA, 25 bp, S. cerevisiae
acttctgctgcgtattattctgcta

SEQ ID NO: 11814 - DNA, 25 bp, S. cerevisiae
acttccagctggtcgtcaagcatta

SEQ ID NO: 11815 - DNA, 25 bp, S. cerevisiae
acattttcaagcgttgtggaggaca

SEQ ID NO: 11816 - DNA, 25 bp, S. cerevisiae
acattattcgcatttgttgtcgtga

SEQ ID NO: 11817 - DNA, 25 bp, S. cerevisiae
acttgtatactgatatggcataggc

SEQ ID NO: 11818 - DNA, 25 bp, S. cerevisiae
acatgaactttcaggaattagccaa

SEQ ID NO: 11819 - DNA, 25 bp, S. cerevisiae
acaggccgttcgaagtagtgaccaa

SEQ ID NO: 11820 - DNA, 25 bp, S. cerevisiae
acttcctagcttattaactgccttc

SEQ ID NO: 11821 - DNA, 25 bp, S. cerevisiae
acatgatagctgtgtatttaccttt

SEQ ID NO: 11822 - DNA, 25 bp, S. cerevisiae
acattacgtcgttccattactatca

SEQ ID NO: 11823 - DNA, 25 bp, S. cerevisiae
acttttgcctattacactactctac

SEQ ID NO: 11824 - DNA, 25 bp, S. cerevisiae
acttcttttcatgtatttccttaat

SEQ ID NO: 11825 - DNA, 25 bp, S. cerevisiae
acttccttcctgatatgtctgactt

SEQ ID NO: 11826 - DNA, 25 bp, S. cerevisiae
acatttttcctgatgatatcgatga

SEQ ID NO: 11827 - DNA, 25 bp, S. cerevisiae
acatggtttcagtatcgtgatcttt

SEQ ID NO: 11828 - DNA, 25 bp, S. cerevisiae
acatggcaaatgtaacttgttttct

SEQ ID NO: 11829 - DNA, 25 bp, S. cerevisiae
acatggacaagtgcgctggatttac

SEQ ID NO: 11830 - DNA, 25 bp, S. cerevisiae
acaggacaagtttatggcattttca

SEQ ID NO: 11831 - DNA, 25 bp, S. cerevisiae
acatgcgattcttttaccgtcttta

SEQ ID NO: 11832 - DNA, 25 bp, S. cerevisiae
acttaattcgtgtctctgttggtat

SEQ ID NO: 11833 - DNA, 25 bp, S. cerevisiae
acattttgatctatccgtagccctt

SEQ ID NO: 11834 - DNA, 25 bp, S. cerevisiae
acaccttcggtggtagtaatgactc

SEQ ID NO: 11835 - DNA, 25 bp, S. cerevisiae
aatccgccgaggtggaagacgtcca

SEQ ID NO: 11836 - DNA, 25 bp, S. cerevisiae
aacggatgccggtggtcaacttgta

SEQ ID NO: 11837 - DNA, 25 bp, S. cerevisiae
cacacggacgtgtacggtaatcttt

SEQ ID NO: 11838 - DNA, 25 bp, S. cerevisiae
acatcaggacgtctcaactaacagt

SEQ ID NO: 11839 - DNA, 25 bp, S. cerevisiae
acattccgcaattgacccttgaaga

SEQ ID NO: 11840 - DNA, 25 bp, S. cerevisiae
acagtcgaggtgtttcgtcatcggt

SEQ ID NO: 11841 - DNA, 25 bp, S. cerevisiae
acatctacttggcatggtgtcctgg

SEQ ID NO: 11842 - DNA, 25 bp, S. cerevisiae
acattagtaatgctggtccctggtc

SEQ ID NO: 11843 - DNA, 25 bp, S. cerevisiae
acattttgggtcgattccgtagtga

SEQ ID NO: 11844 - DNA, 25 bp, S. cerevisiae
acttgattgtggtcgttttgctatt

SEQ ID NO: 11845 - DNA, 25 bp, S. cerevisiae
acacttttgaattcgcgtcgcgtcg

SEQ ID NO: 11846 - DNA, 25 bp, S. cerevisiae
acaggcttagaatcgcagtccatga

SEQ ID NO: 11847 - DNA, 25 bp, S. cerevisiae
acaggcctgcgaattcgacggcgaa

SEQ ID NO: 11848 - DNA, 25 bp, S. cerevisiae
acatgtccacctacttgaagatcta

SEQ ID NO: 11849 - DNA, 25 bp, S. cerevisiae
acatggtcacgatattaatgagctt

SEQ ID NO: 11850 - DNA, 25 bp, S. cerevisiae
acatcattccgaacctgattcacgg

SEQ ID NO: 11851 - DNA, 25 bp, S. cerevisiae
acatcagtgccaattatcagttcct

SEQ ID NO: 11852 - DNA, 25 bp, S. cerevisiae
acatcactgtaaatggcgtcccaga

SEQ ID NO: 11853 - DNA, 25 bp, S. cerevisiae
acatagctcaggaccgtggacgact

SEQ ID NO: 11854 - DNA, 25 bp, S. cerevisiae
acacggcgcccgagaacgctaagaa

SEQ ID NO: 11855 - DNA, 25 bp, S. cerevisiae
acaagatctcgccaaggaaaatttg

SEQ ID NO: 11856 - DNA, 25 bp, S. cerevisiae
acattctcctcagaagtgcggctta

SEQ ID NO: 11857 - DNA, 25 bp, S. cerevisiae
acttctcgttatttctctgagtcag

SEQ ID NO: 11858 - DNA, 25 bp, S. cerevisiae
acattccattgcattggccattttg

SEQ ID NO: 11859 - DNA, 25 bp, S. cerevisiae
acatcctacgccagtcgatttgtga

SEQ ID NO: 11860 - DNA, 25 bp, S. cerevisiae
acatcaatgcaccactttcgagttt

SEQ ID NO: 11861 - DNA, 25 bp, S. cerevisiae
acatccatgggagttgtcgagacct

SEQ ID NO: 11862 - DNA, 25 bp, S. cerevisiae
acatcagacgatccagactttcaaa

SEQ ID NO: 11863 - DNA, 25 bp, S. cerevisiae
acatcaagaccactgcgagcgctaa

SEQ ID NO: 11864 - DNA, 25 bp, S. cerevisiae
acatcaacatcgctctgacgcagaa

SEQ ID NO: 11865 - DNA, 25 bp, S. cerevisiae
acatcaaatgggttcatccgaagat

SEQ ID NO: 11866 - DNA, 25 bp, S. cerevisiae
acatgggatttggtcaccgcgagat

SEQ ID NO: 11867 - DNA, 25 bp, S. cerevisiae
acagggttctgaagaccactctttc

SEQ ID NO: 11868 - DNA, 25 bp, S. cerevisiae
acattggtcctgagatggcccttaa

SEQ ID NO: 11869 - DNA, 25 bp, S. cerevisiae
acttggatgtctatgtacggtctaa

SEQ ID NO: 11870 - DNA, 25 bp, S. cerevisiae
acttggacatgagcgtgagcgtgat

SEQ ID NO: 11871 - DNA, 25 bp, S. cerevisiae
acttggaaagacgtcagcggctgct

SEQ ID NO: 11872 - DNA, 25 bp, S. cerevisiae
acttgcctgttcattgcctgtaaat

SEQ ID NO: 11873 - DNA, 25 bp, S. cerevisiae
cactccttttattacttcggcaatt

SEQ ID NO: 11874 - DNA, 25 bp, S. cerevisiae
acaccattgttatccttgcaggcaa

SEQ ID NO: 11875 - DNA, 25 bp, S. cerevisiae
acatctagctctattggcaccaaca

SEQ ID NO: 11876 - DNA, 25 bp, S. cerevisiae
acttgatccatctgtcgagcgacaa

SEQ ID NO: 11877 - DNA, 25 bp, S. cerevisiae
acatcattgccctttgcggagaaaa

SEQ ID NO: 11878 - DNA, 25 bp, S. cerevisiae
acatatcgctccctacgagaaacaa

SEQ ID NO: 11879 - DNA, 25 bp, S. cerevisiae
acatactgccacacctcagaagaaa

SEQ ID NO: 11880 - DNA, 25 bp, S. cerevisiae
acatactccctttgaatccaaacag

SEQ ID NO: 11881 - DNA, 25 bp, S. cerevisiae
acatattccaagacttactctaccc

SEQ ID NO: 11882 - DNA, 25 bp, S. cerevisiae
acagtgcctctatgattaccaactc

SEQ ID NO: 11883 - DNA, 25 bp, S. cerevisiae
acagtccccagaaaagtcagatgct

SEQ ID NO: 11884 - DNA, 25 bp, S. cerevisiae
acttgttgccaaagaagtctgccaa

SEQ ID NO: 11885 - DNA, 25 bp, S. cerevisiae
acagtttgccaatacaggtgccaat

SEQ ID NO: 11886 - DNA, 25 bp, S. cerevisiae
acatttctgttgttcacgtcggatg

SEQ ID NO: 11887 - DNA, 25 bp, S. cerevisiae
acagactttcaggacacatcgcaga

SEQ ID NO: 11888 - DNA, 25 bp, S. cerevisiae
acagcagcatttcgcacatgttcgc

SEQ ID NO: 11889 - DNA, 25 bp, S. cerevisiae
acatggagagcctagttacagcgaa

SEQ ID NO: 11890 - DNA, 25 bp, S. cerevisiae
acttggctgatgagagaccgcgcgt

SEQ ID NO: 11891 - DNA, 25 bp, S. cerevisiae
acattgccagtgaagagcccagtga

SEQ ID NO: 11892 - DNA, 25 bp, S. cerevisiae
acttgttatggtactcaggctgctg

SEQ ID NO: 11893 - DNA, 25 bp, S. cerevisiae
acattcttcagctgccttgagttat

SEQ ID NO: 11894 - DNA, 25 bp, S. cerevisiae
acattatacgcgttcttagtcctaa

SEQ ID NO: 11895 - DNA, 25 bp, S. cerevisiae
acattttactgattggactacctgg

SEQ ID NO: 11896 - DNA, 25 bp, S. cerevisiae
acatgcatcttattcaatggacaag

SEQ ID NO: 11897 - DNA, 25 bp, S. cerevisiae
acagcagcgaacttgtgtccaaact

SEQ ID NO: 11898 - DNA, 25 bp, S. cerevisiae
acagcagcccatttatgtccaacaa

SEQ ID NO: 11899 - DNA, 25 bp, S. cerevisiae
acagatcctcatcgtgttgaagcag

SEQ ID NO: 11900 - DNA, 25 bp, S. cerevisiae
acagatgctccgttgtttagaatcg

SEQ ID NO: 11901 - DNA, 25 bp, S. cerevisiae
acaggcccttatgcaattgtacgcg

SEQ ID NO: 11902 - DNA, 25 bp, S. cerevisiae
acatggagtctgtcttatcaagaga

SEQ ID NO: 11903 - DNA, 25 bp, S. cerevisiae
acatggctgtattctgttcaaagat

SEQ ID NO: 11904 - DNA, 25 bp, S. cerevisiae
gacgtttatttgctccagaatccac

SEQ ID NO: 11905 - DNA, 25 bp, S. cerevisiae
acagattttttggtactaaagcaat

SEQ ID NO: 11906 - DNA, 25 bp, S. cerevisiae
acatctctttttacaggcccatatt

SEQ ID NO: 11907 - DNA, 25 bp, S. cerevisiae
acatcggcattgctggtaccatgtt

SEQ ID NO: 11908 - DNA, 25 bp, S. cerevisiae
acactcgttgggttcgtttctctga

SEQ ID NO: 11909 - DNA, 25 bp, S. cerevisiae
acagccgtttcgcaagacttcaaga

SEQ ID NO: 11910 - DNA, 25 bp, S. cerevisiae
acaccgttgatcagactacgtccaa

SEQ ID NO: 11911 - DNA, 25 bp, S. cerevisiae
acattcattgcctgggatttgccta

SEQ ID NO: 11912 - DNA, 25 bp, S. cerevisiae
acatattcgaggttgactttcctga

SEQ ID NO: 11913 - DNA, 25 bp, S. cerevisiae
acatgtcatcgcagtggacgtttta

SEQ ID NO: 11914 - DNA, 25 bp, S. cerevisiae
acttgactgaagctgatgcgcgttt

SEQ ID NO: 11915 - DNA, 25 bp, S. cerevisiae
acattgttagcatatttcctgataa

SEQ ID NO: 11916 - DNA, 25 bp, S. cerevisiae
acattattacaatccgcttccaagg

SEQ ID NO: 11917 - DNA, 25 bp, S. cerevisiae
acagtgtaataagcggtgtcccaga

SEQ ID NO: 11918 - DNA, 25 bp, S. cerevisiae
acagattcgatttcctggttcacca

SEQ ID NO: 11919 - DNA, 25 bp, S. cerevisiae
acatttcagtttacttcttttcatg

SEQ ID NO: 11920 - DNA, 25 bp, S. cerevisiae
acattgtcacattttcaccctttat

SEQ ID NO: 11921 - DNA, 25 bp, S. cerevisiae
acttgaggcctgactttgttgatag

SEQ ID NO: 11922 - DNA, 25 bp, S. cerevisiae
acattgttccttccttgttgattag

SEQ ID NO: 11923 - DNA, 25 bp, S. cerevisiae
acattctgcttctttttggtattat

SEQ ID NO: 11924 - DNA, 25 bp, S. cerevisiae
acatgtggcattctgcccatttttt

SEQ ID NO: 11925 - DNA, 25 bp, S. cerevisiae
acatagtcacgttaccattttcacc

SEQ ID NO: 11926 - DNA, 25 bp, S. cerevisiae
acatagagcccttagcaattgctaa

SEQ ID NO: 11927 - DNA, 25 bp, S. cerevisiae
acattccctgcactgaatttgtgaa

SEQ ID NO: 11928 - DNA, 25 bp, S. cerevisiae
acattccttcggtcatgtattctca

SEQ ID NO: 11929 - DNA, 25 bp, S. cerevisiae
acataccctatgtcgattattcaga

SEQ ID NO: 11930 - DNA, 25 bp, S. cerevisiae
acatcatcgtgcaatacgcttttga

SEQ ID NO: 11931 - DNA, 25 bp, S. cerevisiae
acatgaccgtgctaagcgttactat

SEQ ID NO: 11932 - DNA, 25 bp, S. cerevisiae
acatactgccgacactgttgactag

SEQ ID NO: 11933 - DNA, 25 bp, S. cerevisiae
acagaccccaaattgctgatcctaa

SEQ ID NO: 11934 - DNA, 25 bp, S. cerevisiae
acaggtactgtgcatggtttgaaac

SEQ ID NO: 11935 - DNA, 25 bp, S. cerevisiae
acatggctacttgtctgttatacag

SEQ ID NO: 11936 - DNA, 25 bp, S. cerevisiae
acatccaaattggtctcctttcgaa

SEQ ID NO: 11937 - DNA, 25 bp, S. cerevisiae
acatcgacgatttgtccctgggcga

SEQ ID NO: 11938 - DNA, 25 bp, S. cerevisiae
acaccaagcaatttccctggattct

SEQ ID NO: 11939 - DNA, 25 bp, S. cerevisiae
aagccaacaactacgacctatgtcg

SEQ ID NO: 11940 - DNA, 25 bp, S. cerevisiae
acaccacacacccacacactctctt

SEQ ID NO: 11941 - DNA, 25 bp, S. cerevisiae
acagtcatcatcaagcggttctgag

SEQ ID NO: 11942 - DNA, 25 bp, S. cerevisiae
acagctatcagtggtgcctgtgcca

SEQ ID NO: 11943 - DNA, 25 bp, S. cerevisiae
acatttatctgttttagtcaaaaca

SEQ ID NO: 11944 - DNA, 25 bp, S. cerevisiae
acatttacttgctcgatgtgcgata

SEQ ID NO: 11945 - DNA, 25 bp, S. cerevisiae
acagcaaccttcatcgatgtcttca

SEQ ID NO: 11946 - DNA, 25 bp, S. cerevisiae
acatacgccatgactgtgttcagtt

SEQ ID NO: 11947 - DNA, 25 bp, S. cerevisiae
acatgactctttctgattgcgtcct

SEQ ID NO: 11948 - DNA, 25 bp, S. cerevisiae
acatgtatttgttattgctgggcca

SEQ ID NO: 11949 - DNA, 25 bp, S. cerevisiae
acatgacattttttggcgaggccct

SEQ ID NO: 11950 - DNA, 25 bp, S. cerevisiae
acaggctcaagttcaggctcaggct

SEQ ID NO: 11951 - DNA, 25 bp, S. cerevisiae
acaggatgagatatttggcccggtt

SEQ ID NO: 11952 - DNA, 25 bp, S. cerevisiae
acaggtgagtggtttcctccaggat

SEQ ID NO: 11953 - DNA, 25 bp, S. cerevisiae
acagacgatgtcattatcactgata

SEQ ID NO: 11954 - DNA, 25 bp, S. cerevisiae
acagggatgctgttgatctactcat

SEQ ID NO: 11955 - DNA, 25 bp, S. cerevisiae
acaccgatgatctttctgatgccat

SEQ ID NO: 11956 - DNA, 25 bp, S. cerevisiae
acattgcgggcttctggtgacgata

SEQ ID NO: 11957 - DNA, 25 bp, S. cerevisiae
acatgtcagggtttgtatgcccgca

SEQ ID NO: 11958 - DNA, 25 bp, S. cerevisiae
acatctactgaatcgtctgactcaa

SEQ ID NO: 11959 - DNA, 25 bp, S. cerevisiae
acattttatacttggctgtgctcgg

SEQ ID NO: 11960 - DNA, 25 bp, S. cerevisiae
acagagtgttgcaattttggacggc

SEQ ID NO: 11961 - DNA, 25 bp, S. cerevisiae
acaggtcttctcttgtttatctggg

SEQ ID NO: 11962 - DNA, 25 bp, S. cerevisiae
acattgagtttccttctatgaagac

SEQ ID NO: 11963 - DNA, 25 bp, S. cerevisiae
acatggtttaccgatctgtcgcact

SEQ ID NO: 11964 - DNA, 25 bp, S. cerevisiae
acatgtattgctcccgtagatttca

SEQ ID NO: 11965 - DNA, 25 bp, S. cerevisiae
acatctctatgctccagtttttgac

SEQ ID NO: 11966 - DNA, 25 bp, S. cerevisiae
acatcttgatgtgcagggtatatta

SEQ ID NO: 11967 - DNA, 25 bp, S. cerevisiae
acacttttccacggatattccaatt

SEQ ID NO: 11968 - DNA, 25 bp, S. cerevisiae
acacgtttgcgttggtgtagccact

SEQ ID NO: 11969 - DNA, 25 bp, S. cerevisiae
acatatgaaaagtcgcccctgtcgg

SEQ ID NO: 11970 - DNA, 25 bp, S. cerevisiae
acatacaaatacgtgtcccgctcgg

SEQ ID NO: 11971 - DNA, 25 bp, S. cerevisiae
acatacatcttaggtgtcggcgata

SEQ ID NO: 11972 - DNA, 25 bp, S. cerevisiae
acatcattgtcttcttctattcttg

SEQ ID NO: 11973 - DNA, 25 bp, S. cerevisiae
acatcaccactgttttttctcatgc

SEQ ID NO: 11974 - DNA, 25 bp, S. cerevisiae
acatcctagggttttgtcaagcaat

SEQ ID NO: 11975 - DNA, 25 bp, S. cerevisiae
acaccgggccatgttgatcctgaaa

SEQ ID NO: 11976 - DNA, 25 bp, S. cerevisiae
acaacgcggtacattctttcaggaa

SEQ ID NO: 11977 - DNA, 25 bp, S. cerevisiae
acaccgccgtaacagatcttttgaa

SEQ ID NO: 11978 - DNA, 25 bp, S. cerevisiae
acacttagtgcgtcagatttagatc

SEQ ID NO: 11979 - DNA, 25 bp, S. cerevisiae
acatcgatcagtctcattccttgaa

SEQ ID NO: 11980 - DNA, 25 bp, S. cerevisiae
acactaattgctactttggccgaat

SEQ ID NO: 11981 - DNA, 25 bp, S. cerevisiae
acatacattactgttgggccgaaac

SEQ ID NO: 11982 - DNA, 25 bp, S. cerevisiae
acatcagcaaacatttctaccgaaa

SEQ ID NO: 11983 - DNA, 25 bp, S. cerevisiae
acatcgacaggcctgattctacagc

SEQ ID NO: 11984 - DNA, 25 bp, S. cerevisiae
acacagacgatgctcattcattacg

SEQ ID NO: 11985 - DNA, 25 bp, S. cerevisiae
acagctgacgtgaatccgattgaaa

SEQ ID NO: 11986 - DNA, 25 bp, S. cerevisiae
acagcagcaagttccgatggctaca

SEQ ID NO: 11987 - DNA, 25 bp, S. cerevisiae
acatgcacatttttccagactctga

SEQ ID NO: 11988 - DNA, 25 bp, S. cerevisiae
acatgcttttcatctcacacattgg

SEQ ID NO: 11989 - DNA, 25 bp, S. cerevisiae
acagttctatgtcagtttccccaaa

SEQ ID NO: 11990 - DNA, 25 bp, S. cerevisiae
aaatttccctttctatccacaacag

SEQ ID NO: 11991 - DNA, 25 bp, S. cerevisiae
aacttggcccttcaatacgctaaag

SEQ ID NO: 11992 - DNA, 25 bp, S. cerevisiae
caaaaagtcccgtgaagcgctaaag

SEQ ID NO: 11993 - DNA, 25 bp, S. cerevisiae
acaaaagtcctctctaagggaaatg

SEQ ID NO: 11994 - DNA, 25 bp, S. cerevisiae
aaataaagacgtctactcccactgt

SEQ ID NO: 11995 - DNA, 25 bp, S. cerevisiae
aaattaaagttcatatctaccgtat

SEQ ID NO: 11996 - DNA, 25 bp, S. cerevisiae
aaaaaagcgttcacctactgcctat

SEQ ID NO: 11997 - DNA, 25 bp, S. cerevisiae
acagaaacgcccaattcgccggtag

SEQ ID NO: 11998 - DNA, 25 bp, S. cerevisiae
acagatggactgcacttttccggaa

SEQ ID NO: 11999 - DNA, 25 bp, S. cerevisiae
acatagactatctcttttctcggca

SEQ ID NO: 12000 - DNA, 25 bp, S. cerevisiae
acaaacgattccatttctgttgcgg

SEQ ID NO: 12001 - DNA, 25 bp, S. cerevisiae
acaggtctcttaccaggacgggttg

SEQ ID NO: 12002 - DNA, 25 bp, S. cerevisiae
acagggcttatccaacgcctaggat

SEQ ID NO: 12003 - DNA, 25 bp, S. cerevisiae
acaggacttcctcaacatcgacgaa

SEQ ID NO: 12004 - DNA, 25 bp, S. cerevisiae
aagggctagccgtaattcgtcgacg

SEQ ID NO: 12005 - DNA, 25 bp, S. cerevisiae
acagggcaagcgcagaattttcaat

SEQ ID NO: 12006 - DNA, 25 bp, S. cerevisiae
acacgccaagagaaagactgttact

SEQ ID NO: 12007 - DNA, 25 bp, S. cerevisiae
acagctcgatgataattcccagaac

SEQ ID NO: 12008 - DNA, 25 bp, S. cerevisiae
acagcttcatgacacttctgcagaa

SEQ ID NO: 12009 - DNA, 25 bp, S. cerevisiae
acagctgcattacatgttgctacaa

SEQ ID NO: 12010 - DNA, 25 bp, S. cerevisiae
acagtgtccatcgagattgttccag

SEQ ID NO: 12011 - DNA, 25 bp, S. cerevisiae
acatgagtgtggtacttctattgat

SEQ ID NO: 12012 - DNA, 25 bp, S. cerevisiae
acatagtgggatcctgcgggttttt

SEQ ID NO: 12013 - DNA, 25 bp, S. cerevisiae
acatttgggtttctggtgttctctc

SEQ ID NO: 12014 - DNA, 25 bp, S. cerevisiae
acagtttggcctaacggttgtcttg

SEQ ID NO: 12015 - DNA, 25 bp, S. cerevisiae
acacgtttggtttgaactctgttca

SEQ ID NO: 12016 - DNA, 25 bp, S. cerevisiae
acagctttctcgaggaaacgttcaa

SEQ ID NO: 12017 - DNA, 25 bp, S. cerevisiae
acacaatgtccaagcaggcgtacga

SEQ ID NO: 12018 - DNA, 25 bp, S. cerevisiae
acatcaatatccaaacttccctagt

SEQ ID NO: 12019 - DNA, 25 bp, S. cerevisiae
acatatatatacaccacacccacac

SEQ ID NO: 12020 - DNA, 25 bp, S. cerevisiae
acatatatatacccacacactctct

SEQ ID NO: 12021 - DNA, 25 bp, S. cerevisiae
acatatttatcaccaccactttgac

SEQ ID NO: 12022 - DNA, 25 bp, S. cerevisiae
acatcattttaacagctcttctcca

SEQ ID NO: 12023 - DNA, 25 bp, S. cerevisiae
acatggtgaccgcacacaggctgaa

SEQ ID NO: 12024 - DNA, 25 bp, S. cerevisiae
acaggtaatccatttcaggctcaaa

SEQ ID NO: 12025 - DNA, 25 bp, S. cerevisiae
acagctgggtatggactttcgcggc

SEQ ID NO: 12026 - DNA, 25 bp, S. cerevisiae
acagtactggaatccttgggcaggt

SEQ ID NO: 12027 - DNA, 25 bp, S. cerevisiae
acatggcgacagttacagctttaaa

SEQ ID NO: 12028 - DNA, 25 bp, S. cerevisiae
acatggcgtatcttttaccttgctc

SEQ ID NO: 12029 - DNA, 25 bp, S. cerevisiae
acatgggtatttttcctcgttgaga

SEQ ID NO: 12030 - DNA, 25 bp, S. cerevisiae
acatgtcgtcattttgtctcggtta

SEQ ID NO: 12031 - DNA, 25 bp, S. cerevisiae
acatgtcacatttgtttgccggaaa

SEQ ID NO: 12032 - DNA, 25 bp, S. cerevisiae
acagcggcttagtgatattcgataa

SEQ ID NO: 12033 - DNA, 25 bp, S. cerevisiae
acagcctgcccgctttgattgaagg

SEQ ID NO: 12034 - DNA, 25 bp, S. cerevisiae
acatggtccgccttatatttgattg

SEQ ID NO: 12035 - DNA, 25 bp, S. cerevisiae
acaggatcacctttacattagcagt

SEQ ID NO: 12036 - DNA, 25 bp, S. cerevisiae
acaggtacctgcacaatctagttat

SEQ ID NO: 12037 - DNA, 25 bp, S. cerevisiae
acaggtgtccttccatcagtgcgtc

SEQ ID NO: 12038 - DNA, 25 bp, S. cerevisiae
acacttttaactccaatcgacctat

SEQ ID NO: 12039 - DNA, 25 bp, S. cerevisiae
acactactttaaacactggcacctc

SEQ ID NO: 12040 - DNA, 25 bp, S. cerevisiae
acagtacttagcttctatgcaacag

SEQ ID NO: 12041 - DNA, 25 bp, S. cerevisiae
aagctgacgtcactgtcttcaaggc

SEQ ID NO: 12042 - DNA, 25 bp, S. cerevisiae
aagctggcagtacccctaagtttag

SEQ ID NO: 12043 - DNA, 25 bp, S. cerevisiae
acagaatgtgtaccccgattttaag

SEQ ID NO: 12044 - DNA, 25 bp, S. cerevisiae
acaaacttgacgtcgattgtccctt

SEQ ID NO: 12045 - DNA, 25 bp, S. cerevisiae
aaatactctgaacggatcttccacg

SEQ ID NO: 12046 - DNA, 25 bp, S. cerevisiae
acaacggcgagcttggtgtcattat

SEQ ID NO: 12047 - DNA, 25 bp, S. cerevisiae
acagatgccgaagcgcgtgtgatta

SEQ ID NO: 12048 - DNA, 25 bp, S. cerevisiae
acagcattgctttcacatcggagat

SEQ ID NO: 12049 - DNA, 25 bp, S. cerevisiae
acatcgtcttcttggtctttagcca

SEQ ID NO: 12050 - DNA, 25 bp, S. cerevisiae
acatggcatattggaggtttgtacc

SEQ ID NO: 12051 - DNA, 25 bp, S. cerevisiae
acaggtatgcttccttttactttag

SEQ ID NO: 12052 - DNA, 25 bp, S. cerevisiae
acagggctgctttgattggttcttt

SEQ ID NO: 12053 - DNA, 25 bp, S. cerevisiae
acagggtcctgtatggcttcattta

SEQ ID NO: 12054 - DNA, 25 bp, S. cerevisiae
acagggtcccagatgtctacttata

SEQ ID NO: 12055 - DNA, 25 bp, S. cerevisiae
acacggttcaccatctatatttcaa

SEQ ID NO: 12056 - DNA, 25 bp, S. cerevisiae
acagtggttcctgtgtcattaccaa

SEQ ID NO: 12057 - DNA, 25 bp, S. cerevisiae
acatgggtaccaactcgaataacaa

SEQ ID NO: 12058 - DNA, 25 bp, S. cerevisiae
acaggatgctacaattgttgaatta

SEQ ID NO: 12059 - DNA, 25 bp, S. cerevisiae
acatgctatgccaaatctgtcgata

SEQ ID NO: 12060 - DNA, 25 bp, S. cerevisiae
acaccgcatgttgacgactacgaca

SEQ ID NO: 12061 - DNA, 25 bp, S. cerevisiae
acatccctactaacagtgcattcga

SEQ ID NO: 12062 - DNA, 25 bp, S. cerevisiae
acactaggtatttcgcaagctcttt

SEQ ID NO: 12063 - DNA, 25 bp, S. cerevisiae
acagcggcagctaaactatacttac

SEQ ID NO: 12064 - DNA, 25 bp, S. cerevisiae
acaggcagcggatattctactttat

SEQ ID NO: 12065 - DNA, 25 bp, S. cerevisiae
acatgaccggattttgtcctttagg

SEQ ID NO: 12066 - DNA, 25 bp, S. cerevisiae
acatccgggatcttggtgccttgct

SEQ ID NO: 12067 - DNA, 25 bp, S. cerevisiae
acaccgagcggctttgctgcaagga

SEQ ID NO: 12068 - DNA, 25 bp, S. cerevisiae
acatcggcgctgctttctcaagaga

SEQ ID NO: 12069 - DNA, 25 bp, S. cerevisiae
acatcgcactggattcttcacaggg

SEQ ID NO: 12070 - DNA, 25 bp, S. cerevisiae
acagagcctggttctatcacagcga

SEQ ID NO: 12071 - DNA, 25 bp, S. cerevisiae
acagagcaaagtttatcgagcagca

SEQ ID NO: 12072 - DNA, 25 bp, S. cerevisiae
acagttcatataggtcccgacggca

SEQ ID NO: 12073 - DNA, 25 bp, S. cerevisiae
acagtacagatgtcgactcctccgg

SEQ ID NO: 12074 - DNA, 25 bp, S. cerevisiae
acagatacgacctttcctctatggt

SEQ ID NO: 12075 - DNA, 25 bp, S. cerevisiae
acagaacttccggtccattaggact

SEQ ID NO: 12076 - DNA, 25 bp, S. cerevisiae
acagagactctcttggtgctttggc

SEQ ID NO: 12077 - DNA, 25 bp, S. cerevisiae
acagaagccggtatgtttgccatta

SEQ ID NO: 12078 - DNA, 25 bp, S. cerevisiae
acaccagtttgaacttcatagcccc

SEQ ID NO: 12079 - DNA, 25 bp, S. cerevisiae
acactcatgggtgatgaagcttcta

SEQ ID NO: 12080 - DNA, 25 bp, S. cerevisiae
acactcaatttctttggattccaaa

SEQ ID NO: 12081 - DNA, 25 bp, S. cerevisiae
acagctttttcttgtagattggcaa

SEQ ID NO: 12082 - DNA, 25 bp, S. cerevisiae
acagaatttctttccaattgtctaa

SEQ ID NO: 12083 - DNA, 25 bp, S. cerevisiae
acaggtgttgctttccaattgttca

SEQ ID NO: 12084 - DNA, 25 bp, S. cerevisiae
acatggtgtcgtttctaagtatttt

SEQ ID NO: 12085 - DNA, 25 bp, S. cerevisiae
acactgccttgtttctaattgctag

SEQ ID NO: 12086 - DNA, 25 bp, S. cerevisiae
acagcgcccttgttcaaagtctgaa

SEQ ID NO: 12087 - DNA, 25 bp, S. cerevisiae
acacacgactctttaaaggcctcca

SEQ ID NO: 12088 - DNA, 25 bp, S. cerevisiae
acagccgttctctcaaaaattcgca

SEQ ID NO: 12089 - DNA, 25 bp, S. cerevisiae
acactggtttggtcagaaagtacga

SEQ ID NO: 12090 - DNA, 25 bp, S. cerevisiae
aacttgatttctggatacggaggta

SEQ ID NO: 12091 - DNA, 25 bp, S. cerevisiae
aactctccactacatacagttggtt

SEQ ID NO: 12092 - DNA, 25 bp, S. cerevisiae
acatctctccactacgcgaagaagg

SEQ ID NO: 12093 - DNA, 25 bp, S. cerevisiae
acatcgtgccattacccataaggga

SEQ ID NO: 12094 - DNA, 25 bp, S. cerevisiae
acatcgtctctaccatccaaaagaa

SEQ ID NO: 12095 - DNA, 25 bp, S. cerevisiae
acagccatgtcttgtggtttcagag

SEQ ID NO: 12096 - DNA, 25 bp, S. cerevisiae
acagactgttggttgctttcggtaa

SEQ ID NO: 12097 - DNA, 25 bp, S. cerevisiae
acagtggttctgcaggtacggataa

SEQ ID NO: 12098 - DNA, 25 bp, S. cerevisiae
aaaaatttttcataccaatctatag

SEQ ID NO: 12099 - DNA, 25 bp, S. cerevisiae
aagctaaagattgaccccgacacca

SEQ ID NO: 12100 - DNA, 25 bp, S. cerevisiae
acaaactacgtttatcccagacaca

SEQ ID NO: 12101 - DNA, 25 bp, S. cerevisiae
acagaactattatccacctcaacag

SEQ ID NO: 12102 - DNA, 25 bp, S. cerevisiae
acaggagccactttccacattaagg

SEQ ID NO: 12103 - DNA, 25 bp, S. cerevisiae
acagtcagcggttgtccaattacga

SEQ ID NO: 12104 - DNA, 25 bp, S. cerevisiae
acagccgcgggtacagccattaatg

SEQ ID NO: 12105 - DNA, 25 bp, S. cerevisiae
acagaactggttacgctctcattgg

SEQ ID NO: 12106 - DNA, 25 bp, S. cerevisiae
acagtactgtttgcacccattgatg

SEQ ID NO: 12107 - DNA, 25 bp, S. cerevisiae
acacgatttgagagcccgtttgcag

SEQ ID NO: 12108 - DNA, 25 bp, S. cerevisiae
acagttttgagtacaacgtccagag

SEQ ID NO: 12109 - DNA, 25 bp, S. cerevisiae
acaggtgagtgtttacaggcttaca

SEQ ID NO: 12110 - DNA, 25 bp, S. cerevisiae
acaggttttctcaaatggcgtggca

SEQ ID NO: 12111 - DNA, 25 bp, S. cerevisiae
acagtacctgagacttattgagcta

SEQ ID NO: 12112 - DNA, 25 bp, S. cerevisiae
acaagtccccgtaaatggcgagtat

SEQ ID NO: 12113 - DNA, 25 bp, S. cerevisiae
acaaggagacccacggcagtgcaaa

SEQ ID NO: 12114 - DNA, 25 bp, S. cerevisiae
acacccacacccacacacaccacac

SEQ ID NO: 12115 - DNA, 25 bp, S. cerevisiae
acacaccacacccacaccacaccca

SEQ ID NO: 12116 - DNA, 25 bp, S. cerevisiae
acacaatcaccagaagcagcagcag

SEQ ID NO: 12117 - DNA, 25 bp, S. cerevisiae
acatgttatcacagcaagcagacgc

SEQ ID NO: 12118 - DNA, 25 bp, S. cerevisiae
acatgtatgtcccagcagtgaaagc

SEQ ID NO: 12119 - DNA, 25 bp, S. cerevisiae
acagtatgatcctagcttgagtgag

SEQ ID NO: 12120 - DNA, 25 bp, S. cerevisiae
acaagatgtcaattctcgttcgttg

SEQ ID NO: 12121 - DNA, 25 bp, S. cerevisiae
acaggactattcttaccggcttatg

SEQ ID NO: 12122 - DNA, 25 bp, S. cerevisiae
acatgattcatggttatttcggtaa

SEQ ID NO: 12123 - DNA, 25 bp, S. cerevisiae
acatggttggctgttcctggtatat

SEQ ID NO: 12124 - DNA, 25 bp, S. cerevisiae
acatgctctggtggtgtttgctcga

SEQ ID NO: 12125 - DNA, 25 bp, S. cerevisiae
acatgccacatcagttattccgaac

SEQ ID NO: 12126 - DNA, 25 bp, S. cerevisiae
acatgcccgaggatgatagcgacga

SEQ ID NO: 12127 - DNA, 25 bp, S. cerevisiae
acaccactattgctgaggcggctga

SEQ ID NO: 12128 - DNA, 25 bp, S. cerevisiae
acagtgcaaaatctagcccctaact

SEQ ID NO: 12129 - DNA, 25 bp, S. cerevisiae
aaagcaaaattcacccactacctat

SEQ ID NO: 12130 - DNA, 25 bp, S. cerevisiae
acacagcgtaatgtaaccctttact

SEQ ID NO: 12131 - DNA, 25 bp, S. cerevisiae
acaccagaaatcatcacaccgtttg

SEQ ID NO: 12132 - DNA, 25 bp, S. cerevisiae
acaggatatccttccatccagggaa

SEQ ID NO: 12133 - DNA, 25 bp, S. cerevisiae
acaagatcacagtctgatgcgcata

SEQ ID NO: 12134 - DNA, 25 bp, S. cerevisiae
acaacagcaggccttggagcaacaa

SEQ ID NO: 12135 - DNA, 25 bp, S. cerevisiae
acacggctggctctgatggcataat

SEQ ID NO: 12136 - DNA, 25 bp, S. cerevisiae
acacagactcggtagatggattgca

SEQ ID NO: 12137 - DNA, 25 bp, S. cerevisiae
acagcttcttgggagcactattgaa

SEQ ID NO: 12138 - DNA, 25 bp, S. cerevisiae
acatgttttgtgcatgctctttagc

SEQ ID NO: 12139 - DNA, 25 bp, S. cerevisiae
acagtacgtgtcttgtatattcatc

SEQ ID NO: 12140 - DNA, 25 bp, S. cerevisiae
aaatacaaccttctggaacccatca

SEQ ID NO: 12141 - DNA, 25 bp, S. cerevisiae
aaatgagcaaccacactgggacctc

SEQ ID NO: 12142 - DNA, 25 bp, S. cerevisiae
caaacgaactaaaagccagactact

SEQ ID NO: 12143 - DNA, 25 bp, S. cerevisiae
cagcaactgaactaaaaactaataa

SEQ ID NO: 12144 - DNA, 25 bp, S. cerevisiae
acaacgccgatccagagaccaaaaa

SEQ ID NO: 12145 - DNA, 25 bp, S. cerevisiae
acaacccagacgaaaacaagactag

SEQ ID NO: 12146 - DNA, 25 bp, S. cerevisiae
acaacccagatgaaaacaaaaccag

SEQ ID NO: 12147 - DNA, 25 bp, S. cerevisiae
aacatcgccaaagaaccctatcaag

SEQ ID NO: 12148 - DNA, 25 bp, S. cerevisiae
aaatggccggatctatcgaaccaaa

SEQ ID NO: 12149 - DNA, 25 bp, S. cerevisiae
acacatgggccaatggtgaaacaat

SEQ ID NO: 12150 - DNA, 25 bp, S. cerevisiae
acagctgggccattctcatgaagaa

SEQ ID NO: 12151 - DNA, 25 bp, S. cerevisiae
acatgtggagccatctctcttaaat

SEQ ID NO: 12152 - DNA, 25 bp, S. cerevisiae
acagtcgctgctattatagtagcca

SEQ ID NO: 12153 - DNA, 25 bp, S. cerevisiae
acagtggagctgctggacgtatcca

SEQ ID NO: 12154 - DNA, 25 bp, S. cerevisiae
acagtgctcaagaacctttctcaga

SEQ ID NO: 12155 - DNA, 25 bp, S. cerevisiae
acaggcttgtgttcttgttctacaa

SEQ ID NO: 12156 - DNA, 25 bp, S. cerevisiae
acacgctgttattttggatcaagaa

SEQ ID NO: 12157 - DNA, 25 bp, S. cerevisiae
acagccgccgcaactattggaagaa

SEQ ID NO: 12158 - DNA, 25 bp, S. cerevisiae
acagatagacgtcctgaccgcaaat

SEQ ID NO: 12159 - DNA, 25 bp, S. cerevisiae
aacttcgttcgggatcactttggag

SEQ ID NO: 12160 - DNA, 25 bp, S. cerevisiae
aagtctgccttagcaaacttggagg

SEQ ID NO: 12161 - DNA, 25 bp, S. cerevisiae
acagccgccttaaccgaatttgagg

SEQ ID NO: 12162 - DNA, 25 bp, S. cerevisiae
acagcgcagcacgtattccgaaact

SEQ ID NO: 12163 - DNA, 25 bp, S. cerevisiae
acaggaacttgtttgacgcaccaat

SEQ ID NO: 12164 - DNA, 25 bp, S. cerevisiae
acaggttcttctttaatgcctcaga

SEQ ID NO: 12165 - DNA, 25 bp, S. cerevisiae
acaggtttttgcatcacaggtcaga

SEQ ID NO: 12166 - DNA, 25 bp, S. cerevisiae
acaggaagctttatcacagagtggg

SEQ ID NO: 12167 - DNA, 25 bp, S. cerevisiae
acagaaggtttgatctccgcggcaa

SEQ ID NO: 12168 - DNA, 25 bp, S. cerevisiae
acaacctcattaccattttttccag

SEQ ID NO: 12169 - DNA, 25 bp, S. cerevisiae
acaaaccgctagtgttcttaacaga

SEQ ID NO: 12170 - DNA, 25 bp, S. cerevisiae
acaaacccgaggattctctgctaaa

SEQ ID NO: 12171 - DNA, 25 bp, S. cerevisiae
aaatacccaatcatttccctggaag

SEQ ID NO: 12172 - DNA, 25 bp, S. cerevisiae
aaaatcgcctactgttaccgccaag

SEQ ID NO: 12173 - DNA, 25 bp, S. cerevisiae
aagcatttgaagcacgaaaacgcca

SEQ ID NO: 12174 - DNA, 25 bp, S. cerevisiae
aacagtcgacatcaaaacagacaac

SEQ ID NO: 12175 - DNA, 25 bp, S. cerevisiae
acacatgccaactcaaaaccacaat

SEQ ID NO: 12176 - DNA, 25 bp, S. cerevisiae
acacgcccatggagacgaggtcgtc

SEQ ID NO: 12177 - DNA, 25 bp, S. cerevisiae
acactccaatggctacgcaaactgt

SEQ ID NO: 12178 - DNA, 25 bp, S. cerevisiae
acactgccactgtcgctaagaagta

SEQ ID NO: 12179 - DNA, 25 bp, S. cerevisiae
acacatccctgaatgtccaacattt

SEQ ID NO: 12180 - DNA, 25 bp, S. cerevisiae
acacccgtgatttcaaatatgcatg

SEQ ID NO: 12181 - DNA, 25 bp, S. cerevisiae
acagccgctggtcctgcaaatataa

SEQ ID NO: 12182 - DNA, 25 bp, S. cerevisiae
acagagactgccttgatgaacttaa

SEQ ID NO: 12183 - DNA, 25 bp, S. cerevisiae
acagatactctgttggcaccttatt

SEQ ID NO: 12184 - DNA, 25 bp, S. cerevisiae
acactttcatgacccttcgaatgtt

SEQ ID NO: 12185 - DNA, 25 bp, S. cerevisiae
acacgcctgcgagtaaatcgtttca

SEQ ID NO: 12186 - DNA, 25 bp, S. cerevisiae
acaggctcagtcgtttccgttgata

SEQ ID NO: 12187 - DNA, 25 bp, S. cerevisiae
acaggccggcttgatctcgaataat

SEQ ID NO: 12188 - DNA, 25 bp, S. cerevisiae
acagctatcactagtactctttcgc

SEQ ID NO: 12189 - DNA, 25 bp, S. cerevisiae
acagttgcactcctaatgattctcc

SEQ ID NO: 12190 - DNA, 25 bp, S. cerevisiae
acaggtcttctctttgtcacgtaag

SEQ ID NO: 12191 - DNA, 25 bp, S. cerevisiae
acagggcaattctttgttcaaacag

SEQ ID NO: 12192 - DNA, 25 bp, S. cerevisiae
acagtcctcaacttccttcaaaaga

SEQ ID NO: 12193 - DNA, 25 bp, S. cerevisiae
acaactgtaacgaaactggccatat

SEQ ID NO: 12194 - DNA, 25 bp, S. cerevisiae
acaactactaccgaactgtggactg

SEQ ID NO: 12195 - DNA, 25 bp, S. cerevisiae
acagcggtaaagtttctatgagcaa

SEQ ID NO: 12196 - DNA, 25 bp, S. cerevisiae
acaggcattaccatttgctcatcac

SEQ ID NO: 12197 - DNA, 25 bp, S. cerevisiae
aaactatcagccaggtgtaccggtt

SEQ ID NO: 12198 - DNA, 25 bp, S. cerevisiae
aaacaagtgtgtgcgtgtaccggaa

SEQ ID NO: 12199 - DNA, 25 bp, S. cerevisiae
acagggattcgttgacatggtttat

SEQ ID NO: 12200 - DNA, 25 bp, S. cerevisiae
acagggatcgcggtgcaatgtgcca

SEQ ID NO: 12201 - DNA, 25 bp, S. cerevisiae
acaggtgtcaccgtattggccaaga

SEQ ID NO: 12202 - DNA, 25 bp, S. cerevisiae
acagggcccttgcattggcatttac

SEQ ID NO: 12203 - DNA, 25 bp, S. cerevisiae
acactggttattctcttttctgggc

SEQ ID NO: 12204 - DNA, 25 bp, S. cerevisiae
acagtggattgattgccttttcata

SEQ ID NO: 12205 - DNA, 25 bp, S. cerevisiae
acagggatttgtgcttttctaaaga

SEQ ID NO: 12206 - DNA, 25 bp, S. cerevisiae
acaggtgattacgattttttacata

SEQ ID NO: 12207 - DNA, 25 bp, S. cerevisiae
acaagagaccatcaaccttctacta

SEQ ID NO: 12208 - DNA, 25 bp, S. cerevisiae
acaccatcgcagcaacgagagttga

SEQ ID NO: 12209 - DNA, 25 bp, S. cerevisiae
acaagccatccggattggtctggag

SEQ ID NO: 12210 - DNA, 25 bp, S. cerevisiae
acaaagcatgcgagaggccctgggt

SEQ ID NO: 12211 - DNA, 25 bp, S. cerevisiae
acagaagcaacaagagtcctctcag

SEQ ID NO: 12212 - DNA, 25 bp, S. cerevisiae
acagacgcagaatgacccttcgtat

SEQ ID NO: 12213 - DNA, 25 bp, S. cerevisiae
acagacagcttcaaaccacctagtt

SEQ ID NO: 12214 - DNA, 25 bp, S. cerevisiae
acaagtccactgtcaagtctttgag

SEQ ID NO: 12215 - DNA, 25 bp, S. cerevisiae
acagccgccgctagaatttttcatg

SEQ ID NO: 12216 - DNA, 25 bp, S. cerevisiae
acagccgttgttgagtttaatcgag

SEQ ID NO: 12217 - DNA, 25 bp, S. cerevisiae
acagattcctcttttttcttcaatt

SEQ ID NO: 12218 - DNA, 25 bp, S. cerevisiae
acacttgccatttgctttttggtac

SEQ ID NO: 12219 - DNA, 25 bp, S. cerevisiae
acagcgcaaaatcactttcagcatt

SEQ ID NO: 12220 - DNA, 25 bp, S. cerevisiae
acacgctagatacgattgttctttc

SEQ ID NO: 12221 - DNA, 25 bp, S. cerevisiae
acaccgactttgcatgcttgttgtt

SEQ ID NO: 12222 - DNA, 25 bp, S. cerevisiae
acacctgagctaatggttgacttca

SEQ ID NO: 12223 - DNA, 25 bp, S. cerevisiae
acagcgtcgctgtggtatatctcat

SEQ ID NO: 12224 - DNA, 25 bp, S. cerevisiae
acacttccagaactattgtcagaaa

SEQ ID NO: 12225 - DNA, 25 bp, S. cerevisiae
acaactatggtgctattccccaaac

SEQ ID NO: 12226 - DNA, 25 bp, S. cerevisiae
acagcctcctgatgtgttgaagcca

SEQ ID NO: 12227 - DNA, 25 bp, S. cerevisiae
acagcagcctcgtagaaatgaccaa

SEQ ID NO: 12228 - DNA, 25 bp, S. cerevisiae
acagacgctcattactaaggccaat

SEQ ID NO: 12229 - DNA, 25 bp, S. cerevisiae
aaatcgttgtaaccagacgcctggc

SEQ ID NO: 12230 - DNA, 25 bp, S. cerevisiae
acagggtcggtttccttgttgcaat

SEQ ID NO: 12231 - DNA, 25 bp, S. cerevisiae
acaaaaggcgtttaggcagcgtcgt

SEQ ID NO: 12232 - DNA, 25 bp, S. cerevisiae
acaaagtactccattgcccaagtga

SEQ ID NO: 12233 - DNA, 25 bp, S. cerevisiae
acaaagctcgctactcctgaaaaat

SEQ ID NO: 12234 - DNA, 25 bp, S. cerevisiae
acagcaagggctatggttactcaat

SEQ ID NO: 12235 - DNA, 25 bp, S. cerevisiae
acagtaagtgccatgggtcccttca

SEQ ID NO: 12236 - DNA, 25 bp, S. cerevisiae
acagtgtcaaccatgattcatccca

SEQ ID NO: 12237 - DNA, 25 bp, S. cerevisiae
acagggcgacaaagatatctccaaa

SEQ ID NO: 12238 - DNA, 25 bp, S. cerevisiae
acagggccaatcaacgaatcacgaa

SEQ ID NO: 12239 - DNA, 25 bp, S. cerevisiae
aatgattctaatttaagttcgcaag

SEQ ID NO: 12240 - DNA, 25 bp, S. cerevisiae
acaagtatcctataatcccaaagtg

SEQ ID NO: 12241 - DNA, 25 bp, S. cerevisiae
acagggattcttggatcctcccaaa

SEQ ID NO: 12242 - DNA, 25 bp, S. cerevisiae
acagcttttctgtgtcagcctcaga

SEQ ID NO: 12243 - DNA, 25 bp, S. cerevisiae
acagcctgcggatgcatttactcag

SEQ ID NO: 12244 - DNA, 25 bp, S. cerevisiae
acacccttggtgctactcttgataa

SEQ ID NO: 12245 - DNA, 25 bp, S. cerevisiae
acagcctcttcgcttattgcagaaa

SEQ ID NO: 12246 - DNA, 25 bp, S. cerevisiae
acagcacttggtcttcatgttggaa

SEQ ID NO: 12247 - DNA, 25 bp, S. cerevisiae
acagccctgtccaaatatgttgatg

SEQ ID NO: 12248 - DNA, 25 bp, S. cerevisiae
acactttctcgaacctcaaatcagg

SEQ ID NO: 12249 - DNA, 25 bp, S. cerevisiae
acagctgcttctcgtaccaaaataa

SEQ ID NO: 12250 - DNA, 25 bp, S. cerevisiae
acacggaagctgtatcgcactcaaa

SEQ ID NO: 12251 - DNA, 25 bp, S. cerevisiae
acaccagaagtatcacactactcta

SEQ ID NO: 12252 - DNA, 25 bp, S. cerevisiae
acaccgccagtgaccaatctgattt

SEQ ID NO: 12253 - DNA, 25 bp, S. cerevisiae
acacgctccagtagaacaatcatcc

SEQ ID NO: 12254 - DNA, 25 bp, S. cerevisiae
acagatctgatctcccaaatgattg

SEQ ID NO: 12255 - DNA, 25 bp, S. cerevisiae
acacgagtagatcatcccactggaa

SEQ ID NO: 12256 - DNA, 25 bp, S. cerevisiae
acagctgagtttgcttcgaccttaa

SEQ ID NO: 12257 - DNA, 25 bp, S. cerevisiae
acagcagcagcaatttccattcact

SEQ ID NO: 12258 - DNA, 25 bp, S. cerevisiae
acagagccattgttaaatgccttag

SEQ ID NO: 12259 - DNA, 25 bp, S. cerevisiae
acagatctcttggtaaagccggcag

SEQ ID NO: 12260 - DNA, 25 bp, S. cerevisiae
acagattcctgtttctatggcggcg

SEQ ID NO: 12261 - DNA, 25 bp, S. cerevisiae
acagaggtctgtactttggcttgta

SEQ ID NO: 12262 - DNA, 25 bp, S. cerevisiae
acactggtatctatcctggttctat

SEQ ID NO: 12263 - DNA, 25 bp, S. cerevisiae
acagctgttttattccttaacgttg

SEQ ID NO: 12264 - DNA, 25 bp, S. cerevisiae
acacccattgtttccattgagtcgt

SEQ ID NO: 12265 - DNA, 25 bp, S. cerevisiae
acacttcttgggtgctgtggctaga

SEQ ID NO: 12266 - DNA, 25 bp, S. cerevisiae
acactgttggcgatgacttcctgaa

SEQ ID NO: 12267 - DNA, 25 bp, S. cerevisiae
acaacaaatttggttctggcgaact

SEQ ID NO: 12268 - DNA, 25 bp, S. cerevisiae
acagtttgtggaagaggctcatcat

SEQ ID NO: 12269 - DNA, 25 bp, S. cerevisiae
acagattatgacctagacgctacta

SEQ ID NO: 12270 - DNA, 25 bp, S. cerevisiae
acaagacagatccaccaactcattt

SEQ ID NO: 12271 - DNA, 25 bp, S. cerevisiae
acacgacgtgctaccatgacttgga

SEQ ID NO: 12272 - DNA, 25 bp, S. cerevisiae
acacgcctgacactccaaatggagt

SEQ ID NO: 12273 - DNA, 25 bp, S. cerevisiae
acagtttcgatggagtcttgaccct

SEQ ID NO: 12274 - DNA, 25 bp, S. cerevisiae
acagttttgtgttcctgtgtcccta

SEQ ID NO: 12275 - DNA, 25 bp, S. cerevisiae
acaatacgggcatgggctggtctat

SEQ ID NO: 12276 - DNA, 25 bp, S. cerevisiae
acaagacgttgaaggcctggctcac

SEQ ID NO: 12277 - DNA, 25 bp, S. cerevisiae
catgaagaaagtgcggcgggcccct

SEQ ID NO: 12278 - DNA, 25 bp, S. cerevisiae
acaagaactcctatgggtcttccaa

SEQ ID NO: 12279 - DNA, 25 bp, S. cerevisiae
aaggaaccaccctgaatctgttcaa

SEQ ID NO: 12280 - DNA, 25 bp, S. cerevisiae
acaaaacgtcccacttcgttgcaga

SEQ ID NO: 12281 - DNA, 25 bp, S. cerevisiae
acaaaacgtcccattccatgaattc

SEQ ID NO: 12282 - DNA, 25 bp, S. cerevisiae
acaaaaagtccagatgtcaatccat

SEQ ID NO: 12283 - DNA, 25 bp, S. cerevisiae
acaaaatgattctacctccgtcttt

SEQ ID NO: 12284 - DNA, 25 bp, S. cerevisiae
acaaaagctctccaaagggtctgtt

SEQ ID NO: 12285 - DNA, 25 bp, S. cerevisiae
acaaaagttaggtgcatcgtcgtct

SEQ ID NO: 12286 - DNA, 25 bp, S. cerevisiae
acaaaggtaagaaggtcactagcat

SEQ ID NO: 12287 - DNA, 25 bp, S. cerevisiae
acacgggtgacgctaatactgaaga

SEQ ID NO: 12288 - DNA, 25 bp, S. cerevisiae
acacgttggacgtacaatttgcgaa

SEQ ID NO: 12289 - DNA, 25 bp, S. cerevisiae
acacctacggtttccttgagcaaag

SEQ ID NO: 12290 - DNA, 25 bp, S. cerevisiae
acacagcaatgtttcccagtttaat

SEQ ID NO: 12291 - DNA, 25 bp, S. cerevisiae
acagactatttcgacacagttcata

SEQ ID NO: 12292 - DNA, 25 bp, S. cerevisiae
acagcactatttggacactgccacg

SEQ ID NO: 12293 - DNA, 25 bp, S. cerevisiae
acagaccttatgtagttgccacagg

SEQ ID NO: 12294 - DNA, 25 bp, S. cerevisiae
acagaccgatgtagttgctgccaca

SEQ ID NO: 12295 - DNA, 25 bp, S. cerevisiae
acagcaccttctatatcttcagaga

SEQ ID NO: 12296 - DNA, 25 bp, S. cerevisiae
acactgctatcgtcaacccagttaa

SEQ ID NO: 12297 - DNA, 25 bp, S. cerevisiae
acacagtaggtgtagcccaattttt

SEQ ID NO: 12298 - DNA, 25 bp, S. cerevisiae
acagaactatgcgagatgctacccc

SEQ ID NO: 12299 - DNA, 25 bp, S. cerevisiae
acagcatttgacgaatgtcccacgc

SEQ ID NO: 12300 - DNA, 25 bp, S. cerevisiae
acactattactgaagtcgccactag

SEQ ID NO: 12301 - DNA, 25 bp, S. cerevisiae
aactactaagtcaagccaagctcgg

SEQ ID NO: 12302 - DNA, 25 bp, S. cerevisiae
aagctgatccaacctacggaatctc

SEQ ID NO: 12303 - DNA, 25 bp, S. cerevisiae
aacttggcaaccacctatattcacg

SEQ ID NO: 12304 - DNA, 25 bp, S. cerevisiae
acacttaccaaaactcattcgtcac

SEQ ID NO: 12305 - DNA, 25 bp, S. cerevisiae
acagcagaggcggtttttctaagta

SEQ ID NO: 12306 - DNA, 25 bp, S. cerevisiae
acagcagtgccggtagtagtcaaga

SEQ ID NO: 12307 - DNA, 25 bp, S. cerevisiae
acagctagccacttattcgtcaaaa

SEQ ID NO: 12308 - DNA, 25 bp, S. cerevisiae
acagcatttcagttattatctcaaa

SEQ ID NO: 12309 - DNA, 25 bp, S. cerevisiae
acagcacattggttgacttatacga

SEQ ID NO: 12310 - DNA, 25 bp, S. cerevisiae
aagccattggaagaggacacgattt

SEQ ID NO: 12311 - DNA, 25 bp, S. cerevisiae
aaaccggtagaacgcacgccagttg

SEQ ID NO: 12312 - DNA, 25 bp, S. cerevisiae
aagatcccagtagacccctatgtta

SEQ ID NO: 12313 - DNA, 25 bp, S. cerevisiae
aaatcgctagaagatccttacaaat

SEQ ID NO: 12314 - DNA, 25 bp, S. cerevisiae
acaaaactacattgctgccggtcaa

SEQ ID NO: 12315 - DNA, 25 bp, S. cerevisiae
acacacaacttgagctcacacgtaa

SEQ ID NO: 12316 - DNA, 25 bp, S. cerevisiae
acagccaaccgtatcatcgaggaat

SEQ ID NO: 12317 - DNA, 25 bp, S. cerevisiae
acagctacccgcaatataccaaaat

SEQ ID NO: 12318 - DNA, 25 bp, S. cerevisiae
acactatccggcaatgttctacatt

SEQ ID NO: 12319 - DNA, 25 bp, S. cerevisiae
acagaccccggtaattcagattatg

SEQ ID NO: 12320 - DNA, 25 bp, S. cerevisiae
acaaccccgccattgattcggaaga

SEQ ID NO: 12321 - DNA, 25 bp, S. cerevisiae
aactcgccggctatattggtagaaa

SEQ ID NO: 12322 - DNA, 25 bp, S. cerevisiae
acactactacttttgacatggttca

SEQ ID NO: 12323 - DNA, 25 bp, S. cerevisiae
acactctttcttccaattggttcac

SEQ ID NO: 12324 - DNA, 25 bp, S. cerevisiae
acagttgtttttctgatggctctca

SEQ ID NO: 12325 - DNA, 25 bp, S. cerevisiae
acagaaatttttccgtggcctacat

SEQ ID NO: 12326 - DNA, 25 bp, S. cerevisiae
aagtcctcgttagcgaagacctggc

SEQ ID NO: 12327 - DNA, 25 bp, S. cerevisiae
aaattctacattaccgacgaccgtg

SEQ ID NO: 12328 - DNA, 25 bp, S. cerevisiae
aaattcaaatggtccaacgcccgct

SEQ ID NO: 12329 - DNA, 25 bp, S. cerevisiae
aaatcccaagttggcgaggccccat

SEQ ID NO: 12330 - DNA, 25 bp, S. cerevisiae
aactctcaacgtgccgggaaacaga

SEQ ID NO: 12331 - DNA, 25 bp, S. cerevisiae
aagcctctaccttacggaaagcatc

SEQ ID NO: 12332 - DNA, 25 bp, S. cerevisiae
aagcagcacttacagagggaaactc

SEQ ID NO: 12333 - DNA, 25 bp, S. cerevisiae
aaatacttcatcgagcagaggaata

SEQ ID NO: 12334 - DNA, 25 bp, S. cerevisiae
acaaactctcattccgagcagacgg

SEQ ID NO: 12335 - DNA, 25 bp, S. cerevisiae
acaaagtccatgctgttggtccgtg

SEQ ID NO: 12336 - DNA, 25 bp, S. cerevisiae
acaaatctccacatgggttacctct

SEQ ID NO: 12337 - DNA, 25 bp, S. cerevisiae
acagacagtgcctttgggttcccac

SEQ ID NO: 12338 - DNA, 25 bp, S. cerevisiae
acagaatgtatgatcgtgcgcgcga

SEQ ID NO: 12339 - DNA, 25 bp, S. cerevisiae
acaactctccgaaaaatgacgccag

SEQ ID NO: 12340 - DNA, 25 bp, S. cerevisiae
acaactgccaagtgttatgtcccaa

SEQ ID NO: 12341 - DNA, 25 bp, S. cerevisiae
acaactcctagattttggccgacag

SEQ ID NO: 12342 - DNA, 25 bp, S. cerevisiae
acagagctagttcctcagacggtat

SEQ ID NO: 12343 - DNA, 25 bp, S. cerevisiae
acagagcttgtttgtatgccggatt

SEQ ID NO: 12344 - DNA, 25 bp, S. cerevisiae
acaccagagctactgcttctgaata

SEQ ID NO: 12345 - DNA, 25 bp, S. cerevisiae
acaacctggtcgtgagtgatagctc

SEQ ID NO: 12346 - DNA, 25 bp, S. cerevisiae
acacggctcggttgatgcatttgtt

SEQ ID NO: 12347 - DNA, 25 bp, S. cerevisiae
acaaatcgtgttgcttctcggttta

SEQ ID NO: 12348 - DNA, 25 bp, S. cerevisiae
acacattgtactaacttcacctttg

SEQ ID NO: 12349 - DNA, 25 bp, S. cerevisiae
acacaatcaattcagcttccactat

SEQ ID NO: 12350 - DNA, 25 bp, S. cerevisiae
acacatccaagaaacgtcggctcat

SEQ ID NO: 12351 - DNA, 25 bp, S. cerevisiae
acacaccaagaaacacggcgctatt

SEQ ID NO: 12352 - DNA, 25 bp, S. cerevisiae
acagcacagcaatggttcaactatt

SEQ ID NO: 12353 - DNA, 25 bp, S. cerevisiae
acagcatgccaaacgttccagtaag

SEQ ID NO: 12354 - DNA, 25 bp, S. cerevisiae
acaagactgcctttgtcggaattac

SEQ ID NO: 12355 - DNA, 25 bp, S. cerevisiae
acaaggccggttttgcagaatgtgc

SEQ ID NO: 12356 - DNA, 25 bp, S. cerevisiae
acaaggtccgttttgcatggtgggc

SEQ ID NO: 12357 - DNA, 25 bp, S. cerevisiae
acaacagttcgtcttcatcatggga

SEQ ID NO: 12358 - DNA, 25 bp, S. cerevisiae
acaacaggtgttgtcctctgaggac

SEQ ID NO: 12359 - DNA, 25 bp, S. cerevisiae
acactctgtggctggaactcgaaac

SEQ ID NO: 12360 - DNA, 25 bp, S. cerevisiae
acactcatatgaccggtatcttgaa

SEQ ID NO: 12361 - DNA, 25 bp, S. cerevisiae
acacatatcatgacttggtttcaag

SEQ ID NO: 12362 - DNA, 25 bp, S. cerevisiae
acactgagtctctttgtcatgatac

SEQ ID NO: 12363 - DNA, 25 bp, S. cerevisiae
acacgttcctgttggcgatgatcaa

SEQ ID NO: 12364 - DNA, 25 bp, S. cerevisiae
acagcgcttcgatttggtcattcaa

SEQ ID NO: 12365 - DNA, 25 bp, S. cerevisiae
acagcagatgctcgttccatgattg

SEQ ID NO: 12366 - DNA, 25 bp, S. cerevisiae
acagcagtgcttatccatattccag

SEQ ID NO: 12367 - DNA, 25 bp, S. cerevisiae
acaagtctcattaatcaccactcgg

SEQ ID NO: 12368 - DNA, 25 bp, S. cerevisiae
acaacctttatgacaacactcttcc

SEQ ID NO: 12369 - DNA, 25 bp, S. cerevisiae
acaaatttaccgtttctgccatcta

SEQ ID NO: 12370 - DNA, 25 bp, S. cerevisiae
aactactttccgtattcggcagtgt

SEQ ID NO: 12371 - DNA, 25 bp, S. cerevisiae
aactactttttgctacgtcgtctat

SEQ ID NO: 12372 - DNA, 25 bp, S. cerevisiae
aaattccacttgttaagatagtcga

SEQ ID NO: 12373 - DNA, 25 bp, S. cerevisiae
aagaacttatcctcacaacaatcct

SEQ ID NO: 12374 - DNA, 25 bp, S. cerevisiae
aaaagccatactaccaaaatacctg

SEQ ID NO: 12375 - DNA, 25 bp, S. cerevisiae
gaacccctgaagaacacgaaacctg

SEQ ID NO: 12376 - DNA, 25 bp, S. cerevisiae
aattccctccaatacgaaaccgcat

SEQ ID NO: 12377 - DNA, 25 bp, S. cerevisiae
aaccctgacctgtgtaattattctg

SEQ ID NO: 12378 - DNA, 25 bp, S. cerevisiae
acactggtccagttgtttctgttga

SEQ ID NO: 12379 - DNA, 25 bp, S. cerevisiae
acacttggcgtggtttattagacta

SEQ ID NO: 12380 - DNA, 25 bp, S. cerevisiae
acactgtgggtcttcatttccaaga

SEQ ID NO: 12381 - DNA, 25 bp, S. cerevisiae
acaagtgggtgctcatattctggaa

SEQ ID NO: 12382 - DNA, 25 bp, S. cerevisiae
aaagcacggttacattggtgaattt

SEQ ID NO: 12383 - DNA, 25 bp, S. cerevisiae
acaagcaccgtgaagctagaggttt

SEQ ID NO: 12384 - DNA, 25 bp, S. cerevisiae
acaaggccgaaactcatgcattttt

SEQ ID NO: 12385 - DNA, 25 bp, S. cerevisiae
acacacgccgattggtcatattaat

SEQ ID NO: 12386 - DNA, 25 bp, S. cerevisiae
acagccgggtgtcattagagattac

SEQ ID NO: 12387 - DNA, 25 bp, S. cerevisiae
acaagttggagcttctcggttctga

SEQ ID NO: 12388 - DNA, 25 bp, S. cerevisiae
acaagttatgcctccggtggtgaag

SEQ ID NO: 12389 - DNA, 25 bp, S. cerevisiae
acacatttgattgctccgggttgga

SEQ ID NO: 12390 - DNA, 25 bp, S. cerevisiae
cactactggtgtgcccgggaaaaat

SEQ ID NO: 12391 - DNA, 25 bp, S. cerevisiae
acaagtggtgtactccggaaatcaa

SEQ ID NO: 12392 - DNA, 25 bp, S. cerevisiae
acaagggtgtcttccaaggtgtcca

SEQ ID NO: 12393 - DNA, 25 bp, S. cerevisiae
acaactgtagctccccaaggtgtag

SEQ ID NO: 12394 - DNA, 25 bp, S. cerevisiae
acactttgtcccttcttggaggata

SEQ ID NO: 12395 - DNA, 25 bp, S. cerevisiae
aaactttcgtgtcagggttcttcat

SEQ ID NO: 12396 - DNA, 25 bp, S. cerevisiae
caaagagaccctctggtccctttat

SEQ ID NO: 12397 - DNA, 25 bp, S. cerevisiae
aaatgaaccgtgtggtgcccaattt

SEQ ID NO: 12398 - DNA, 25 bp, S. cerevisiae
acaatatgcaccctgattgcgagcc

SEQ ID NO: 12399 - DNA, 25 bp, S. cerevisiae
acaatatcagcgactctaggccgca

SEQ ID NO: 12400 - DNA, 25 bp, S. cerevisiae
acaatcaatgcaaggccaggctcct

SEQ ID NO: 12401 - DNA, 25 bp, S. cerevisiae
acaacaacagcaggctcaggctcaa

SEQ ID NO: 12402 - DNA, 25 bp, S. cerevisiae
acacgcatggcattgtcgcagggca

SEQ ID NO: 12403 - DNA, 25 bp, S. cerevisiae
acacatgatggttctcggtggcatt

SEQ ID NO: 12404 - DNA, 25 bp, S. cerevisiae
acacaggtgttcgttatggcttttg

SEQ ID NO: 12405 - DNA, 25 bp, S. cerevisiae
acacattttcgaattggtcttcatg

SEQ ID NO: 12406 - DNA, 25 bp, S. cerevisiae
acagctcaagtgaagcttccacgat

SEQ ID NO: 12407 - DNA, 25 bp, S. cerevisiae
acaaaatcctttatcggtgcccatt

SEQ ID NO: 12408 - DNA, 25 bp, S. cerevisiae
acaaatttttcatccccgcatttga

SEQ ID NO: 12409 - DNA, 25 bp, S. cerevisiae
acaaatggctttgtatccccacata

SEQ ID NO: 12410 - DNA, 25 bp, S. cerevisiae
acactaattttcctcctgtggtagc

SEQ ID NO: 12411 - DNA, 25 bp, S. cerevisiae
acactggaatgttcaaccatgggta

SEQ ID NO: 12412 - DNA, 25 bp, S. cerevisiae
gctatcgtaatcactgacccggtaa

SEQ ID NO: 12413 - DNA, 25 bp, S. cerevisiae
acaagagattgttccgccggttaat

SEQ ID NO: 12414 - DNA, 25 bp, S. cerevisiae
acaaggtttcctgcacatggtaatt

SEQ ID NO: 12415 - DNA, 25 bp, S. cerevisiae
acaagcgtttgccatgctagaccta

SEQ ID NO: 12416 - DNA, 25 bp, S. cerevisiae
acaaggttccattgatcaaggttgc

SEQ ID NO: 12417 - DNA, 25 bp, S. cerevisiae
acactattgttcgttctgggtgcac

SEQ ID NO: 12418 - DNA, 25 bp, S. cerevisiae
acacatacggtttcttgactccaaa

SEQ ID NO: 12419 - DNA, 25 bp, S. cerevisiae
acaacctactacatgtactgccaac

SEQ ID NO: 12420 - DNA, 25 bp, S. cerevisiae
acaaactacaattcagctactacaa

SEQ ID NO: 12421 - DNA, 25 bp, S. cerevisiae
acaaagagaatatcagcgccgctaa

SEQ ID NO: 12422 - DNA, 25 bp, S. cerevisiae
aaatgtcgattatcacgccctaggt

SEQ ID NO: 12423 - DNA, 25 bp, S. cerevisiae
caaaacagacaacaaagacgaggaa

SEQ ID NO: 12424 - DNA, 25 bp, S. cerevisiae
aaacttgaacaatagcgacggtgaa

SEQ ID NO: 12425 - DNA, 25 bp, S. cerevisiae
gaagacttaagagaaagagacggaa

SEQ ID NO: 12426 - DNA, 25 bp, S. cerevisiae
aagacttaagagaaagagacggaag

SEQ ID NO: 12427 - DNA, 25 bp, S. cerevisiae
aaaggtaagcagaataggccctaca

SEQ ID NO: 12428 - DNA, 25 bp, S. cerevisiae
aagggatcgactatgggaccagaca

SEQ ID NO: 12429 - DNA, 25 bp, S. cerevisiae
acaagccacacctattgaaattcta

SEQ ID NO: 12430 - DNA, 25 bp, S. cerevisiae
aaaggacctttatacattcattgtg

SEQ ID NO: 12431 - DNA, 25 bp, S. cerevisiae
aaaggccaacttcaaattcgataga

SEQ ID NO: 12432 - DNA, 25 bp, S. cerevisiae
acaacccattgtcgacttcttgaaa

SEQ ID NO: 12433 - DNA, 25 bp, S. cerevisiae
acacacgattatgcctttctatgag

SEQ ID NO: 12434 - DNA, 25 bp, S. cerevisiae
acacactgattatcgtggttaccaa

SEQ ID NO: 12435 - DNA, 25 bp, S. cerevisiae
acaacactgccatctttgttagcac

SEQ ID NO: 12436 - DNA, 25 bp, S. cerevisiae
aaatccttgggctttgcgtttggag

SEQ ID NO: 12437 - DNA, 25 bp, S. cerevisiae
acaagaagattgtctccaacgcttc

SEQ ID NO: 12438 - DNA, 25 bp, S. cerevisiae
acaaaactttcaatcgcacggtgga

SEQ ID NO: 12439 - DNA, 25 bp, S. cerevisiae
acaaaagctgttatgctgccgttaa

SEQ ID NO: 12440 - DNA, 25 bp, S. cerevisiae
acacaagccaactcttctctattag

SEQ ID NO: 12441 - DNA, 25 bp, S. cerevisiae
acacacccacacactctcttacatc

SEQ ID NO: 12442 - DNA, 25 bp, S. cerevisiae
acacaatctttcacctttacagcaa

SEQ ID NO: 12443 - DNA, 25 bp, S. cerevisiae
acaaattcttcaatccgtcttcgac

SEQ ID NO: 12444 - DNA, 25 bp, S. cerevisiae
acaatattgttcaccacttctaccg

SEQ ID NO: 12445 - DNA, 25 bp, S. cerevisiae
acaaactttgttcatgatttcccat

SEQ ID NO: 12446 - DNA, 25 bp, S. cerevisiae
acaacgtttgtacaacattccacat

SEQ ID NO: 12447 - DNA, 25 bp, S. cerevisiae
acacagcctattcaaaacttccagc

SEQ ID NO: 12448 - DNA, 25 bp, S. cerevisiae
acaatgccactttacaaactcctat

SEQ ID NO: 12449 - DNA, 25 bp, S. cerevisiae
acaaccagtggttccaataccttat

SEQ ID NO: 12450 - DNA, 25 bp, S. cerevisiae
acaaccagatgactcgcactatgac

SEQ ID NO: 12451 - DNA, 25 bp, S. cerevisiae
acaacagccatagcagctctatcag

SEQ ID NO: 12452 - DNA, 25 bp, S. cerevisiae
acaacgctaagtaccattctgatct

SEQ ID NO: 12453 - DNA, 25 bp, S. cerevisiae
acaacttccctcactacataattat

SEQ ID NO: 12454 - DNA, 25 bp, S. cerevisiae
acaaaatacactctgctggacaatt

SEQ ID NO: 12455 - DNA, 25 bp, S. cerevisiae
aaatcagtaccaaatgcacccacat

SEQ ID NO: 12456 - DNA, 25 bp, S. cerevisiae
acaaagctggtaaggcttccttgtt

SEQ ID NO: 12457 - DNA, 25 bp, S. cerevisiae
acacatcttggtttggctggacttt

SEQ ID NO: 12458 - DNA, 25 bp, S. cerevisiae
acacttgcggctctttagcttttat

SEQ ID NO: 12459 - DNA, 25 bp, S. cerevisiae
acactctgctttgtttcctttgata

SEQ ID NO: 12460 - DNA, 25 bp, S. cerevisiae
acactctcttacatctacctttact

SEQ ID NO: 12461 - DNA, 25 bp, S. cerevisiae
acaagctcatatatcgttcggttag

SEQ ID NO: 12462 - DNA, 25 bp, S. cerevisiae
acaactacaggcctctttggtgaac

SEQ ID NO: 12463 - DNA, 25 bp, S. cerevisiae
acaagctacaaattccattggccaa

SEQ ID NO: 12464 - DNA, 25 bp, S. cerevisiae
acaagtacggacttcgtgctgacaa

SEQ ID NO: 12465 - DNA, 25 bp, S. cerevisiae
acaagtctgggcttcctttgataaa

SEQ ID NO: 12466 - DNA, 25 bp, S. cerevisiae
acaagcagcattttaactctggaag

SEQ ID NO: 12467 - DNA, 25 bp, S. cerevisiae
acaaccctcctgattatgaacctga

SEQ ID NO: 12468 - DNA, 25 bp, S. cerevisiae
aaatccctgagtcttggaccgtaca

SEQ ID NO: 12469 - DNA, 25 bp, S. cerevisiae
aacccaaagagaattgctaccgcta

SEQ ID NO: 12470 - DNA, 25 bp, S. cerevisiae
acacccgcaaaggattctactggca

SEQ ID NO: 12471 - DNA, 25 bp, S. cerevisiae
acaaccagccagtaattctacggat

SEQ ID NO: 12472 - DNA, 25 bp, S. cerevisiae
acaaatcagttgcaagtcttcctag

SEQ ID NO: 12473 - DNA, 25 bp, S. cerevisiae
acaaacgcttgatagtcttgcttga

SEQ ID NO: 12474 - DNA, 25 bp, S. cerevisiae
acaaggattccgtaggttcattgaa

SEQ ID NO: 12475 - DNA, 25 bp, S. cerevisiae
acaaggaaccgtgggatgctttatc

SEQ ID NO: 12476 - DNA, 25 bp, S. cerevisiae
aaaggacatgcagcgggacaattat

SEQ ID NO: 12477 - DNA, 25 bp, S. cerevisiae
acaaggaccccgttgatctatagaa

SEQ ID NO: 12478 - DNA, 25 bp, S. cerevisiae
acaaagcaactcctcttgacttaga

SEQ ID NO: 12479 - DNA, 25 bp, S. cerevisiae
acaatggcacacagcgttgcgttga

SEQ ID NO: 12480 - DNA, 25 bp, S. cerevisiae
acaatggctcagctgcagtagagtt

SEQ ID NO: 12481 - DNA, 25 bp, S. cerevisiae
acaatggcatcttctgcactatcgt

SEQ ID NO: 12482 - DNA, 25 bp, S. cerevisiae
acaagcgtttctctggttctttgaa

SEQ ID NO: 12483 - DNA, 25 bp, S. cerevisiae
acaaattcttctcctggttctctat

SEQ ID NO: 12484 - DNA, 25 bp, S. cerevisiae
acactattcaacctctattttctca

SEQ ID NO: 12485 - DNA, 25 bp, S. cerevisiae
aaattgcatgctctgctgatgggaa

SEQ ID NO: 12486 - DNA, 25 bp, S. cerevisiae
acaaattgttggatgccccagctgc

SEQ ID NO: 12487 - DNA, 25 bp, S. cerevisiae
acaactcgttaatactgcggtcaaa

SEQ ID NO: 12488 - DNA, 25 bp, S. cerevisiae
aaatccagtcgagagacgcggtaat

SEQ ID NO: 12489 - DNA, 25 bp, S. cerevisiae
aaatagcactgcgaacgaccctaac

SEQ ID NO: 12490 - DNA, 25 bp, S. cerevisiae
aaattcaggccattgtaccacggac

SEQ ID NO: 12491 - DNA, 25 bp, S. cerevisiae
aaattgcagccccaggtgtacaaac

SEQ ID NO: 12492 - DNA, 25 bp, S. cerevisiae
acaacagtggctcaatcgggtcatc

SEQ ID NO: 12493 - DNA, 25 bp, S. cerevisiae
aaatcttgcgctcatgtcgaaacca

SEQ ID NO: 12494 - DNA, 25 bp, S. cerevisiae
acacaaatcactttcctcattggag

SEQ ID NO: 12495 - DNA, 25 bp, S. cerevisiae
acaacaaaggcttctccatcaactt

SEQ ID NO: 12496 - DNA, 25 bp, S. cerevisiae
acaacaagaggtttctcctgaccgc

SEQ ID NO: 12497 - DNA, 25 bp, S. cerevisiae
acacaaatgggttatccgccactca

SEQ ID NO: 12498 - DNA, 25 bp, S. cerevisiae
acaaacattttctactggccagtca

SEQ ID NO: 12499 - DNA, 25 bp, S. cerevisiae
acaaaatctggtgagtcgactggaa

SEQ ID NO: 12500 - DNA, 25 bp, S. cerevisiae
acacactggccaatttttgatccga

SEQ ID NO: 12501 - DNA, 25 bp, S. cerevisiae
acaacgcgctcaagtggttaccatg

SEQ ID NO: 12502 - DNA, 25 bp, S. cerevisiae
acaaggatgggttcttggcccggca

SEQ ID NO: 12503 - DNA, 25 bp, S. cerevisiae
acaactcttggtggtgtgctttcaa

SEQ ID NO: 12504 - DNA, 25 bp, S. cerevisiae
aaattggtgacctacatttctccct

SEQ ID NO: 12505 - DNA, 25 bp, S. cerevisiae
aaattgggactgtccttgcttggga

SEQ ID NO: 12506 - DNA, 25 bp, S. cerevisiae
aagtactaccgtgttcctggcgagt

SEQ ID NO: 12507 - DNA, 25 bp, S. cerevisiae
aagtttacctaatctccggtgcagc

SEQ ID NO: 12508 - DNA, 25 bp, S. cerevisiae
aaattttgctcccattgcgggtgtg

SEQ ID NO: 12509 - DNA, 25 bp, S. cerevisiae
aaataagcggatctctggcgggcac

SEQ ID NO: 12510 - DNA, 25 bp, S. cerevisiae
aaagaagtggatcttacgcgccctt

SEQ ID NO: 12511 - DNA, 25 bp, S. cerevisiae
acaaaccgagggatggcagtcaagt

SEQ ID NO: 12512 - DNA, 25 bp, S. cerevisiae
acaagcaggaacagcgtggcgccat

SEQ ID NO: 12513 - DNA, 25 bp, S. cerevisiae
acaagggagctgtgggacccaacaa

SEQ ID NO: 12514 - DNA, 25 bp, S. cerevisiae
aaatggcgccagtggaacgtagaca

SEQ ID NO: 12515 - DNA, 25 bp, S. cerevisiae
aaatcctgacagtgggactacagaa

SEQ ID NO: 12516 - DNA, 25 bp, S. cerevisiae
aaatgttgaatttggtgacctaggc

SEQ ID NO: 12517 - DNA, 25 bp, S. cerevisiae
aaatttgatcacatgaaggccaagc

SEQ ID NO: 12518 - DNA, 25 bp, S. cerevisiae
aaatctttcaaacagccttcaggcg

SEQ ID NO: 12519 - DNA, 25 bp, S. cerevisiae
aaattttacggtgctggtgccggcg

SEQ ID NO: 12520 - DNA, 25 bp, S. cerevisiae
acacagatgttgtcgttcttgaggg

SEQ ID NO: 12521 - DNA, 25 bp, S. cerevisiae
acacagatggtgtccttcaaacaga

SEQ ID NO: 12522 - DNA, 25 bp, S. cerevisiae
aaatgcatggtggagctgttcaaca

SEQ ID NO: 12523 - DNA, 25 bp, S. cerevisiae
acacatcaggtcatttcttcaacac

SEQ ID NO: 12524 - DNA, 25 bp, S. cerevisiae
acactactgtgtttcttgtgctatt

SEQ ID NO: 12525 - DNA, 25 bp, S. cerevisiae
acactactgtgtttcttgtgctatt

SEQ ID NO: 12526 - DNA, 25 bp, S. cerevisiae
aaattgatatctccattccagcatg

SEQ ID NO: 12527 - DNA, 25 bp, S. cerevisiae
acaagcttgggattgggttagccat

SEQ ID NO: 12528 - DNA, 25 bp, S. cerevisiae
acaactttggtttcgaatctgatga

SEQ ID NO: 12529 - DNA, 25 bp, S. cerevisiae
acaacttcggcatccaatagcgata

SEQ ID NO: 12530 - DNA, 25 bp, S. cerevisiae
acaacctcaggaacagcaacagcaa

SEQ ID NO: 12531 - DNA, 25 bp, S. cerevisiae
acaagagagggaacaattagcacat

SEQ ID NO: 12532 - DNA, 25 bp, S. cerevisiae
acaacgggtttggactggcatacat

SEQ ID NO: 12533 - DNA, 25 bp, S. cerevisiae
aaatccaaggtacggtgtgcaatct

SEQ ID NO: 12534 - DNA, 25 bp, S. cerevisiae
aaatccaacagctgagggcatcctc

SEQ ID NO: 12535 - DNA, 25 bp, S. cerevisiae
aaatctcaccaataatacctcaaat

SEQ ID NO: 12536 - DNA, 25 bp, S. cerevisiae
aaatgctaaccaagaaacgtccaag

SEQ ID NO: 12537 - DNA, 25 bp, S. cerevisiae
acaatggctctatctcatcaagtga

SEQ ID NO: 12538 - DNA, 25 bp, S. cerevisiae
acaagggcatgttcgcgtgggtcca

SEQ ID NO: 12539 - DNA, 25 bp, S. cerevisiae
acacaagtctcttcctgtgggttag

SEQ ID NO: 12540 - DNA, 25 bp, S. cerevisiae
acaagagttggttgcactgcaccga

SEQ ID NO: 12541 - DNA, 25 bp, S. cerevisiae
acaaattactgtccaatgccctgat

SEQ ID NO: 12542 - DNA, 25 bp, S. cerevisiae
acacattcgatataccatctccaga

SEQ ID NO: 12543 - DNA, 25 bp, S. cerevisiae
acacaaccataccattgctgctttg

SEQ ID NO: 12544 - DNA, 25 bp, S. cerevisiae
acacattccattcttgctggttggg

SEQ ID NO: 12545 - DNA, 25 bp, S. cerevisiae
acaactacattcaacctggtcaagg

SEQ ID NO: 12546 - DNA, 25 bp, S. cerevisiae
acaaccagcttatactttccaatga

SEQ ID NO: 12547 - DNA, 25 bp, S. cerevisiae
acaaaccttatgaacttgccatcaa

SEQ ID NO: 12548 - DNA, 25 bp, S. cerevisiae
acaactactatgcatcacttgcctg

SEQ ID NO: 12549 - DNA, 25 bp, S. cerevisiae
acaagcctgtgtgacgcactcaaga

SEQ ID NO: 12550 - DNA, 25 bp, S. cerevisiae
acaagacgggtctgccatgcatcag

SEQ ID NO: 12551 - DNA, 25 bp, S. cerevisiae
acacagatcagttgtccgttccagg

SEQ ID NO: 12552 - DNA, 25 bp, S. cerevisiae
acaatcttgatttggcttccctcga

SEQ ID NO: 12553 - DNA, 25 bp, S. cerevisiae
acacattgggtatgctgggtcatca

SEQ ID NO: 12554 - DNA, 25 bp, S. cerevisiae
acaattacttgttgatgggtcatct

SEQ ID NO: 12555 - DNA, 25 bp, S. cerevisiae
acaatgaactcttccaaggtccatc

SEQ ID NO: 12556 - DNA, 25 bp, S. cerevisiae
acaaagactcttccatcactgttgc

SEQ ID NO: 12557 - DNA, 25 bp, S. cerevisiae
acaatggtcacttcgacacatgcca

SEQ ID NO: 12558 - DNA, 25 bp, S. cerevisiae
acaacttatctgtgaatctcgctca

SEQ ID NO: 12559 - DNA, 25 bp, S. cerevisiae
acaactttcttccaaattgcgcttc

SEQ ID NO: 12560 - DNA, 25 bp, S. cerevisiae
aaaatgaaatttggcgataccttgc

SEQ ID NO: 12561 - DNA, 25 bp, S. cerevisiae
acaaagttgatcgaaggcccctcag

SEQ ID NO: 12562 - DNA, 25 bp, S. cerevisiae
acaaagtattcaatctagccctccg

SEQ ID NO: 12563 - DNA, 25 bp, S. cerevisiae
aaatatgtaacaatcctgcaggtca

SEQ ID NO: 12564 - DNA, 25 bp, S. cerevisiae
aaatataaacataccgcaacgggca

SEQ ID NO: 12565 - DNA, 25 bp, S. cerevisiae
gaaaaacgcccaaagctacggtgtg

SEQ ID NO: 12566 - DNA, 25 bp, S. cerevisiae
aaatcaacggccaaagacgctcttg

SEQ ID NO: 12567 - DNA, 25 bp, S. cerevisiae
aaattactggcgaaggcggcatccc

SEQ ID NO: 12568 - DNA, 25 bp, S. cerevisiae
aaatggatctaggaaagtggcagga

SEQ ID NO: 12569 - DNA, 25 bp, S. cerevisiae
aaattactggtaactcatggagaaa

SEQ ID NO: 12570 - DNA, 25 bp, S. cerevisiae
acaactactggtgctgccagtcgaa

SEQ ID NO: 12571 - DNA, 25 bp, S. cerevisiae
acaagatgacgcttccgccaaagaa

SEQ ID NO: 12572 - DNA, 25 bp, S. cerevisiae
acaagagaatcttccggcctacaaa

SEQ ID NO: 12573 - DNA, 25 bp, S. cerevisiae
acaaggctgtctacgccggtgaaaa

SEQ ID NO: 12574 - DNA, 25 bp, S. cerevisiae
acaatgtatgctgccgacggtgact

SEQ ID NO: 12575 - DNA, 25 bp, S. cerevisiae
acaagaggttctggacgcggagcac

SEQ ID NO: 12576 - DNA, 25 bp, S. cerevisiae
acaagaatttcaagctcgcaccaca

SEQ ID NO: 12577 - DNA, 25 bp, S. cerevisiae
acaagactgtcttttcatccagcag

SEQ ID NO: 12578 - DNA, 25 bp, S. cerevisiae
acaacaaccatatttcattcagcga

SEQ ID NO: 12579 - DNA, 25 bp, S. cerevisiae
aacattgccgaaactaacctacctg

SEQ ID NO: 12580 - DNA, 25 bp, S. cerevisiae
aaatagtgccacgactaaccttcct

SEQ ID NO: 12581 - DNA, 25 bp, S. cerevisiae
caaatgggcccgtgaatccggtgtt

SEQ ID NO: 12582 - DNA, 25 bp, S. cerevisiae
acaagtctatactccgctaacacag

SEQ ID NO: 12583 - DNA, 25 bp, S. cerevisiae
aaagaaattccctgaccgtcatgtt

SEQ ID NO: 12584 - DNA, 25 bp, S. cerevisiae
aacttgtccaagaccacggagttca

SEQ ID NO: 12585 - DNA, 25 bp, S. cerevisiae
aaattccccagagacgtactgtcac

SEQ ID NO: 12586 - DNA, 25 bp, S. cerevisiae
aaattgaacccagagcgtagagctt

SEQ ID NO: 12587 - DNA, 25 bp, S. cerevisiae
aaattccccttggatgatgctacga

SEQ ID NO: 12588 - DNA, 25 bp, S. cerevisiae
acaatgtcctgtgtgtaggtcacca

SEQ ID NO: 12589 - DNA, 25 bp, S. cerevisiae
acaattttggcagttacgtctcgag

SEQ ID NO: 12590 - DNA, 25 bp, S. cerevisiae
acaatttggcgattttctggctaaa

SEQ ID NO: 12591 - DNA, 25 bp, S. cerevisiae
acaacttccgagaatctcaggctta

SEQ ID NO: 12592 - DNA, 25 bp, S. cerevisiae
aaatttggccactgcgatacgtttt

SEQ ID NO: 12593 - DNA, 25 bp, S. cerevisiae
aaattcggcgacaccaacggctgtt

SEQ ID NO: 12594 - DNA, 25 bp, S. cerevisiae
aaattgccggaaggccattgcgaat

SEQ ID NO: 12595 - DNA, 25 bp, S. cerevisiae
aaattgataaacttgccgtggcaga

SEQ ID NO: 12596 - DNA, 25 bp, S. cerevisiae
aaatacttcatcgaggccgtggaaa

SEQ ID NO: 12597 - DNA, 25 bp, S. cerevisiae
acaagagattacaggcacgtcgaaa

SEQ ID NO: 12598 - DNA, 25 bp, S. cerevisiae
aaatatgcctcctataaacgcgaat

SEQ ID NO: 12599 - DNA, 25 bp, S. cerevisiae
aaacatccggtcacacaacgatttc

SEQ ID NO: 12600 - DNA, 25 bp, S. cerevisiae
aaatcgcttcaattggacttattcc

SEQ ID NO: 12601 - DNA, 25 bp, S. cerevisiae
acaagcgtgctctatgggtttttcc

SEQ ID NO: 12602 - DNA, 25 bp, S. cerevisiae
acaagagctcttctggtttctacgc

SEQ ID NO: 12603 - DNA, 25 bp, S. cerevisiae
acaagttgcggtacgtcttgactcc

SEQ ID NO: 12604 - DNA, 25 bp, S. cerevisiae
acaagttcgctgatacgtgttacgc

SEQ ID NO: 12605 - DNA, 25 bp, S. cerevisiae
acaaattcagcggtcatcactgtat

SEQ ID NO: 12606 - DNA, 25 bp, S. cerevisiae
aaatgactacggatactgccataag

SEQ ID NO: 12607 - DNA, 25 bp, S. cerevisiae
acaaaccacgtgatggtctacacgt

SEQ ID NO: 12608 - DNA, 25 bp, S. cerevisiae
acaattcacatagtccggagttttt

SEQ ID NO: 12609 - DNA, 25 bp, S. cerevisiae
aaattactacccaccatttgtgcta

SEQ ID NO: 12610 - DNA, 25 bp, S. cerevisiae
aaatttaaaccctgattcgccatca

SEQ ID NO: 12611 - DNA, 25 bp, S. cerevisiae
aaattcctgatacggcggttgacaa

SEQ ID NO: 12612 - DNA, 25 bp, S. cerevisiae
aaattcactacactgccgattggac

SEQ ID NO: 12613 - DNA, 25 bp, S. cerevisiae
aaattgaatggacgccgaattgctc

SEQ ID NO: 12614 - DNA, 25 bp, S. cerevisiae
acaaatggttcatcaggtggccctc

SEQ ID NO: 12615 - DNA, 25 bp, S. cerevisiae
acaaattgcggtgcatcgtgatgct

SEQ ID NO: 12616 - DNA, 25 bp, S. cerevisiae
acaagtatgggttctcgctgcaggc

SEQ ID NO: 12617 - DNA, 25 bp, S. cerevisiae
acaagttggtatttgctctgctgcc

SEQ ID NO: 12618 - DNA, 25 bp, S. cerevisiae
acaagtctctacatttgctgtcaat

SEQ ID NO: 12619 - DNA, 25 bp, S. cerevisiae
acaactgccacctttgcaggttgtg

SEQ ID NO: 12620 - DNA, 25 bp, S. cerevisiae
acaaggtcccgtactggttgctgga

SEQ ID NO: 12621 - DNA, 25 bp, S. cerevisiae
acaagagattccgtctatagagtcg

SEQ ID NO: 12622 - DNA, 25 bp, S. cerevisiae
acaactgtctctaacttccaattct

SEQ ID NO: 12623 - DNA, 25 bp, S. cerevisiae
acaagttcttactttgacacctgcc

SEQ ID NO: 12624 - DNA, 25 bp, S. cerevisiae
acaacgtctttggtgtgaatccgct

SEQ ID NO: 12625 - DNA, 25 bp, S. cerevisiae
acaatttgtttgatgcggtggcctc

SEQ ID NO: 12626 - DNA, 25 bp, S. cerevisiae
acaacctggcgtgggcgagctgtta

SEQ ID NO: 12627 - DNA, 25 bp, S. cerevisiae
acaagtggctggtctgcacaccttt

SEQ ID NO: 12628 - DNA, 25 bp, S. cerevisiae
acaattggctattccaagcgccttt

SEQ ID NO: 12629 - DNA, 25 bp, S. cerevisiae
acaactgcaaagtcctactgcacct

SEQ ID NO: 12630 - DNA, 25 bp, S. cerevisiae
acaagtgcattttcattacccctga

SEQ ID NO: 12631 - DNA, 25 bp, S. cerevisiae
acaatctctcagtggatcaactttt

SEQ ID NO: 12632 - DNA, 25 bp, S. cerevisiae
aaattgcattgctcggttctttgga

SEQ ID NO: 12633 - DNA, 25 bp, S. cerevisiae
acaatccccatcattcggcaaattt

SEQ ID NO: 12634 - DNA, 25 bp, S. cerevisiae
acaaaaccatgtctgcgctctattt

SEQ ID NO: 12635 - DNA, 25 bp, S. cerevisiae
acaaaaccagtatcagcatctgatt

SEQ ID NO: 12636 - DNA, 25 bp, S. cerevisiae
aaatgaactcgttaccatctcctgg

SEQ ID NO: 12637 - DNA, 25 bp, S. cerevisiae
acaagggtcagaacctgcggcgata

SEQ ID NO: 12638 - DNA, 25 bp, S. cerevisiae
acaagttgccaaagcctgctggttg

SEQ ID NO: 12639 - DNA, 25 bp, S. cerevisiae
acaagttggcttgcttgggttgctg

SEQ ID NO: 12640 - DNA, 25 bp, S. cerevisiae
acaactgtttccattctgctgacaa

SEQ ID NO: 12641 - DNA, 25 bp, S. cerevisiae
aaatatgctgcaatcggttcgtgaa

SEQ ID NO: 12642 - DNA, 25 bp, S. cerevisiae
acaatggctttgtccgcatatgcta

SEQ ID NO: 12643 - DNA, 25 bp, S. cerevisiae
aaatactacttcttcaggtgccact

SEQ ID NO: 12644 - DNA, 25 bp, S. cerevisiae
aaatccttcgtatgggacttggcaa

SEQ ID NO: 12645 - DNA, 25 bp, S. cerevisiae
aaatctctgtcgctcaaaagttgga

SEQ ID NO: 12646 - DNA, 25 bp, S. cerevisiae
aaattcctgagctacccaagatggg

SEQ ID NO: 12647 - DNA, 25 bp, S. cerevisiae
aaatacctacttcatgaccaccggt

SEQ ID NO: 12648 - DNA, 25 bp, S. cerevisiae
aaattcctccgtcattttcggtgct

SEQ ID NO: 12649 - DNA, 25 bp, S. cerevisiae
aaattttgccaatgtcgtacgtgct

SEQ ID NO: 12650 - DNA, 25 bp, S. cerevisiae
aaatttgagccgagtatctacgttt

SEQ ID NO: 12651 - DNA, 25 bp, S. cerevisiae
acaagggttgctgttccgagaagtt

SEQ ID NO: 12652 - DNA, 25 bp, S. cerevisiae
acaagactggtcacattgccgctga

SEQ ID NO: 12653 - DNA, 25 bp, S. cerevisiae
acaagaccagtcactacttccaaat

SEQ ID NO: 12654 - DNA, 25 bp, S. cerevisiae
acaaggcgatcgatttttccaaata

SEQ ID NO: 12655 - DNA, 25 bp, S. cerevisiae
acaagaagcctgatttatatacgat

SEQ ID NO: 12656 - DNA, 25 bp, S. cerevisiae
acaatcttggagagtctttcactaa

SEQ ID NO: 12657 - DNA, 25 bp, S. cerevisiae
acaacttgtcagatgctttctctta

SEQ ID NO: 12658 - DNA, 25 bp, S. cerevisiae
acaaccagtctctcatgttcattta

SEQ ID NO: 12659 - DNA, 25 bp, S. cerevisiae
acaaccaccatcaattgccaacatg

SEQ ID NO: 12660 - DNA, 25 bp, S. cerevisiae
acaagcccatgtctttcaacgagta

SEQ ID NO: 12661 - DNA, 25 bp, S. cerevisiae
acaagtcatttcttttgagcactga

SEQ ID NO: 12662 - DNA, 25 bp, S. cerevisiae
acaactcgtgtctgttccatgctat

SEQ ID NO: 12663 - DNA, 25 bp, S. cerevisiae
aaatttcagccttttcaacatggtt

SEQ ID NO: 12664 - DNA, 25 bp, S. cerevisiae
aaatttcccaatggcgcgaatggat

SEQ ID NO: 12665 - DNA, 25 bp, S. cerevisiae
aaattcgtccaaccggagtcaactg

SEQ ID NO: 12666 - DNA, 25 bp, S. cerevisiae
acaatgttcgtgttgcgtcgaggtt

SEQ ID NO: 12667 - DNA, 25 bp, S. cerevisiae
aaattcgttgttgtctgggttgcaa

SEQ ID NO: 12668 - DNA, 25 bp, S. cerevisiae
aaattgtgggttgttgcctattgga

SEQ ID NO: 12669 - DNA, 25 bp, S. cerevisiae
aaatgcagatggatggccccgcagt

SEQ ID NO: 12670 - DNA, 25 bp, S. cerevisiae
acaatcagaacaacagccggagcaa

SEQ ID NO: 12671 - DNA, 25 bp, S. cerevisiae
aacatgcatcatgaagtgctcagaa

SEQ ID NO: 12672 - DNA, 25 bp, S. cerevisiae
aaatgcattgctcgagctgcgcatg

SEQ ID NO: 12673 - DNA, 25 bp, S. cerevisiae
aaatagtcatcgatgccatgcaggg

SEQ ID NO: 12674 - DNA, 25 bp, S. cerevisiae
aaattacatccatcgtatcggtaga

SEQ ID NO: 12675 - DNA, 25 bp, S. cerevisiae
acaatgttgctctgaacgacgtata

SEQ ID NO: 12676 - DNA, 25 bp, S. cerevisiae
acaattcgctgctatgaaggacggg

SEQ ID NO: 12677 - DNA, 25 bp, S. cerevisiae
acaatctcttgcaattagtcatcga

SEQ ID NO: 12678 - DNA, 25 bp, S. cerevisiae
acaatgacactctcgttgacgtctt

SEQ ID NO: 12679 - DNA, 25 bp, S. cerevisiae
aaatgtaccggatctgaattcagct

SEQ ID NO: 12680 - DNA, 25 bp, S. cerevisiae
aacttaccagttctagcttacaatc

SEQ ID NO: 12681 - DNA, 25 bp, S. cerevisiae
aaattacgtgattccgacttacaat

SEQ ID NO: 12682 - DNA, 25 bp, S. cerevisiae
aaattggttcgacagcgtccacagt

SEQ ID NO: 12683 - DNA, 25 bp, S. cerevisiae
acaaggttttgacaccatcgtcggg

SEQ ID NO: 12684 - DNA, 25 bp, S. cerevisiae
acaatcagttttctccacttttggg

SEQ ID NO: 12685 - DNA, 25 bp, S. cerevisiae
aaatcagtttctcgagcccgtttat

SEQ ID NO: 12686 - DNA, 25 bp, S. cerevisiae
aaatattttgatctcccgtggaaag

SEQ ID NO: 12687 - DNA, 25 bp, S. cerevisiae
acaattttatgtggtctccgagaat

SEQ ID NO: 12688 - DNA, 25 bp, S. cerevisiae
aaatgctgttccaggtaacccaggt

SEQ ID NO: 12689 - DNA, 25 bp, S. cerevisiae
aaaggcttcatcgtgggacctacgg

SEQ ID NO: 12690 - DNA, 25 bp, S. cerevisiae
aaagtattcggtcagacgtagctga

SEQ ID NO: 12691 - DNA, 25 bp, S. cerevisiae
acaatcaatgctcgccttcaaggta

SEQ ID NO: 12692 - DNA, 25 bp, S. cerevisiae
acaatactgctggtgatgacgatca

SEQ ID NO: 12693 - DNA, 25 bp, S. cerevisiae
aaattggccataaagcttgcgaaat

SEQ ID NO: 12694 - DNA, 25 bp, S. cerevisiae
acaattcgtcatacaacagcttaat

SEQ ID NO: 12695 - DNA, 25 bp, S. cerevisiae
aaagaggattattatgccagacaac

SEQ ID NO: 12696 - DNA, 25 bp, S. cerevisiae
aaagggcaacgaagccgatctcgcc

SEQ ID NO: 12697 - DNA, 25 bp, S. cerevisiae
aaaggaggagcgtcagcttttcgcc

SEQ ID NO: 12698 - DNA, 25 bp, S. cerevisiae
aaattagttggatacgttctcgtga

SEQ ID NO: 12699 - DNA, 25 bp, S. cerevisiae
aaatccctcctgctaaattacttgg

SEQ ID NO: 12700 - DNA, 25 bp, S. cerevisiae
aaacccactggacaagatcgacttg

SEQ ID NO: 12701 - DNA, 25 bp, S. cerevisiae
aaatccaactgccaccgaaaactgt

SEQ ID NO: 12702 - DNA, 25 bp, S. cerevisiae
aaattatattcccacctacagacac

SEQ ID NO: 12703 - DNA, 25 bp, S. cerevisiae
aaagtattacccctaagattcacag

SEQ ID NO: 12704 - DNA, 25 bp, S. cerevisiae
aaattttacccgtagagcatcagga

SEQ ID NO: 12705 - DNA, 25 bp, S. cerevisiae
aaattcttcccgttcttggcaatat

SEQ ID NO: 12706 - DNA, 25 bp, S. cerevisiae
aaataattacccatcttgctgaaaa

SEQ ID NO: 12707 - DNA, 25 bp, S. cerevisiae
aaattttacaacatcgtcgaccaag

SEQ ID NO: 12708 - DNA, 25 bp, S. cerevisiae
aaatctaaaggtctcgtcgtcgaag

SEQ ID NO: 12709 - DNA, 25 bp, S. cerevisiae
aaatctagggccatgtcgatttcga

SEQ ID NO: 12710 - DNA, 25 bp, S. cerevisiae
acaagacataaatctgcctccgcag

SEQ ID NO: 12711 - DNA, 25 bp, S. cerevisiae
acaagaacaaattcgcgctggccgc

SEQ ID NO: 12712 - DNA, 25 bp, S. cerevisiae
aaatagagccgattccttggacttc

SEQ ID NO: 12713 - DNA, 25 bp, S. cerevisiae
acaatagaggtcctccttctatcat

SEQ ID NO: 12714 - DNA, 25 bp, S. cerevisiae
acaatcatggctccgtcgtgtaatt

SEQ ID NO: 12715 - DNA, 25 bp, S. cerevisiae
aaattggcgacgtcgatggactgat

SEQ ID NO: 12716 - DNA, 25 bp, S. cerevisiae
aaatgtgacgtctgcaatggatcta

SEQ ID NO: 12717 - DNA, 25 bp, S. cerevisiae
aaattttgatctgtggtcctccagc

SEQ ID NO: 12718 - DNA, 25 bp, S. cerevisiae
aaattcttagacagtgactcgccgc

SEQ ID NO: 12719 - DNA, 25 bp, S. cerevisiae
aaattttacatcatcaacgcgccat

SEQ ID NO: 12720 - DNA, 25 bp, S. cerevisiae
aaattcttccctgaaatcgatgcaa

SEQ ID NO: 12721 - DNA, 25 bp, S. cerevisiae
aaatatctgataccgccataaagga

SEQ ID NO: 12722 - DNA, 25 bp, S. cerevisiae
aaatcgtgatgaccttgagaacagt

SEQ ID NO: 12723 - DNA, 25 bp, S. cerevisiae
aaatcgttgcgggaactcacagttt

SEQ ID NO: 12724 - DNA, 25 bp, S. cerevisiae
aaatttccggcttcttcacgttatg

SEQ ID NO: 12725 - DNA, 25 bp, S. cerevisiae
aaattcttccgttggccaccattat

SEQ ID NO: 12726 - DNA, 25 bp, S. cerevisiae
acaattttgcgatctgtctcctttt

SEQ ID NO: 12727 - DNA, 25 bp, S. cerevisiae
aaattcggtcctattgatgctttga

SEQ ID NO: 12728 - DNA, 25 bp, S. cerevisiae
acaatcattagacgtttcctccgac

SEQ ID NO: 12729 - DNA, 25 bp, S. cerevisiae
aaattaaactttacgtcgctgacag

SEQ ID NO: 12730 - DNA, 25 bp, S. cerevisiae
aaatttgaacctttcctcaggcaag

SEQ ID NO: 12731 - DNA, 25 bp, S. cerevisiae
aaatcaactggacccactggtgcgg

SEQ ID NO: 12732 - DNA, 25 bp, S. cerevisiae
aaaacactgaaagacgctgagccga

SEQ ID NO: 12733 - DNA, 25 bp, S. cerevisiae
aaataatctaagttacctgatacaa

SEQ ID NO: 12734 - DNA, 25 bp, S. cerevisiae
aaatacgtcgagctaccttcaaatt

SEQ ID NO: 12735 - DNA, 25 bp, S. cerevisiae
aaattcgatggacgtctctcattaa

SEQ ID NO: 12736 - DNA, 25 bp, S. cerevisiae
aaatcacatttcctaacaactcagt

SEQ ID NO: 12737 - DNA, 25 bp, S. cerevisiae
aaatcacactattctggtaacatca

SEQ ID NO: 12738 - DNA, 25 bp, S. cerevisiae
aaatcgcactgcgtcatcgttacag

SEQ ID NO: 12739 - DNA, 25 bp, S. cerevisiae
acaattgactccgtgtttacgcttt

SEQ ID NO: 12740 - DNA, 25 bp, S. cerevisiae
acaatgcagctatcacgtttgccgg

SEQ ID NO: 12741 - DNA, 25 bp, S. cerevisiae
acaatgactcgccatctgtgttcgg

SEQ ID NO: 12742 - DNA, 25 bp, S. cerevisiae
aaattccgacatatttcagtccacg

SEQ ID NO: 12743 - DNA, 25 bp, S. cerevisiae
acaatctcccctctttatggaagga

SEQ ID NO: 12744 - DNA, 25 bp, S. cerevisiae
acaatcttcaccaaatgttacgccc

SEQ ID NO: 12745 - DNA, 25 bp, S. cerevisiae
aaatcacgagccaagttcaacccgt

SEQ ID NO: 12746 - DNA, 25 bp, S. cerevisiae
aaatacaggtgcaatgtcccacgcc

SEQ ID NO: 12747 - DNA, 25 bp, S. cerevisiae
aaatcacagcgctggtaccattggc

SEQ ID NO: 12748 - DNA, 25 bp, S. cerevisiae
aaatatggttcgctcaccgagtgca

SEQ ID NO: 12749 - DNA, 25 bp, S. cerevisiae
aaattacagtcgctgctattatagt

SEQ ID NO: 12750 - DNA, 25 bp, S. cerevisiae
aaatatgcggatccacttctgaaag

SEQ ID NO: 12751 - DNA, 25 bp, S. cerevisiae
aaatagctcaaccatcgtctagcgg

SEQ ID NO: 12752 - DNA, 25 bp, S. cerevisiae
aaattgtaccttcctcatacgtgag

SEQ ID NO: 12753 - DNA, 25 bp, S. cerevisiae
aacattgagtgcagagtccctttct

SEQ ID NO: 12754 - DNA, 25 bp, S. cerevisiae
aaatcaagagtacttccgccgttgc

SEQ ID NO: 12755 - DNA, 25 bp, S. cerevisiae
aaataactctacatcggccactgta

SEQ ID NO: 12756 - DNA, 25 bp, S. cerevisiae
aaattacctggatggccatctgctg

SEQ ID NO: 12757 - DNA, 25 bp, S. cerevisiae
aaattacttggaagacgcacgtcga

SEQ ID NO: 12758 - DNA, 25 bp, S. cerevisiae
aaattcgttggacagtacttgcaga

SEQ ID NO: 12759 - DNA, 25 bp, S. cerevisiae
aaatttttggtcagtgccgctgcag

SEQ ID NO: 12760 - DNA, 25 bp, S. cerevisiae
acaatcttttgtgcacgtggttaga

SEQ ID NO: 12761 - DNA, 25 bp, S. cerevisiae
aaatttagccgttcagtcctatatg

SEQ ID NO: 12762 - DNA, 25 bp, S. cerevisiae
aaattctagccaagacgtccctatg

SEQ ID NO: 12763 - DNA, 25 bp, S. cerevisiae
aaattgctcctctgggttgtgctat

SEQ ID NO: 12764 - DNA, 25 bp, S. cerevisiae
aaattggactgtttctccggcattg

SEQ ID NO: 12765 - DNA, 25 bp, S. cerevisiae
aaattaagcttagtgctccggctgg

SEQ ID NO: 12766 - DNA, 25 bp, S. cerevisiae
acaatataccactagattctctgcg

SEQ ID NO: 12767 - DNA, 25 bp, S. cerevisiae
acaatattcaagtggattcgcgcta

SEQ ID NO: 12768 - DNA, 25 bp, S. cerevisiae
acaatttctttcgagttcatcatga

SEQ ID NO: 12769 - DNA, 25 bp, S. cerevisiae
acaatattctcagtacgtgtcttga

SEQ ID NO: 12770 - DNA, 25 bp, S. cerevisiae
aaattagctcgtgctccaatcgaaa

SEQ ID NO: 12771 - DNA, 25 bp, S. cerevisiae
acaattccacgagttcgtactcaaa

SEQ ID NO: 12772 - DNA, 25 bp, S. cerevisiae
acaagtctccggattgtggatccag

SEQ ID NO: 12773 - DNA, 25 bp, S. cerevisiae
aaatttctcagtatgatccggtcga

SEQ ID NO: 12774 - DNA, 25 bp, S. cerevisiae
aaattttgcgtttggccttgatgga

SEQ ID NO: 12775 - DNA, 25 bp, S. cerevisiae
aaattgtatcacttctgagacttag

SEQ ID NO: 12776 - DNA, 25 bp, S. cerevisiae
aaatttgatgactcttcctatagga

SEQ ID NO: 12777 - DNA, 25 bp, S. cerevisiae
acaatattcgtcgattcccgagaga

SEQ ID NO: 12778 - DNA, 25 bp, S. cerevisiae
acaatgaccgcggagatccttagaa

SEQ ID NO: 12779 - DNA, 25 bp, S. cerevisiae
aaatacgctcatcaatccttcggta

SEQ ID NO: 12780 - DNA, 25 bp, S. cerevisiae
aaatcagcagtaccgagcgtttggg

SEQ ID NO: 12781 - DNA, 25 bp, S. cerevisiae
aaattgcatcctcagacttcttgac

SEQ ID NO: 12782 - DNA, 25 bp, S. cerevisiae
aaattatggctcacgcttttggcag

SEQ ID NO: 12783 - DNA, 25 bp, S. cerevisiae
aaatattggcttgagcctgcgggct

SEQ ID NO: 12784 - DNA, 25 bp, S. cerevisiae
aaataggtgcgtggactctggacat

SEQ ID NO: 12785 - DNA, 25 bp, S. cerevisiae
aaatcagcgggtgagcccaccagat

SEQ ID NO: 12786 - DNA, 25 bp, S. cerevisiae
aaatcaccaggtggcccaagacaga

SEQ ID NO: 12787 - DNA, 25 bp, S. cerevisiae
aaatgcctagaggtgttccagtagc

SEQ ID NO: 12788 - DNA, 25 bp, S. cerevisiae
aaattaggtcagctgatgagccgat

SEQ ID NO: 12789 - DNA, 25 bp, S. cerevisiae
aaattcacgatcgtggcggcctgat

SEQ ID NO: 12790 - DNA, 25 bp, S. cerevisiae
aaatctagaaatcatgggcgcaatt

SEQ ID NO: 12791 - DNA, 25 bp, S. cerevisiae
aaatttgacaatcggcggcggcaac

SEQ ID NO: 12792 - DNA, 25 bp, S. cerevisiae
aaatgttggcaactgggctcaggaa

SEQ ID NO: 12793 - DNA, 25 bp, S. cerevisiae
aaatatgggacactgctgggcaaga

SEQ ID NO: 12794 - DNA, 25 bp, S. cerevisiae
aaattggttgaagtgctcggcatca

SEQ ID NO: 12795 - DNA, 25 bp, S. cerevisiae
aaatttcatgtcaccgcattgggcg

SEQ ID NO: 12796 - DNA, 25 bp, S. cerevisiae
aaattggagctgacaccgaagcgga

SEQ ID NO: 12797 - DNA, 25 bp, S. cerevisiae
aaattgatgctgcactcgacaagca

SEQ ID NO: 12798 - DNA, 25 bp, S. cerevisiae
aaattgctagatgctccagctgcca

SEQ ID NO: 12799 - DNA, 25 bp, S. cerevisiae
aaatagcattgcttccggcgctgat

SEQ ID NO: 12800 - DNA, 25 bp, S. cerevisiae
aaattgttgctgaccgtccagatgt

SEQ ID NO: 12801 - DNA, 25 bp, S. cerevisiae
aaatctttggaaatggtcgacacct

SEQ ID NO: 12802 - DNA, 25 bp, S. cerevisiae
acaatgcttcgaaatggatcctcaa

SEQ ID NO: 12803 - DNA, 25 bp, S. cerevisiae
acaatctgttgttatgggctccgag

SEQ ID NO: 12804 - DNA, 25 bp, S. cerevisiae
aaatcatgggtgtgggccctgcata

SEQ ID NO: 12805 - DNA, 25 bp, S. cerevisiae
aaatcattcgatctaaccacactag

SEQ ID NO: 12806 - DNA, 25 bp, S. cerevisiae
aaatccatcgagttagacccctcat

SEQ ID NO: 12807 - DNA, 25 bp, S. cerevisiae
aaatgccactgggtaacgccactaa

SEQ ID NO: 12808 - DNA, 25 bp, S. cerevisiae
aaatgctactgtgccaatctccatt

SEQ ID NO: 12809 - DNA, 25 bp, S. cerevisiae
aaataatagcgcatgccgatccctc

SEQ ID NO: 12810 - DNA, 25 bp, S. cerevisiae
aaataaggcagaggcccagctccga

SEQ ID NO: 12811 - DNA, 25 bp, S. cerevisiae
aaatctgtatgctagctggtacccc

SEQ ID NO: 12812 - DNA, 25 bp, S. cerevisiae
aaattggcagctttggaatccccac

SEQ ID NO: 12813 - DNA, 25 bp, S. cerevisiae
aaattcttgcttgggaaggcctccg

SEQ ID NO: 12814 - DNA, 25 bp, S. cerevisiae
aaattcgtgttgctgacagatcaca

SEQ ID NO: 12815 - DNA, 25 bp, S. cerevisiae
aaattggtgttgctgacgctatcaa

SEQ ID NO: 12816 - DNA, 25 bp, S. cerevisiae
aaattcttggatctgagggctatca

SEQ ID NO: 12817 - DNA, 25 bp, S. cerevisiae
aaatatcttcgcactatgggtctcg

SEQ ID NO: 12818 - DNA, 25 bp, S. cerevisiae
aaattcctgaattgcctcaaaccat

SEQ ID NO: 12819 - DNA, 25 bp, S. cerevisiae
aaattccagctgatcaacaacccat

SEQ ID NO: 12820 - DNA, 25 bp, S. cerevisiae
aaatatccgctatcaacagaacccc

SEQ ID NO: 12821 - DNA, 25 bp, S. cerevisiae
aaatccgctagtgctgctttaggta

SEQ ID NO: 12822 - DNA, 25 bp, S. cerevisiae
aaattcgtcgatgggctttacgcgc

SEQ ID NO: 12823 - DNA, 25 bp, S. cerevisiae
aaatatgcttccaaggctgttccac

SEQ ID NO: 12824 - DNA, 25 bp, S. cerevisiae
aaattctttcgaatgcttctgcctc

SEQ ID NO: 12825 - DNA, 25 bp, S. cerevisiae
aaattcacttgtatttctggtaaga

SEQ ID NO: 12826 - DNA, 25 bp, S. cerevisiae
aaatgatcggttccgtcgtcggtat

SEQ ID NO: 12827 - DNA, 25 bp, S. cerevisiae
acaatacgttactgtcaccggtgca

SEQ ID NO: 12828 - DNA, 25 bp, S. cerevisiae
aaatacattacaaggccactccgca

SEQ ID NO: 12829 - DNA, 25 bp, S. cerevisiae
aaatccttagaaagccccactgacg

SEQ ID NO: 12830 - DNA, 25 bp, S. cerevisiae
aaatcctaaagacgacccagtgaag

SEQ ID NO: 12831 - DNA, 25 bp, S. cerevisiae
aaatttgccagacccatctagagat

SEQ ID NO: 12832 - DNA, 25 bp, S. cerevisiae
aaatcaatgcctgagccactgggac

SEQ ID NO: 12833 - DNA, 25 bp, S. cerevisiae
aaatcaaactgcctcgagtctgacg

SEQ ID NO: 12834 - DNA, 25 bp, S. cerevisiae
aaattcatactgctgcgattgctgc

SEQ ID NO: 12835 - DNA, 25 bp, S. cerevisiae
acaatctgtgccatttctggtcaaa

SEQ ID NO: 12836 - DNA, 25 bp, S. cerevisiae
aaattctccaatttctgttgatagc

SEQ ID NO: 12837 - DNA, 25 bp, S. cerevisiae
aaattggatgcattttttcctatta

SEQ ID NO: 12838 - DNA, 25 bp, S. cerevisiae
aaattgttatacgatggctcaccag

SEQ ID NO: 12839 - DNA, 25 bp, S. cerevisiae
aaatgattataatgcggctaccgtg

SEQ ID NO: 12840 - DNA, 25 bp, S. cerevisiae
aaatagtaacattcaggctgagcac

SEQ ID NO: 12841 - DNA, 25 bp, S. cerevisiae
aaatgacccatgctaaagacgattc

SEQ ID NO: 12842 - DNA, 25 bp, S. cerevisiae
aaatcacgcgcttaagaatacgggc

SEQ ID NO: 12843 - DNA, 25 bp, S. cerevisiae
aaatccactcatttaactccggagg

SEQ ID NO: 12844 - DNA, 25 bp, S. cerevisiae
aaatctgcgattctaacccggcaat

SEQ ID NO: 12845 - DNA, 25 bp, S. cerevisiae
acaattgactacctttctccagaaa

SEQ ID NO: 12846 - DNA, 25 bp, S. cerevisiae
aaatattccccactacgccaagaat

SEQ ID NO: 12847 - DNA, 25 bp, S. cerevisiae
aaatttcctagcaccagcagaacct

SEQ ID NO: 12848 - DNA, 25 bp, S. cerevisiae
aaatatccctgtcgacgaggaccct

SEQ ID NO: 12849 - DNA, 25 bp, S. cerevisiae
aaatattcctcacgatctgacgacg

SEQ ID NO: 12850 - DNA, 25 bp, S. cerevisiae
aaatcagattctcatcagcgctacc

SEQ ID NO: 12851 - DNA, 25 bp, S. cerevisiae
aaattggctcatccactagtatccc

SEQ ID NO: 12852 - DNA, 25 bp, S. cerevisiae
aaattggtgctgcttatgtctgccc

SEQ ID NO: 12853 - DNA, 25 bp, S. cerevisiae
aaattgtcgccgctgatgactcttc

SEQ ID NO: 12854 - DNA, 25 bp, S. cerevisiae
aaatagattcgctgcaagtttgtga

SEQ ID NO: 12855 - DNA, 25 bp, S. cerevisiae
aaattgttcctccaagcggtatgac

SEQ ID NO: 12856 - DNA, 25 bp, S. cerevisiae
aaattgctttccaagacagcggata

SEQ ID NO: 12857 - DNA, 25 bp, S. cerevisiae
aaattcgtgctcgacaacgacgtaa

SEQ ID NO: 12858 - DNA, 25 bp, S. cerevisiae
aaattggtctattcttcgtcttgga

SEQ ID NO: 12859 - DNA, 25 bp, S. cerevisiae
aaattccctaacttcgatctttctg

SEQ ID NO: 12860 - DNA, 25 bp, S. cerevisiae
aaattccccaatttgcatgtcttga

SEQ ID NO: 12861 - DNA, 25 bp, S. cerevisiae
aaattggccttcatactttagtgtt

SEQ ID NO: 12862 - DNA, 25 bp, S. cerevisiae
aaattggccgtcttcattttgagat

SEQ ID NO: 12863 - DNA, 25 bp, S. cerevisiae
aagttgtggttctaccagatccgtc

SEQ ID NO: 12864 - DNA, 25 bp, S. cerevisiae
aaattctaggtattctcagaccgaa

SEQ ID NO: 12865 - DNA, 25 bp, S. cerevisiae
aaatctaacgagtgcaccaccggtc

SEQ ID NO: 12866 - DNA, 25 bp, S. cerevisiae
aacattcaaaaattcacccgtggtg

SEQ ID NO: 12867 - DNA, 25 bp, S. cerevisiae
aaattgctacagctgaaccctggtc

SEQ ID NO: 12868 - DNA, 25 bp, S. cerevisiae
aaattaagatccaccgctagcacag

SEQ ID NO: 12869 - DNA, 25 bp, S. cerevisiae
aaattttgacggactcgctagcacc

SEQ ID NO: 12870 - DNA, 25 bp, S. cerevisiae
aaatctttagcgacttcttgaccac

SEQ ID NO: 12871 - DNA, 25 bp, S. cerevisiae
aaatacattccaatcctttgtcccg

SEQ ID NO: 12872 - DNA, 25 bp, S. cerevisiae
aaatacagaactacctctttccctg

SEQ ID NO: 12873 - DNA, 25 bp, S. cerevisiae
aaattcaaggttctcgacgctggtg

SEQ ID NO: 12874 - DNA, 25 bp, S. cerevisiae
aaattccattttatctgagcgaggg

SEQ ID NO: 12875 - DNA, 25 bp, S. cerevisiae
aaattcgatatgtccttacagcaag

SEQ ID NO: 12876 - DNA, 25 bp, S. cerevisiae
aaattcatcatcagccgttcataag

SEQ ID NO: 12877 - DNA, 25 bp, S. cerevisiae
aaatagattcggtgtcctgccagac

SEQ ID NO: 12878 - DNA, 25 bp, S. cerevisiae
aaattggcccttcatggtattcctg

SEQ ID NO: 12879 - DNA, 25 bp, S. cerevisiae
aaatttccactatcaggtctttcag

SEQ ID NO: 12880 - DNA, 25 bp, S. cerevisiae
aaatcacgcacacgaggactttctt

SEQ ID NO: 12881 - DNA, 25 bp, S. cerevisiae
aaatcctgtacgagctgtttttcca

SEQ ID NO: 12882 - DNA, 25 bp, S. cerevisiae
aaattgtttggctctgttcctggat

SEQ ID NO: 12883 - DNA, 25 bp, S. cerevisiae
aaatttgcacagagcgtcttgccgt

SEQ ID NO: 12884 - DNA, 25 bp, S. cerevisiae
aaatctctcaggttttggtaatata

SEQ ID NO: 12885 - DNA, 25 bp, S. cerevisiae
aaattctcactttatttgcgccaat

SEQ ID NO: 12886 - DNA, 25 bp, S. cerevisiae
aaattcgatatttgtgcagccacct

SEQ ID NO: 12887 - DNA, 25 bp, S. cerevisiae
aaattcctctttgggtcacagtctc

SEQ ID NO: 12888 - DNA, 25 bp, S. cerevisiae
aaattcccatggttgtggcgccttt

SEQ ID NO: 12889 - DNA, 25 bp, S. cerevisiae
aaattccacttgttggtgccgggct

SEQ ID NO: 12890 - DNA, 25 bp, S. cerevisiae
aaattgctactttcttggagggaga

SEQ ID NO: 12891 - DNA, 25 bp, S. cerevisiae
aaattgcctatatcggtgcctctgc

SEQ ID NO: 12892 - DNA, 25 bp, S. cerevisiae
aaatatgcggaatccagtctggacc

SEQ ID NO: 12893 - DNA, 25 bp, S. cerevisiae
aaattgcctttgactgcttctgtgc

SEQ ID NO: 12894 - DNA, 25 bp, S. cerevisiae
aaattgctttgcatttcggtgcttc

SEQ ID NO: 12895 - DNA, 25 bp, S. cerevisiae
aaatcttttcagactacgggctgtt

SEQ ID NO: 12896 - DNA, 25 bp, S. cerevisiae
aaatgatcctaccttagcataccct

SEQ ID NO: 12897 - DNA, 25 bp, S. cerevisiae
aaattcatctcgcttacttgtcact

SEQ ID NO: 12898 - DNA, 25 bp, S. cerevisiae
aaattgttgacaggccagttttgaa

SEQ ID NO: 12899 - DNA, 25 bp, S. cerevisiae
aaattgagttcagtcccttcttgca

SEQ ID NO: 12900 - DNA, 25 bp, S. cerevisiae
aaataggctcatacccacattttgg

SEQ ID NO: 12901 - DNA, 25 bp, S. cerevisiae
aaagccgactttcacgcctttggat

SEQ ID NO: 12902 - DNA, 25 bp, S. cerevisiae
aaataaatcattcacctaccgcaac

SEQ ID NO: 12903 - DNA, 25 bp, S. cerevisiae
aaatttggcgataccttgccacggt

SEQ ID NO: 12904 - DNA, 25 bp, S. cerevisiae
aaattctttatcgtttgccatcggt

SEQ ID NO: 12905 - DNA, 25 bp, S. cerevisiae
aaatttcttcccacaagagcacatg

SEQ ID NO: 12906 - DNA, 25 bp, S. cerevisiae
aaatttctgtcattttcaggaacaa

SEQ ID NO: 12907 - DNA, 25 bp, S. cerevisiae
aaattccccaccgaatacatcaaag

SEQ ID NO: 12908 - DNA, 25 bp, S. cerevisiae
aaattccccgcaactaaacatagag

SEQ ID NO: 12909 - DNA, 25 bp, S. cerevisiae
aaattaccaccatctttatcggagg

SEQ ID NO: 12910 - DNA, 25 bp, S. cerevisiae
aaatatcccgcttctgattaatcag

SEQ ID NO: 12911 - DNA, 25 bp, S. cerevisiae
aaattctttgatcgcaacatgctca

SEQ ID NO: 12912 - DNA, 25 bp, S. cerevisiae
aaattctacttctcatctatcatcg

SEQ ID NO: 12913 - DNA, 25 bp, S. cerevisiae
aaatgctgccataatgggcgcgcat

SEQ ID NO: 12914 - DNA, 25 bp, S. cerevisiae
aaatttcacagcgaaccagatcgag

SEQ ID NO: 12915 - DNA, 25 bp, S. cerevisiae
aaataccacatccattgctgaggct

SEQ ID NO: 12916 - DNA, 25 bp, S. cerevisiae
aaataccccgatgctggtcttttat

SEQ ID NO: 12917 - DNA, 25 bp, S. cerevisiae
aaattcgtccgcactaacttattct

SEQ ID NO: 12918 - DNA, 25 bp, S. cerevisiae
aaatgggatccctctaaacctatct

SEQ ID NO: 12919 - DNA, 25 bp, S. cerevisiae
aaagtagtccgtctattacccatca

SEQ ID NO: 12920 - DNA, 25 bp, S. cerevisiae
aaatgaagttcgcaaattaccacgc

SEQ ID NO: 12921 - DNA, 25 bp, S. cerevisiae
ctaacaacttcgcagctattaccaa

SEQ ID NO: 12922 - DNA, 25 bp, S. cerevisiae
aaatcaacttctcagttttcccagg

SEQ ID NO: 12923 - DNA, 25 bp, S. cerevisiae
tacggacgttgttttccctgtacat

SEQ ID NO: 12924 - DNA, 25 bp, S. cerevisiae
cacggacgttggcttcttttaatga

SEQ ID NO: 12925 - DNA, 25 bp, S. cerevisiae
aaaaacggagcagctttcggtgtca

SEQ ID NO: 12926 - DNA, 25 bp, S. cerevisiae
aaatactgtgcatggcatcccgtgc

SEQ ID NO: 12927 - DNA, 25 bp, S. cerevisiae
aaatatcaagatcctatcccgctga

SEQ ID NO: 12928 - DNA, 25 bp, S. cerevisiae
aaatctagaatctcgtccgcttcaa

SEQ ID NO: 12929 - DNA, 25 bp, S. cerevisiae
aaatatgaggcccttttccatgcac

SEQ ID NO: 12930 - DNA, 25 bp, S. cerevisiae
aaatcatacctctacttcgacaaac

SEQ ID NO: 12931 - DNA, 25 bp, S. cerevisiae
aaattcctgctctactcctcaaaag

SEQ ID NO: 12932 - DNA, 25 bp, S. cerevisiae
aaattccactccttcttcaagacat

SEQ ID NO: 12933 - DNA, 25 bp, S. cerevisiae
aaatttgactctcattgcagctcct

SEQ ID NO: 12934 - DNA, 25 bp, S. cerevisiae
aaattccatggtcgcggatgaacgg

SEQ ID NO: 12935 - DNA, 25 bp, S. cerevisiae
aaattcctcatattacgctgtgcaa

SEQ ID NO: 12936 - DNA, 25 bp, S. cerevisiae
aaatatcagctcttcaactgcagaa

SEQ ID NO: 12937 - DNA, 25 bp, S. cerevisiae
aaatatcattcagtttcgacacaag

SEQ ID NO: 12938 - DNA, 25 bp, S. cerevisiae
aaatgccaccagaacgaagccaatg

SEQ ID NO: 12939 - DNA, 25 bp, S. cerevisiae
aaattcatcctgttctttgactgcc

SEQ ID NO: 12940 - DNA, 25 bp, S. cerevisiae
aaattactgccgctttggtcacttt

SEQ ID NO: 12941 - DNA, 25 bp, S. cerevisiae
aaatccaactcagagcagggcaaga

SEQ ID NO: 12942 - DNA, 25 bp, S. cerevisiae
aaatctagactaccacaggacgata

SEQ ID NO: 12943 - DNA, 25 bp, S. cerevisiae
aaatccgaaagcgtcagtgccgctt

SEQ ID NO: 12944 - DNA, 25 bp, S. cerevisiae
aaatctgcgcagcatttccgagttt

SEQ ID NO: 12945 - DNA, 25 bp, S. cerevisiae
aaatgacgatgccacaaaccactct

SEQ ID NO: 12946 - DNA, 25 bp, S. cerevisiae
aaattctctgcgacttgcaccaata

SEQ ID NO: 12947 - DNA, 25 bp, S. cerevisiae
aaatttctggcgtcagtttggcaat

SEQ ID NO: 12948 - DNA, 25 bp, S. cerevisiae
aaatactcagtttcgacagttcaat

SEQ ID NO: 12949 - DNA, 25 bp, S. cerevisiae
aaataactcattcagacgtgtccat

SEQ ID NO: 12950 - DNA, 25 bp, S. cerevisiae
aaattcgttctctcaggtgctaata

SEQ ID NO: 12951 - DNA, 25 bp, S. cerevisiae
aaattcatattccatacgccgcgaa

SEQ ID NO: 12952 - DNA, 25 bp, S. cerevisiae
aaattcactttagcaaccgccagag

SEQ ID NO: 12953 - DNA, 25 bp, S. cerevisiae
aaatctatggttgttcggcccagaa

SEQ ID NO: 12954 - DNA, 25 bp, S. cerevisiae
aaatcttttctctggtggagcggct

SEQ ID NO: 12955 - DNA, 25 bp, S. cerevisiae
aaatcttgttgcgacgatggcgact

SEQ ID NO: 12956 - DNA, 25 bp, S. cerevisiae
aaattcgtaccggtgatggctccag

SEQ ID NO: 12957 - DNA, 25 bp, S. cerevisiae
aaattctgatacctcctcttgatag

SEQ ID NO: 12958 - DNA, 25 bp, S. cerevisiae
aaatctcgtgggtacctattcagtg

SEQ ID NO: 12959 - DNA, 25 bp, S. cerevisiae
aaattttggaatatgctaacttgaa

SEQ ID NO: 12960 - DNA, 25 bp, S. cerevisiae
aaatctattgtggttctgcaaactt

SEQ ID NO: 12961 - DNA, 25 bp, S. cerevisiae
aaattttgatgcgttccacagaatg

SEQ ID NO: 12962 - DNA, 25 bp, S. cerevisiae
aaattcactgatgcatggcgtctga

SEQ ID NO: 12963 - DNA, 25 bp, S. cerevisiae
aaatctcagctggactgggctagtt

SEQ ID NO: 12964 - DNA, 25 bp, S. cerevisiae
aaagcccatcagtttgcctaatttt

SEQ ID NO: 12965 - DNA, 25 bp, S. cerevisiae
aaatcacccgatctgcctgaatatt

SEQ ID NO: 12966 - DNA, 25 bp, S. cerevisiae
aaatacctggatccgactgaattgc

SEQ ID NO: 12967 - DNA, 25 bp, S. cerevisiae
aaataccttgtgacagttgtactga

SEQ ID NO: 12968 - DNA, 25 bp, S. cerevisiae
aaataactgctggaatgctttgaaa

SEQ ID NO: 12969 - DNA, 25 bp, S. cerevisiae
aaattaggctgtcattctgctccaa

SEQ ID NO: 12970 - DNA, 25 bp, S. cerevisiae
aaatctctacgcaagtccactatta

SEQ ID NO: 12971 - DNA, 25 bp, S. cerevisiae
aaatgcttacccatcgaatttgatt

SEQ ID NO: 12972 - DNA, 25 bp, S. cerevisiae
aaatcacaacccactgaatctcagt

SEQ ID NO: 12973 - DNA, 25 bp, S. cerevisiae
aaatctaactccaacgtatccactt

SEQ ID NO: 12974 - DNA, 25 bp, S. cerevisiae
aaattcatttctacctttctcactt

SEQ ID NO: 12975 - DNA, 25 bp, S. cerevisiae
aaatctattactaccattgacccca

SEQ ID NO: 12976 - DNA, 25 bp, S. cerevisiae
aaatttacaaccaatcgctgcccaa

SEQ ID NO: 12977 - DNA, 25 bp, S. cerevisiae
aaattaaggtcctaccatgccgcta

SEQ ID NO: 12978 - DNA, 25 bp, S. cerevisiae
aaatatacacctccataaatgcccc

SEQ ID NO: 12979 - DNA, 25 bp, S. cerevisiae
aaattatcgaccttcaaacctgcgc

SEQ ID NO: 12980 - DNA, 25 bp, S. cerevisiae
aaatctggtccgttccattacgaga

SEQ ID NO: 12981 - DNA, 25 bp, S. cerevisiae
aaatcaacaacgtctccggcatggg

SEQ ID NO: 12982 - DNA, 25 bp, S. cerevisiae
aaattagcgctgcttccatgtggtc

SEQ ID NO: 12983 - DNA, 25 bp, S. cerevisiae
aaataagtcacacgctctgggtcat

SEQ ID NO: 12984 - DNA, 25 bp, S. cerevisiae
aaatgctgacaacgtcgagtggtaa

SEQ ID NO: 12985 - DNA, 25 bp, S. cerevisiae
aaatcatctcaaggtcacgtgacta

SEQ ID NO: 12986 - DNA, 25 bp, S. cerevisiae
aaatttgcagagttgagcgtttcag

SEQ ID NO: 12987 - DNA, 25 bp, S. cerevisiae
aaatttcttattttcaccagtccat

SEQ ID NO: 12988 - DNA, 25 bp, S. cerevisiae
aaatttgttagtttgcccatggcgt

SEQ ID NO: 12989 - DNA, 25 bp, S. cerevisiae
aaatattagttccaccgacgcagag

SEQ ID NO: 12990 - DNA, 25 bp, S. cerevisiae
aaatcttgctcgtcgaagacaccga

SEQ ID NO: 12991 - DNA, 25 bp, S. cerevisiae
aaatatcttacagtcaaggcccgat

SEQ ID NO: 12992 - DNA, 25 bp, S. cerevisiae
aaattttctcaacaggccatggatg

SEQ ID NO: 12993 - DNA, 25 bp, S. cerevisiae
aaatttttcaatcccgctatcagag

SEQ ID NO: 12994 - DNA, 25 bp, S. cerevisiae
aaatcttttaatccacttcagaatg

SEQ ID NO: 12995 - DNA, 25 bp, S. cerevisiae
aaatctctccatgaaatgtgcggta

SEQ ID NO: 12996 - DNA, 25 bp, S. cerevisiae
aaatttcaacgtatgctggcagtgc

SEQ ID NO: 12997 - DNA, 25 bp, S. cerevisiae
aaatttatcctcctttggtcgagca

SEQ ID NO: 12998 - DNA, 25 bp, S. cerevisiae
aaatttcctgtcttactgcactttc

SEQ ID NO: 12999 - DNA, 25 bp, S. cerevisiae
aaattacgctactaactggcttcca

SEQ ID NO: 13000 - DNA, 25 bp, S. cerevisiae
aaatgattccttgagccggttaaat

SEQ ID NO: 13001 - DNA, 25 bp, S. cerevisiae
aaatggtggtctgaaacgtaacaat

SEQ ID NO: 13002 - DNA, 25 bp, S. cerevisiae
aaaggactcagtgtgcccgaaaaat

SEQ ID NO: 13003 - DNA, 25 bp, S. cerevisiae
aagatggacctgaggccggacagtc

SEQ ID NO: 13004 - DNA, 25 bp, S. cerevisiae
aaatcgaactgaaaccggcacgctc

SEQ ID NO: 13005 - DNA, 25 bp, S. cerevisiae
aaatctgaatctaccctaggccgag

SEQ ID NO: 13006 - DNA, 25 bp, S. cerevisiae
aaatctacatctacttgggaagcga

SEQ ID NO: 13007 - DNA, 25 bp, S. cerevisiae
aaatactctatcgtgctactaaggg

SEQ ID NO: 13008 - DNA, 25 bp, S. cerevisiae
aaataattcgtttgcgccaagtccg

SEQ ID NO: 13009 - DNA, 25 bp, S. cerevisiae
aaatacgtttgtccctaagtgctct

SEQ ID NO: 13010 - DNA, 25 bp, S. cerevisiae
aaatcccagcttggttcttgaaccg

SEQ ID NO: 13011 - DNA, 25 bp, S. cerevisiae
aaatactttcagttcatctccaccc

SEQ ID NO: 13012 - DNA, 25 bp, S. cerevisiae
aaatgatcaggaggccacaactaca

SEQ ID NO: 13013 - DNA, 25 bp, S. cerevisiae
aaatatgcattatgccccacaacaa

SEQ ID NO: 13014 - DNA, 25 bp, S. cerevisiae
aaatacgctgaacccgaacatagaa

SEQ ID NO: 13015 - DNA, 25 bp, S. cerevisiae
aaatccgtcggagatgaagctacaa

SEQ ID NO: 13016 - DNA, 25 bp, S. cerevisiae
aaatctaccgttcccagtgcaataa

SEQ ID NO: 13017 - DNA, 25 bp, S. cerevisiae
aaatcgaaagcttgcccggcttaag

SEQ ID NO: 13018 - DNA, 25 bp, S. cerevisiae
aaatcgctaacttctatcatgccgg

SEQ ID NO: 13019 - DNA, 25 bp, S. cerevisiae
aaattagtctttcgctcctatctga

SEQ ID NO: 13020 - DNA, 25 bp, S. cerevisiae
aaattatcctattgtctccttctct

SEQ ID NO: 13021 - DNA, 25 bp, S. cerevisiae
aaatctccggtatctttggtgaaat

SEQ ID NO: 13022 - DNA, 25 bp, S. cerevisiae
aaatctacgggattctcttcctgaa

SEQ ID NO: 13023 - DNA, 25 bp, S. cerevisiae
aaattatctccgatgcttccggaaa

SEQ ID NO: 13024 - DNA, 25 bp, S. cerevisiae
aaatttcctgagactttccttgaat

SEQ ID NO: 13025 - DNA, 25 bp, S. cerevisiae
aaatttatcgcatctcagctccttg

SEQ ID NO: 13026 - DNA, 25 bp, S. cerevisiae
aaattttcgctgtccatcatcgttg

SEQ ID NO: 13027 - DNA, 25 bp, S. cerevisiae
aaatttgattgggactcctgcccta

SEQ ID NO: 13028 - DNA, 25 bp, S. cerevisiae
aaatctactttgacgatggcacggt

SEQ ID NO: 13029 - DNA, 25 bp, S. cerevisiae
aaatccagtatttcgggcacgtctt

SEQ ID NO: 13030 - DNA, 25 bp, S. cerevisiae
aaatttgtgctcgacttgcaagtaa

SEQ ID NO: 13031 - DNA, 25 bp, S. cerevisiae
aaatatccgtgcaagactctaatgt

SEQ ID NO: 13032 - DNA, 25 bp, S. cerevisiae
aaatttccatgcagacactttgtcc

SEQ ID NO: 13033 - DNA, 25 bp, S. cerevisiae
aaatcttccatgagagaggcccagc

SEQ ID NO: 13034 - DNA, 25 bp, S. cerevisiae
aaatagctctttggcggtgctacac

SEQ ID NO: 13035 - DNA, 25 bp, S. cerevisiae
aaatagttctattgctcgttataca

SEQ ID NO: 13036 - DNA, 25 bp, S. cerevisiae
aaataccatggattgtttctgaaca

SEQ ID NO: 13037 - DNA, 25 bp, S. cerevisiae
aaatgccaaagctgatcaacgaatc

SEQ ID NO: 13038 - DNA, 25 bp, S. cerevisiae
aaatcctcaagctgttgaccacatc

SEQ ID NO: 13039 - DNA, 25 bp, S. cerevisiae
aaatatctagttcctgctgacctta

SEQ ID NO: 13040 - DNA, 25 bp, S. cerevisiae
aaatttgctaatcctgcgcccttag

SEQ ID NO: 13041 - DNA, 25 bp, S. cerevisiae
aaatacggtgcctgttgcagcgaca

SEQ ID NO: 13042 - DNA, 25 bp, S. cerevisiae
aaatacgttcccgatgtcacataca

SEQ ID NO: 13043 - DNA, 25 bp, S. cerevisiae
aaatacttcgccgatttgactcaat

SEQ ID NO: 13044 - DNA, 25 bp, S. cerevisiae
aaatacgtctgtgtcttgcaccagg

SEQ ID NO: 13045 - DNA, 25 bp, S. cerevisiae
aaataagtccttacacgcacaagaa

SEQ ID NO: 13046 - DNA, 25 bp, S. cerevisiae
aaatatggcgagatcccaggatatc

SEQ ID NO: 13047 - DNA, 25 bp, S. cerevisiae
aaatttgcagactacccgctgatgt

SEQ ID NO: 13048 - DNA, 25 bp, S. cerevisiae
aaatttcagatattcctgctgcagg

SEQ ID NO: 13049 - DNA, 25 bp, S. cerevisiae
aaatttgctggttcttgcatcggct

SEQ ID NO: 13050 - DNA, 25 bp, S. cerevisiae
aaatttctgctgattgtacccattg

SEQ ID NO: 13051 - DNA, 25 bp, S. cerevisiae
aaatttgcgatttgtctgaccacat

SEQ ID NO: 13052 - DNA, 25 bp, S. cerevisiae
aaatcttggatttggccgacattac

SEQ ID NO: 13053 - DNA, 25 bp, S. cerevisiae
aaatgtttcgtatggctcgtatggc

SEQ ID NO: 13054 - DNA, 25 bp, S. cerevisiae
aaatcggtggtatagtagctctgtc

SEQ ID NO: 13055 - DNA, 25 bp, S. cerevisiae
aaatcgtcggtagaccactggcggc

SEQ ID NO: 13056 - DNA, 25 bp, S. cerevisiae
aaatgcggcggaaggcctcaatacg

SEQ ID NO: 13057 - DNA, 25 bp, S. cerevisiae
aagacggcgcagaaactgccgctac

SEQ ID NO: 13058 - DNA, 25 bp, S. cerevisiae
aaatacttatgttactgccgctgcc

SEQ ID NO: 13059 - DNA, 25 bp, S. cerevisiae
aaatcactgttgttaagccggactc

SEQ ID NO: 13060 - DNA, 25 bp, S. cerevisiae
aaatgacgagctcccaaagtatgaa

SEQ ID NO: 13061 - DNA, 25 bp, S. cerevisiae
aaatagactctaccattcactcagg

SEQ ID NO: 13062 - DNA, 25 bp, S. cerevisiae
aaataataatatccctactcctcct

SEQ ID NO: 13063 - DNA, 25 bp, S. cerevisiae
aaatatctacaaaccaatctcaccc

SEQ ID NO: 13064 - DNA, 25 bp, S. cerevisiae
aaatattgcatcttccagctccaaa

SEQ ID NO: 13065 - DNA, 25 bp, S. cerevisiae
aaatgcattatccatgcccaggatt

SEQ ID NO: 13066 - DNA, 25 bp, S. cerevisiae
aaatgcctgcagaagagttggacat

SEQ ID NO: 13067 - DNA, 25 bp, S. cerevisiae
aaatctgctaggtcaaatcgggcgc

SEQ ID NO: 13068 - DNA, 25 bp, S. cerevisiae
aaccccttctacatccgcgaggaat

SEQ ID NO: 13069 - DNA, 25 bp, S. cerevisiae
aaatctcgcttctgtacctggaaaa

SEQ ID NO: 13070 - DNA, 25 bp, S. cerevisiae
aacattcgttctctggatttaagga

SEQ ID NO: 13071 - DNA, 25 bp, S. cerevisiae
aaatatttgttgctggtttctaggc

SEQ ID NO: 13072 - DNA, 25 bp, S. cerevisiae
aaatttgcgtcttggctttttagca

SEQ ID NO: 13073 - DNA, 25 bp, S. cerevisiae
aaatcgcactgttagctgtcgccgg

SEQ ID NO: 13074 - DNA, 25 bp, S. cerevisiae
aaatggacacaatctttactggaag

SEQ ID NO: 13075 - DNA, 25 bp, S. cerevisiae
aaatcttgcactcatcgatcacagg

SEQ ID NO: 13076 - DNA, 25 bp, S. cerevisiae
aaatctccgcaggtcaatacagcag

SEQ ID NO: 13077 - DNA, 25 bp, S. cerevisiae
aaatctcctctgctacatgaacatg

SEQ ID NO: 13078 - DNA, 25 bp, S. cerevisiae
aaatcccactagacgtttctgacta

SEQ ID NO: 13079 - DNA, 25 bp, S. cerevisiae
aaatcagtcaagaaggccggcgcta

SEQ ID NO: 13080 - DNA, 25 bp, S. cerevisiae
aaatcactatccattttggcagatg

SEQ ID NO: 13081 - DNA, 25 bp, S. cerevisiae
aaatattactgcctttgcccatgag

SEQ ID NO: 13082 - DNA, 25 bp, S. cerevisiae
aaatgattacggtcctccaagaggt

SEQ ID NO: 13083 - DNA, 25 bp, S. cerevisiae
aaatctcaactttgcctccaagaaa

SEQ ID NO: 13084 - DNA, 25 bp, S. cerevisiae
aaatatggtttgtcgctacctgaga

SEQ ID NO: 13085 - DNA, 25 bp, S. cerevisiae
aaatcgcgtcttgcattgaccaaat

SEQ ID NO: 13086 - DNA, 25 bp, S. cerevisiae
aaatctgagttcgttgttccaacat

SEQ ID NO: 13087 - DNA, 25 bp, S. cerevisiae
aaatatggctctgcttgatccaaaa

SEQ ID NO: 13088 - DNA, 25 bp, S. cerevisiae
aaatcagcccatttttcgcaaaatt

SEQ ID NO: 13089 - DNA, 25 bp, S. cerevisiae
aaatcaatacggtttcgggcagcat

SEQ ID NO: 13090 - DNA, 25 bp, S. cerevisiae
aaatgaaacaggtcttgaagcgcaa

SEQ ID NO: 13091 - DNA, 25 bp, S. cerevisiae
aaatctaccgtcttatgctatgccc

SEQ ID NO: 13092 - DNA, 25 bp, S. cerevisiae
aaatctggcgacaatttgactgtgg

SEQ ID NO: 13093 - DNA, 25 bp, S. cerevisiae
aaatcgcgctgttatcttgactggt

SEQ ID NO: 13094 - DNA, 25 bp, S. cerevisiae
aaatgactcgtgttccaacggatga

SEQ ID NO: 13095 - DNA, 25 bp, S. cerevisiae
aaatatctcttctcgacggctatga

SEQ ID NO: 13096 - DNA, 25 bp, S. cerevisiae
aaatcttcattcacgcagcagggta

SEQ ID NO: 13097 - DNA, 25 bp, S. cerevisiae
aaatctatgttcaaccagggtaagg

SEQ ID NO: 13098 - DNA, 25 bp, S. cerevisiae
aaaggagccgaatacgtctgctcgc

SEQ ID NO: 13099 - DNA, 25 bp, S. cerevisiae
tattaaggccgcaagggttcattcc

SEQ ID NO: 13100 - DNA, 25 bp, S. cerevisiae
aaatcggccacttgggtgtcttgca

SEQ ID NO: 13101 - DNA, 25 bp, S. cerevisiae
aaatcggttgaatcatttccagcaa

SEQ ID NO: 13102 - DNA, 25 bp, S. cerevisiae
aaatcatttctatcaccatttccca

SEQ ID NO: 13103 - DNA, 25 bp, S. cerevisiae
aaatatctgatttacctttccggca

SEQ ID NO: 13104 - DNA, 25 bp, S. cerevisiae
aaatccacagggttttcctcaggat

SEQ ID NO: 13105 - DNA, 25 bp, S. cerevisiae
aaatgtacaagcagtcttcctcggg

SEQ ID NO: 13106 - DNA, 25 bp, S. cerevisiae
aaatgataaatcactctccgccgaa

SEQ ID NO: 13107 - DNA, 25 bp, S. cerevisiae
aaatcacctatttctccaaacagtt

SEQ ID NO: 13108 - DNA, 25 bp, S. cerevisiae
aaatagacgaattccaccaccaggt

SEQ ID NO: 13109 - DNA, 25 bp, S. cerevisiae
aaatcttccctcatttacaaagcgc

SEQ ID NO: 13110 - DNA, 25 bp, S. cerevisiae
aaagttcccaaatgacgccaacgca

SEQ ID NO: 13111 - DNA, 25 bp, S. cerevisiae
aaatggtctccagcttacggaacgc

SEQ ID NO: 13112 - DNA, 25 bp, S. cerevisiae
aaatcagacccatatcttcgtccag

SEQ ID NO: 13113 - DNA, 25 bp, S. cerevisiae
aaatcagtccatgtggatctttcat

SEQ ID NO: 13114 - DNA, 25 bp, S. cerevisiae
aaatactctatcaatggcatcttta

SEQ ID NO: 13115 - DNA, 25 bp, S. cerevisiae
aaatagtctaccagcatctttaccc

SEQ ID NO: 13116 - DNA, 25 bp, S. cerevisiae
aaatctttattcttggctcttctta

SEQ ID NO: 13117 - DNA, 25 bp, S. cerevisiae
aaatcgcatctttggaagcccattt

SEQ ID NO: 13118 - DNA, 25 bp, S. cerevisiae
aaatcaaatcctgcttgttcgtatt

SEQ ID NO: 13119 - DNA, 25 bp, S. cerevisiae
aaataacatcagtcgagggtccttt

SEQ ID NO: 13120 - DNA, 25 bp, S. cerevisiae
aaatcaactcaaacctgctgtagcg

SEQ ID NO: 13121 - DNA, 25 bp, S. cerevisiae
aaatcccttgcaggttcgatagctg

SEQ ID NO: 13122 - DNA, 25 bp, S. cerevisiae
aaatctgcatgtagcttgaaggaaa

SEQ ID NO: 13123 - DNA, 25 bp, S. cerevisiae
aaatgatgcttattctgatgacgag

SEQ ID NO: 13124 - DNA, 25 bp, S. cerevisiae
aaatccgcatgtacctgggcagcag

SEQ ID NO: 13125 - DNA, 25 bp, S. cerevisiae
aaatcttcttacctctgagccagca

SEQ ID NO: 13126 - DNA, 25 bp, S. cerevisiae
aaatctgcgccattttgtgagtcag

SEQ ID NO: 13127 - DNA, 25 bp, S. cerevisiae
aaatacggcatcaacgctgtcattg

SEQ ID NO: 13128 - DNA, 25 bp, S. cerevisiae
aaatacgtgtgcatccatggtggca

SEQ ID NO: 13129 - DNA, 25 bp, S. cerevisiae
aaatacccattttagctgcgccatt

SEQ ID NO: 13130 - DNA, 25 bp, S. cerevisiae
aaatacaccattttcacgagcctat

SEQ ID NO: 13131 - DNA, 25 bp, S. cerevisiae
aaatccccattgtgcatagagtttt

SEQ ID NO: 13132 - DNA, 25 bp, S. cerevisiae
aaatccgatgccagcaaattttgca

SEQ ID NO: 13133 - DNA, 25 bp, S. cerevisiae
aaacctttggactcttctaagatcg

SEQ ID NO: 13134 - DNA, 25 bp, S. cerevisiae
aaacgatttggtcacctatacgccg

SEQ ID NO: 13135 - DNA, 25 bp, S. cerevisiae
aaagtactttgacaccttcgacctg

SEQ ID NO: 13136 - DNA, 25 bp, S. cerevisiae
aaagcgcctttacaacccaacagtg

SEQ ID NO: 13137 - DNA, 25 bp, S. cerevisiae
aaaggtcgtcaagaagcacgtatag

SEQ ID NO: 13138 - DNA, 25 bp, S. cerevisiae
aaatggctgctgataaacgcgatgc

SEQ ID NO: 13139 - DNA, 25 bp, S. cerevisiae
aaatcgttgctacctacttgcgtga

SEQ ID NO: 13140 - DNA, 25 bp, S. cerevisiae
aaatgcgggctatccttccgttaat

SEQ ID NO: 13141 - DNA, 25 bp, S. cerevisiae
aaatgtgggtttcactccgtatttg

SEQ ID NO: 13142 - DNA, 25 bp, S. cerevisiae
aaatggctgtttgcccaaattattc

SEQ ID NO: 13143 - DNA, 25 bp, S. cerevisiae
aaagtggtgttgtcaagcaagcaaa

SEQ ID NO: 13144 - DNA, 25 bp, S. cerevisiae
aaatggtgatgtcgctagcccgaaa

SEQ ID NO: 13145 - DNA, 25 bp, S. cerevisiae
aaatcactgagtttggccactgaaa

SEQ ID NO: 13146 - DNA, 25 bp, S. cerevisiae
aaatcatcgagacatagttccattg

SEQ ID NO: 13147 - DNA, 25 bp, S. cerevisiae
aaagaccaaccttcttcgcaaagtg

SEQ ID NO: 13148 - DNA, 25 bp, S. cerevisiae
aaatcacggtccaatctttcacaag

SEQ ID NO: 13149 - DNA, 25 bp, S. cerevisiae
aaatgagcccgaaccattaccaact

SEQ ID NO: 13150 - DNA, 25 bp, S. cerevisiae
aaaggcgccgtaactatactaactg

SEQ ID NO: 13151 - DNA, 25 bp, S. cerevisiae
taaagggcggtatcttaactgacgg

SEQ ID NO: 13152 - DNA, 25 bp, S. cerevisiae
aaacctttgattgcacccatacgga

SEQ ID NO: 13153 - DNA, 25 bp, S. cerevisiae
aaatctctttggttgcacgcgatac

SEQ ID NO: 13154 - DNA, 25 bp, S. cerevisiae
aaatcagctattggctatcaccgct

SEQ ID NO: 13155 - DNA, 25 bp, S. cerevisiae
aaatcgttcagacagttctccaaag

SEQ ID NO: 13156 - DNA, 25 bp, S. cerevisiae
aaatcattgatatccggtctcaaaa

SEQ ID NO: 13157 - DNA, 25 bp, S. cerevisiae
aaatctgcgattttgggtctgccaa

SEQ ID NO: 13158 - DNA, 25 bp, S. cerevisiae
aaatcgatgacaacgctggctgctt

SEQ ID NO: 13159 - DNA, 25 bp, S. cerevisiae
aaatgctcaataccatctgctagtt

SEQ ID NO: 13160 - DNA, 25 bp, S. cerevisiae
aaatcaaaaccaagctctcctactg

SEQ ID NO: 13161 - DNA, 25 bp, S. cerevisiae
aaacggactcacttaggcactactt

SEQ ID NO: 13162 - DNA, 25 bp, S. cerevisiae
aaagccagactacttcaagaaggtt

SEQ ID NO: 13163 - DNA, 25 bp, S. cerevisiae
aaatgccatgacagagtgccaatag

SEQ ID NO: 13164 - DNA, 25 bp, S. cerevisiae
aaatgcagagcaccaggtttgttct

SEQ ID NO: 13165 - DNA, 25 bp, S. cerevisiae
aaataagcgcgatgccctagaggat

SEQ ID NO: 13166 - DNA, 25 bp, S. cerevisiae
aaataagccgacgtccttgggagca

SEQ ID NO: 13167 - DNA, 25 bp, S. cerevisiae
aaagtgcgagtctttctctaagagg

SEQ ID NO: 13168 - DNA, 25 bp, S. cerevisiae
aaaggacgacagtgccatcaaggaa

SEQ ID NO: 13169 - DNA, 25 bp, S. cerevisiae
aaaggttgtaccctcactgggatca

SEQ ID NO: 13170 - DNA, 25 bp, S. cerevisiae
aaaggcttgacatccaaagggtact

SEQ ID NO: 13171 - DNA, 25 bp, S. cerevisiae
aaaggcactatagctcccgggtacg

SEQ ID NO: 13172 - DNA, 25 bp, S. cerevisiae
aaatgctcaaaagccctcgtggtgg

SEQ ID NO: 13173 - DNA, 25 bp, S. cerevisiae
aaatctggtctccaattgttgcttg

SEQ ID NO: 13174 - DNA, 25 bp, S. cerevisiae
aaagtcgccgccgtcagagaaaaat

SEQ ID NO: 13175 - DNA, 25 bp, S. cerevisiae
aaagtccggacgtgaccaacaatat

SEQ ID NO: 13176 - DNA, 25 bp, S. cerevisiae
aaagtttctatctgggtatcgtggg

SEQ ID NO: 13177 - DNA, 25 bp, S. cerevisiae
aaagagtttccctggatctcctcgg

SEQ ID NO: 13178 - DNA, 25 bp, S. cerevisiae
aaagcgctgcacacaacgggttttc

SEQ ID NO: 13179 - DNA, 25 bp, S. cerevisiae
aaaacgccactagccgatgttatcg

SEQ ID NO: 13180 - DNA, 25 bp, S. cerevisiae
aaagagtcgccagatgtaccattgt

SEQ ID NO: 13181 - DNA, 25 bp, S. cerevisiae
aaaggctcttaacgttccactacat

SEQ ID NO: 13182 - DNA, 25 bp, S. cerevisiae
aaaggtttagtcgtcatcgccggtg

SEQ ID NO: 13183 - DNA, 25 bp, S. cerevisiae
aacagttccctgatgacgtgggttt

SEQ ID NO: 13184 - DNA, 25 bp, S. cerevisiae
aaatcagccccagttagctacgata

SEQ ID NO: 13185 - DNA, 25 bp, S. cerevisiae
aaacgagcagggtgctagccctgaa

SEQ ID NO: 13186 - DNA, 25 bp, S. cerevisiae
aaatgtcgggactgcaggtcatcga

SEQ ID NO: 13187 - DNA, 25 bp, S. cerevisiae
aaatcgagtctccatcaaccaggct

SEQ ID NO: 13188 - DNA, 25 bp, S. cerevisiae
aaatcttagattcagtgttcagcaa

SEQ ID NO: 13189 - DNA, 25 bp, S. cerevisiae
aaatgtttcttcgatgctttagccg

SEQ ID NO: 13190 - DNA, 25 bp, S. cerevisiae
aaatgagatttctcgccttggcgca

SEQ ID NO: 13191 - DNA, 25 bp, S. cerevisiae
aaacttgtcttgtcctaatgtgcct

SEQ ID NO: 13192 - DNA, 25 bp, S. cerevisiae
aaatcgttttcccaaatggcgctgt

SEQ ID NO: 13193 - DNA, 25 bp, S. cerevisiae
aaatgcttttctcttcgaagtagta

SEQ ID NO: 13194 - DNA, 25 bp, S. cerevisiae
aaatccttttcgatgtggtgctaag

SEQ ID NO: 13195 - DNA, 25 bp, S. cerevisiae
aaacaaaccacgtgatggtctacac

SEQ ID NO: 13196 - DNA, 25 bp, S. cerevisiae
aaatgcttggcatcaccgtgttgat

SEQ ID NO: 13197 - DNA, 25 bp, S. cerevisiae
aaatgctagggctacatcctctgtg

SEQ ID NO: 13198 - DNA, 25 bp, S. cerevisiae
aaatcttgtccggtgcacaacgtat

SEQ ID NO: 13199 - DNA, 25 bp, S. cerevisiae
aaatctagacccaaactgctgcaag

SEQ ID NO: 13200 - DNA, 25 bp, S. cerevisiae
aaatcgagatgccactaagtccaag

SEQ ID NO: 13201 - DNA, 25 bp, S. cerevisiae
aaatgcacttgcactttctgcacca

SEQ ID NO: 13202 - DNA, 25 bp, S. cerevisiae
aaatgcagttgcaacatcttaggca

SEQ ID NO: 13203 - DNA, 25 bp, S. cerevisiae
aaatcattctattcctttgtcagta

SEQ ID NO: 13204 - DNA, 25 bp, S. cerevisiae
aaatcacctcatacaattttttagg

SEQ ID NO: 13205 - DNA, 25 bp, S. cerevisiae
aaatcccctattactatcgctgttg

SEQ ID NO: 13206 - DNA, 25 bp, S. cerevisiae
aaatccgttttcattgctgctgttg

SEQ ID NO: 13207 - DNA, 25 bp, S. cerevisiae
aaatgttattttctggctcggtatc

SEQ ID NO: 13208 - DNA, 25 bp, S. cerevisiae
aaacttgttattgaggacgccttgc

SEQ ID NO: 13209 - DNA, 25 bp, S. cerevisiae
aaatcgtcttttttcgacaccatct

SEQ ID NO: 13210 - DNA, 25 bp, S. cerevisiae
aaatgtgctaccttggaagtctacc

SEQ ID NO: 13211 - DNA, 25 bp, S. cerevisiae
aaaaaatctccgctgaactactcct

SEQ ID NO: 13212 - DNA, 25 bp, S. cerevisiae
aaagaaattcactcaaacatcaaaa

SEQ ID NO: 13213 - DNA, 25 bp, S. cerevisiae
aaagaatttccagcgaagccacaga

SEQ ID NO: 13214 - DNA, 25 bp, S. cerevisiae
aaatgctgcttaacctcagtcctta

SEQ ID NO: 13215 - DNA, 25 bp, S. cerevisiae
aaatccaatcagaactccagcactc

SEQ ID NO: 13216 - DNA, 25 bp, S. cerevisiae
aaatctcagcgttgtgccatcatgt

SEQ ID NO: 13217 - DNA, 25 bp, S. cerevisiae
aaatccgatgattgtgccactaaag

SEQ ID NO: 13218 - DNA, 25 bp, S. cerevisiae
aaatgccactgacacctgtagtttc

SEQ ID NO: 13219 - DNA, 25 bp, S. cerevisiae
aaatgttcaactcccagatcctaat

SEQ ID NO: 13220 - DNA, 25 bp, S. cerevisiae
aaatgtctagactccatctgcccaa

SEQ ID NO: 13221 - DNA, 25 bp, S. cerevisiae
aaagtcatatgctaggatcctcatc

SEQ ID NO: 13222 - DNA, 25 bp, S. cerevisiae
aaatccatcatcaaatccgccgtcg

SEQ ID NO: 13223 - DNA, 25 bp, S. cerevisiae
aaatccattgaagtcccaggtgcag

SEQ ID NO: 13224 - DNA, 25 bp, S. cerevisiae
aaatgtcttgtagcgcctagtgagg

SEQ ID NO: 13225 - DNA, 25 bp, S. cerevisiae
aaatgaaatatctgccaccgctcaa

SEQ ID NO: 13226 - DNA, 25 bp, S. cerevisiae
aaatgcgacattatctacctctaag

SEQ ID NO: 13227 - DNA, 25 bp, S. cerevisiae
aaatctctatatattccgctcaaag

SEQ ID NO: 13228 - DNA, 25 bp, S. cerevisiae
aaatctcgtattatcctgttcaggg

SEQ ID NO: 13229 - DNA, 25 bp, S. cerevisiae
aaatcgccagttcttcaggtcatgt

SEQ ID NO: 13230 - DNA, 25 bp, S. cerevisiae
aaatcgcctacgtcttcggtcaaat

SEQ ID NO: 13231 - DNA, 25 bp, S. cerevisiae
aaatcttcaggcaaagtcgcctccg

SEQ ID NO: 13232 - DNA, 25 bp, S. cerevisiae
aaatgctatcagacgaaccgctcct

SEQ ID NO: 13233 - DNA, 25 bp, S. cerevisiae
aaatcttcgttcttttgcgtgatgg

SEQ ID NO: 13234 - DNA, 25 bp, S. cerevisiae
aaatcgactatgtttccttagcaga

SEQ ID NO: 13235 - DNA, 25 bp, S. cerevisiae
aaatgctaccaaggacatcttccca

SEQ ID NO: 13236 - DNA, 25 bp, S. cerevisiae
aaaggacattgtcggtgctgttcta

SEQ ID NO: 13237 - DNA, 25 bp, S. cerevisiae
aaagagactcctcgctactgttttc

SEQ ID NO: 13238 - DNA, 25 bp, S. cerevisiae
aaaggagccgatcgcgcctattgtt

SEQ ID NO: 13239 - DNA, 25 bp, S. cerevisiae
aaaggatgtcggcacgctagcgtat

SEQ ID NO: 13240 - DNA, 25 bp, S. cerevisiae
aaatggaacgtgttgaacagagatt

SEQ ID NO: 13241 - DNA, 25 bp, S. cerevisiae
aaatggaacgtgttgaacagagatt

SEQ ID NO: 13242 - DNA, 25 bp, S. cerevisiae
aaatgggtcactctcaactacttcg

SEQ ID NO: 13243 - DNA, 25 bp, S. cerevisiae
aaatggcgattgatttcccacctac

SEQ ID NO: 13244 - DNA, 25 bp, S. cerevisiae
aaatgacgcattttattcttccagc

SEQ ID NO: 13245 - DNA, 25 bp, S. cerevisiae
aaagagcctgtatgctgtgtggcat

SEQ ID NO: 13246 - DNA, 25 bp, S. cerevisiae
aaaggatcgcacacctaaggtcgaa

SEQ ID NO: 13247 - DNA, 25 bp, S. cerevisiae
aaaggccatccatactacgtgggca

SEQ ID NO: 13248 - DNA, 25 bp, S. cerevisiae
aaatctcccgacgacgatggtgaca

SEQ ID NO: 13249 - DNA, 25 bp, S. cerevisiae
aaatcgcgtttcttacagtggctca

SEQ ID NO: 13250 - DNA, 25 bp, S. cerevisiae
aaatcgattctttttcaggtgccaa

SEQ ID NO: 13251 - DNA, 25 bp, S. cerevisiae
aaatcgatccatttgatgtctgtga

SEQ ID NO: 13252 - DNA, 25 bp, S. cerevisiae
aaatgctcgcgatttctggcttcgt

SEQ ID NO: 13253 - DNA, 25 bp, S. cerevisiae
aacttctactgtgccagttgctacc

SEQ ID NO: 13254 - DNA, 25 bp, S. cerevisiae
aaatgtcgacttagccgatttggcc

SEQ ID NO: 13255 - DNA, 25 bp, S. cerevisiae
aaatgagggcgtttgctccggtgat

SEQ ID NO: 13256 - DNA, 25 bp, S. cerevisiae
cagaaggtgccggttatccgtttgt

SEQ ID NO: 13257 - DNA, 25 bp, S. cerevisiae
aaaggtctagtgttggccagtttat

SEQ ID NO: 13258 - DNA, 25 bp, S. cerevisiae
aaaggtacagccatgggttgttcca

SEQ ID NO: 13259 - DNA, 25 bp, S. cerevisiae
aaatggcccgccatggtatcgttta

SEQ ID NO: 13260 - DNA, 25 bp, S. cerevisiae
aaatggcccgatctgatttttggta

SEQ ID NO: 13261 - DNA, 25 bp, S. cerevisiae
aaatgtcacccacaagattttggta

SEQ ID NO: 13262 - DNA, 25 bp, S. cerevisiae
aaagtacccatgcatattagaagag

SEQ ID NO: 13263 - DNA, 25 bp, S. cerevisiae
aaatcgacagtttgatctggccaat

SEQ ID NO: 13264 - DNA, 25 bp, S. cerevisiae
aaatcggccttgtctgatagtgata

SEQ ID NO: 13265 - DNA, 25 bp, S. cerevisiae
aaatccgccttattgatgacatgct

SEQ ID NO: 13266 - DNA, 25 bp, S. cerevisiae
aaatgctgcggttggtttagttgcc

SEQ ID NO: 13267 - DNA, 25 bp, S. cerevisiae
aaatctgtggtgtttccattgtcag

SEQ ID NO: 13268 - DNA, 25 bp, S. cerevisiae
aaatgttgcgggtttgtccagtatg

SEQ ID NO: 13269 - DNA, 25 bp, S. cerevisiae
aaatgtccgaggctgattttggatc

SEQ ID NO: 13270 - DNA, 25 bp, S. cerevisiae
aaagtacgatgctgatgttttggac

SEQ ID NO: 13271 - DNA, 25 bp, S. cerevisiae
aaatgttcgacggtggattagtgac

SEQ ID NO: 13272 - DNA, 25 bp, S. cerevisiae
aaacttctgacggtagtgccagcga

SEQ ID NO: 13273 - DNA, 25 bp, S. cerevisiae
aaatcggtgactccatcttcgacaa

SEQ ID NO: 13274 - DNA, 25 bp, S. cerevisiae
aaatccgaatctatcaccatcacta

SEQ ID NO: 13275 - DNA, 25 bp, S. cerevisiae
aaatcgctggtttgtctccatacga

SEQ ID NO: 13276 - DNA, 25 bp, S. cerevisiae
aaatgcaccgatgggctacaaggat

SEQ ID NO: 13277 - DNA, 25 bp, S. cerevisiae
aaatgccctctgtaagcgaactata

SEQ ID NO: 13278 - DNA, 25 bp, S. cerevisiae
aaatggtgaagaccctgccaataac

SEQ ID NO: 13279 - DNA, 25 bp, S. cerevisiae
aaatggatgcaaccggttcagcaaa

SEQ ID NO: 13280 - DNA, 25 bp, S. cerevisiae
aaatgtcatgctagtccagttcaga

SEQ ID NO: 13281 - DNA, 25 bp, S. cerevisiae
aaaggctttcccattagccgatgct

SEQ ID NO: 13282 - DNA, 25 bp, S. cerevisiae
aaatggattcttgtttagccggtgt

SEQ ID NO: 13283 - DNA, 25 bp, S. cerevisiae
aaatgtaactctctcttgcagttga

SEQ ID NO: 13284 - DNA, 25 bp, S. cerevisiae
aaatctggattcaatatgcggagtg

SEQ ID NO: 13285 - DNA, 25 bp, S. cerevisiae
aaatctggctatgctatggcggtgg

SEQ ID NO: 13286 - DNA, 25 bp, S. cerevisiae
aaatcgtgctatggctattgctgtt

SEQ ID NO: 13287 - DNA, 25 bp, S. cerevisiae
aaatcggtattgtcgaaatctctcc

SEQ ID NO: 13288 - DNA, 25 bp, S. cerevisiae
aaatggtttagtcggctcatcttcc

SEQ ID NO: 13289 - DNA, 25 bp, S. cerevisiae
aaatgtttttatccatccagcctca

SEQ ID NO: 13290 - DNA, 25 bp, S. cerevisiae
aaatgcggtagtcaacttctctcta

SEQ ID NO: 13291 - DNA, 25 bp, S. cerevisiae
aaatggagggtccaagcccaactca

SEQ ID NO: 13292 - DNA, 25 bp, S. cerevisiae
aaatgctcgcgtttgaccctcaaaa

SEQ ID NO: 13293 - DNA, 25 bp, S. cerevisiae
aaatgtacggaaagctgccatcaaa

SEQ ID NO: 13294 - DNA, 25 bp, S. cerevisiae
aaatgttcagtcagctgcgcaacaa

SEQ ID NO: 13295 - DNA, 25 bp, S. cerevisiae
aaatgtccacgcataatcgcatgta

SEQ ID NO: 13296 - DNA, 25 bp, S. cerevisiae
aaatgtctactcatgaccgtcggag

SEQ ID NO: 13297 - DNA, 25 bp, S. cerevisiae
aaaggtcaccttcagggagcgcccg

SEQ ID NO: 13298 - DNA, 25 bp, S. cerevisiae
aaacttacctatgaggccacccttg

SEQ ID NO: 13299 - DNA, 25 bp, S. cerevisiae
aaaatgtacctagattcccgtccat

SEQ ID NO: 13300 - DNA, 25 bp, S. cerevisiae
aaagggaccttgattcgctggacct

SEQ ID NO: 13301 - DNA, 25 bp, S. cerevisiae
aaatgacaaattcgcttttccaaat

SEQ ID NO: 13302 - DNA, 25 bp, S. cerevisiae
aaaggcgaattggtacctgccaaca

SEQ ID NO: 13303 - DNA, 25 bp, S. cerevisiae
aaatgtctgcggcatacccgggaga

SEQ ID NO: 13304 - DNA, 25 bp, S. cerevisiae
aaatgcctcttcatcatcagtttct

SEQ ID NO: 13305 - DNA, 25 bp, S. cerevisiae
aaagttgatcttgggccgtttggtg

SEQ ID NO: 13306 - DNA, 25 bp, S. cerevisiae
aaaggttcaataggccgtgttatgt

SEQ ID NO: 13307 - DNA, 25 bp, S. cerevisiae
aaatgttcttgaggtcggcgctggc

SEQ ID NO: 13308 - DNA, 25 bp, S. cerevisiae
aaagtagccagacatcatccctttc

SEQ ID NO: 13309 - DNA, 25 bp, S. cerevisiae
aaaggccaattattactgctaaaga

SEQ ID NO: 13310 - DNA, 25 bp, S. cerevisiae
aaatgatcgataccaatgctcccgg

SEQ ID NO: 13311 - DNA, 25 bp, S. cerevisiae
aaatgtccctgttgagttacgtgaa

SEQ ID NO: 13312 - DNA, 25 bp, S. cerevisiae
aaatgcttaacttcgccatacgcta

SEQ ID NO: 13313 - DNA, 25 bp, S. cerevisiae
aaatggtagccgcttgctatgccat

SEQ ID NO: 13314 - DNA, 25 bp, S. cerevisiae
aaatgtttacttttgggcgctgcca

SEQ ID NO: 13315 - DNA, 25 bp, S. cerevisiae
aaatgaaagttctgccactgggtgg

SEQ ID NO: 13316 - DNA, 25 bp, S. cerevisiae
aaagaaatcgactcgtccgttccat

SEQ ID NO: 13317 - DNA, 25 bp, S. cerevisiae
aaaggctacacacctaccaaaggat

SEQ ID NO: 13318 - DNA, 25 bp, S. cerevisiae
aaatggcctgccactttgcaaattc

SEQ ID NO: 13319 - DNA, 25 bp, S. cerevisiae
aaaggttcatcttgattcgaagacg

SEQ ID NO: 13320 - DNA, 25 bp, S. cerevisiae
aaagaccactgtacaggttgctgaa

SEQ ID NO: 13321 - DNA, 25 bp, S. cerevisiae
aaagggcctgtagggatctgttgct

SEQ ID NO: 13322 - DNA, 25 bp, S. cerevisiae
aaaggctgcctttttcgatgttctt

SEQ ID NO: 13323 - DNA, 25 bp, S. cerevisiae
aaatgtggccctcctttgatttctt

SEQ ID NO: 13324 - DNA, 25 bp, S. cerevisiae
aaagggcccgcgatcgatgagctct

SEQ ID NO: 13325 - DNA, 25 bp, S. cerevisiae
aaatggtgtttgtccgttaacgcat

SEQ ID NO: 13326 - DNA, 25 bp, S. cerevisiae
aaatgcgggtacttgtctctaagac

SEQ ID NO: 13327 - DNA, 25 bp, S. cerevisiae
aaatgctcgatgctttgaaaaatga

SEQ ID NO: 13328 - DNA, 25 bp, S. cerevisiae
aaagggtggtgctcgtcaattcaac

SEQ ID NO: 13329 - DNA, 25 bp, S. cerevisiae
aaaggcgctagcttgtgatcctcag

SEQ ID NO: 13330 - DNA, 25 bp, S. cerevisiae
aaatgggctcgactgcatagcacct

SEQ ID NO: 13331 - DNA, 25 bp, S. cerevisiae
aaaggccttcagtgccatttaattt

SEQ ID NO: 13332 - DNA, 25 bp, S. cerevisiae
aaaggcttctgatactataccgaaa

SEQ ID NO: 13333 - DNA, 25 bp, S. cerevisiae
aaagtcgtccgtgttcgttgcgaca

SEQ ID NO: 13334 - DNA, 25 bp, S. cerevisiae
aaatgttcttgatctccggattgaa

SEQ ID NO: 13335 - DNA, 25 bp, S. cerevisiae
aactctggcggatcttcggacggat

SEQ ID NO: 13336 - DNA, 25 bp, S. cerevisiae
aaagaacgtctggtcttactcacgt

SEQ ID NO: 13337 - DNA, 25 bp, S. cerevisiae
aaatgtgtcggtgtcatttaccgtc

SEQ ID NO: 13338 - DNA, 25 bp, S. cerevisiae
aaatgttccagggttttggccagat

SEQ ID NO: 13339 - DNA, 25 bp, S. cerevisiae
aaatgcgtctgacctggtgagttcc

SEQ ID NO: 13340 - DNA, 25 bp, S. cerevisiae
aaatgccatccagaggtgctgcttc

SEQ ID NO: 13341 - DNA, 25 bp, S. cerevisiae
aaatgcaacacctcatcgttatgac

SEQ ID NO: 13342 - DNA, 25 bp, S. cerevisiae
aaaggtgcaaattccaggtctgaac

SEQ ID NO: 13343 - DNA, 25 bp, S. cerevisiae
aaaggaagaattttcgtctgcagaa

SEQ ID NO: 13344 - DNA, 25 bp, S. cerevisiae
aaatgtgccaaatatctcctctaaa

SEQ ID NO: 13345 - DNA, 25 bp, S. cerevisiae
aaatgacactattttttggctcaag

SEQ ID NO: 13346 - DNA, 25 bp, S. cerevisiae
aaagagacatacttccttcaccggt

SEQ ID NO: 13347 - DNA, 25 bp, S. cerevisiae
aaatgcctggtttattgatgacaac

SEQ ID NO: 13348 - DNA, 25 bp, S. cerevisiae
aaagtcgtgcaagatctcaggaaca

SEQ ID NO: 13349 - DNA, 25 bp, S. cerevisiae
aaatggcgtcattccagcaaaggac

SEQ ID NO: 13350 - DNA, 25 bp, S. cerevisiae
aaatgtgcttctagcggaacacgca

SEQ ID NO: 13351 - DNA, 25 bp, S. cerevisiae
aaatgtgccgctaccagatgagtcc

SEQ ID NO: 13352 - DNA, 25 bp, S. cerevisiae
aaatgcagtggaggccgtgtaccct

SEQ ID NO: 13353 - DNA, 25 bp, S. cerevisiae
aaagggatctggtggtattatgaca

SEQ ID NO: 13354 - DNA, 25 bp, S. cerevisiae
aaaggtaggctctcgaaggatgata

SEQ ID NO: 13355 - DNA, 25 bp, S. cerevisiae
aaaggacagcttctctaaggaacta

SEQ ID NO: 13356 - DNA, 25 bp, S. cerevisiae
aaaggacatccctcaaaggctacta

SEQ ID NO: 13357 - DNA, 25 bp, S. cerevisiae
aaatgtacatccgtctcagaactat

SEQ ID NO: 13358 - DNA, 25 bp, S. cerevisiae
aaatgttcatccatccgaatccagg

SEQ ID NO: 13359 - DNA, 25 bp, S. cerevisiae
aaatgctgcttcctttctgtttaaa

SEQ ID NO: 13360 - DNA, 25 bp, S. cerevisiae
aaaggctctcagcttttggctaaat

SEQ ID NO: 13361 - DNA, 25 bp, S. cerevisiae
aaaggtttttgataccatccaatga

SEQ ID NO: 13362 - DNA, 25 bp, S. cerevisiae
aaaggtcgtttgtaatcctcatgaa

SEQ ID NO: 13363 - DNA, 25 bp, S. cerevisiae
aaagggctgttttgaagttcgctgc

SEQ ID NO: 13364 - DNA, 25 bp, S. cerevisiae
aaatggactgatattgccaatacct

SEQ ID NO: 13365 - DNA, 25 bp, S. cerevisiae
aaagtacgattactcacacccattc

SEQ ID NO: 13366 - DNA, 25 bp, S. cerevisiae
aaagtactgcagagcctgactctct

SEQ ID NO: 13367 - DNA, 25 bp, S. cerevisiae
aaatgagtgtgcctgtccaaccttg

SEQ ID NO: 13368 - DNA, 25 bp, S. cerevisiae
aaaggctggccgaccaatttggtgt

SEQ ID NO: 13369 - DNA, 25 bp, S. cerevisiae
aaaggccaccgcacaaattgctgtt

SEQ ID NO: 13370 - DNA, 25 bp, S. cerevisiae
aaaggcgccgctgtgaaagttgttg

SEQ ID NO: 13371 - DNA, 25 bp, S. cerevisiae
aaagtgcccagtgtgaaaagtatca

SEQ ID NO: 13372 - DNA, 25 bp, S. cerevisiae
aaatgtgctgcctctgtcgataagt

SEQ ID NO: 13373 - DNA, 25 bp, S. cerevisiae
aaatgagctgcagtttgtcgatcca

SEQ ID NO: 13374 - DNA, 25 bp, S. cerevisiae
aaatgcgaatagtcgttcctcagct

SEQ ID NO: 13375 - DNA, 25 bp, S. cerevisiae
aaatgtgtaagccaggtaccacctt

SEQ ID NO: 13376 - DNA, 25 bp, S. cerevisiae
aaatgctgccaagattgtcctaatc

SEQ ID NO: 13377 - DNA, 25 bp, S. cerevisiae
aaatgtccaaggtcaagctgcatga

SEQ ID NO: 13378 - DNA, 25 bp, S. cerevisiae
aaatgctccagtggctacgaatgca

SEQ ID NO: 13379 - DNA, 25 bp, S. cerevisiae
aaaggccattgatcatttgcacaaa

SEQ ID NO: 13380 - DNA, 25 bp, S. cerevisiae
aaaggcctgcttacatttcaactgc

SEQ ID NO: 13381 - DNA, 25 bp, S. cerevisiae
aaatgtcctgcttgtgattctcaat

SEQ ID NO: 13382 - DNA, 25 bp, S. cerevisiae
aaatgtttcaagtatgtgcctcaaa

SEQ ID NO: 13383 - DNA, 25 bp, S. cerevisiae
aaatgttgccaatttgcgtctccca

SEQ ID NO: 13384 - DNA, 25 bp, S. cerevisiae
aaaggtgcacctttggttactcagg

SEQ ID NO: 13385 - DNA, 25 bp, S. cerevisiae
aaatgggattcgatgctgttttgca

SEQ ID NO: 13386 - DNA, 25 bp, S. cerevisiae
aaaggagttcaacggacctgagcct

SEQ ID NO: 13387 - DNA, 25 bp, S. cerevisiae
aaagggattcggctacgctggctct

SEQ ID NO: 13388 - DNA, 25 bp, S. cerevisiae
aacagggtccgctgcatggtcgtgc

SEQ ID NO: 13389 - DNA, 25 bp, S. cerevisiae
aaatggtgcgcgagttattccgccg

SEQ ID NO: 13390 - DNA, 25 bp, S. cerevisiae
aaaggtgcccatgctgcttttgtac

SEQ ID NO: 13391 - DNA, 25 bp, S. cerevisiae
aaaggccccacggttggtgcaagtg

SEQ ID NO: 13392 - DNA, 25 bp, S. cerevisiae
aaaggccctatcatcggagatcaag

SEQ ID NO: 13393 - DNA, 25 bp, S. cerevisiae
aaaggccttagcagccgaagatgac

SEQ ID NO: 13394 - DNA, 25 bp, S. cerevisiae
aaaggctcttcatggcatttagatg

SEQ ID NO: 13395 - DNA, 25 bp, S. cerevisiae
aaaggccatgccattccgaaaattg

SEQ ID NO: 13396 - DNA, 25 bp, S. cerevisiae
aaatggaagccattgctgccgaaag

SEQ ID NO: 13397 - DNA, 25 bp, S. cerevisiae
aaaggaagcatttggccgctaaaat

SEQ ID NO: 13398 - DNA, 25 bp, S. cerevisiae
aaaggatcctctgacgactcaaaga

SEQ ID NO: 13399 - DNA, 25 bp, S. cerevisiae
aaaggtggctccaacgacgcttcga

SEQ ID NO: 13400 - DNA, 25 bp, S. cerevisiae
aaatgggaacctcattccgtcgtca

SEQ ID NO: 13401 - DNA, 25 bp, S. cerevisiae
aaaggccaaaatcattctccaccga

SEQ ID NO: 13402 - DNA, 25 bp, S. cerevisiae
aaatggcacgaactgaatatgtccc

SEQ ID NO: 13403 - DNA, 25 bp, S. cerevisiae
aaaggcgatgaactgctgatgatta

SEQ ID NO: 13404 - DNA, 25 bp, S. cerevisiae
aaatggcttgatgcgctgtgtgtag

SEQ ID NO: 13405 - DNA, 25 bp, S. cerevisiae
aaatgagcttgatccgcttgtctga

SEQ ID NO: 13406 - DNA, 25 bp, S. cerevisiae
aaaggctatcattcgttgcgctgtt

SEQ ID NO: 13407 - DNA, 25 bp, S. cerevisiae
aaatgtatggcgttggcctctgctt

SEQ ID NO: 13408 - DNA, 25 bp, S. cerevisiae
aaatgagggcactgctgtctccttt

SEQ ID NO: 13409 - DNA, 25 bp, S. cerevisiae
aaagtggctgcgtagcatactccgt

SEQ ID NO: 13410 - DNA, 25 bp, S. cerevisiae
aaagtgagcgaaatatttcagagct

SEQ ID NO: 13411 - DNA, 25 bp, S. cerevisiae
aaatgttcgaagtcatattcccgag

SEQ ID NO: 13412 - DNA, 25 bp, S. cerevisiae
aaatgttcagcatgccttcattcct

SEQ ID NO: 13413 - DNA, 25 bp, S. cerevisiae
aaatgttcacagatcttttcgatta

SEQ ID NO: 13414 - DNA, 25 bp, S. cerevisiae
aaagcaacaccgtgatgcccttggt

SEQ ID NO: 13415 - DNA, 25 bp, S. cerevisiae
aaagacccgcgcagatgcttgcttg

SEQ ID NO: 13416 - DNA, 25 bp, S. cerevisiae
aaaggcgtcaccaggagatgtccac

SEQ ID NO: 13417 - DNA, 25 bp, S. cerevisiae
aacttggtcaagaagggtccagtca

SEQ ID NO: 13418 - DNA, 25 bp, S. cerevisiae
aaatgtggacaatgagggctcgaga

SEQ ID NO: 13419 - DNA, 25 bp, S. cerevisiae
aaagatccgctaccggtgccaagcg

SEQ ID NO: 13420 - DNA, 25 bp, S. cerevisiae
aaaatgcacgcatgccggaatcaat

SEQ ID NO: 13421 - DNA, 25 bp, S. cerevisiae
aaatgaatccattgccgcttataat

SEQ ID NO: 13422 - DNA, 25 bp, S. cerevisiae
aaatgcaaacaaccgctccagagta

SEQ ID NO: 13423 - DNA, 25 bp, S. cerevisiae
aaatgaatcctctaagccgctcagt

SEQ ID NO: 13424 - DNA, 25 bp, S. cerevisiae
aaatgtgatcacagcaccggaagcc

SEQ ID NO: 13425 - DNA, 25 bp, S. cerevisiae
aaagttggcccagcttttgaagtga

SEQ ID NO: 13426 - DNA, 25 bp, S. cerevisiae
aaaggcatcttttcgttagaggcaa

SEQ ID NO: 13427 - DNA, 25 bp, S. cerevisiae
aaagggttatactggcaaggcatca

SEQ ID NO: 13428 - DNA, 25 bp, S. cerevisiae
aaagggttacgatttgccagatgaa

SEQ ID NO: 13429 - DNA, 25 bp, S. cerevisiae
aaaggtgttcttgctctagaaaaag

SEQ ID NO: 13430 - DNA, 25 bp, S. cerevisiae
aaaggcttacttgtccgtagatgag

SEQ ID NO: 13431 - DNA, 25 bp, S. cerevisiae
aaaggctatcttctattcgtaagga

SEQ ID NO: 13432 - DNA, 25 bp, S. cerevisiae
aaaggtacttcttttggctgcaaga

SEQ ID NO: 13433 - DNA, 25 bp, S. cerevisiae
aaatgttcatgctcacttccttaga

SEQ ID NO: 13434 - DNA, 25 bp, S. cerevisiae
aaatgggttaattctcctgcttata

SEQ ID NO: 13435 - DNA, 25 bp, S. cerevisiae
aaatgggaccacagccgcgcagtaa

SEQ ID NO: 13436 - DNA, 25 bp, S. cerevisiae
aaaggacgccacaagtacgcagata

SEQ ID NO: 13437 - DNA, 25 bp, S. cerevisiae
aaaggacatggctaagaaccagaaa

SEQ ID NO: 13438 - DNA, 25 bp, S. cerevisiae
aaatggacatgcctacttggcgaaa

SEQ ID NO: 13439 - DNA, 25 bp, S. cerevisiae
aacatctagatgcaccacttggtcc

SEQ ID NO: 13440 - DNA, 25 bp, S. cerevisiae
aaacgttgagaccactttgtcgagt

SEQ ID NO: 13441 - DNA, 25 bp, S. cerevisiae
aaaggttcgttgttgtttcagcgct

SEQ ID NO: 13442 - DNA, 25 bp, S. cerevisiae
aaaggccacgttttgatgaacttgt

SEQ ID NO: 13443 - DNA, 25 bp, S. cerevisiae
aaaggacggtgtttgggccattatg

SEQ ID NO: 13444 - DNA, 25 bp, S. cerevisiae
aaaggacggtctatgggccattatt

SEQ ID NO: 13445 - DNA, 25 bp, S. cerevisiae
aaaggcccgtcaattttctcattca

SEQ ID NO: 13446 - DNA, 25 bp, S. cerevisiae
aaaggtttacttcgcttcagctgcc

SEQ ID NO: 13447 - DNA, 25 bp, S. cerevisiae
caaaggattttctgggtcggacctg

SEQ ID NO: 13448 - DNA, 25 bp, S. cerevisiae
aaaggctgtttttgcggacgttgcg

SEQ ID NO: 13449 - DNA, 25 bp, S. cerevisiae
aaaggtgtcttctgggacccagcat

SEQ ID NO: 13450 - DNA, 25 bp, S. cerevisiae
aaaggcacatttttgggcccacctg

SEQ ID NO: 13451 - DNA, 25 bp, S. cerevisiae
aaagggaccctagatgccatttcat

SEQ ID NO: 13452 - DNA, 25 bp, S. cerevisiae
aaaggagattcctgcggcaattccc

SEQ ID NO: 13453 - DNA, 25 bp, S. cerevisiae
aaaggaatactctctggcgttcaaa

SEQ ID NO: 13454 - DNA, 25 bp, S. cerevisiae
aaaggctctttgtgctacttcataa

SEQ ID NO: 13455 - DNA, 25 bp, S. cerevisiae
aaatggttctgtttcgatgcacgct

SEQ ID NO: 13456 - DNA, 25 bp, S. cerevisiae
aaatgtcagattcgctgctcctcag

SEQ ID NO: 13457 - DNA, 25 bp, S. cerevisiae
aaatgatatctcctctgcttcatcg

SEQ ID NO: 13458 - DNA, 25 bp, S. cerevisiae
aaagataggcactcccttgatgacc

SEQ ID NO: 13459 - DNA, 25 bp, S. cerevisiae
aaagtcagctggtgccgataaacgc

SEQ ID NO: 13460 - DNA, 25 bp, S. cerevisiae
aaagatgctgcatgctgcccgtaaa

SEQ ID NO: 13461 - DNA, 25 bp, S. cerevisiae
aaaggctcaagctcaggctcaagcg

SEQ ID NO: 13462 - DNA, 25 bp, S. cerevisiae
aaaggccgaatagagctcaagcagt

SEQ ID NO: 13463 - DNA, 25 bp, S. cerevisiae
gtaagagaagaatgaacccaggtcc

SEQ ID NO: 13464 - DNA, 25 bp, S. cerevisiae
aaacgcaagaggtgctgccgtcggc

SEQ ID NO: 13465 - DNA, 25 bp, S. cerevisiae
aaagtgcaagacgtttccggtggct

SEQ ID NO: 13466 - DNA, 25 bp, S. cerevisiae
aaatgtcaccatggctttcaccaga

SEQ ID NO: 13467 - DNA, 25 bp, S. cerevisiae
aaatgatactcttcgttatacgcaa

SEQ ID NO: 13468 - DNA, 25 bp, S. cerevisiae
aaatggctctctcagcgttcaatat

SEQ ID NO: 13469 - DNA, 25 bp, S. cerevisiae
aaatggctcttcttcgggcgatata

SEQ ID NO: 13470 - DNA, 25 bp, S. cerevisiae
aaatggttgcatgtgatggacccaa

SEQ ID NO: 13471 - DNA, 25 bp, S. cerevisiae
aaagatgtacctggtacgcccagcg

SEQ ID NO: 13472 - DNA, 25 bp, S. cerevisiae
aaatggcgatgtgtctgttggctcc

SEQ ID NO: 13473 - DNA, 25 bp, S. cerevisiae
aaatggcctgctatttctgtatcgc

SEQ ID NO: 13474 - DNA, 25 bp, S. cerevisiae
aaaggcctgaacttacttctgcaca

SEQ ID NO: 13475 - DNA, 25 bp, S. cerevisiae
aaatgtcctatcattatcgtctaac

SEQ ID NO: 13476 - DNA, 25 bp, S. cerevisiae
aaatgtttgctggtaagcgcccgtg

SEQ ID NO: 13477 - DNA, 25 bp, S. cerevisiae
aaatggctttgtcacatctgctcaa

SEQ ID NO: 13478 - DNA, 25 bp, S. cerevisiae
aaagacttttgcacacctcatcaaa

SEQ ID NO: 13479 - DNA, 25 bp, S. cerevisiae
aaatgtcctggtggcgacttgctaa

SEQ ID NO: 13480 - DNA, 25 bp, S. cerevisiae
aaagatgctgattttcggtaccaag

SEQ ID NO: 13481 - DNA, 25 bp, S. cerevisiae
aaatggcatttggtttcctagaggc

SEQ ID NO: 13482 - DNA, 25 bp, S. cerevisiae
aaagagtgtcgagcgacttcgccgt

SEQ ID NO: 13483 - DNA, 25 bp, S. cerevisiae
aaagaggcggaatcctactcgtcac

SEQ ID NO: 13484 - DNA, 25 bp, S. cerevisiae
aaagagaacgcagagcctaccgact

SEQ ID NO: 13485 - DNA, 25 bp, S. cerevisiae
aaatgggctatcgttacctctggtt

SEQ ID NO: 13486 - DNA, 25 bp, S. cerevisiae
aaagttgcatttgccttagccgtcc

SEQ ID NO: 13487 - DNA, 25 bp, S. cerevisiae
aaagtctaatgtcagttcaacgtca

SEQ ID NO: 13488 - DNA, 25 bp, S. cerevisiae
aaaatcggtattgtcgaaatctctc

SEQ ID NO: 13489 - DNA, 25 bp, S. cerevisiae
aaaggcccttacagagcagctgcag

SEQ ID NO: 13490 - DNA, 25 bp, S. cerevisiae
aaaggctcttcacattgcacagcta

SEQ ID NO: 13491 - DNA, 25 bp, S. cerevisiae
aaatggctctttttctatggataca

SEQ ID NO: 13492 - DNA, 25 bp, S. cerevisiae
aaatggctgtagaactcgcacgtaa

SEQ ID NO: 13493 - DNA, 25 bp, S. cerevisiae
aaatggttctgttcattgccgctaa

SEQ ID NO: 13494 - DNA, 25 bp, S. cerevisiae
aaatgtggctggacgattccgcata

SEQ ID NO: 13495 - DNA, 25 bp, S. cerevisiae
aaatgtctgttatttggtgcagctg

SEQ ID NO: 13496 - DNA, 25 bp, S. cerevisiae
aaatgtctgttattcggagcggctt

SEQ ID NO: 13497 - DNA, 25 bp, S. cerevisiae
aaagttattagagcgcctggccatc

SEQ ID NO: 13498 - DNA, 25 bp, S. cerevisiae
aaagtctttgtagtcgctgggtcgc

SEQ ID NO: 13499 - DNA, 25 bp, S. cerevisiae
aaaggcgttcttgccttgggtgcaa

SEQ ID NO: 13500 - DNA, 25 bp, S. cerevisiae
aaatggactttgaacttctgggtga

SEQ ID NO: 13501 - DNA, 25 bp, S. cerevisiae
aaagtgtccttaacgctctgggata

SEQ ID NO: 13502 - DNA, 25 bp, S. cerevisiae
aaagggccattgcaaccatacgttc

SEQ ID NO: 13503 - DNA, 25 bp, S. cerevisiae
aaagggtcaatccaccctactgatg

SEQ ID NO: 13504 - DNA, 25 bp, S. cerevisiae
aaaggtgttgctgcaggcctactat

SEQ ID NO: 13505 - DNA, 25 bp, S. cerevisiae
aaagacgtagctcaccttggagaat

SEQ ID NO: 13506 - DNA, 25 bp, S. cerevisiae
aaatgtgcgcccaaagtcttaagaa

SEQ ID NO: 13507 - DNA, 25 bp, S. cerevisiae
aaatgtgcgttcaaaggcttactga

SEQ ID NO: 13508 - DNA, 25 bp, S. cerevisiae
aaatgtgcctacagagcagccgact

SEQ ID NO: 13509 - DNA, 25 bp, S. cerevisiae
aaaggcactttcgatgcattcagaa

SEQ ID NO: 13510 - DNA, 25 bp, S. cerevisiae
aaagactctaacatcgacatcgcat

SEQ ID NO: 13511 - DNA, 25 bp, S. cerevisiae
aaagacttccaaagcgttccactga

SEQ ID NO: 13512 - DNA, 25 bp, S. cerevisiae
aaagactacctaccctctgacattg

SEQ ID NO: 13513 - DNA, 25 bp, S. cerevisiae
aaaggcaaccaactcctctttggag

SEQ ID NO: 13514 - DNA, 25 bp, S. cerevisiae
aaagtcgtcttggtgggcctttgca

SEQ ID NO: 13515 - DNA, 25 bp, S. cerevisiae
aaagcggtcgcatcgggtgtcttca

SEQ ID NO: 13516 - DNA, 25 bp, S. cerevisiae
aaagtcgggcatttggagttgttga

SEQ ID NO: 13517 - DNA, 25 bp, S. cerevisiae
aaagtgctagatgattggttttcaa

SEQ ID NO: 13518 - DNA, 25 bp, S. cerevisiae
aaaggtcggcgtatactggataaga

SEQ ID NO: 13519 - DNA, 25 bp, S. cerevisiae
aaaggtctccgcattatgccgtaag

SEQ ID NO: 13520 - DNA, 25 bp, S. cerevisiae
aaagttcacccatttttgttagcag

SEQ ID NO: 13521 - DNA, 25 bp, S. cerevisiae
aagaggttgagctccttcgagtacg

SEQ ID NO: 13522 - DNA, 25 bp, S. cerevisiae
aaatgggtgatgtgcctatcggcat

SEQ ID NO: 13523 - DNA, 25 bp, S. cerevisiae
aaaggctgtctccatttcttacagt

SEQ ID NO: 13524 - DNA, 25 bp, S. cerevisiae
aaatgggcgcattactacaagaagt

SEQ ID NO: 13525 - DNA, 25 bp, S. cerevisiae
aaaggctcgcatcccatatcaaaaa

SEQ ID NO: 13526 - DNA, 25 bp, S. cerevisiae
aaaggtccaggcgaactcaatgaaa

SEQ ID NO: 13527 - DNA, 25 bp, S. cerevisiae
aaaggtgcacgagattgcctagaaa

SEQ ID NO: 13528 - DNA, 25 bp, S. cerevisiae
aaaggctgtggcaggtgcaaccaat

SEQ ID NO: 13529 - DNA, 25 bp, S. cerevisiae
aaagtctgtggaacctaagccaaag

SEQ ID NO: 13530 - DNA, 25 bp, S. cerevisiae
aaagtctgccgtatcgaagccgcat

SEQ ID NO: 13531 - DNA, 25 bp, S. cerevisiae
aaagacctcggaactagcagaattt

SEQ ID NO: 13532 - DNA, 25 bp, S. cerevisiae
aaagatgccccaactttccaagaat

SEQ ID NO: 13533 - DNA, 25 bp, S. cerevisiae
aaagtcgtcgccatatttgtactat

SEQ ID NO: 13534 - DNA, 25 bp, S. cerevisiae
aaagaacaccgctttgggttgcata

SEQ ID NO: 13535 - DNA, 25 bp, S. cerevisiae
aaagggacccgctggtgctgtgaaa

SEQ ID NO: 13536 - DNA, 25 bp, S. cerevisiae
aaaggaatcccgtggtgctcatgca

SEQ ID NO: 13537 - DNA, 25 bp, S. cerevisiae
aaagggatccctttggctgctattg

SEQ ID NO: 13538 - DNA, 25 bp, S. cerevisiae
aaaggtatcccacttgctgctattg

SEQ ID NO: 13539 - DNA, 25 bp, S. cerevisiae
aaaggtgacccacttcgttcatgga

SEQ ID NO: 13540 - DNA, 25 bp, S. cerevisiae
aaagggcatcctattccattcaaaa

SEQ ID NO: 13541 - DNA, 25 bp, S. cerevisiae
aaagggtcctaccatcagcttaaca

SEQ ID NO: 13542 - DNA, 25 bp, S. cerevisiae
aaaggctactttggacacagttcaa

SEQ ID NO: 13543 - DNA, 25 bp, S. cerevisiae
aaaggctactatttccactttgccg

SEQ ID NO: 13544 - DNA, 25 bp, S. cerevisiae
aaaggctatttatgcccgctacacg

SEQ ID NO: 13545 - DNA, 25 bp, S. cerevisiae
aaaggtaatgcatctacctcccgtt

SEQ ID NO: 13546 - DNA, 25 bp, S. cerevisiae
aaagtaccagattagccgccgccgt

SEQ ID NO: 13547 - DNA, 25 bp, S. cerevisiae
aaagtcaaattctccagcacccata

SEQ ID NO: 13548 - DNA, 25 bp, S. cerevisiae
aaaggcaagaacttccgcagatccc

SEQ ID NO: 13549 - DNA, 25 bp, S. cerevisiae
aaagtagctaacatgccatcaacag

SEQ ID NO: 13550 - DNA, 25 bp, S. cerevisiae
aaagtgggctgctagagctgcttct

SEQ ID NO: 13551 - DNA, 25 bp, S. cerevisiae
aaaggttcagtgctacttcgctgcc

SEQ ID NO: 13552 - DNA, 25 bp, S. cerevisiae
aaagtgaaaccttgagccctggaga

SEQ ID NO: 13553 - DNA, 25 bp, S. cerevisiae
aaaggaaggctctagtgtactggga

SEQ ID NO: 13554 - DNA, 25 bp, S. cerevisiae
aaaggcaggtgtgttttcagacgat

SEQ ID NO: 13555 - DNA, 25 bp, S. cerevisiae
aaaggcagggttttgttctcacaga

SEQ ID NO: 13556 - DNA, 25 bp, S. cerevisiae
aaagagggactttgcaggcgacgtt

SEQ ID NO: 13557 - DNA, 25 bp, S. cerevisiae
aaagttcgctaatctcgctgactag

SEQ ID NO: 13558 - DNA, 25 bp, S. cerevisiae
aaagttgagctccatcaccgatact

SEQ ID NO: 13559 - DNA, 25 bp, S. cerevisiae
aaagtgctcacgttacatttggcga

SEQ ID NO: 13560 - DNA, 25 bp, S. cerevisiae
aaaggtctcaaattcgtgtttcatt

SEQ ID NO: 13561 - DNA, 25 bp, S. cerevisiae
aaaggttgattatgttctcccgcca

SEQ ID NO: 13562 - DNA, 25 bp, S. cerevisiae
aaagaactactgttgatcccgccag

SEQ ID NO: 13563 - DNA, 25 bp, S. cerevisiae
aaacggaacaaataagtgcgctctt

SEQ ID NO: 13564 - DNA, 25 bp, S. cerevisiae
aaagttaccagtgtcgcattttcgc

SEQ ID NO: 13565 - DNA, 25 bp, S. cerevisiae
aaaggtagcgtgtactcgcttatct

SEQ ID NO: 13566 - DNA, 25 bp, S. cerevisiae
aaaggttgtcggtctgcacattgtt

SEQ ID NO: 13567 - DNA, 25 bp, S. cerevisiae
aaaggttgcatccactcgccaagag

SEQ ID NO: 13568 - DNA, 25 bp, S. cerevisiae
aaagtttcagcgctcatgccaatga

SEQ ID NO: 13569 - DNA, 25 bp, S. cerevisiae
aaagtgtacggcctactggatcaaa

SEQ ID NO: 13570 - DNA, 25 bp, S. cerevisiae
aaaggtcctggcctgttatgaagaa

SEQ ID NO: 13571 - DNA, 25 bp, S. cerevisiae
aaaggcggcatctgcgcttaccgaa

SEQ ID NO: 13572 - DNA, 25 bp, S. cerevisiae
aaaggcatacactcctgatactcca

SEQ ID NO: 13573 - DNA, 25 bp, S. cerevisiae
aaagttcccggcctattgagcaacg

SEQ ID NO: 13574 - DNA, 25 bp, S. cerevisiae
aaaggttaatgtgcgcgttggtcaa

SEQ ID NO: 13575 - DNA, 25 bp, S. cerevisiae
aaaggtattgttcccctatggtgca

SEQ ID NO: 13576 - DNA, 25 bp, S. cerevisiae
aaagtgcacttcgaccaagctggta

SEQ ID NO: 13577 - DNA, 25 bp, S. cerevisiae
aaagatccagtctccagatctgcga

SEQ ID NO: 13578 - DNA, 25 bp, S. cerevisiae
aaaggtgcttctacagtttcgtcga

SEQ ID NO: 13579 - DNA, 25 bp, S. cerevisiae
aaaggccgtctagtgttgtttgata

SEQ ID NO: 13580 - DNA, 25 bp, S. cerevisiae
aaagtgccaccggttcgaatcatac

SEQ ID NO: 13581 - DNA, 25 bp, S. cerevisiae
aaagagctcaccgtttcgatcgagg

SEQ ID NO: 13582 - DNA, 25 bp, S. cerevisiae
aaagtcggcgaagtttccatcagag

SEQ ID NO: 13583 - DNA, 25 bp, S. cerevisiae
aaaggtcgcgctatggtctgtgcta

SEQ ID NO: 13584 - DNA, 25 bp, S. cerevisiae
aaatggccgcaggagatgttcttct

SEQ ID NO: 13585 - DNA, 25 bp, S. cerevisiae
aaaggcagtacgcatgcttcttctg

SEQ ID NO: 13586 - DNA, 25 bp, S. cerevisiae
aaagttcgctgggatcgctatactc

SEQ ID NO: 13587 - DNA, 25 bp, S. cerevisiae
aaacgtggcgtgttgcctgtaacca

SEQ ID NO: 13588 - DNA, 25 bp, S. cerevisiae
aaacgtcggcttctttagcagtgat

SEQ ID NO: 13589 - DNA, 25 bp, S. cerevisiae
aaagtctttcgctcgtatccatgaa

SEQ ID NO: 13590 - DNA, 25 bp, S. cerevisiae
aaaggaggtcgatcagaacgcagaa

SEQ ID NO: 13591 - DNA, 25 bp, S. cerevisiae
aaagggcagacaccactgtgacatg

SEQ ID NO: 13592 - DNA, 25 bp, S. cerevisiae
aaagggctctgcacaagttgaccaa

SEQ ID NO: 13593 - DNA, 25 bp, S. cerevisiae
aaaggcgcttcaaatgagttcacaa

SEQ ID NO: 13594 - DNA, 25 bp, S. cerevisiae
aaaggcccttctaagactgcactac

SEQ ID NO: 13595 - DNA, 25 bp, S. cerevisiae
aaaggtgctcctaagaagatgaaga

SEQ ID NO: 13596 - DNA, 25 bp, S. cerevisiae
aaaggctcctcaacgcaagatacaa

SEQ ID NO: 13597 - DNA, 25 bp, S. cerevisiae
aaagatcccttaccacagtacagtc

SEQ ID NO: 13598 - DNA, 25 bp, S. cerevisiae
aaagatgcgctgaacaaccacctcg

SEQ ID NO: 13599 - DNA, 25 bp, S. cerevisiae
aaagcgggttgtcacattgccgtaa

SEQ ID NO: 13600 - DNA, 25 bp, S. cerevisiae
aaagttggtcttcgccatcatggca

SEQ ID NO: 13601 - DNA, 25 bp, S. cerevisiae
aaagtgttctttcatctgcagtgcc

SEQ ID NO: 13602 - DNA, 25 bp, S. cerevisiae
aaaggatataccctccatactccaa

SEQ ID NO: 13603 - DNA, 25 bp, S. cerevisiae
aaaggtgaaccacccaggctaccag

SEQ ID NO: 13604 - DNA, 25 bp, S. cerevisiae
aaaggagaagaaccgccactacaag

SEQ ID NO: 13605 - DNA, 25 bp, S. cerevisiae
aaacagcaaaaagcccgtcctcagg

SEQ ID NO: 13606 - DNA, 25 bp, S. cerevisiae
aaaggtcgacgagctgagcgccctg

SEQ ID NO: 13607 - DNA, 25 bp, S. cerevisiae
aaaggagcgacagctttggacaatg

SEQ ID NO: 13608 - DNA, 25 bp, S. cerevisiae
aaagggccatctcttgcggaaacaa

SEQ ID NO: 13609 - DNA, 25 bp, S. cerevisiae
aaagagcgggaccttcgctatacaa

SEQ ID NO: 13610 - DNA, 25 bp, S. cerevisiae
aaaggagcgcgatgcgttgctaacc

SEQ ID NO: 13611 - DNA, 25 bp, S. cerevisiae
aaagcgagagcgacagcgatagtga

SEQ ID NO: 13612 - DNA, 25 bp, S. cerevisiae
aaagagaggctgaagcttggcattg

SEQ ID NO: 13613 - DNA, 25 bp, S. cerevisiae
aaagaacgctgctccaggcatggtt

SEQ ID NO: 13614 - DNA, 25 bp, S. cerevisiae
aaagaaaatgctccctcgtggctct

SEQ ID NO: 13615 - DNA, 25 bp, S. cerevisiae
aaaggatgacatagccaccgtggaa

SEQ ID NO: 13616 - DNA, 25 bp, S. cerevisiae
aaagggctttgtcagctagctgcta

SEQ ID NO: 13617 - DNA, 25 bp, S. cerevisiae
aaaggtcttagttatgctagcctga

SEQ ID NO: 13618 - DNA, 25 bp, S. cerevisiae
aaaggcaatatgctcggtctcacgc

SEQ ID NO: 13619 - DNA, 25 bp, S. cerevisiae
aaaggctttgccagatgctgtcacc

SEQ ID NO: 13620 - DNA, 25 bp, S. cerevisiae
aaagtctgttactccagtgagccca

SEQ ID NO: 13621 - DNA, 25 bp, S. cerevisiae
aaagtcggcttgtccaattacccat

SEQ ID NO: 13622 - DNA, 25 bp, S. cerevisiae
aaagttcagcttgtcatattcccca

SEQ ID NO: 13623 - DNA, 25 bp, S. cerevisiae
aaagggcctgactttgacgccggtg

SEQ ID NO: 13624 - DNA, 25 bp, S. cerevisiae
aaaggtagctgcttctaaagccagt

SEQ ID NO: 13625 - DNA, 25 bp, S. cerevisiae
aaagggcaccgtcttatgctcatta

SEQ ID NO: 13626 - DNA, 25 bp, S. cerevisiae
aaagagggcccatctttcatgttcc

SEQ ID NO: 13627 - DNA, 25 bp, S. cerevisiae
aaagagcggtctttcttcttgttct

SEQ ID NO: 13628 - DNA, 25 bp, S. cerevisiae
aaagagggcgcgtattccttgttca

SEQ ID NO: 13629 - DNA, 25 bp, S. cerevisiae
aaagaggcccgatacctgtttcaca

SEQ ID NO: 13630 - DNA, 25 bp, S. cerevisiae
aacagtgctccgaagaacattttta

SEQ ID NO: 13631 - DNA, 25 bp, S. cerevisiae
aaagtgccccttgatgcattttcga

SEQ ID NO: 13632 - DNA, 25 bp, S. cerevisiae
aaagtgctcctctgatgtcttcaac

SEQ ID NO: 13633 - DNA, 25 bp, S. cerevisiae
aaagtatgcggatcttgttgaacat

SEQ ID NO: 13634 - DNA, 25 bp, S. cerevisiae
aaagtgctcgcgttacggagataca

SEQ ID NO: 13635 - DNA, 25 bp, S. cerevisiae
aaagattggccaaaaaggttgctcg

SEQ ID NO: 13636 - DNA, 25 bp, S. cerevisiae
aaagtgatgttcaaacgagtttgcc

SEQ ID NO: 13637 - DNA, 25 bp, S. cerevisiae
aaaggcacgatctatttcaatacaa

SEQ ID NO: 13638 - DNA, 25 bp, S. cerevisiae
aaaggcacgacattgtctctgcaac

SEQ ID NO: 13639 - DNA, 25 bp, S. cerevisiae
aaagtccatgtctatcttgaactct

SEQ ID NO: 13640 - DNA, 25 bp, S. cerevisiae
aaagtgctccgttaaagcctgtgac

SEQ ID NO: 13641 - DNA, 25 bp, S. cerevisiae
aaagtgatcccaatgaagcccgttc

SEQ ID NO: 13642 - DNA, 25 bp, S. cerevisiae
aaagacacccgaatgggcattgttt

SEQ ID NO: 13643 - DNA, 25 bp, S. cerevisiae
aaagaaacccatttgtgcattgcgt

SEQ ID NO: 13644 - DNA, 25 bp, S. cerevisiae
aaagatgatgaacctgtcctgccta

SEQ ID NO: 13645 - DNA, 25 bp, S. cerevisiae
aaagtggaacctgcacatcgtgcct

SEQ ID NO: 13646 - DNA, 25 bp, S. cerevisiae
aaaggtgaacctggctacgtagctt

SEQ ID NO: 13647 - DNA, 25 bp, S. cerevisiae
aaagtcgcaactgctctacgaagat

SEQ ID NO: 13648 - DNA, 25 bp, S. cerevisiae
aaagctgctgaagccggactacgat

SEQ ID NO: 13649 - DNA, 25 bp, S. cerevisiae
aaaggtaatgtacggcctaggcata

SEQ ID NO: 13650 - DNA, 25 bp, S. cerevisiae
aaacgctaagtatggccaaggaggc

SEQ ID NO: 13651 - DNA, 25 bp, S. cerevisiae
aaacgcaaagcaatcacgccgcgga

SEQ ID NO: 13652 - DNA, 25 bp, S. cerevisiae
aaaggacctggtagtgggcccacag

SEQ ID NO: 13653 - DNA, 25 bp, S. cerevisiae
aaaggtcttggtatcacatgcccca

SEQ ID NO: 13654 - DNA, 25 bp, S. cerevisiae
aaacctcttggtgtcaagttgcctc

SEQ ID NO: 13655 - DNA, 25 bp, S. cerevisiae
aaagttttaacccacatgatgacag

SEQ ID NO: 13656 - DNA, 25 bp, S. cerevisiae
aaagtttgtataccgtccagacgcg

SEQ ID NO: 13657 - DNA, 25 bp, S. cerevisiae
aaaggtggtgccaagcgtcacagaa

SEQ ID NO: 13658 - DNA, 25 bp, S. cerevisiae
aaagagtgtcctgagcgttgcaaac

SEQ ID NO: 13659 - DNA, 25 bp, S. cerevisiae
aaacgttgaccctgttgcaaacatg

SEQ ID NO: 13660 - DNA, 25 bp, S. cerevisiae
aaagggttgcgcttctttcaacgct

SEQ ID NO: 13661 - DNA, 25 bp, S. cerevisiae
aaagacgttcacagtctagactggg

SEQ ID NO: 13662 - DNA, 25 bp, S. cerevisiae
aaaggttactgctgctgagccggtt

SEQ ID NO: 13663 - DNA, 25 bp, S. cerevisiae
aaagtggtgcccatgtcgtatgcca

SEQ ID NO: 13664 - DNA, 25 bp, S. cerevisiae
aaagggtcatctacgtcgggccacg

SEQ ID NO: 13665 - DNA, 25 bp, S. cerevisiae
aaaggactctaaggccggtgacaag

SEQ ID NO: 13666 - DNA, 25 bp, S. cerevisiae
aaagaagcatttcgcggctacggag

SEQ ID NO: 13667 - DNA, 25 bp, S. cerevisiae
aaagcagccttacgaggccaaggcc

SEQ ID NO: 13668 - DNA, 25 bp, S. cerevisiae
aaagacgatgtcaaggcaccagaag

SEQ ID NO: 13669 - DNA, 25 bp, S. cerevisiae
aaagaagactctgcgccggttgctg

SEQ ID NO: 13670 - DNA, 25 bp, S. cerevisiae
aaagaaactaaatctgctccagcag

SEQ ID NO: 13671 - DNA, 25 bp, S. cerevisiae
aaagtcgtcttttctgcacagtatc

SEQ ID NO: 13672 - DNA, 25 bp, S. cerevisiae
aaagtgcctctttacgacatatata

SEQ ID NO: 13673 - DNA, 25 bp, S. cerevisiae
aaagtcgcgactcacagtaaatcag

SEQ ID NO: 13674 - DNA, 25 bp, S. cerevisiae
gaataatgccaaaagtcgtacgacc

SEQ ID NO: 13675 - DNA, 25 bp, S. cerevisiae
aaagctccaaagtggtatccatccg

SEQ ID NO: 13676 - DNA, 25 bp, S. cerevisiae
aaagtctacagacggcttatctccc

SEQ ID NO: 13677 - DNA, 25 bp, S. cerevisiae
aaagggtcaagctttgcaattctga

SEQ ID NO: 13678 - DNA, 25 bp, S. cerevisiae
aaactggtacaggatctttgcgatg

SEQ ID NO: 13679 - DNA, 25 bp, S. cerevisiae
aaagttggaagtgcctgcggtctgc

SEQ ID NO: 13680 - DNA, 25 bp, S. cerevisiae
aaagcatgcgagaggccctgggttc

SEQ ID NO: 13681 - DNA, 25 bp, S. cerevisiae
aaagtggctcaatggctccagcagt

SEQ ID NO: 13682 - DNA, 25 bp, S. cerevisiae
aaagtccacaattgctgttccaagt

SEQ ID NO: 13683 - DNA, 25 bp, S. cerevisiae
aaagtagcgcaattctcctggcaag

SEQ ID NO: 13684 - DNA, 25 bp, S. cerevisiae
aaagacatgatgaatctcccggaag

SEQ ID NO: 13685 - DNA, 25 bp, S. cerevisiae
aaagcaagcgatgtctccagaattc

SEQ ID NO: 13686 - DNA, 25 bp, S. cerevisiae
aaagaagcgtgttggaccatttcca

SEQ ID NO: 13687 - DNA, 25 bp, S. cerevisiae
aaagaacctttacctatttgcagag

SEQ ID NO: 13688 - DNA, 25 bp, S. cerevisiae
aaaggttgcgacttcttggtcagta

SEQ ID NO: 13689 - DNA, 25 bp, S. cerevisiae
aaagttcgcgatttttcattggctg

SEQ ID NO: 13690 - DNA, 25 bp, S. cerevisiae
aaagcttcggtggtgttgcctggtt

SEQ ID NO: 13691 - DNA, 25 bp, S. cerevisiae
aaagacaactcaatcgtgctaagcg

SEQ ID NO: 13692 - DNA, 25 bp, S. cerevisiae
aaagtccttcatttgcggcgtgcta

SEQ ID NO: 13693 - DNA, 25 bp, S. cerevisiae
aaagattcttcaagagcgccgcctg

SEQ ID NO: 13694 - DNA, 25 bp, S. cerevisiae
aaagtttgttcattgcccacagtct

SEQ ID NO: 13695 - DNA, 25 bp, S. cerevisiae
aaagttgtcttccaagcggcggatt

SEQ ID NO: 13696 - DNA, 25 bp, S. cerevisiae
aaagttacctacatgctattaccaa

SEQ ID NO: 13697 - DNA, 25 bp, S. cerevisiae
aaagttcgcccatcgattattggaa

SEQ ID NO: 13698 - DNA, 25 bp, S. cerevisiae
aaagttcgcgctcacgttcaggaaa

SEQ ID NO: 13699 - DNA, 25 bp, S. cerevisiae
aaggccgcggccaacgagtaggaca

SEQ ID NO: 13700 - DNA, 25 bp, S. cerevisiae
aaagccggtgccaacgttattgtcg

SEQ ID NO: 13701 - DNA, 25 bp, S. cerevisiae
aaagtggttcgtactgatggattac

SEQ ID NO: 13702 - DNA, 25 bp, S. cerevisiae
aaaggtgcgagcgttttggcgcaaa

SEQ ID NO: 13703 - DNA, 25 bp, S. cerevisiae
aaaggtggctttatcatggcgctaa

SEQ ID NO: 13704 - DNA, 25 bp, S. cerevisiae
aaagggccattcaattcggtgctaa

SEQ ID NO: 13705 - DNA, 25 bp, S. cerevisiae
aaagagctgccattcctaggagtga

SEQ ID NO: 13706 - DNA, 25 bp, S. cerevisiae
aaagttcaggtcgtacagtggcaag

SEQ ID NO: 13707 - DNA, 25 bp, S. cerevisiae
aaagtagcaatgaaggccctgggat

SEQ ID NO: 13708 - DNA, 25 bp, S. cerevisiae
aaagattcattcaacggcagcgatt

SEQ ID NO: 13709 - DNA, 25 bp, S. cerevisiae
aaagacatcattaactggaccattg

SEQ ID NO: 13710 - DNA, 25 bp, S. cerevisiae
aaagaggctgtaggcgatgcgttaa

SEQ ID NO: 13711 - DNA, 25 bp, S. cerevisiae
cataagggagctaccacatcttcca

SEQ ID NO: 13712 - DNA, 25 bp, S. cerevisiae
aaagtgttgcagtcgagccatccaa

SEQ ID NO: 13713 - DNA, 25 bp, S. cerevisiae
aaagatccggttgctgttgcacgtg

SEQ ID NO: 13714 - DNA, 25 bp, S. cerevisiae
aaagggctggtaatggtgtcacact

SEQ ID NO: 13715 - DNA, 25 bp, S. cerevisiae
aaagggttctattcacgtcagtgtt

SEQ ID NO: 13716 - DNA, 25 bp, S. cerevisiae
aaagggttctttcggatcagctcct

SEQ ID NO: 13717 - DNA, 25 bp, S. cerevisiae
aaagaggcttccagggtcgcagagc

SEQ ID NO: 13718 - DNA, 25 bp, S. cerevisiae
aaagagcacatttcggtaacccagc

SEQ ID NO: 13719 - DNA, 25 bp, S. cerevisiae
aaagccaagtgcaggaaactcccaa

SEQ ID NO: 13720 - DNA, 25 bp, S. cerevisiae
aaactcaggagcgtggatacccacc

SEQ ID NO: 13721 - DNA, 25 bp, S. cerevisiae
aaagtcagggcagtgggtatcgtcc

SEQ ID NO: 13722 - DNA, 25 bp, S. cerevisiae
aaagtcaattgcgttggctaccacc

SEQ ID NO: 13723 - DNA, 25 bp, S. cerevisiae
aaagtaaaaccgctctgtccgcata

SEQ ID NO: 13724 - DNA, 25 bp, S. cerevisiae
aaagccaaaatcagagggtgccgaa

SEQ ID NO: 13725 - DNA, 25 bp, S. cerevisiae
aaacctaacctgcaagtactggcct

SEQ ID NO: 13726 - DNA, 25 bp, S. cerevisiae
aaagaagccggctggactcccgaga

SEQ ID NO: 13727 - DNA, 25 bp, S. cerevisiae
aaagtagccgagtttgactctccgg

SEQ ID NO: 13728 - DNA, 25 bp, S. cerevisiae
aaagttcacggctttgatcactcct

SEQ ID NO: 13729 - DNA, 25 bp, S. cerevisiae
aaagtactatcgctcatttggctct

SEQ ID NO: 13730 - DNA, 25 bp, S. cerevisiae
aaagaattgcatttgatcgtcaagg

SEQ ID NO: 13731 - DNA, 25 bp, S. cerevisiae
aaagaaatgcaatcactctcagagc

SEQ ID NO: 13732 - DNA, 25 bp, S. cerevisiae
aaagaatacatcgacttcaagcctc

SEQ ID NO: 13733 - DNA, 25 bp, S. cerevisiae
aaagaatattcgacgcgccagctgt

SEQ ID NO: 13734 - DNA, 25 bp, S. cerevisiae
aaagtatcactagccgcaagagttg

SEQ ID NO: 13735 - DNA, 25 bp, S. cerevisiae
aaagacatccatccgcgaactgaag

SEQ ID NO: 13736 - DNA, 25 bp, S. cerevisiae
aaagagatcttctagcgagcttgaa

SEQ ID NO: 13737 - DNA, 25 bp, S. cerevisiae
aaagatgattacaagggtctcgcct

SEQ ID NO: 13738 - DNA, 25 bp, S. cerevisiae
aacactaggtgttgtcggaaccact

SEQ ID NO: 13739 - DNA, 25 bp, S. cerevisiae
aacactggaattgtcgtggcccctg

SEQ ID NO: 13740 - DNA, 25 bp, S. cerevisiae
aaagtgtccatgatactgctgccca

SEQ ID NO: 13741 - DNA, 25 bp, S. cerevisiae
aaagttggcagaaggagcgtctcaa

SEQ ID NO: 13742 - DNA, 25 bp, S. cerevisiae
aaagctcgcctgataagccctgaag

SEQ ID NO: 13743 - DNA, 25 bp, S. cerevisiae
aaagctggtttaacattcccagttg

SEQ ID NO: 13744 - DNA, 25 bp, S. cerevisiae
aaagacgtttcaccggatccgatct

SEQ ID NO: 13745 - DNA, 25 bp, S. cerevisiae
aaagtcgtcaagaaggctttcgaag

SEQ ID NO: 13746 - DNA, 25 bp, S. cerevisiae
aaagtctctgttccggctttacatt

SEQ ID NO: 13747 - DNA, 25 bp, S. cerevisiae
aaagatacttctgctggttcgaata

SEQ ID NO: 13748 - DNA, 25 bp, S. cerevisiae
aaagtcttgactattgttccggaat

SEQ ID NO: 13749 - DNA, 25 bp, S. cerevisiae
aaagatgacgctgctgaaccactcc

SEQ ID NO: 13750 - DNA, 25 bp, S. cerevisiae
aaagcagtcgcaggctacgaacgca

SEQ ID NO: 13751 - DNA, 25 bp, S. cerevisiae
aaagcagaggcaaatcgagtacgaa

SEQ ID NO: 13752 - DNA, 25 bp, S. cerevisiae
aaagaaggcatctctggcctccaag

SEQ ID NO: 13753 - DNA, 25 bp, S. cerevisiae
aaagaaggactcagcgccactcaaa

SEQ ID NO: 13754 - DNA, 25 bp, S. cerevisiae
aaagaaggactcacagcagactggt

SEQ ID NO: 13755 - DNA, 25 bp, S. cerevisiae
aaagtgaagactctagccctgttcc

SEQ ID NO: 13756 - DNA, 25 bp, S. cerevisiae
aaagtggaattcttagcccgcatca

SEQ ID NO: 13757 - DNA, 25 bp, S. cerevisiae
aaagttgacattcacattccctgca

SEQ ID NO: 13758 - DNA, 25 bp, S. cerevisiae
aaagcagcgaattgccacgttaccc

SEQ ID NO: 13759 - DNA, 25 bp, S. cerevisiae
aaacactaatttcgccagatacctt

SEQ ID NO: 13760 - DNA, 25 bp, S. cerevisiae
aaacatacatactgtgccgcacggc

SEQ ID NO: 13761 - DNA, 25 bp, S. cerevisiae
aaagatgacaatgctgttccagcgt

SEQ ID NO: 13762 - DNA, 25 bp, S. cerevisiae
aaagttcctgtcctgtctcaagatg

SEQ ID NO: 13763 - DNA, 25 bp, S. cerevisiae
aaagttcgtgattctcctgcagtgg

SEQ ID NO: 13764 - DNA, 25 bp, S. cerevisiae
aaagttggtgcgcaggtcagctata

SEQ ID NO: 13765 - DNA, 25 bp, S. cerevisiae
aaagttataaacgtgccgctgcagt

SEQ ID NO: 13766 - DNA, 25 bp, S. cerevisiae
aaagttcctgtctcaggcgttcatc

SEQ ID NO: 13767 - DNA, 25 bp, S. cerevisiae
aaagttttgtgctctgtggatcctc

SEQ ID NO: 13768 - DNA, 25 bp, S. cerevisiae
aaagttgatattccggttgatgtga

SEQ ID NO: 13769 - DNA, 25 bp, S. cerevisiae
aaagtagatggtgccgtaggaaact

SEQ ID NO: 13770 - DNA, 25 bp, S. cerevisiae
aaagtctctctggaaactggccgtg

SEQ ID NO: 13771 - DNA, 25 bp, S. cerevisiae
aaagcttgcctctaacttggccaat

SEQ ID NO: 13772 - DNA, 25 bp, S. cerevisiae
aaagctcgcagtctctgcattggaa

SEQ ID NO: 13773 - DNA, 25 bp, S. cerevisiae
aaagtccggcaggtcattggaatac

SEQ ID NO: 13774 - DNA, 25 bp, S. cerevisiae
aaagttgccgagctcatagatgaat

SEQ ID NO: 13775 - DNA, 25 bp, S. cerevisiae
aaagattgtcgttgtcagagctgaa

SEQ ID NO: 13776 - DNA, 25 bp, S. cerevisiae
aaagagacggctggctccagctgat

SEQ ID NO: 13777 - DNA, 25 bp, S. cerevisiae
aaagtaccaccactgtgcttgacat

SEQ ID NO: 13778 - DNA, 25 bp, S. cerevisiae
aaagaagcctccaatgtcgaaagta

SEQ ID NO: 13779 - DNA, 25 bp, S. cerevisiae
aaagaagtcccttgccgtggaggct

SEQ ID NO: 13780 - DNA, 25 bp, S. cerevisiae
aaagtcgtcaccaccgtgtagtgat

SEQ ID NO: 13781 - DNA, 25 bp, S. cerevisiae
aaagacttcgtttctcactcaaggt

SEQ ID NO: 13782 - DNA, 25 bp, S. cerevisiae
aaagacaccggttcatcctacgcat

SEQ ID NO: 13783 - DNA, 25 bp, S. cerevisiae
aaagtactcggtttcatcaaggatt

SEQ ID NO: 13784 - DNA, 25 bp, S. cerevisiae
aaagtcagcaggcacattcatcccg

SEQ ID NO: 13785 - DNA, 25 bp, S. cerevisiae
aaagccagagagtaaatcgcccgcg

SEQ ID NO: 13786 - DNA, 25 bp, S. cerevisiae
aaagccaaagacaagttccgcactc

SEQ ID NO: 13787 - DNA, 25 bp, S. cerevisiae
aaagcaacaggtcaactccgcgata

SEQ ID NO: 13788 - DNA, 25 bp, S. cerevisiae
aaagatttggcgctcattctcggta

SEQ ID NO: 13789 - DNA, 25 bp, S. cerevisiae
aaagtattggcagcacatatcggca

SEQ ID NO: 13790 - DNA, 25 bp, S. cerevisiae
aaagtcagtagctcatcttcgctca

SEQ ID NO: 13791 - DNA, 25 bp, S. cerevisiae
aaagtctgccattgacgtcatccaa

SEQ ID NO: 13792 - DNA, 25 bp, S. cerevisiae
aaagttgacggcgaatgcctcatag

SEQ ID NO: 13793 - DNA, 25 bp, S. cerevisiae
aaagtcgcacgggaagccttcagaa

SEQ ID NO: 13794 - DNA, 25 bp, S. cerevisiae
aaagattgcacggtgtctccttcaa

SEQ ID NO: 13795 - DNA, 25 bp, S. cerevisiae
aaagattccaaagtctgccattgaa

SEQ ID NO: 13796 - DNA, 25 bp, S. cerevisiae
aaagattggccgtcttgaccacagc

SEQ ID NO: 13797 - DNA, 25 bp, S. cerevisiae
aaagcaaatgggtcctactgaagaa

SEQ ID NO: 13798 - DNA, 25 bp, S. cerevisiae
aaagcccgaggtgatactgaccgaa

SEQ ID NO: 13799 - DNA, 25 bp, S. cerevisiae
aaagatccgcttatgtcactaccga

SEQ ID NO: 13800 - DNA, 25 bp, S. cerevisiae
aaagatccctttatcacagaacaat

SEQ ID NO: 13801 - DNA, 25 bp, S. cerevisiae
aaagttctccgctgctatacaaaat

SEQ ID NO: 13802 - DNA, 25 bp, S. cerevisiae
aaagagatgtctctggtttgcccct

SEQ ID NO: 13803 - DNA, 25 bp, S. cerevisiae
aaagaaccccagtctggctcagtaa

SEQ ID NO: 13804 - DNA, 25 bp, S. cerevisiae
aaagacgtcctactctagtgcaaaa

SEQ ID NO: 13805 - DNA, 25 bp, S. cerevisiae
aaagagcaatactcaggcgcttccg

SEQ ID NO: 13806 - DNA, 25 bp, S. cerevisiae
aaagagattctctcaggcgcccgtg

SEQ ID NO: 13807 - DNA, 25 bp, S. cerevisiae
aaagaatagattcctcctccatacg

SEQ ID NO: 13808 - DNA, 25 bp, S. cerevisiae
aaagaatagaccctcctgcaacact

SEQ ID NO: 13809 - DNA, 25 bp, S. cerevisiae
aaagaaaggcgctgcacccaattca

SEQ ID NO: 13810 - DNA, 25 bp, S. cerevisiae
aaagaaaagcttggcccgctgttca

SEQ ID NO: 13811 - DNA, 25 bp, S. cerevisiae
aaagaagaacttgcgcccgtgtgtc

SEQ ID NO: 13812 - DNA, 25 bp, S. cerevisiae
aaagaaggtattgccaccgtggagc

SEQ ID NO: 13813 - DNA, 25 bp, S. cerevisiae
aaagagaggctgttgccgacgcttg

SEQ ID NO: 13814 - DNA, 25 bp, S. cerevisiae
aaagtttcctctgctgacacaggtg

SEQ ID NO: 13815 - DNA, 25 bp, S. cerevisiae
aaagttgtcgacatggagccaggtg

SEQ ID NO: 13816 - DNA, 25 bp, S. cerevisiae
aaagccgcccttgatagagttgaaa

SEQ ID NO: 13817 - DNA, 25 bp, S. cerevisiae
aaaccagtaccagggaggctttgca

SEQ ID NO: 13818 - DNA, 25 bp, S. cerevisiae
aaagctatgattgagggacccttca

SEQ ID NO: 13819 - DNA, 25 bp, S. cerevisiae
aaagctatggagtgcctacaactta

SEQ ID NO: 13820 - DNA, 25 bp, S. cerevisiae
aaagcaacggataccagtcaactat

SEQ ID NO: 13821 - DNA, 25 bp, S. cerevisiae
aaagttgggcataccgtccattcag

SEQ ID NO: 13822 - DNA, 25 bp, S. cerevisiae
aaagttggccacaggtccttgcaaa

SEQ ID NO: 13823 - DNA, 25 bp, S. cerevisiae
aaagctactgatatccctttcatcc

SEQ ID NO: 13824 - DNA, 25 bp, S. cerevisiae
aaagtcacttccagcgtcataacat

SEQ ID NO: 13825 - DNA, 25 bp, S. cerevisiae
aaagtattctgctccttctaacatg

SEQ ID NO: 13826 - DNA, 25 bp, S. cerevisiae
aaagagactggagccttgctcgtca

SEQ ID NO: 13827 - DNA, 25 bp, S. cerevisiae
aaagatgcctaagtggtcccaatgg

SEQ ID NO: 13828 - DNA, 25 bp, S. cerevisiae
aaacgaattagctgcatccggtgcc

SEQ ID NO: 13829 - DNA, 25 bp, S. cerevisiae
aaagcggtccgaagcaacaggtcct

SEQ ID NO: 13830 - DNA, 25 bp, S. cerevisiae
aaacagactggccaagacaagggta

SEQ ID NO: 13831 - DNA, 25 bp, S. cerevisiae
aaagccgtaggcactaacgtacagt

SEQ ID NO: 13832 - DNA, 25 bp, S. cerevisiae
aaagccaacggctacacaggtgttc

SEQ ID NO: 13833 - DNA, 25 bp, S. cerevisiae
aaagagctggcgtactctcaaggaa

SEQ ID NO: 13834 - DNA, 25 bp, S. cerevisiae
aaagatcttggctagctctccaaat

SEQ ID NO: 13835 - DNA, 25 bp, S. cerevisiae
aaagatcttccaacttccaagtctc

SEQ ID NO: 13836 - DNA, 25 bp, S. cerevisiae
aaagcttccttgatatcctgagtct

SEQ ID NO: 13837 - DNA, 25 bp, S. cerevisiae
aaagtttgggcgttcttgcatcaca

SEQ ID NO: 13838 - DNA, 25 bp, S. cerevisiae
aaagttttgttgttgcattccattt

SEQ ID NO: 13839 - DNA, 25 bp, S. cerevisiae
aaagtatgcctttgccatttccatt

SEQ ID NO: 13840 - DNA, 25 bp, S. cerevisiae
aaagatctcgcaacccatttaacag

SEQ ID NO: 13841 - DNA, 25 bp, S. cerevisiae
aaagagcttccagccatttatccac

SEQ ID NO: 13842 - DNA, 25 bp, S. cerevisiae
aaagttgtccagaccatctttgcca

SEQ ID NO: 13843 - DNA, 25 bp, S. cerevisiae
aaagtttccaggttgattcgcgaga

SEQ ID NO: 13844 - DNA, 25 bp, S. cerevisiae
aaagttcccaggtactgtcagacaa

SEQ ID NO: 13845 - DNA, 25 bp, S. cerevisiae
aaagttctccgttgattcgcgacag

SEQ ID NO: 13846 - DNA, 25 bp, S. cerevisiae
aaagttcctggtttgagatcgacga

SEQ ID NO: 13847 - DNA, 25 bp, S. cerevisiae
aaagttttgacctggattgcgcgca

SEQ ID NO: 13848 - DNA, 25 bp, S. cerevisiae
aaagttttactgactgcgtatggca

SEQ ID NO: 13849 - DNA, 25 bp, S. cerevisiae
aaagtattatcaacctcctcataga

SEQ ID NO: 13850 - DNA, 25 bp, S. cerevisiae
aaagattccatcacagcattccagg

SEQ ID NO: 13851 - DNA, 25 bp, S. cerevisiae
aaagcatttcattacactgtccaag

SEQ ID NO: 13852 - DNA, 25 bp, S. cerevisiae
aaagtttgattaccgtccacaggat

SEQ ID NO: 13853 - DNA, 25 bp, S. cerevisiae
aaagatgtccttgtggtcagttacc

SEQ ID NO: 13854 - DNA, 25 bp, S. cerevisiae
aaagagcccgtttattgcagttcac

SEQ ID NO: 13855 - DNA, 25 bp, S. cerevisiae
aaagactagaatcctacgtcgcttc

SEQ ID NO: 13856 - DNA, 25 bp, S. cerevisiae
aacatcctggtggacttgcatgcaa

SEQ ID NO: 13857 - DNA, 25 bp, S. cerevisiae
aaagctacggatgcgctacagggta

SEQ ID NO: 13858 - DNA, 25 bp, S. cerevisiae
aaagctctcttcagggacagggtaa

SEQ ID NO: 13859 - DNA, 25 bp, S. cerevisiae
aaagttggtgatcctaagtcgtgca

SEQ ID NO: 13860 - DNA, 25 bp, S. cerevisiae
aaagatcaggaagcacatgtggcaa

SEQ ID NO: 13861 - DNA, 25 bp, S. cerevisiae
aaagcacgcagatccaagtgtatat

SEQ ID NO: 13862 - DNA, 25 bp, S. cerevisiae
aaaccgggacaggagttcatggcat

SEQ ID NO: 13863 - DNA, 25 bp, S. cerevisiae
aaacgcacttgccagtcaactagat

SEQ ID NO: 13864 - DNA, 25 bp, S. cerevisiae
aaagttgctgtgtctcaagagggat

SEQ ID NO: 13865 - DNA, 25 bp, S. cerevisiae
aaagctgcaaaagttccgggataga

SEQ ID NO: 13866 - DNA, 25 bp, S. cerevisiae
aaagcaactggacttgccgcggaat

SEQ ID NO: 13867 - DNA, 25 bp, S. cerevisiae
aaagcaagctgttgcggccttgggt

SEQ ID NO: 13868 - DNA, 25 bp, S. cerevisiae
aaagaatccactttgcacttagtct

SEQ ID NO: 13869 - DNA, 25 bp, S. cerevisiae
aaagctcctgcactttgcacgtggc

SEQ ID NO: 13870 - DNA, 25 bp, S. cerevisiae
aaagatttcgccacctttgcaaagg

SEQ ID NO: 13871 - DNA, 25 bp, S. cerevisiae
aaagaataccctacactactcaaag

SEQ ID NO: 13872 - DNA, 25 bp, S. cerevisiae
aaagcaaattcatcacctaccacta

SEQ ID NO: 13873 - DNA, 25 bp, S. cerevisiae
aaagatcattgagccacctgcccaa

SEQ ID NO: 13874 - DNA, 25 bp, S. cerevisiae
aaagcattgagaacgattccgcccc

SEQ ID NO: 13875 - DNA, 25 bp, S. cerevisiae
aaagcctggtactgtgggccagcca

SEQ ID NO: 13876 - DNA, 25 bp, S. cerevisiae
aaagccgagctttagtgaagacgta

SEQ ID NO: 13877 - DNA, 25 bp, S. cerevisiae
aaagccgccggttgtaagatcattg

SEQ ID NO: 13878 - DNA, 25 bp, S. cerevisiae
aaagatagtcgcttttgcgcaatat

SEQ ID NO: 13879 - DNA, 25 bp, S. cerevisiae
aaagatagcatttctccaccatttg

SEQ ID NO: 13880 - DNA, 25 bp, S. cerevisiae
aaagacagctattctacctctcaat

SEQ ID NO: 13881 - DNA, 25 bp, S. cerevisiae
aaagaatggtgctggctctgctacg

SEQ ID NO: 13882 - DNA, 25 bp, S. cerevisiae
aaagaagtcaaaatcggcgtccgat

SEQ ID NO: 13883 - DNA, 25 bp, S. cerevisiae
aaagattttcagaatccgccgcaaa

SEQ ID NO: 13884 - DNA, 25 bp, S. cerevisiae
aaagcacagatttgggacacggcag

SEQ ID NO: 13885 - DNA, 25 bp, S. cerevisiae
aaagcgaattagctgccatccgcaa

SEQ ID NO: 13886 - DNA, 25 bp, S. cerevisiae
aaacgaaatcgtaagtccacatgaa

SEQ ID NO: 13887 - DNA, 25 bp, S. cerevisiae
aaagttgttgactcaccttgcttac

SEQ ID NO: 13888 - DNA, 25 bp, S. cerevisiae
aaactttctgacattttcctctcca

SEQ ID NO: 13889 - DNA, 25 bp, S. cerevisiae
aaagcaacactgacctctgttctaa

SEQ ID NO: 13890 - DNA, 25 bp, S. cerevisiae
aaagcctttatttcagtgtgcccca

SEQ ID NO: 13891 - DNA, 25 bp, S. cerevisiae
aaagcggcagtaattttgctcgtac

SEQ ID NO: 13892 - DNA, 25 bp, S. cerevisiae
aaacgttttgctcttcagttgtcaa

SEQ ID NO: 13893 - DNA, 25 bp, S. cerevisiae
aaacggcttcctcagacaggtacaa

SEQ ID NO: 13894 - DNA, 25 bp, S. cerevisiae
aaacctctcttatcaattgggctgg

SEQ ID NO: 13895 - DNA, 25 bp, S. cerevisiae
aaagcctccttagcttagtggtaga

SEQ ID NO: 13896 - DNA, 25 bp, S. cerevisiae
aaacctcacctagtctcggagacgg

SEQ ID NO: 13897 - DNA, 25 bp, S. cerevisiae
aacattgtaagacctttagaactca

SEQ ID NO: 13898 - DNA, 25 bp, S. cerevisiae
aacactttaagctatttgagaactg

SEQ ID NO: 13899 - DNA, 25 bp, S. cerevisiae
aaagctcgtctagttttagtactgt

SEQ ID NO: 13900 - DNA, 25 bp, S. cerevisiae
aaacagttgcccttttagtgcttgc

SEQ ID NO: 13901 - DNA, 25 bp, S. cerevisiae
aaagacttggcctcttatgttgcgt

SEQ ID NO: 13902 - DNA, 25 bp, S. cerevisiae
aacaccatccagcatgcaatacagt

SEQ ID NO: 13903 - DNA, 25 bp, S. cerevisiae
aaagccatggcgctgatcaaactgg

SEQ ID NO: 13904 - DNA, 25 bp, S. cerevisiae
aaagctctactcatgatcgcacaat

SEQ ID NO: 13905 - DNA, 25 bp, S. cerevisiae
aaagactatctcatatgtccccaga

SEQ ID NO: 13906 - DNA, 25 bp, S. cerevisiae
aaagatcttctcattcaaacgcata

SEQ ID NO: 13907 - DNA, 25 bp, S. cerevisiae
aaagcggtccaattcaactcagcaa

SEQ ID NO: 13908 - DNA, 25 bp, S. cerevisiae
aaagcggccgcttatacaccaacag

SEQ ID NO: 13909 - DNA, 25 bp, S. cerevisiae
aaagaacgcagccattgcttcctct

SEQ ID NO: 13910 - DNA, 25 bp, S. cerevisiae
aaagcaagcaacctgtattcctcac

SEQ ID NO: 13911 - DNA, 25 bp, S. cerevisiae
aagggaagaccatcgaccacatgtg

SEQ ID NO: 13912 - DNA, 25 bp, S. cerevisiae
aaagatgcgaacaacttccccattg

SEQ ID NO: 13913 - DNA, 25 bp, S. cerevisiae
aaagcagctgacattcttccggata

SEQ ID NO: 13914 - DNA, 25 bp, S. cerevisiae
aaagcagtcacaaattcccacgctg

SEQ ID NO: 13915 - DNA, 25 bp, S. cerevisiae
aaagagcccatttcactggacactc

SEQ ID NO: 13916 - DNA, 25 bp, S. cerevisiae
aaagagaccattgacgacactgcct

SEQ ID NO: 13917 - DNA, 25 bp, S. cerevisiae
aaaccactttgccatggacattgcc

SEQ ID NO: 13918 - DNA, 25 bp, S. cerevisiae
aaagaattgtacagtgccgtcaccg

SEQ ID NO: 13919 - DNA, 25 bp, S. cerevisiae
aaagatcttgtgacacggcctgcta

SEQ ID NO: 13920 - DNA, 25 bp, S. cerevisiae
aaagcattgctgatcttggactcat

SEQ ID NO: 13921 - DNA, 25 bp, S. cerevisiae
aaagccgctagatgttgtaattcct

SEQ ID NO: 13922 - DNA, 25 bp, S. cerevisiae
aaagaatctgtttttggccacaaga

SEQ ID NO: 13923 - DNA, 25 bp, S. cerevisiae
aaagcctatcgtgctttcctcggaa

SEQ ID NO: 13924 - DNA, 25 bp, S. cerevisiae
aaagatgggcattcctacgcgaaga

SEQ ID NO: 13925 - DNA, 25 bp, S. cerevisiae
aaagagtcctatatcctggtagaag

SEQ ID NO: 13926 - DNA, 25 bp, S. cerevisiae
aaagaagcttctgaactcaaggaca

SEQ ID NO: 13927 - DNA, 25 bp, S. cerevisiae
aaagacctgatcgacaagccagatg

SEQ ID NO: 13928 - DNA, 25 bp, S. cerevisiae
aaagagcctatcaacgaccaggaga

SEQ ID NO: 13929 - DNA, 25 bp, S. cerevisiae
aaagcagccaaaagcgtccgatagt

SEQ ID NO: 13930 - DNA, 25 bp, S. cerevisiae
aaagaaatctttgcaacatctgaag

SEQ ID NO: 13931 - DNA, 25 bp, S. cerevisiae
aaagactatcttaccaaccagcagc

SEQ ID NO: 13932 - DNA, 25 bp, S. cerevisiae
aaagcctactttgataccagataat

SEQ ID NO: 13933 - DNA, 25 bp, S. cerevisiae
aaagccccttggtgacttcaatgat

SEQ ID NO: 13934 - DNA, 25 bp, S. cerevisiae
aaagccgcccattgtagtaccaata

SEQ ID NO: 13935 - DNA, 25 bp, S. cerevisiae
aaacccacaaggtgtactagtcgat

SEQ ID NO: 13936 - DNA, 25 bp, S. cerevisiae
aaagctgccgagtccacagatagta

SEQ ID NO: 13937 - DNA, 25 bp, S. cerevisiae
aaagcgggctggttacagacttact

SEQ ID NO: 13938 - DNA, 25 bp, S. cerevisiae
aaactgggctggtcttgagttccat

SEQ ID NO: 13939 - DNA, 25 bp, S. cerevisiae
aaactggtggcgctagaatgatcta

SEQ ID NO: 13940 - DNA, 25 bp, S. cerevisiae
aaaatggttcaggtagtgtttatat

SEQ ID NO: 13941 - DNA, 25 bp, S. cerevisiae
aaagctgtgcgatttcggtgtttct

SEQ ID NO: 13942 - DNA, 25 bp, S. cerevisiae
aaacatggcaatataggctggtccc

SEQ ID NO: 13943 - DNA, 25 bp, S. cerevisiae
aaagagagccattttgaccggtcat

SEQ ID NO: 13944 - DNA, 25 bp, S. cerevisiae
aaagactactccttgggcgctacat

SEQ ID NO: 13945 - DNA, 25 bp, S. cerevisiae
aaagacactgtcgttgcaaggctac

SEQ ID NO: 13946 - DNA, 25 bp, S. cerevisiae
aaacttccaggagattcgctacttg

SEQ ID NO: 13947 - DNA, 25 bp, S. cerevisiae
aaagaagctgccgctgttgctgaag

SEQ ID NO: 13948 - DNA, 25 bp, S. cerevisiae
aaagacctttcaaggcgacgcatct

SEQ ID NO: 13949 - DNA, 25 bp, S. cerevisiae
aaaccatcagggagttagcgcacgt

SEQ ID NO: 13950 - DNA, 25 bp, S. cerevisiae
aaaccaatcttttgctaagccatct

SEQ ID NO: 13951 - DNA, 25 bp, S. cerevisiae
aaagcatcagaggtgttggtccagt

SEQ ID NO: 13952 - DNA, 25 bp, S. cerevisiae
aaagcgagggttagccccagcttat

SEQ ID NO: 13953 - DNA, 25 bp, S. cerevisiae
aaagccgctggtaatgtcattggtg

SEQ ID NO: 13954 - DNA, 25 bp, S. cerevisiae
aaagcttgccatgggcggatttcaa

SEQ ID NO: 13955 - DNA, 25 bp, S. cerevisiae
aaactggcctcgctagttaagctca

SEQ ID NO: 13956 - DNA, 25 bp, S. cerevisiae
aaagaatggcttcccttggtgtcga

SEQ ID NO: 13957 - DNA, 25 bp, S. cerevisiae
aaactgtgaggatccattgccgact

SEQ ID NO: 13958 - DNA, 25 bp, S. cerevisiae
aaagaagtacatcgccaccattggt

SEQ ID NO: 13959 - DNA, 25 bp, S. cerevisiae
aaagctggcttacttggtgttgaga

SEQ ID NO: 13960 - DNA, 25 bp, S. cerevisiae
aaagcattgaataccgtctctgacg

SEQ ID NO: 13961 - DNA, 25 bp, S. cerevisiae
aaagctccaatattcgttctcacgc

SEQ ID NO: 13962 - DNA, 25 bp, S. cerevisiae
aaaccacgcaatacgttgcctgaga

SEQ ID NO: 13963 - DNA, 25 bp, S. cerevisiae
aaagctcaacttcaggcgatatcat

SEQ ID NO: 13964 - DNA, 25 bp, S. cerevisiae
aaagcgaatgctgcggctatttcct

SEQ ID NO: 13965 - DNA, 25 bp, S. cerevisiae
aaaccggcctgcgattagaatccca

SEQ ID NO: 13966 - DNA, 25 bp, S. cerevisiae
aaacctggcacctacggagacgcaa

SEQ ID NO: 13967 - DNA, 25 bp, S. cerevisiae
aacactgggtcctatcgtagacgga

SEQ ID NO: 13968 - DNA, 25 bp, S. cerevisiae
aaacgatggtccaggtacagcggaa

SEQ ID NO: 13969 - DNA, 25 bp, S. cerevisiae
aaactactatcgaggtacacggaat

SEQ ID NO: 13970 - DNA, 25 bp, S. cerevisiae
aaactggccactacgggtgcagcgg

SEQ ID NO: 13971 - DNA, 25 bp, S. cerevisiae
aacccacaattgatgcaggctgcgc

SEQ ID NO: 13972 - DNA, 25 bp, S. cerevisiae
aaaccttcttttgttagagctcgct

SEQ ID NO: 13973 - DNA, 25 bp, S. cerevisiae
aaagcacttctttctggttgtaacg

SEQ ID NO: 13974 - DNA, 25 bp, S. cerevisiae
aaagcagttgctgattggcctgtat

SEQ ID NO: 13975 - DNA, 25 bp, S. cerevisiae
aaagcagcttctgtttctccttcta

SEQ ID NO: 13976 - DNA, 25 bp, S. cerevisiae
aaaccaggacgattctgtccgtgaa

SEQ ID NO: 13977 - DNA, 25 bp, S. cerevisiae
aaagccttctcacaataagggcaaa

SEQ ID NO: 13978 - DNA, 25 bp, S. cerevisiae
aaagccactcaagaaaccgctgaaa

SEQ ID NO: 13979 - DNA, 25 bp, S. cerevisiae
aaacgtactcactcgaatcggtgcg

SEQ ID NO: 13980 - DNA, 25 bp, S. cerevisiae
aacatgtctgaatctttgaaggagg

SEQ ID NO: 13981 - DNA, 25 bp, S. cerevisiae
aaactctgtcagaagaaatcgagca

SEQ ID NO: 13982 - DNA, 25 bp, S. cerevisiae
aaacgttcacacattctagcaccag

SEQ ID NO: 13983 - DNA, 25 bp, S. cerevisiae
aaacgttagtcgttcatcccagcag

SEQ ID NO: 13984 - DNA, 25 bp, S. cerevisiae
aaagcttctctttacgttccaatga

SEQ ID NO: 13985 - DNA, 25 bp, S. cerevisiae
aaagcatcttctcccatacgtgtta

SEQ ID NO: 13986 - DNA, 25 bp, S. cerevisiae
aaagcactccctccaaggattctaa

SEQ ID NO: 13987 - DNA, 25 bp, S. cerevisiae
aaagcacttccagcaagttcaccag

SEQ ID NO: 13988 - DNA, 25 bp, S. cerevisiae
aaagccgttgttccattatctacta

SEQ ID NO: 13989 - DNA, 25 bp, S. cerevisiae
aagacttgaaagacggttggccaca

SEQ ID NO: 13990 - DNA, 25 bp, S. cerevisiae
aaagcttgacaagtctcgtgtggag

SEQ ID NO: 13991 - DNA, 25 bp, S. cerevisiae
aaagctgttcgagtatggcattgag

SEQ ID NO: 13992 - DNA, 25 bp, S. cerevisiae
aaagctatcttttcgtgtatgtacg

SEQ ID NO: 13993 - DNA, 25 bp, S. cerevisiae
aaacctgctatctctgttaaagctt

SEQ ID NO: 13994 - DNA, 25 bp, S. cerevisiae
aaagcttcttatccagtttacgtat

SEQ ID NO: 13995 - DNA, 25 bp, S. cerevisiae
aacagcttttcacatttaccgtctt

SEQ ID NO: 13996 - DNA, 25 bp, S. cerevisiae
aaacgacgttgatggcgacactccg

SEQ ID NO: 13997 - DNA, 25 bp, S. cerevisiae
aaaacggcagtcgatacggccacgg

SEQ ID NO: 13998 - DNA, 25 bp, S. cerevisiae
aagaacgagaccgatcagcagtgcg

SEQ ID NO: 13999 - DNA, 25 bp, S. cerevisiae
aaagcacaaaccgtcacatgccgtt

SEQ ID NO: 14000 - DNA, 25 bp, S. cerevisiae
aaagaaacactcgtcaagctgattt

SEQ ID NO: 14001 - DNA, 25 bp, S. cerevisiae
aacagcaaacaccagtaacgatatg

SEQ ID NO: 14002 - DNA, 25 bp, S. cerevisiae
aaagcgatcatcttgaggcactgaa

SEQ ID NO: 14003 - DNA, 25 bp, S. cerevisiae
aaagctgctctattaggccatgtag

SEQ ID NO: 14004 - DNA, 25 bp, S. cerevisiae
aaagctctgtgcgtacgaatccgtt

SEQ ID NO: 14005 - DNA, 25 bp, S. cerevisiae
aaagcctgtttatgcaaccattggg

SEQ ID NO: 14006 - DNA, 25 bp, S. cerevisiae
aaacttagagaacaccagcgctgaa

SEQ ID NO: 14007 - DNA, 25 bp, S. cerevisiae
aaagcttcataaactcaacggctga

SEQ ID NO: 14008 - DNA, 25 bp, S. cerevisiae
aaagcttctcaatctagatctgcta

SEQ ID NO: 14009 - DNA, 25 bp, S. cerevisiae
aaagctttctaggtcgtcttcttca

SEQ ID NO: 14010 - DNA, 25 bp, S. cerevisiae
aaacctgatccaggcctgtcttaac

SEQ ID NO: 14011 - DNA, 25 bp, S. cerevisiae
aaactgttgtattgcatggtgggtc

SEQ ID NO: 14012 - DNA, 25 bp, S. cerevisiae
aaacatgcattttggccgagaggac

SEQ ID NO: 14013 - DNA, 25 bp, S. cerevisiae
aaagctgctgctgctcagccgaagg

SEQ ID NO: 14014 - DNA, 25 bp, S. cerevisiae
aaaccagacccagccattgttgaaa

SEQ ID NO: 14015 - DNA, 25 bp, S. cerevisiae
aaaccgtgttaggaaatgctcagaa

SEQ ID NO: 14016 - DNA, 25 bp, S. cerevisiae
aaagcgcgtcacacaattttagttg

SEQ ID NO: 14017 - DNA, 25 bp, S. cerevisiae
aaagcgttccatgcaaactggagat

SEQ ID NO: 14018 - DNA, 25 bp, S. cerevisiae
aaagctttccaatctagcgaatgat

SEQ ID NO: 14019 - DNA, 25 bp, S. cerevisiae
aaagcttcccattgcctatggatat

SEQ ID NO: 14020 - DNA, 25 bp, S. cerevisiae
aaagcccaagccatttatgcacaaa

SEQ ID NO: 14021 - DNA, 25 bp, S. cerevisiae
aaacgctaccactgaccaagagggt

SEQ ID NO: 14022 - DNA, 25 bp, S. cerevisiae
aaagcgtaccacaggcgaatgcgta

SEQ ID NO: 14023 - DNA, 25 bp, S. cerevisiae
aaactttccatgtcgccagaaggta

SEQ ID NO: 14024 - DNA, 25 bp, S. cerevisiae
aaactgcttcgcatctcaaatcagg

SEQ ID NO: 14025 - DNA, 25 bp, S. cerevisiae
aaagcagtagccatccaagaaatat

SEQ ID NO: 14026 - DNA, 25 bp, S. cerevisiae
aaacagatccgcataccgcaagtat

SEQ ID NO: 14027 - DNA, 25 bp, S. cerevisiae
aaaccaccgaagtccagcaaaagca

SEQ ID NO: 14028 - DNA, 25 bp, S. cerevisiae
aaaccaaaacattcctctacatcaa

SEQ ID NO: 14029 - DNA, 25 bp, S. cerevisiae
aaaccaaggagtgccctcagcgaaa

SEQ ID NO: 14030 - DNA, 25 bp, S. cerevisiae
aaacctcagggctccttcagtaaag

SEQ ID NO: 14031 - DNA, 25 bp, S. cerevisiae
aaagccggaaatgcagtcgcagtta

SEQ ID NO: 14032 - DNA, 25 bp, S. cerevisiae
aaagcggcaaaaggcactccagtta

SEQ ID NO: 14033 - DNA, 25 bp, S. cerevisiae
aaagcctgcgcagacgtatttttct

SEQ ID NO: 14034 - DNA, 25 bp, S. cerevisiae
aaagcccggcgagatatgtctcaga

SEQ ID NO: 14035 - DNA, 25 bp, S. cerevisiae
aaagccccactgacgatagcatgga

SEQ ID NO: 14036 - DNA, 25 bp, S. cerevisiae
aaagcctccctagctcaatatgaag

SEQ ID NO: 14037 - DNA, 25 bp, S. cerevisiae
aaagcccacctagttgcaattgaaa

SEQ ID NO: 14038 - DNA, 25 bp, S. cerevisiae
aaagcagtgctttgtcttcaagatt

SEQ ID NO: 14039 - DNA, 25 bp, S. cerevisiae
aaagcagcctaatttctcaggaaag

SEQ ID NO: 14040 - DNA, 25 bp, S. cerevisiae
aaactcttgggcgatcatgcgctaa

SEQ ID NO: 14041 - DNA, 25 bp, S. cerevisiae
aaaccactcggctatcatgttcgaa

SEQ ID NO: 14042 - DNA, 25 bp, S. cerevisiae
aaaaaagctgctcaagctaagatag

SEQ ID NO: 14043 - DNA, 25 bp, S. cerevisiae
aaaactacgctgactcctacgattg

SEQ ID NO: 14044 - DNA, 25 bp, S. cerevisiae
aaaccatacctgacacaatccgatt

SEQ ID NO: 14045 - DNA, 25 bp, S. cerevisiae
aaaccgtgaccatttagttgcttag

SEQ ID NO: 14046 - DNA, 25 bp, S. cerevisiae
aaactgtcggccaagcaggcagacc

SEQ ID NO: 14047 - DNA, 25 bp, S. cerevisiae
aaagcgatcttcttgagagccaaca

SEQ ID NO: 14048 - DNA, 25 bp, S. cerevisiae
aaagcatgtctgtacaggaacccag

SEQ ID NO: 14049 - DNA, 25 bp, S. cerevisiae
aaacgcctgaatatcacaccacggt

SEQ ID NO: 14050 - DNA, 25 bp, S. cerevisiae
aaagctgtcaaatgaccactccggt

SEQ ID NO: 14051 - DNA, 25 bp, S. cerevisiae
aaagcagccgcaaacattctacaac

SEQ ID NO: 14052 - DNA, 25 bp, S. cerevisiae
aacactcaagatacctcagatgcca

SEQ ID NO: 14053 - DNA, 25 bp, S. cerevisiae
aaagcagcaggttctctcaagtcag

SEQ ID NO: 14054 - DNA, 25 bp, S. cerevisiae
aaagcaggtgttcccataggccgga

SEQ ID NO: 14055 - DNA, 25 bp, S. cerevisiae
aaagccgtcctttatagagactgtg

SEQ ID NO: 14056 - DNA, 25 bp, S. cerevisiae
aaagctctctgtgtcaaaggccggc

SEQ ID NO: 14057 - DNA, 25 bp, S. cerevisiae
aaactggcgtaagtgttcaactaca

SEQ ID NO: 14058 - DNA, 25 bp, S. cerevisiae
aaacggagtttccattccattagat

SEQ ID NO: 14059 - DNA, 25 bp, S. cerevisiae
aaaccgtggtcggatgtgccattga

SEQ ID NO: 14060 - DNA, 25 bp, S. cerevisiae
aaacggacacatttgacttcttcag

SEQ ID NO: 14061 - DNA, 25 bp, S. cerevisiae
aaagccgtactaagcactctcaagg

SEQ ID NO: 14062 - DNA, 25 bp, S. cerevisiae
aaagcctcttacagttgctcgatgg

SEQ ID NO: 14063 - DNA, 25 bp, S. cerevisiae
aaagcggtgctattgcctctgcaat

SEQ ID NO: 14064 - DNA, 25 bp, S. cerevisiae
aaacgatgtctgcaatgctcgcaat

SEQ ID NO: 14065 - DNA, 25 bp, S. cerevisiae
aaacgcattcattgggcgcgcgatt

SEQ ID NO: 14066 - DNA, 25 bp, S. cerevisiae
aaacgtcagggcatgcgccaatgat

SEQ ID NO: 14067 - DNA, 25 bp, S. cerevisiae
aaacctcagggtgcaatgtatcttt

SEQ ID NO: 14068 - DNA, 25 bp, S. cerevisiae
aaagctgtcgttcgcaccaaatgaa

SEQ ID NO: 14069 - DNA, 25 bp, S. cerevisiae
aaagctcgatggtgtacatacccac

SEQ ID NO: 14070 - DNA, 25 bp, S. cerevisiae
aaactgatccaacaagccacttcta

SEQ ID NO: 14071 - DNA, 25 bp, S. cerevisiae
aaagctggaccacaagctgccttaa

SEQ ID NO: 14072 - DNA, 25 bp, S. cerevisiae
aaagctcgacaacagcaatgcctaa

SEQ ID NO: 14073 - DNA, 25 bp, S. cerevisiae
aaagctttacgctggagcggatcca

SEQ ID NO: 14074 - DNA, 25 bp, S. cerevisiae
aaagcttacctgtggagccagacct

SEQ ID NO: 14075 - DNA, 25 bp, S. cerevisiae
aaagctctttcgctgggacatggtc

SEQ ID NO: 14076 - DNA, 25 bp, S. cerevisiae
aaactctgtagaccgtcgattggca

SEQ ID NO: 14077 - DNA, 25 bp, S. cerevisiae
aaacccaaacgagtgcgaactgcaa

SEQ ID NO: 14078 - DNA, 25 bp, S. cerevisiae
aaacctcatcaaccattccaagtta

SEQ ID NO: 14079 - DNA, 25 bp, S. cerevisiae
aaagcgcttgaaccctctaacgaat

SEQ ID NO: 14080 - DNA, 25 bp, S. cerevisiae
aaacctttgaggaattcaccgcaag

SEQ ID NO: 14081 - DNA, 25 bp, S. cerevisiae
aaagccttatcaagtttgcccaact

SEQ ID NO: 14082 - DNA, 25 bp, S. cerevisiae
aaaccgggttttatgacgcaggatg

SEQ ID NO: 14083 - DNA, 25 bp, S. cerevisiae
aaaccagggtctactagtgattgag

SEQ ID NO: 14084 - DNA, 25 bp, S. cerevisiae
aaaccgaggaggacgcaatcaatca

SEQ ID NO: 14085 - DNA, 25 bp, S. cerevisiae
aaaccgaaatcgtctgcaacagcac

SEQ ID NO: 14086 - DNA, 25 bp, S. cerevisiae
aaagccataacgatgctcagtcaat

SEQ ID NO: 14087 - DNA, 25 bp, S. cerevisiae
aaagccatgaacttatcccacattc

SEQ ID NO: 14088 - DNA, 25 bp, S. cerevisiae
aaacgatggtctttcaccagtctca

SEQ ID NO: 14089 - DNA, 25 bp, S. cerevisiae
aaacgcatggactttgatgggtcac

SEQ ID NO: 14090 - DNA, 25 bp, S. cerevisiae
aaagctggtgactgggttgccatct

SEQ ID NO: 14091 - DNA, 25 bp, S. cerevisiae
aagacggtgatctggcttttttgat

SEQ ID NO: 14092 - DNA, 25 bp, S. cerevisiae
aaacgtggtcaaggtgtttcatctt

SEQ ID NO: 14093 - DNA, 25 bp, S. cerevisiae
aaacttcttctccaatagggccaag

SEQ ID NO: 14094 - DNA, 25 bp, S. cerevisiae
aaagccgataacctagcggtctcag

SEQ ID NO: 14095 - DNA, 25 bp, S. cerevisiae
aacactcgagaatgcaaccgcttgg

SEQ ID NO: 14096 - DNA, 25 bp, S. cerevisiae
aaactcgcgaaattactatcattgg

SEQ ID NO: 14097 - DNA, 25 bp, S. cerevisiae
aaacgggtcctaaatgcggtgtgtg

SEQ ID NO: 14098 - DNA, 25 bp, S. cerevisiae
aaagcgtttcccagaggttatgatg

SEQ ID NO: 14099 - DNA, 25 bp, S. cerevisiae
aaagccttctgccaaagaggttaag

SEQ ID NO: 14100 - DNA, 25 bp, S. cerevisiae
aaactgttcgtcaaagaggccataa

SEQ ID NO: 14101 - DNA, 25 bp, S. cerevisiae
aaagctttctttttcctgatctgaa

SEQ ID NO: 14102 - DNA, 25 bp, S. cerevisiae
aaagctctctttgtcttctgttcaa

SEQ ID NO: 14103 - DNA, 25 bp, S. cerevisiae
aaagctccacaagctgctggtgtta

SEQ ID NO: 14104 - DNA, 25 bp, S. cerevisiae
aaagctattgcagctgctacggcgt

SEQ ID NO: 14105 - DNA, 25 bp, S. cerevisiae
aaagctcatccctttgaagttcgat

SEQ ID NO: 14106 - DNA, 25 bp, S. cerevisiae
aaagctgcctatcgtttcagttcga

SEQ ID NO: 14107 - DNA, 25 bp, S. cerevisiae
aaacgatgtctttactgtcccaatg

SEQ ID NO: 14108 - DNA, 25 bp, S. cerevisiae
aaagctgcaagagggtttcaatgat

SEQ ID NO: 14109 - DNA, 25 bp, S. cerevisiae
aaaccaaggtatttgcagcagtcaa

SEQ ID NO: 14110 - DNA, 25 bp, S. cerevisiae
aaaccgagtgcgtttcatgcatgta

SEQ ID NO: 14111 - DNA, 25 bp, S. cerevisiae
aaacggagcctcttcattatttgat

SEQ ID NO: 14112 - DNA, 25 bp, S. cerevisiae
aaaccagccttcatcattgttgcat

SEQ ID NO: 14113 - DNA, 25 bp, S. cerevisiae
aaacgcagtcgctagagttgccaag

SEQ ID NO: 14114 - DNA, 25 bp, S. cerevisiae
aaactgctggtgctgatcatgtcat

SEQ ID NO: 14115 - DNA, 25 bp, S. cerevisiae
aaagcgcttgcattttggtagattc

SEQ ID NO: 14116 - DNA, 25 bp, S. cerevisiae
aaacgcttctttggctgacaagtca

SEQ ID NO: 14117 - DNA, 25 bp, S. cerevisiae
aaactgctgttgatcgggaattccg

SEQ ID NO: 14118 - DNA, 25 bp, S. cerevisiae
aaactgctcttggtagactggataa

SEQ ID NO: 14119 - DNA, 25 bp, S. cerevisiae
aaactgtttgcggtgctattgacaa

SEQ ID NO: 14120 - DNA, 25 bp, S. cerevisiae
aaaccgtgatgctgttaccgagggc

SEQ ID NO: 14121 - DNA, 25 bp, S. cerevisiae
aaagcccttccagcgcagagaaatg

SEQ ID NO: 14122 - DNA, 25 bp, S. cerevisiae
aaaccagagcttgccgaacctttga

SEQ ID NO: 14123 - DNA, 25 bp, S. cerevisiae
aaaccatctctctactctggaagaa

SEQ ID NO: 14124 - DNA, 25 bp, S. cerevisiae
aaaccattctgagtcattctagtga

SEQ ID NO: 14125 - DNA, 25 bp, S. cerevisiae
aaaccttgtcgtaatctatgtggcc

SEQ ID NO: 14126 - DNA, 25 bp, S. cerevisiae
aaaccggtcgtaacttcagcacact

SEQ ID NO: 14127 - DNA, 25 bp, S. cerevisiae
aaagccggtcgttcgatcataagag

SEQ ID NO: 14128 - DNA, 25 bp, S. cerevisiae
aaacccgtcactcatatcaatacag

SEQ ID NO: 14129 - DNA, 25 bp, S. cerevisiae
aaagccttagtctccaagtcgttga

SEQ ID NO: 14130 - DNA, 25 bp, S. cerevisiae
aaaccactctaccatttcgttatca

SEQ ID NO: 14131 - DNA, 25 bp, S. cerevisiae
aaacttctgccgctttcaggaatgg

SEQ ID NO: 14132 - DNA, 25 bp, S. cerevisiae
aaactcctgcgcctggttataaatg

SEQ ID NO: 14133 - DNA, 25 bp, S. cerevisiae
aaagccaagcgtccggtaagcaatc

SEQ ID NO: 14134 - DNA, 25 bp, S. cerevisiae
aaacgaatgggatgagctacgcaaa

SEQ ID NO: 14135 - DNA, 25 bp, S. cerevisiae
aaacagattgcgcagggctttgaaa

SEQ ID NO: 14136 - DNA, 25 bp, S. cerevisiae
aaagcggctgagtatggcgcaatta

SEQ ID NO: 14137 - DNA, 25 bp, S. cerevisiae
aaagcctgacgttatcatctgcgcg

SEQ ID NO: 14138 - DNA, 25 bp, S. cerevisiae
aaacgccactttctggttctattag

SEQ ID NO: 14139 - DNA, 25 bp, S. cerevisiae
aaactccaatttcaggtcactcaaa

SEQ ID NO: 14140 - DNA, 25 bp, S. cerevisiae
aaacagaccgctactactgctaaag

SEQ ID NO: 14141 - DNA, 25 bp, S. cerevisiae
aacacaaaacatgccttgttccgaa

SEQ ID NO: 14142 - DNA, 25 bp, S. cerevisiae
aaacgatgtcatttctagcccagaa

SEQ ID NO: 14143 - DNA, 25 bp, S. cerevisiae
aaagcgatgtcttcttcacctataa

SEQ ID NO: 14144 - DNA, 25 bp, S. cerevisiae
aaacgttttagcaaattcgatatgg

SEQ ID NO: 14145 - DNA, 25 bp, S. cerevisiae
aaactgttcttgattcctatggtga

SEQ ID NO: 14146 - DNA, 25 bp, S. cerevisiae
aaacgtatttgcgtgtccacagatg

SEQ ID NO: 14147 - DNA, 25 bp, S. cerevisiae
aaacgctgtttcttggcatacactg

SEQ ID NO: 14148 - DNA, 25 bp, S. cerevisiae
aaaccagatttcaacgacgccagga

SEQ ID NO: 14149 - DNA, 25 bp, S. cerevisiae
aaacgttcttgttcgagatcttgga

SEQ ID NO: 14150 - DNA, 25 bp, S. cerevisiae
aaagccattgttcttggtcttccac

SEQ ID NO: 14151 - DNA, 25 bp, S. cerevisiae
aaacctgcgtatatttgacttcgac

SEQ ID NO: 14152 - DNA, 25 bp, S. cerevisiae
aaacttggctggtgttgactatcta

SEQ ID NO: 14153 - DNA, 25 bp, S. cerevisiae
aaagccatgggttctgttcagttct

SEQ ID NO: 14154 - DNA, 25 bp, S. cerevisiae
aaagccattggatttcttgcgtaca

SEQ ID NO: 14155 - DNA, 25 bp, S. cerevisiae
aaaccactgaaattcgtgtcagaag

SEQ ID NO: 14156 - DNA, 25 bp, S. cerevisiae
aaaccctcaatctacggtgacaatc

SEQ ID NO: 14157 - DNA, 25 bp, S. cerevisiae
aaacctactactttggccacaacag

SEQ ID NO: 14158 - DNA, 25 bp, S. cerevisiae
aaagcgttgcctttgtgagctgtca

SEQ ID NO: 14159 - DNA, 25 bp, S. cerevisiae
aaaccattccgtgtagtgccaataa

SEQ ID NO: 14160 - DNA, 25 bp, S. cerevisiae
aaacgaatccggtacaggccacaag

SEQ ID NO: 14161 - DNA, 25 bp, S. cerevisiae
aaacggttcaggaatcgggcaacat

SEQ ID NO: 14162 - DNA, 25 bp, S. cerevisiae
aaacgatgcgtattctgtcagggac

SEQ ID NO: 14163 - DNA, 25 bp, S. cerevisiae
aaagcgggtattgccgttgacaaga

SEQ ID NO: 14164 - DNA, 25 bp, S. cerevisiae
aaactggcgtttactcctggtcaag

SEQ ID NO: 14165 - DNA, 25 bp, S. cerevisiae
aaacccgtcatcaactccattgtaa

SEQ ID NO: 14166 - DNA, 25 bp, S. cerevisiae
aaacggcaactgttccaatggagaa

SEQ ID NO: 14167 - DNA, 25 bp, S. cerevisiae
aaagcccaatcgctaccatggagca

SEQ ID NO: 14168 - DNA, 25 bp, S. cerevisiae
aaagcctgacattggcagacctgga

SEQ ID NO: 14169 - DNA, 25 bp, S. cerevisiae
aaacttcaccaccagaaggcatgga

SEQ ID NO: 14170 - DNA, 25 bp, S. cerevisiae
aaaaccccgcagacgaagacgatct

SEQ ID NO: 14171 - DNA, 25 bp, S. cerevisiae
aaactccaaattccggcacttgtga

SEQ ID NO: 14172 - DNA, 25 bp, S. cerevisiae
aaacttctccgaactggttgattgg

SEQ ID NO: 14173 - DNA, 25 bp, S. cerevisiae
aaacttttggcaactcatgttacca

SEQ ID NO: 14174 - DNA, 25 bp, S. cerevisiae
aaactaagtggcaactactcgactg

SEQ ID NO: 14175 - DNA, 25 bp, S. cerevisiae
aaacgcaggtgggtggccatctact

SEQ ID NO: 14176 - DNA, 25 bp, S. cerevisiae
aaacctctgtcgatgtacttggaaa

SEQ ID NO: 14177 - DNA, 25 bp, S. cerevisiae
aaagcctgtaggatcgacgttaata

SEQ ID NO: 14178 - DNA, 25 bp, S. cerevisiae
aaacgctagggtccgacgtgcataa

SEQ ID NO: 14179 - DNA, 25 bp, S. cerevisiae
aaagccgacattgcctgtgctggta

SEQ ID NO: 14180 - DNA, 25 bp, S. cerevisiae
aaactctaatgtccgtgtgttataa

SEQ ID NO: 14181 - DNA, 25 bp, S. cerevisiae
aaacactaagctccttggctttggt

SEQ ID NO: 14182 - DNA, 25 bp, S. cerevisiae
aaagccagctatctccaaggctcta

SEQ ID NO: 14183 - DNA, 25 bp, S. cerevisiae
aaagccagctatctccaaggctcta

SEQ ID NO: 14184 - DNA, 25 bp, S. cerevisiae
aaagccagccatctccagtgctcta

SEQ ID NO: 14185 - DNA, 25 bp, S. cerevisiae
aaagccagccatctccagtgctcta

SEQ ID NO: 14186 - DNA, 25 bp, S. cerevisiae
aaagccagcaaattaccccaaagag

SEQ ID NO: 14187 - DNA, 25 bp, S. cerevisiae
aaacgtctacgccaacaatgaatct

SEQ ID NO: 14188 - DNA, 25 bp, S. cerevisiae
aaaccagtccacgttgtcagaatgc

SEQ ID NO: 14189 - DNA, 25 bp, S. cerevisiae
aaacaggctcatcgcgaagcagtgc

SEQ ID NO: 14190 - DNA, 25 bp, S. cerevisiae
aaacatgctgcttcacgagggagaa

SEQ ID NO: 14191 - DNA, 25 bp, S. cerevisiae
aaactttatcacatgggcgatgact

SEQ ID NO: 14192 - DNA, 25 bp, S. cerevisiae
aaaccgctatacagggcagcattca

SEQ ID NO: 14193 - DNA, 25 bp, S. cerevisiae
aaacctcatttcaggatcactccag

SEQ ID NO: 14194 - DNA, 25 bp, S. cerevisiae
aaacctctatggtggagacatccaa

SEQ ID NO: 14195 - DNA, 25 bp, S. cerevisiae
aaacggctatgccagtcttactccg

SEQ ID NO: 14196 - DNA, 25 bp, S. cerevisiae
aaacatgggagcttttaactgccgg

SEQ ID NO: 14197 - DNA, 25 bp, S. cerevisiae
aaacaggcgctgtttacccattcgg

SEQ ID NO: 14198 - DNA, 25 bp, S. cerevisiae
aaacgcagcactattagcatccact

SEQ ID NO: 14199 - DNA, 25 bp, S. cerevisiae
aaagccgctaatatgtcagacgatg

SEQ ID NO: 14200 - DNA, 25 bp, S. cerevisiae
aaactctcctgataaggcttgccac

SEQ ID NO: 14201 - DNA, 25 bp, S. cerevisiae
aaaaatacgttgcactgtcccgtgt

SEQ ID NO: 14202 - DNA, 25 bp, S. cerevisiae
aaacaagtgcttccgttcgttccag

SEQ ID NO: 14203 - DNA, 25 bp, S. cerevisiae
aaacggtgccttcttcgttgcaggt

SEQ ID NO: 14204 - DNA, 25 bp, S. cerevisiae
aaagccgtacgtcttgaagcaacag

SEQ ID NO: 14205 - DNA, 25 bp, S. cerevisiae
aaacctccacttcctattaaggcag

SEQ ID NO: 14206 - DNA, 25 bp, S. cerevisiae
aaactcctacttgccagctagacaa

SEQ ID NO: 14207 - DNA, 25 bp, S. cerevisiae
aaacttttctcagccaaatcgcaac

SEQ ID NO: 14208 - DNA, 25 bp, S. cerevisiae
aaaccgtatgaactctgcgttgtca

SEQ ID NO: 14209 - DNA, 25 bp, S. cerevisiae
aaacttggttggtactgtcgatgac

SEQ ID NO: 14210 - DNA, 25 bp, S. cerevisiae
aaacttggttatgatgctgtctttc

SEQ ID NO: 14211 - DNA, 25 bp, S. cerevisiae
aaaccgccattgtgggtacagtttg

SEQ ID NO: 14212 - DNA, 25 bp, S. cerevisiae
aaacctggtgctaaatgggacgatt

SEQ ID NO: 14213 - DNA, 25 bp, S. cerevisiae
aataccaacacgatcctttctactt

SEQ ID NO: 14214 - DNA, 25 bp, S. cerevisiae
aataccaacacgacgtctactacgt

SEQ ID NO: 14215 - DNA, 25 bp, S. cerevisiae
aaaccaacccgatcattctagcttt

SEQ ID NO: 14216 - DNA, 25 bp, S. cerevisiae
aaactacacgcacgatttttcactc

SEQ ID NO: 14217 - DNA, 25 bp, S. cerevisiae
aaactactcgtttggccatggtcac

SEQ ID NO: 14218 - DNA, 25 bp, S. cerevisiae
aaactttgcttggtatccccactag

SEQ ID NO: 14219 - DNA, 25 bp, S. cerevisiae
aaacctttcttggatccagtcactg

SEQ ID NO: 14220 - DNA, 25 bp, S. cerevisiae
aaacctgtggccatgtcttttgtga

SEQ ID NO: 14221 - DNA, 25 bp, S. cerevisiae
aaagccatcccagcaagtatcttga

SEQ ID NO: 14222 - DNA, 25 bp, S. cerevisiae
aaaccacacagagccgttctagaac

SEQ ID NO: 14223 - DNA, 25 bp, S. cerevisiae
aaacgccaaggagctgtcatacgat

SEQ ID NO: 14224 - DNA, 25 bp, S. cerevisiae
aaacgccaaatatcgctcaaagctg

SEQ ID NO: 14225 - DNA, 25 bp, S. cerevisiae
aaacggacattttcattcaagagga

SEQ ID NO: 14226 - DNA, 25 bp, S. cerevisiae
aaagccactttagccagagatttgc

SEQ ID NO: 14227 - DNA, 25 bp, S. cerevisiae
gaaaccccaatacaaatatcccgct

SEQ ID NO: 14228 - DNA, 25 bp, S. cerevisiae
aagaccttcgaacaagcttatccct

SEQ ID NO: 14229 - DNA, 25 bp, S. cerevisiae
aaacgtcaagaacatagtgctgcac

SEQ ID NO: 14230 - DNA, 25 bp, S. cerevisiae
aaacggcgaagctcagactaatgat

SEQ ID NO: 14231 - DNA, 25 bp, S. cerevisiae
aaactttagctgttaacgctgccaa

SEQ ID NO: 14232 - DNA, 25 bp, S. cerevisiae
aaacttgttgccttacatcctgcta

SEQ ID NO: 14233 - DNA, 25 bp, S. cerevisiae
aaactgcttgggattttctcgagga

SEQ ID NO: 14234 - DNA, 25 bp, S. cerevisiae
aaaccattgtggcattttgctctag

SEQ ID NO: 14235 - DNA, 25 bp, S. cerevisiae
aaacctgttgggattctgtgatgac

SEQ ID NO: 14236 - DNA, 25 bp, S. cerevisiae
aaacctttggcgataattctgatga

SEQ ID NO: 14237 - DNA, 25 bp, S. cerevisiae
aaacgcccacttcttattggatgtt

SEQ ID NO: 14238 - DNA, 25 bp, S. cerevisiae
aaacgaccactttttatcctgcaat

SEQ ID NO: 14239 - DNA, 25 bp, S. cerevisiae
aaacggtcgcatttttgatctaaat

SEQ ID NO: 14240 - DNA, 25 bp, S. cerevisiae
aaaccgcacgaagttctgatctaaa

SEQ ID NO: 14241 - DNA, 25 bp, S. cerevisiae
aaacccaagtggtgctgttgctgcc

SEQ ID NO: 14242 - DNA, 25 bp, S. cerevisiae
aaacctaagaattgcctctcgcttt

SEQ ID NO: 14243 - DNA, 25 bp, S. cerevisiae
aaacgttgaagttctcgctgcagat

SEQ ID NO: 14244 - DNA, 25 bp, S. cerevisiae
aaactactacgctacatcttatggt

SEQ ID NO: 14245 - DNA, 25 bp, S. cerevisiae
aaactacgacgtaatctccgcatgt

SEQ ID NO: 14246 - DNA, 25 bp, S. cerevisiae
aaaccgataacacattccagagata

SEQ ID NO: 14247 - DNA, 25 bp, S. cerevisiae
aaactcgatagtgccattccacgat

SEQ ID NO: 14248 - DNA, 25 bp, S. cerevisiae
aaactctacgagtgcattcccgatt

SEQ ID NO: 14249 - DNA, 25 bp, S. cerevisiae
aaactgaactagtccatgggcccat

SEQ ID NO: 14250 - DNA, 25 bp, S. cerevisiae
aaacaaggtagctggcagaacgtat

SEQ ID NO: 14251 - DNA, 25 bp, S. cerevisiae
aaaacagtcaagtgacaatttgttt

SEQ ID NO: 14252 - DNA, 25 bp, S. cerevisiae
aaaccgtcaaaacgacattactgat

SEQ ID NO: 14253 - DNA, 25 bp, S. cerevisiae
aaaccgatctcacagacctcggatg

SEQ ID NO: 14254 - DNA, 25 bp, S. cerevisiae
aaacccattggctgactttgtggag

SEQ ID NO: 14255 - DNA, 25 bp, S. cerevisiae
aaaccaccccatgaacttgtggagg

SEQ ID NO: 14256 - DNA, 25 bp, S. cerevisiae
aaaccagcctttgacctttgtgatg

SEQ ID NO: 14257 - DNA, 25 bp, S. cerevisiae
aaacgacatcattaaacctttggtg

SEQ ID NO: 14258 - DNA, 25 bp, S. cerevisiae
aaactactctgaacattccttgggt

SEQ ID NO: 14259 - DNA, 25 bp, S. cerevisiae
aaactaccgtcctatccattgtgag

SEQ ID NO: 14260 - DNA, 25 bp, S. cerevisiae
aaacgaccgcttccgctaatgtgag

SEQ ID NO: 14261 - DNA, 25 bp, S. cerevisiae
aaacgtcgccactcatttaattaga

SEQ ID NO: 14262 - DNA, 25 bp, S. cerevisiae
cgaagtccaacataaacgggctaat

SEQ ID NO: 14263 - DNA, 25 bp, S. cerevisiae
gcaaaccgaacatcaaaccgtccaa

SEQ ID NO: 14264 - DNA, 25 bp, S. cerevisiae
aagatccggtcatagaaccgctcca

SEQ ID NO: 14265 - DNA, 25 bp, S. cerevisiae
aaaccgtggcaaaagaatctgtaag

SEQ ID NO: 14266 - DNA, 25 bp, S. cerevisiae
aaaccgttattaatgctgctctggg

SEQ ID NO: 14267 - DNA, 25 bp, S. cerevisiae
aaaccttataccaagacatggctgc

SEQ ID NO: 14268 - DNA, 25 bp, S. cerevisiae
aaactttgaacccaacatcgtcagc

SEQ ID NO: 14269 - DNA, 25 bp, S. cerevisiae
aaacgttaaccgctatttgcaagtg

SEQ ID NO: 14270 - DNA, 25 bp, S. cerevisiae
aaacgctctgaagggtaatttgcca

SEQ ID NO: 14271 - DNA, 25 bp, S. cerevisiae
aaacgctttacgcttttatgtcacg

SEQ ID NO: 14272 - DNA, 25 bp, S. cerevisiae
aaacgcgattatccgaattgttgtc

SEQ ID NO: 14273 - DNA, 25 bp, S. cerevisiae
aaacgttgacaccttgtctggtggt

SEQ ID NO: 14274 - DNA, 25 bp, S. cerevisiae
aaacctatctgtttcttcaggatca

SEQ ID NO: 14275 - DNA, 25 bp, S. cerevisiae
aaacctacgcacatcttggatttga

SEQ ID NO: 14276 - DNA, 25 bp, S. cerevisiae
aaaacttatcccacgaatttgatgt

SEQ ID NO: 14277 - DNA, 25 bp, S. cerevisiae
aaacgattattctccattgttggca

SEQ ID NO: 14278 - DNA, 25 bp, S. cerevisiae
aaacttaagtgtcctgccagattca

SEQ ID NO: 14279 - DNA, 25 bp, S. cerevisiae
aaaactcaactatcggcaattacca

SEQ ID NO: 14280 - DNA, 25 bp, S. cerevisiae
aaaaccaggatctagaacaacagct

SEQ ID NO: 14281 - DNA, 25 bp, S. cerevisiae
aaaccgcggaggaagccagtcaact

SEQ ID NO: 14282 - DNA, 25 bp, S. cerevisiae
aaaccgtggcattcaactagcacaa

SEQ ID NO: 14283 - DNA, 25 bp, S. cerevisiae
aaacgctattgatgaggcacgcaaa

SEQ ID NO: 14284 - DNA, 25 bp, S. cerevisiae
aaacgtaccagtcccgaggcattga

SEQ ID NO: 14285 - DNA, 25 bp, S. cerevisiae
aaacgatgaccaccgcgagggattc

SEQ ID NO: 14286 - DNA, 25 bp, S. cerevisiae
aaacacataccatagcgcaaagaac

SEQ ID NO: 14287 - DNA, 25 bp, S. cerevisiae
aaacctccagcatatgccctattag

SEQ ID NO: 14288 - DNA, 25 bp, S. cerevisiae
aaacctgccaactattcctataaga

SEQ ID NO: 14289 - DNA, 25 bp, S. cerevisiae
aaacttacatacattccttgctgga

SEQ ID NO: 14290 - DNA, 25 bp, S. cerevisiae
aaacttagctacctttgcatcatta

SEQ ID NO: 14291 - DNA, 25 bp, S. cerevisiae
aaacttgcgaatacgtgtgctcatt

SEQ ID NO: 14292 - DNA, 25 bp, S. cerevisiae
aaacattgctgatggtgtcgaacaa

SEQ ID NO: 14293 - DNA, 25 bp, S. cerevisiae
aaactacttcgaggatttgccacag

SEQ ID NO: 14294 - DNA, 25 bp, S. cerevisiae
aaaccctatgcgtgatttgaagatc

SEQ ID NO: 14295 - DNA, 25 bp, S. cerevisiae
aaaccccttctgctcaacagagaga

SEQ ID NO: 14296 - DNA, 25 bp, S. cerevisiae
aaacccctgctaggtctaagatcaa

SEQ ID NO: 14297 - DNA, 25 bp, S. cerevisiae
aaactgtgcgattcactaaagctaa

SEQ ID NO: 14298 - DNA, 25 bp, S. cerevisiae
aaacgctgatgaggccttgaagcaa

SEQ ID NO: 14299 - DNA, 25 bp, S. cerevisiae
aaacgacatggagcactgaagaact

SEQ ID NO: 14300 - DNA, 25 bp, S. cerevisiae
aaacgacagcgagcctgaatctgaa

SEQ ID NO: 14301 - DNA, 25 bp, S. cerevisiae
aaacgactgcaaacgctatcacaag

SEQ ID NO: 14302 - DNA, 25 bp, S. cerevisiae
aaactcctgaggatctagcccagtg

SEQ ID NO: 14303 - DNA, 25 bp, S. cerevisiae
aaaccgcggataatcatggtccagt

SEQ ID NO: 14304 - DNA, 25 bp, S. cerevisiae
aaacggcatcaagtgctcctggaaa

SEQ ID NO: 14305 - DNA, 25 bp, S. cerevisiae
aaacggcagcatatccatttgaaat

SEQ ID NO: 14306 - DNA, 25 bp, S. cerevisiae
aaacgggaaacaaggttcacatcag

SEQ ID NO: 14307 - DNA, 25 bp, S. cerevisiae
aaactaggcgagttgacctctaaga

SEQ ID NO: 14308 - DNA, 25 bp, S. cerevisiae
aaactagcctagtttctccgaaatg

SEQ ID NO: 14309 - DNA, 25 bp, S. cerevisiae
aaacgcaactcctgcaatggacact

SEQ ID NO: 14310 - DNA, 25 bp, S. cerevisiae
aaactgctactcaaggaacgacctg

SEQ ID NO: 14311 - DNA, 25 bp, S. cerevisiae
aaactaatccaacaagccacatcag

SEQ ID NO: 14312 - DNA, 25 bp, S. cerevisiae
aaactggcagactggtcatgagtga

SEQ ID NO: 14313 - DNA, 25 bp, S. cerevisiae
aaactgagcatgacctggacatctt

SEQ ID NO: 14314 - DNA, 25 bp, S. cerevisiae
aaacgaggtgtcagcagtgtcatac

SEQ ID NO: 14315 - DNA, 25 bp, S. cerevisiae
aaacgagcttgtgctgcagggcgac

SEQ ID NO: 14316 - DNA, 25 bp, S. cerevisiae
aaactcatctttcctgatggagcgt

SEQ ID NO: 14317 - DNA, 25 bp, S. cerevisiae
aaaccggtcatcttcgatactattt

SEQ ID NO: 14318 - DNA, 25 bp, S. cerevisiae
aaaccgattctctaatggacgatgg

SEQ ID NO: 14319 - DNA, 25 bp, S. cerevisiae
aaacgctgtgtccatcgatttcgat

SEQ ID NO: 14320 - DNA, 25 bp, S. cerevisiae
aaacccactgcagttgatcctaatt

SEQ ID NO: 14321 - DNA, 25 bp, S. cerevisiae
aaacgcgtttgtattggccacgata

SEQ ID NO: 14322 - DNA, 25 bp, S. cerevisiae
aaacggctgtttctgcttccaaaag

SEQ ID NO: 14323 - DNA, 25 bp, S. cerevisiae
aaaccgtatgctctagattcattac

SEQ ID NO: 14324 - DNA, 25 bp, S. cerevisiae
aaactgccaacgttgcttctttgaa

SEQ ID NO: 14325 - DNA, 25 bp, S. cerevisiae
aaacacttttattgatgattgtctt

SEQ ID NO: 14326 - DNA, 25 bp, S. cerevisiae
aaactgctggttcagatgaagtctt

SEQ ID NO: 14327 - DNA, 25 bp, S. cerevisiae
aaacgtcgttcttgatgatgcaatg

SEQ ID NO: 14328 - DNA, 25 bp, S. cerevisiae
aaacgagcgtcatttgtgtgcaaga

SEQ ID NO: 14329 - DNA, 25 bp, S. cerevisiae
aaacgatgcctattatgctccacag

SEQ ID NO: 14330 - DNA, 25 bp, S. cerevisiae
aaactgatactttagcaccattgca

SEQ ID NO: 14331 - DNA, 25 bp, S. cerevisiae
aaacattacatggacagcggcttag

SEQ ID NO: 14332 - DNA, 25 bp, S. cerevisiae
aaactctcattgtctaaggctgatg

SEQ ID NO: 14333 - DNA, 25 bp, S. cerevisiae
aaactccagcatttatcactcgcat

SEQ ID NO: 14334 - DNA, 25 bp, S. cerevisiae
aaactcaaattcttcatcctcttca

SEQ ID NO: 14335 - DNA, 25 bp, S. cerevisiae
aaactttagagctaccgccattcat

SEQ ID NO: 14336 - DNA, 25 bp, S. cerevisiae
aaactatctagacaccctgagcttt

SEQ ID NO: 14337 - DNA, 25 bp, S. cerevisiae
aaactagcacaacttctactaccac

SEQ ID NO: 14338 - DNA, 25 bp, S. cerevisiae
aaacttcagcaactactacttctcc

SEQ ID NO: 14339 - DNA, 25 bp, S. cerevisiae
aaactattcacagtggccttgacat

SEQ ID NO: 14340 - DNA, 25 bp, S. cerevisiae
aaacatattgacgtcgatttgatcg

SEQ ID NO: 14341 - DNA, 25 bp, S. cerevisiae
aaactatcggacgtgttcctcgagc

SEQ ID NO: 14342 - DNA, 25 bp, S. cerevisiae
aaactggtagatctgtgtccaccgc

SEQ ID NO: 14343 - DNA, 25 bp, S. cerevisiae
aaactgattcaacaggtcccaccag

SEQ ID NO: 14344 - DNA, 25 bp, S. cerevisiae
aaactgtaacatatagcccgcatcc

SEQ ID NO: 14345 - DNA, 25 bp, S. cerevisiae
aaaatgccggtcctgtcaaagttga

SEQ ID NO: 14346 - DNA, 25 bp, S. cerevisiae
aaaagccggacacgccattgtttat

SEQ ID NO: 14347 - DNA, 25 bp, S. cerevisiae
aaaagccagcgaggctcattctggg

SEQ ID NO: 14348 - DNA, 25 bp, S. cerevisiae
aaacgcctggcatcatcgtgttgac

SEQ ID NO: 14349 - DNA, 25 bp, S. cerevisiae
aaacagtcagtttctctggagagca

SEQ ID NO: 14350 - DNA, 25 bp, S. cerevisiae
aaactagcgaattatctggtgatga

SEQ ID NO: 14351 - DNA, 25 bp, S. cerevisiae
aaacatagcagactttcccacagat

SEQ ID NO: 14352 - DNA, 25 bp, S. cerevisiae
aaacttgaagtcgtcacacaccact

SEQ ID NO: 14353 - DNA, 25 bp, S. cerevisiae
aaactcatcaagacctatgccacca

SEQ ID NO: 14354 - DNA, 25 bp, S. cerevisiae
aaacgtgtgcaactcttaggctctg

SEQ ID NO: 14355 - DNA, 25 bp, S. cerevisiae
aaacgcgtccgttagtgagatcaca

SEQ ID NO: 14356 - DNA, 25 bp, S. cerevisiae
aaacgtgcctccaaggctttgattg

SEQ ID NO: 14357 - DNA, 25 bp, S. cerevisiae
aaaattcccctatgtgaggtggaca

SEQ ID NO: 14358 - DNA, 25 bp, S. cerevisiae
aaaaattttagacgcggcgcttgca

SEQ ID NO: 14359 - DNA, 25 bp, S. cerevisiae
aaacaacttgtaaatggcggctcca

SEQ ID NO: 14360 - DNA, 25 bp, S. cerevisiae
aaacaacattgcatggaggccccag

SEQ ID NO: 14361 - DNA, 25 bp, S. cerevisiae
aaaagtagtcaaggaggctctcgaa

SEQ ID NO: 14362 - DNA, 25 bp, S. cerevisiae
aaacggtgttctcaaggccatgtca

SEQ ID NO: 14363 - DNA, 25 bp, S. cerevisiae
aaaacgtttcgtcagtgtctgccaa

SEQ ID NO: 14364 - DNA, 25 bp, S. cerevisiae
aaaacgttgtggctactgccgagct

SEQ ID NO: 14365 - DNA, 25 bp, S. cerevisiae
aaaacctcgcgtgtttggcggatgt

SEQ ID NO: 14366 - DNA, 25 bp, S. cerevisiae
aaaaccctggatcaattccttctct

SEQ ID NO: 14367 - DNA, 25 bp, S. cerevisiae
aaactcttcgtacccagacttatgg

SEQ ID NO: 14368 - DNA, 25 bp, S. cerevisiae
aaacatttctgttggtgaatctggt

SEQ ID NO: 14369 - DNA, 25 bp, S. cerevisiae
aaacgaactatctctcaagggcatt

SEQ ID NO: 14370 - DNA, 25 bp, S. cerevisiae
aaactaaccaccgacactggacatg

SEQ ID NO: 14371 - DNA, 25 bp, S. cerevisiae
aaactaaatcccgagcagctgaatg

SEQ ID NO: 14372 - DNA, 25 bp, S. cerevisiae
aaaaagaatcccgtcgtggtgcgat

SEQ ID NO: 14373 - DNA, 25 bp, S. cerevisiae
aaactaaacctcttcgtgcgtgatt

SEQ ID NO: 14374 - DNA, 25 bp, S. cerevisiae
aaacatattgtcctgtaccggtact

SEQ ID NO: 14375 - DNA, 25 bp, S. cerevisiae
aaaagcttttgggactcgaatactg

SEQ ID NO: 14376 - DNA, 25 bp, S. cerevisiae
aagatactcttcactaaccaaacct

SEQ ID NO: 14377 - DNA, 25 bp, S. cerevisiae
aaacattcatccatcatacaccaaa

SEQ ID NO: 14378 - DNA, 25 bp, S. cerevisiae
aaacgctcttctccatatcgtataa

SEQ ID NO: 14379 - DNA, 25 bp, S. cerevisiae
aaacgctttctccttcatgttacaa

SEQ ID NO: 14380 - DNA, 25 bp, S. cerevisiae
aaacgatcttctaacttctgtgaat

SEQ ID NO: 14381 - DNA, 25 bp, S. cerevisiae
aaacggttcatcatcttcaatcaat

SEQ ID NO: 14382 - DNA, 25 bp, S. cerevisiae
aaactggccctttttcaatatgctt

SEQ ID NO: 14383 - DNA, 25 bp, S. cerevisiae
aaactgcgtctgattcttcgaatgt

SEQ ID NO: 14384 - DNA, 25 bp, S. cerevisiae
aaacgcttcgtcattgatctggcat

SEQ ID NO: 14385 - DNA, 25 bp, S. cerevisiae
aaacggcggtgcattgatgcctgct

SEQ ID NO: 14386 - DNA, 25 bp, S. cerevisiae
aaaatggtgagttctctggcggtgc

SEQ ID NO: 14387 - DNA, 25 bp, S. cerevisiae
aaacaggtgcgttgtcaatcggtga

SEQ ID NO: 14388 - DNA, 25 bp, S. cerevisiae
aaacggtggctgttcgtgggctact

SEQ ID NO: 14389 - DNA, 25 bp, S. cerevisiae
aaacaggccgcttatgtggctgcgt

SEQ ID NO: 14390 - DNA, 25 bp, S. cerevisiae
aaacatggccgctaatgcttgacaa

SEQ ID NO: 14391 - DNA, 25 bp, S. cerevisiae
aaacgtgtttcatgtgtagactgac

SEQ ID NO: 14392 - DNA, 25 bp, S. cerevisiae
aaactgcttcttgaggattccatga

SEQ ID NO: 14393 - DNA, 25 bp, S. cerevisiae
aaacagttttgccagtggttgcata

SEQ ID NO: 14394 - DNA, 25 bp, S. cerevisiae
aaacactgccggcattgggtcagga

SEQ ID NO: 14395 - DNA, 25 bp, S. cerevisiae
aaaaatgctggtcctgtaaacgtgg

SEQ ID NO: 14396 - DNA, 25 bp, S. cerevisiae
aaaaatcatgtagctgcccaacggg

SEQ ID NO: 14397 - DNA, 25 bp, S. cerevisiae
aaacaccttcacatctcaaaacggg

SEQ ID NO: 14398 - DNA, 25 bp, S. cerevisiae
aaaacgacatgctcataccattggc

SEQ ID NO: 14399 - DNA, 25 bp, S. cerevisiae
aaaaattttgcctctctcgaacact

SEQ ID NO: 14400 - DNA, 25 bp, S. cerevisiae
aaacaacatttgaacctctcgacct

SEQ ID NO: 14401 - DNA, 25 bp, S. cerevisiae
aaacaaatcttctacttctcaacgt

SEQ ID NO: 14402 - DNA, 25 bp, S. cerevisiae
aaacaaatctcatcctatgtccacg

SEQ ID NO: 14403 - DNA, 25 bp, S. cerevisiae
aaacatgaactctctcgtagctacg

SEQ ID NO: 14404 - DNA, 25 bp, S. cerevisiae
aaacatcaaccattcgcggtgatat

SEQ ID NO: 14405 - DNA, 25 bp, S. cerevisiae
aaacatttcacttccagacgatgat

SEQ ID NO: 14406 - DNA, 25 bp, S. cerevisiae
aaactttagcacacttcagatccct

SEQ ID NO: 14407 - DNA, 25 bp, S. cerevisiae
aaacgtgttccctcaattgtcagat

SEQ ID NO: 14408 - DNA, 25 bp, S. cerevisiae
aaacacgcttcacccctattagaag

SEQ ID NO: 14409 - DNA, 25 bp, S. cerevisiae
aaacacctcgctggcgcttaataga

SEQ ID NO: 14410 - DNA, 25 bp, S. cerevisiae
aaactctggaatcgccgtcaacaaa

SEQ ID NO: 14411 - DNA, 25 bp, S. cerevisiae
aaacagtgctgataccgctaaaaat

SEQ ID NO: 14412 - DNA, 25 bp, S. cerevisiae
aagaacttgaagacggaaacataca

SEQ ID NO: 14413 - DNA, 25 bp, S. cerevisiae
aaaaattgaggtgggcacagccaaa

SEQ ID NO: 14414 - DNA, 25 bp, S. cerevisiae
aaacttatgctgtttactgcagcga

SEQ ID NO: 14415 - DNA, 25 bp, S. cerevisiae
aaactttgcgttcatctggacttcg

SEQ ID NO: 14416 - DNA, 25 bp, S. cerevisiae
aaaatacaagttcatgggtccagat

SEQ ID NO: 14417 - DNA, 25 bp, S. cerevisiae
caaaatacaaatcttctacccgtct

SEQ ID NO: 14418 - DNA, 25 bp, S. cerevisiae
aaaagcagccttccactaaacaact

SEQ ID NO: 14419 - DNA, 25 bp, S. cerevisiae
aaaagagcctattcatggaacaaga

SEQ ID NO: 14420 - DNA, 25 bp, S. cerevisiae
aaaactccagcagcaggaaccgcaa

SEQ ID NO: 14421 - DNA, 25 bp, S. cerevisiae
aaaaagactgctgaccaaactggaa

SEQ ID NO: 14422 - DNA, 25 bp, S. cerevisiae
aaaaaacacaaacagcgtcaaggct

SEQ ID NO: 14423 - DNA, 25 bp, S. cerevisiae
aaacaaaaccgcatcacctttggca

SEQ ID NO: 14424 - DNA, 25 bp, S. cerevisiae
aacaagaatccccagatgccgcttt

SEQ ID NO: 14425 - DNA, 25 bp, S. cerevisiae
aaacatttattctttgcgcacggca

SEQ ID NO: 14426 - DNA, 25 bp, S. cerevisiae
aaacttgtggatgctactactgtga

SEQ ID NO: 14427 - DNA, 25 bp, S. cerevisiae
aaacatttgagatcgactcgtggta

SEQ ID NO: 14428 - DNA, 25 bp, S. cerevisiae
aaacttgatcaatatgccatacttg

SEQ ID NO: 14429 - DNA, 25 bp, S. cerevisiae
aaactctgttttggcaggcaactgc

SEQ ID NO: 14430 - DNA, 25 bp, S. cerevisiae
aaacgtctctgtgtttggcactcaa

SEQ ID NO: 14431 - DNA, 25 bp, S. cerevisiae
aaactgcttatctcatttgcgcaat

SEQ ID NO: 14432 - DNA, 25 bp, S. cerevisiae
aaactccgccagatatcttgatcaa

SEQ ID NO: 14433 - DNA, 25 bp, S. cerevisiae
aaactcccataaattcgatatcaga

SEQ ID NO: 14434 - DNA, 25 bp, S. cerevisiae
aaactgtcgctgtcggtgttatcaa

SEQ ID NO: 14435 - DNA, 25 bp, S. cerevisiae
aaactgtcatcgttgggactgtcaa

SEQ ID NO: 14436 - DNA, 25 bp, S. cerevisiae
aaacattccacagggtacaaatcaa

SEQ ID NO: 14437 - DNA, 25 bp, S. cerevisiae
aaaatccccggagcacaagatataa

SEQ ID NO: 14438 - DNA, 25 bp, S. cerevisiae
aacataccctactgcaatcacaaaa

SEQ ID NO: 14439 - DNA, 25 bp, S. cerevisiae
aaaagcagctagtcatcgaacaaga

SEQ ID NO: 14440 - DNA, 25 bp, S. cerevisiae
aaactcacagagctcgaaacagatg

SEQ ID NO: 14441 - DNA, 25 bp, S. cerevisiae
aaactcagagagctcacaattcgga

SEQ ID NO: 14442 - DNA, 25 bp, S. cerevisiae
aaactcatggaagccatcttccgca

SEQ ID NO: 14443 - DNA, 25 bp, S. cerevisiae
aaacttcaaatctgctcatatccga

SEQ ID NO: 14444 - DNA, 25 bp, S. cerevisiae
aaactgcacatcataggcctatcca

SEQ ID NO: 14445 - DNA, 25 bp, S. cerevisiae
aaacaacatcatacgagcctgtgga

SEQ ID NO: 14446 - DNA, 25 bp, S. cerevisiae
aaactcacaattggccactgtggat

SEQ ID NO: 14447 - DNA, 25 bp, S. cerevisiae
aaaacactatatggctaagcatggt

SEQ ID NO: 14448 - DNA, 25 bp, S. cerevisiae
aagagaatcccctaatccatttgac

SEQ ID NO: 14449 - DNA, 25 bp, S. cerevisiae
aaaacccctctgatgacatttccat

SEQ ID NO: 14450 - DNA, 25 bp, S. cerevisiae
aaaagcccctcctagttggactatg

SEQ ID NO: 14451 - DNA, 25 bp, S. cerevisiae
aaacttctacttagtgcctcagacg

SEQ ID NO: 14452 - DNA, 25 bp, S. cerevisiae
aaaaattggttgtgtcttggcgcaa

SEQ ID NO: 14453 - DNA, 25 bp, S. cerevisiae
aaaattccagttgtacctccgagag

SEQ ID NO: 14454 - DNA, 25 bp, S. cerevisiae
aaaactctttccgacagcgacgagg

SEQ ID NO: 14455 - DNA, 25 bp, S. cerevisiae
aaactatttccgttgcgctattgtc

SEQ ID NO: 14456 - DNA, 25 bp, S. cerevisiae
aaacatcaattccaacacttcacaa

SEQ ID NO: 14457 - DNA, 25 bp, S. cerevisiae
aaaacatactactagcatcgtcaca

SEQ ID NO: 14458 - DNA, 25 bp, S. cerevisiae
aaacacgcagcttcattccaggtga

SEQ ID NO: 14459 - DNA, 25 bp, S. cerevisiae
aaacatcgacactattgccaaggaa

SEQ ID NO: 14460 - DNA, 25 bp, S. cerevisiae
aaaacgatactttgccagcgggtga

SEQ ID NO: 14461 - DNA, 25 bp, S. cerevisiae
cctaacgacctctctgacgaattga

SEQ ID NO: 14462 - DNA, 25 bp, S. cerevisiae
cttatcgaaccctacaacaacatta

SEQ ID NO: 14463 - DNA, 25 bp, S. cerevisiae
ctttaaaccctgaccacgatagtag

SEQ ID NO: 14464 - DNA, 25 bp, S. cerevisiae
cggttcagtcaacttcccagaagtg

SEQ ID NO: 14465 - DNA, 25 bp, S. cerevisiae
aacactctgtggtcaaatcctgtac

SEQ ID NO: 14466 - DNA, 25 bp, S. cerevisiae
aacaccacttggaaatcatgcagct

SEQ ID NO: 14467 - DNA, 25 bp, S. cerevisiae
aaactgtgcttggattcctcaggaa

SEQ ID NO: 14468 - DNA, 25 bp, S. cerevisiae
aaacattctctgttctttctgttcc

SEQ ID NO: 14469 - DNA, 25 bp, S. cerevisiae
aaacttccatcaattaaccttgaag

SEQ ID NO: 14470 - DNA, 25 bp, S. cerevisiae
aaacggccagtagcgagactgcaga

SEQ ID NO: 14471 - DNA, 25 bp, S. cerevisiae
aaacaacctccaacacaggcttatt

SEQ ID NO: 14472 - DNA, 25 bp, S. cerevisiae
aaacatgttcatgcctggcgctcaa

SEQ ID NO: 14473 - DNA, 25 bp, S. cerevisiae
aaacttgatcatatcctcgctatca

SEQ ID NO: 14474 - DNA, 25 bp, S. cerevisiae
aaactcccagttgcattttgacaag

SEQ ID NO: 14475 - DNA, 25 bp, S. cerevisiae
aaacttccagtttatctttgacgca

SEQ ID NO: 14476 - DNA, 25 bp, S. cerevisiae
aaactatgccactcctttagacgat

SEQ ID NO: 14477 - DNA, 25 bp, S. cerevisiae
aaacagtgttataacgccgttctag

SEQ ID NO: 14478 - DNA, 25 bp, S. cerevisiae
aaacagttttggacccgctagtgca

SEQ ID NO: 14479 - DNA, 25 bp, S. cerevisiae
aaacagcgtttttctcaagtagcaa

SEQ ID NO: 14480 - DNA, 25 bp, S. cerevisiae
aacacagcgttgcaaactacggcga

SEQ ID NO: 14481 - DNA, 25 bp, S. cerevisiae
aactcacgttggaaactggcgggcg

SEQ ID NO: 14482 - DNA, 25 bp, S. cerevisiae
aaactcggctctagattttacgcgt

SEQ ID NO: 14483 - DNA, 25 bp, S. cerevisiae
aaactcagtcactcttatgcaggct

SEQ ID NO: 14484 - DNA, 25 bp, S. cerevisiae
aaactatagccctacttcaccttct

SEQ ID NO: 14485 - DNA, 25 bp, S. cerevisiae
aaaaaccctcctaatagccatcatc

SEQ ID NO: 14486 - DNA, 25 bp, S. cerevisiae
aaacaacactcacttttacctgccg

SEQ ID NO: 14487 - DNA, 25 bp, S. cerevisiae
aaacaagcgacatctatgaccccta

SEQ ID NO: 14488 - DNA, 25 bp, S. cerevisiae
aaacatttcataaagctcaccgccc

SEQ ID NO: 14489 - DNA, 25 bp, S. cerevisiae
aaactcctctcgacatacgaatcgg

SEQ ID NO: 14490 - DNA, 25 bp, S. cerevisiae
aaaagcccattcctatcataatcgt

SEQ ID NO: 14491 - DNA, 25 bp, S. cerevisiae
aaaactcctgtggtaccaggcgtga

SEQ ID NO: 14492 - DNA, 25 bp, S. cerevisiae
aaaatccgttgagaacgagtgctca

SEQ ID NO: 14493 - DNA, 25 bp, S. cerevisiae
aaacttgctgttgaagctttcacaa

SEQ ID NO: 14494 - DNA, 25 bp, S. cerevisiae
aatactaaggtgcaaatctttgagg

SEQ ID NO: 14495 - DNA, 25 bp, S. cerevisiae
aaaacaacgtgccataactcctggg

SEQ ID NO: 14496 - DNA, 25 bp, S. cerevisiae
aaaacgccattccagaattctcggc

SEQ ID NO: 14497 - DNA, 25 bp, S. cerevisiae
aaacaagcgcagatggagattccag

SEQ ID NO: 14498 - DNA, 25 bp, S. cerevisiae
aaacagagacattgtccgttccgag

SEQ ID NO: 14499 - DNA, 25 bp, S. cerevisiae
aaacaatgcctatacagctaccgcg

SEQ ID NO: 14500 - DNA, 25 bp, S. cerevisiae
aaacttcacacattacgctacacag

SEQ ID NO: 14501 - DNA, 25 bp, S. cerevisiae
aaaaattctgaacgccactactgag

SEQ ID NO: 14502 - DNA, 25 bp, S. cerevisiae
aaaaattgcaatacgatgacctcgg

SEQ ID NO: 14503 - DNA, 25 bp, S. cerevisiae
aaaacttcttcatcaatggtcccca

SEQ ID NO: 14504 - DNA, 25 bp, S. cerevisiae
aaaacttttggatgtggctccgcca

SEQ ID NO: 14505 - DNA, 25 bp, S. cerevisiae
aaaagggaatgcacctcctgtttca

SEQ ID NO: 14506 - DNA, 25 bp, S. cerevisiae
aaaattgttggtctagcggttatgg

SEQ ID NO: 14507 - DNA, 25 bp, S. cerevisiae
aaacttgttcttgcctatgtttaca

SEQ ID NO: 14508 - DNA, 25 bp, S. cerevisiae
aaacatttcgaccagcctttcgata

SEQ ID NO: 14509 - DNA, 25 bp, S. cerevisiae
aaacataacggacccaactgcctgg

SEQ ID NO: 14510 - DNA, 25 bp, S. cerevisiae
aaacaatcacggcaccatttccttg

SEQ ID NO: 14511 - DNA, 25 bp, S. cerevisiae
aaaaatggcttgtcacctgaggcag

SEQ ID NO: 14512 - DNA, 25 bp, S. cerevisiae
aaaaatagattctcaggcccgctac

SEQ ID NO: 14513 - DNA, 25 bp, S. cerevisiae
aaaaaagtttgttgcgcccagtctg

SEQ ID NO: 14514 - DNA, 25 bp, S. cerevisiae
aaaaaggtcatatagccccaatgct

SEQ ID NO: 14515 - DNA, 25 bp, S. cerevisiae
aaaactttcaaatccttctgctggg

SEQ ID NO: 14516 - DNA, 25 bp, S. cerevisiae
aaaacgttcaaaggactctatgctg

SEQ ID NO: 14517 - DNA, 25 bp, S. cerevisiae
aaaatatcgcccattaccttcttca

SEQ ID NO: 14518 - DNA, 25 bp, S. cerevisiae
aaaaaggtgccacttactcttcgct

SEQ ID NO: 14519 - DNA, 25 bp, S. cerevisiae
aaaaagagcgcgtcagatttcctgc

SEQ ID NO: 14520 - DNA, 25 bp, S. cerevisiae
aaaaaagtcgctgtctgtgccggga

SEQ ID NO: 14521 - DNA, 25 bp, S. cerevisiae
aaaaactgctcctgtctgggttaga

SEQ ID NO: 14522 - DNA, 25 bp, S. cerevisiae
aaaattcaccaatacttgtttcaag

SEQ ID NO: 14523 - DNA, 25 bp, S. cerevisiae
aaaattcaccaatacttgtttcaag

SEQ ID NO: 14524 - DNA, 25 bp, S. cerevisiae
cgaagtccaagataaggttttgcaa

SEQ ID NO: 14525 - DNA, 25 bp, S. cerevisiae
aatgggcggctataaagattttcta

SEQ ID NO: 14526 - DNA, 25 bp, S. cerevisiae
aaacttctgaattgctttcctcttc

SEQ ID NO: 14527 - DNA, 25 bp, S. cerevisiae
aaacttcttatctattctctccatt

SEQ ID NO: 14528 - DNA, 25 bp, S. cerevisiae
aaaaattgctaatacttccgccgct

SEQ ID NO: 14529 - DNA, 25 bp, S. cerevisiae
aaaaaatgttcgtcgccttctgtcg

SEQ ID NO: 14530 - DNA, 25 bp, S. cerevisiae
aaaaactcagggtcgcctttggctg

SEQ ID NO: 14531 - DNA, 25 bp, S. cerevisiae
aaacaactgcagcacctgagtttcg

SEQ ID NO: 14532 - DNA, 25 bp, S. cerevisiae
aaacttgtggagatcctggctataa

SEQ ID NO: 14533 - DNA, 25 bp, S. cerevisiae
aaactatgtggctttattggctcaa

SEQ ID NO: 14534 - DNA, 25 bp, S. cerevisiae
caaagctaggcgctgctatcggtgc

SEQ ID NO: 14535 - DNA, 25 bp, S. cerevisiae
aaaaaggcctttgctggtgccttcg

SEQ ID NO: 14536 - DNA, 25 bp, S. cerevisiae
aaccaagaccgtcaagcgtgcttct

SEQ ID NO: 14537 - DNA, 25 bp, S. cerevisiae
aaactatgacccaccaatgtcttct

SEQ ID NO: 14538 - DNA, 25 bp, S. cerevisiae
aaaaataccagtgcccattacgttg

SEQ ID NO: 14539 - DNA, 25 bp, S. cerevisiae
aaaaaacacgctgctccagtaccgt

SEQ ID NO: 14540 - DNA, 25 bp, S. cerevisiae
aaacttggtctccatgttaacctat

SEQ ID NO: 14541 - DNA, 25 bp, S. cerevisiae
aaacatgtcgagattcctcaatcca

SEQ ID NO: 14542 - DNA, 25 bp, S. cerevisiae
aaaaatcggccttcaatgcttcctg

SEQ ID NO: 14543 - DNA, 25 bp, S. cerevisiae
aagaaattggatgaagattccatcg

SEQ ID NO: 14544 - DNA, 25 bp, S. cerevisiae
aaacaactggtgcaagacgcctcgt

SEQ ID NO: 14545 - DNA, 25 bp, S. cerevisiae
aaacaattccaacaggccacatttg

SEQ ID NO: 14546 - DNA, 25 bp, S. cerevisiae
aaaaattgccccttgagaataatag

SEQ ID NO: 14547 - DNA, 25 bp, S. cerevisiae
aaaaattgcccaacgtcggcactgg

SEQ ID NO: 14548 - DNA, 25 bp, S. cerevisiae
aaaaatgacaccatgcggcgctgaa

SEQ ID NO: 14549 - DNA, 25 bp, S. cerevisiae
aaaataacaaacacgctgctggcat

SEQ ID NO: 14550 - DNA, 25 bp, S. cerevisiae
aaacaaacgagctttcccatgcaat

SEQ ID NO: 14551 - DNA, 25 bp, S. cerevisiae
aaacttactcatcgtcatggtgcca

SEQ ID NO: 14552 - DNA, 25 bp, S. cerevisiae
aaacatctggtctctgaagtactgg

SEQ ID NO: 14553 - DNA, 25 bp, S. cerevisiae
aaacacccatcgtggcgaagtgaac

SEQ ID NO: 14554 - DNA, 25 bp, S. cerevisiae
aaaagccaattgtcagccgaggata

SEQ ID NO: 14555 - DNA, 25 bp, S. cerevisiae
aaacactgcatgatgatcgggagtc

SEQ ID NO: 14556 - DNA, 25 bp, S. cerevisiae
aaaaaggttgcgcagctgcagctcc

SEQ ID NO: 14557 - DNA, 25 bp, S. cerevisiae
aaaacaggcaccacatgtagcgcaa

SEQ ID NO: 14558 - DNA, 25 bp, S. cerevisiae
aaaacaggcacatcgtgtgaagagt

SEQ ID NO: 14559 - DNA, 25 bp, S. cerevisiae
taaaacgggttctgatacaagcatc

SEQ ID NO: 14560 - DNA, 25 bp, S. cerevisiae
aagaactggcctatcgaaaaatacg

SEQ ID NO: 14561 - DNA, 25 bp, S. cerevisiae
aaaacgcgtatttgagcatagttca

SEQ ID NO: 14562 - DNA, 25 bp, S. cerevisiae
aaaagcccatggaaattgaggccat

SEQ ID NO: 14563 - DNA, 25 bp, S. cerevisiae
aaaaatcagcacctctggttggaga

SEQ ID NO: 14564 - DNA, 25 bp, S. cerevisiae
aaacacaagcctacacgtcgttgaa

SEQ ID NO: 14565 - DNA, 25 bp, S. cerevisiae
aacaaaccgaagattctgtccagaa

SEQ ID NO: 14566 - DNA, 25 bp, S. cerevisiae
aaaaatctcgtgtagcattcgctgc

SEQ ID NO: 14567 - DNA, 25 bp, S. cerevisiae
aaacagtctctggttgagtctcctc

SEQ ID NO: 14568 - DNA, 25 bp, S. cerevisiae
aaacaggcgagattactatctgaaa

SEQ ID NO: 14569 - DNA, 25 bp, S. cerevisiae
aaacaagtgctgaggccgctgcaaa

SEQ ID NO: 14570 - DNA, 25 bp, S. cerevisiae
aaaatactttcaacctcaatactag

SEQ ID NO: 14571 - DNA, 25 bp, S. cerevisiae
aacacccctgacgttggacaattga

SEQ ID NO: 14572 - DNA, 25 bp, S. cerevisiae
aaaaagctttgagggctgccagaag

SEQ ID NO: 14573 - DNA, 25 bp, S. cerevisiae
aaaacatctttactgggccgcaagc

SEQ ID NO: 14574 - DNA, 25 bp, S. cerevisiae
aaaaattcattactaggcatccaaa

SEQ ID NO: 14575 - DNA, 25 bp, S. cerevisiae
aaacacgccaatgtcaggtgccgaa

SEQ ID NO: 14576 - DNA, 25 bp, S. cerevisiae
aaaagccgtagcaacacacccgtcg

SEQ ID NO: 14577 - DNA, 25 bp, S. cerevisiae
aaaatccgaagaacatccacctggg

SEQ ID NO: 14578 - DNA, 25 bp, S. cerevisiae
aaaatcctcgagaagcaagctattg

SEQ ID NO: 14579 - DNA, 25 bp, S. cerevisiae
aaaagtcacgccacggatatgatga

SEQ ID NO: 14580 - DNA, 25 bp, S. cerevisiae
aaaactcctcattgtcatcagctac

SEQ ID NO: 14581 - DNA, 25 bp, S. cerevisiae
aaacagctactatgtcagccttccg

SEQ ID NO: 14582 - DNA, 25 bp, S. cerevisiae
aaacatgtattctactctggctata

SEQ ID NO: 14583 - DNA, 25 bp, S. cerevisiae
aaacatgatcatgcgccacggtaag

SEQ ID NO: 14584 - DNA, 25 bp, S. cerevisiae
aaacaagattctccaccgtgattta

SEQ ID NO: 14585 - DNA, 25 bp, S. cerevisiae
aaaagcatgatgatcccttaaggga

SEQ ID NO: 14586 - DNA, 25 bp, S. cerevisiae
aaaaattgtcccgtttgcagtgaga

SEQ ID NO: 14587 - DNA, 25 bp, S. cerevisiae
aaaactctactccatgttcttccaa

SEQ ID NO: 14588 - DNA, 25 bp, S. cerevisiae
aaaatcggacggattcttcacacgt

SEQ ID NO: 14589 - DNA, 25 bp, S. cerevisiae
aaaaaggaccattgcgtcttcctcg

SEQ ID NO: 14590 - DNA, 25 bp, S. cerevisiae
aaacaaatctagttggtccaccgca

SEQ ID NO: 14591 - DNA, 25 bp, S. cerevisiae
aaaaagctgatcctttgttccccag

SEQ ID NO: 14592 - DNA, 25 bp, S. cerevisiae
aaaaagccatcgaaggaccctccag

SEQ ID NO: 14593 - DNA, 25 bp, S. cerevisiae
aaaagagaagccttggaccgtgcca

SEQ ID NO: 14594 - DNA, 25 bp, S. cerevisiae
aagaagccggttctgaagccgttca

SEQ ID NO: 14595 - DNA, 25 bp, S. cerevisiae
aaacacggtgattgggtggtgcaaa

SEQ ID NO: 14596 - DNA, 25 bp, S. cerevisiae
aaacactgtgttgcttgtcccagaa

SEQ ID NO: 14597 - DNA, 25 bp, S. cerevisiae
aaaacatcaacctccgtcgatggta

SEQ ID NO: 14598 - DNA, 25 bp, S. cerevisiae
aaaaatgcaacacctcatcgttatg

SEQ ID NO: 14599 - DNA, 25 bp, S. cerevisiae
aaaagcgtagtgtctcatcgagtat

SEQ ID NO: 14600 - DNA, 25 bp, S. cerevisiae
aaaacgtactgtccatactgccatg

SEQ ID NO: 14601 - DNA, 25 bp, S. cerevisiae
aaaaattatcgttcattgtcctctc

SEQ ID NO: 14602 - DNA, 25 bp, S. cerevisiae
aaaagatgcgtctggcaagccatta

SEQ ID NO: 14603 - DNA, 25 bp, S. cerevisiae
aaaactaccgacagtagcgcgctga

SEQ ID NO: 14604 - DNA, 25 bp, S. cerevisiae
aaaaatctggcctatcacctgacga

SEQ ID NO: 14605 - DNA, 25 bp, S. cerevisiae
aaacagcttgtccagatcccgaaag

SEQ ID NO: 14606 - DNA, 25 bp, S. cerevisiae
aaacagcagttctattcagcctaat

SEQ ID NO: 14607 - DNA, 25 bp, S. cerevisiae
aacacatcagcttcgaaacctattg

SEQ ID NO: 14608 - DNA, 25 bp, S. cerevisiae
aaacagtgttctaaggagcatccag

SEQ ID NO: 14609 - DNA, 25 bp, S. cerevisiae
aaacatcttcttacattggctcttg

SEQ ID NO: 14610 - DNA, 25 bp, S. cerevisiae
aaaacctggccgacattcataaaat

SEQ ID NO: 14611 - DNA, 25 bp, S. cerevisiae
aaacaccggacgcatttgacaaagt

SEQ ID NO: 14612 - DNA, 25 bp, S. cerevisiae
aacaaccgttgcctattaccacagg

SEQ ID NO: 14613 - DNA, 25 bp, S. cerevisiae
aaacaggatgctaccgttgtcgaat

SEQ ID NO: 14614 - DNA, 25 bp, S. cerevisiae
aaaagtcaaattggccatctccgag

SEQ ID NO: 14615 - DNA, 25 bp, S. cerevisiae
aaaacaaagactcgtcctgctgcga

SEQ ID NO: 14616 - DNA, 25 bp, S. cerevisiae
aaaaacttctttcaccagattctga

SEQ ID NO: 14617 - DNA, 25 bp, S. cerevisiae
aaaacctgtattgcccgaattgtca

SEQ ID NO: 14618 - DNA, 25 bp, S. cerevisiae
aaacaacactttgctcacttacggc

SEQ ID NO: 14619 - DNA, 25 bp, S. cerevisiae
aaaaatccatttggcgccttaagag

SEQ ID NO: 14620 - DNA, 25 bp, S. cerevisiae
aaaaattgctttgggcctgtgcgac

SEQ ID NO: 14621 - DNA, 25 bp, S. cerevisiae
aaaaatcgcgtattgggccctgtgt

SEQ ID NO: 14622 - DNA, 25 bp, S. cerevisiae
aaaatacggtacttgcccacatggt

SEQ ID NO: 14623 - DNA, 25 bp, S. cerevisiae
aaaaatgcggaatctcacccatgat

SEQ ID NO: 14624 - DNA, 25 bp, S. cerevisiae
aaaacatcggtgttgctgacccaca

SEQ ID NO: 14625 - DNA, 25 bp, S. cerevisiae
aaaaatggcggatcgctgcactcca

SEQ ID NO: 14626 - DNA, 25 bp, S. cerevisiae
aaacaaagctgaaactgccgcccaa

SEQ ID NO: 14627 - DNA, 25 bp, S. cerevisiae
aaacacgacagtaacgctagcccaa

SEQ ID NO: 14628 - DNA, 25 bp, S. cerevisiae
aaaagcttcacaaacggtcgatcaa

SEQ ID NO: 14629 - DNA, 25 bp, S. cerevisiae
aaaagccacctaacagcgtactctt

SEQ ID NO: 14630 - DNA, 25 bp, S. cerevisiae
aaaacccgcaattagctatagattt

SEQ ID NO: 14631 - DNA, 25 bp, S. cerevisiae
aaacatccctgcagtgagtacatat

SEQ ID NO: 14632 - DNA, 25 bp, S. cerevisiae
aaacagctgtttccgctgctaatag

SEQ ID NO: 14633 - DNA, 25 bp, S. cerevisiae
aaaacgggcgatgtagtggtacaga

SEQ ID NO: 14634 - DNA, 25 bp, S. cerevisiae
aacaactgggctgttatttttgcca

SEQ ID NO: 14635 - DNA, 25 bp, S. cerevisiae
aaacactgcgctcatgaatttatag

SEQ ID NO: 14636 - DNA, 25 bp, S. cerevisiae
aaaaaggtctcctctgcttctgctg

SEQ ID NO: 14637 - DNA, 25 bp, S. cerevisiae
aaaactgcaggactgggcgtaacac

SEQ ID NO: 14638 - DNA, 25 bp, S. cerevisiae
aaaacttctgcaagagggtggctct

SEQ ID NO: 14639 - DNA, 25 bp, S. cerevisiae
aaaagcgccggccttgtgtatgtct

SEQ ID NO: 14640 - DNA, 25 bp, S. cerevisiae
aaaacgactcgtacagcagaccagc

SEQ ID NO: 14641 - DNA, 25 bp, S. cerevisiae
aaaagcgaccgtgaatcgacgcctc

SEQ ID NO: 14642 - DNA, 25 bp, S. cerevisiae
aaaaagtccctcttctggaagctga

SEQ ID NO: 14643 - DNA, 25 bp, S. cerevisiae
aaaaaccccattgctggcggtgata

SEQ ID NO: 14644 - DNA, 25 bp, S. cerevisiae
aaaaaccccagtgccagtgcctgat

SEQ ID NO: 14645 - DNA, 25 bp, S. cerevisiae
aaaacaaatccagccatcaatccag

SEQ ID NO: 14646 - DNA, 25 bp, S. cerevisiae
aaaaccaatgacgttccgagacaga

SEQ ID NO: 14647 - DNA, 25 bp, S. cerevisiae
aaaagtcagttcattccggtgagaa

SEQ ID NO: 14648 - DNA, 25 bp, S. cerevisiae
aaaaatccgtccactctggtgagaa

SEQ ID NO: 14649 - DNA, 25 bp, S. cerevisiae
aaaattctagttctcctgttcaaat

SEQ ID NO: 14650 - DNA, 25 bp, S. cerevisiae
aaaaatgtcgctacccttgttcaat

SEQ ID NO: 14651 - DNA, 25 bp, S. cerevisiae
aaaaagctctgtgcgactgaattaa

SEQ ID NO: 14652 - DNA, 25 bp, S. cerevisiae
aaaaatagccctgcgttcacaaact

SEQ ID NO: 14653 - DNA, 25 bp, S. cerevisiae
aaaactgccagcgaattcgactctg

SEQ ID NO: 14654 - DNA, 25 bp, S. cerevisiae
aaaacgtgctagatccagaactcca

SEQ ID NO: 14655 - DNA, 25 bp, S. cerevisiae
aaaacgctagtggaccagaaccata

SEQ ID NO: 14656 - DNA, 25 bp, S. cerevisiae
aaacaactttcgttctgaagccatt

SEQ ID NO: 14657 - DNA, 25 bp, S. cerevisiae
aaacaacttgttttgctgcatcacc

SEQ ID NO: 14658 - DNA, 25 bp, S. cerevisiae
aaacaagttctactcatggctcacc

SEQ ID NO: 14659 - DNA, 25 bp, S. cerevisiae
aaacaccgtcttcaatcatggcagc

SEQ ID NO: 14660 - DNA, 25 bp, S. cerevisiae
aaaaacgtcaccgatactgccattg

SEQ ID NO: 14661 - DNA, 25 bp, S. cerevisiae
aaaaaccctgtattccatcgtgtgg

SEQ ID NO: 14662 - DNA, 25 bp, S. cerevisiae
aaaacggcagttttctgtctctgac

SEQ ID NO: 14663 - DNA, 25 bp, S. cerevisiae
aaaactggcagaatcgtcttctgaa

SEQ ID NO: 14664 - DNA, 25 bp, S. cerevisiae
aaaaatgcctgaatgtgtcttcttc

SEQ ID NO: 14665 - DNA, 25 bp, S. cerevisiae
aaaacttcaagctactaccttcgcg

SEQ ID NO: 14666 - DNA, 25 bp, S. cerevisiae
aaaacttcaccgctatggcattcac

SEQ ID NO: 14667 - DNA, 25 bp, S. cerevisiae
aaacactttgtccttgtggagatac

SEQ ID NO: 14668 - DNA, 25 bp, S. cerevisiae
aaacactttgatcttgagaggtcca

SEQ ID NO: 14669 - DNA, 25 bp, S. cerevisiae
gaaacctttaagctgggtgtgccaa

SEQ ID NO: 14670 - DNA, 25 bp, S. cerevisiae
aaaatctttactctggcttgttcca

SEQ ID NO: 14671 - DNA, 25 bp, S. cerevisiae
aaaactttcagtctccgagtgccta

SEQ ID NO: 14672 - DNA, 25 bp, S. cerevisiae
aaaagcagatacactcaagccgttg

SEQ ID NO: 14673 - DNA, 25 bp, S. cerevisiae
aaacacattcaaatcttcaacggcc

SEQ ID NO: 14674 - DNA, 25 bp, S. cerevisiae
aacaagggccaaattctcacacagg

SEQ ID NO: 14675 - DNA, 25 bp, S. cerevisiae
aaaacattcaaatagtatcagcccc

SEQ ID NO: 14676 - DNA, 25 bp, S. cerevisiae
aaaacatctcaatcttttccttcct

SEQ ID NO: 14677 - DNA, 25 bp, S. cerevisiae
aaaacactacttgatctcactcact

SEQ ID NO: 14678 - DNA, 25 bp, S. cerevisiae
aaaaagttcttccatatcccaatca

SEQ ID NO: 14679 - DNA, 25 bp, S. cerevisiae
aaaaatgtttctcgcacatctccaa

SEQ ID NO: 14680 - DNA, 25 bp, S. cerevisiae
aaaaaccttatgtgtctcgatgata

SEQ ID NO: 14681 - DNA, 25 bp, S. cerevisiae
aaaaaggcttcgtcgttcgatgcat

SEQ ID NO: 14682 - DNA, 25 bp, S. cerevisiae
aaaaagagttcgaggcagctgcatt

SEQ ID NO: 14683 - DNA, 25 bp, S. cerevisiae
cacaaattctaatggtaccgcaccc

SEQ ID NO: 14684 - DNA, 25 bp, S. cerevisiae
aaaattactccccattccagagttg

SEQ ID NO: 14685 - DNA, 25 bp, S. cerevisiae
aaaacaactccattactcttgcaca

SEQ ID NO: 14686 - DNA, 25 bp, S. cerevisiae
aaaaccatctctcgataagggcgat

SEQ ID NO: 14687 - DNA, 25 bp, S. cerevisiae
aaaacaattcatctctgacgtcgcc

SEQ ID NO: 14688 - DNA, 25 bp, S. cerevisiae
aaaacagtctgccaagccggatgcg

SEQ ID NO: 14689 - DNA, 25 bp, S. cerevisiae
aaaaagctatcctaccagtgcacgg

SEQ ID NO: 14690 - DNA, 25 bp, S. cerevisiae
aaaaattctgattctgcaacccgct

SEQ ID NO: 14691 - DNA, 25 bp, S. cerevisiae
cttccataagtcctggtacgttcct

SEQ ID NO: 14692 - DNA, 25 bp, S. cerevisiae
cttgctatacgaggtggtccgataa

SEQ ID NO: 14693 - DNA, 25 bp, S. cerevisiae
aaaacaagtgagacgcttcagcgga

SEQ ID NO: 14694 - DNA, 25 bp, S. cerevisiae
aaaaaatcaactgcaccatccggtc

SEQ ID NO: 14695 - DNA, 25 bp, S. cerevisiae
aaaaaatagacccacctgcaacgct

SEQ ID NO: 14696 - DNA, 25 bp, S. cerevisiae
aaaaagtcagtgttcgccgccaact

SEQ ID NO: 14697 - DNA, 25 bp, S. cerevisiae
aaaaaggcagcgtaccatcgtcaac

SEQ ID NO: 14698 - DNA, 25 bp, S. cerevisiae
aaaaggcgggtccttctagcagcaa

SEQ ID NO: 14699 - DNA, 25 bp, S. cerevisiae
aaaacgcactgagggtcgccgaaga

SEQ ID NO: 14700 - DNA, 25 bp, S. cerevisiae
aaaaacgatgctcctctggtggaat

SEQ ID NO: 14701 - DNA, 25 bp, S. cerevisiae
aaaaatcaccgaattgcagctgcaa

SEQ ID NO: 14702 - DNA, 25 bp, S. cerevisiae
aaaatatcccattcaaagtcaaagg

SEQ ID NO: 14703 - DNA, 25 bp, S. cerevisiae
aagaaatgtccattcactggtttag

SEQ ID NO: 14704 - DNA, 25 bp, S. cerevisiae
aaaagtgtcctaaggtggatcatat

SEQ ID NO: 14705 - DNA, 25 bp, S. cerevisiae
aaaaatgcctttgagctcgatcaat

SEQ ID NO: 14706 - DNA, 25 bp, S. cerevisiae
aaaaatgctctcatcgcttcaaaaa

SEQ ID NO: 14707 - DNA, 25 bp, S. cerevisiae
aaaatcattgtcttgccccaattct

SEQ ID NO: 14708 - DNA, 25 bp, S. cerevisiae
aaaagctttacgatccacattccct

SEQ ID NO: 14709 - DNA, 25 bp, S. cerevisiae
aaaacttatacaacgcacagggtgc

SEQ ID NO: 14710 - DNA, 25 bp, S. cerevisiae
aaaacatgtggagccgcaggacgct

SEQ ID NO: 14711 - DNA, 25 bp, S. cerevisiae
aaaatgcctgttataacgacggtag

SEQ ID NO: 14712 - DNA, 25 bp, S. cerevisiae
aaaaagcaccatttctaagaccaag

SEQ ID NO: 14713 - DNA, 25 bp, S. cerevisiae
aaaaagtcctttcattatcctcaga

SEQ ID NO: 14714 - DNA, 25 bp, S. cerevisiae
aaaaatatcaaactcctctcagcct

SEQ ID NO: 14715 - DNA, 25 bp, S. cerevisiae
aaaactccacattagcatcaccgtc

SEQ ID NO: 14716 - DNA, 25 bp, S. cerevisiae
aaaagtgggctgcttcatcttgggc

SEQ ID NO: 14717 - DNA, 25 bp, S. cerevisiae
aaaagtgtgacgtctgcctactggt

SEQ ID NO: 14718 - DNA, 25 bp, S. cerevisiae
aaaagcttatatttccccatggcgt

SEQ ID NO: 14719 - DNA, 25 bp, S. cerevisiae
aaaaagagtgccattccatctccac

SEQ ID NO: 14720 - DNA, 25 bp, S. cerevisiae
aaaaatctcattacctgtcgcactg

SEQ ID NO: 14721 - DNA, 25 bp, S. cerevisiae
aaaactgccactcttgtggacgagt

SEQ ID NO: 14722 - DNA, 25 bp, S. cerevisiae
aaaatagccgctactttcgtcgtgg

SEQ ID NO: 14723 - DNA, 25 bp, S. cerevisiae
aaaaagagcgccatgggtacagttg

SEQ ID NO: 14724 - DNA, 25 bp, S. cerevisiae
aaaatagggacgtggttgcgctgct

SEQ ID NO: 14725 - DNA, 25 bp, S. cerevisiae
aaaacggtagcttcagcggtggctc

SEQ ID NO: 14726 - DNA, 25 bp, S. cerevisiae
aaaaaatctcttagcccagtatgga

SEQ ID NO: 14727 - DNA, 25 bp, S. cerevisiae
aaaaatcctattactctcgctgaag

SEQ ID NO: 14728 - DNA, 25 bp, S. cerevisiae
aaaacatcagcgtctattgccctga

SEQ ID NO: 14729 - DNA, 25 bp, S. cerevisiae
aaaacaaggtttcccctgctgatgc

SEQ ID NO: 14730 - DNA, 25 bp, S. cerevisiae
aaaacaaggtttcccctgctgatgc

SEQ ID NO: 14731 - DNA, 25 bp, S. cerevisiae
aaaacaaggtgtgcccaatcttcca

SEQ ID NO: 14732 - DNA, 25 bp, S. cerevisiae
aaaaacgaatctgccgtcatcttca

SEQ ID NO: 14733 - DNA, 25 bp, S. cerevisiae
aacaaggaaataccacctcttcgca

SEQ ID NO: 14734 - DNA, 25 bp, S. cerevisiae
aaaaggacattaacacctgcgccac

SEQ ID NO: 14735 - DNA, 25 bp, S. cerevisiae
aaaaggttgtatgcccggactcttg

SEQ ID NO: 14736 - DNA, 25 bp, S. cerevisiae
aacaaaggccatttacacgatattt

SEQ ID NO: 14737 - DNA, 25 bp, S. cerevisiae
aaaaagggcattccaattatttgat

SEQ ID NO: 14738 - DNA, 25 bp, S. cerevisiae
aaaaagggttcctctgcatctcttt

SEQ ID NO: 14739 - DNA, 25 bp, S. cerevisiae
aaaagaccctacactaatctctggc

SEQ ID NO: 14740 - DNA, 25 bp, S. cerevisiae
aaaatacggttctgctacctctagg

SEQ ID NO: 14741 - DNA, 25 bp, S. cerevisiae
aacagaacaggtccaagctactcat

SEQ ID NO: 14742 - DNA, 25 bp, S. cerevisiae
aacacaacaagtggcccttcaattg

SEQ ID NO: 14743 - DNA, 25 bp, S. cerevisiae
aaaaactgaggcctctgcttctctt

SEQ ID NO: 14744 - DNA, 25 bp, S. cerevisiae
aaaaactgatcagggctctctccta

SEQ ID NO: 14745 - DNA, 25 bp, S. cerevisiae
aataaacgtcgggtgctcctgcggc

SEQ ID NO: 14746 - DNA, 25 bp, S. cerevisiae
aaaaggactgctggcctggacatga

SEQ ID NO: 14747 - DNA, 25 bp, S. cerevisiae
aaaagggtacccagccattggcaat

SEQ ID NO: 14748 - DNA, 25 bp, S. cerevisiae
aaaagcagggcagccgtgccatttc

SEQ ID NO: 14749 - DNA, 25 bp, S. cerevisiae
aaaacggtgctgctaaggcctttgt

SEQ ID NO: 14750 - DNA, 25 bp, S. cerevisiae
aaaaagagtctgcagcccggtattc

SEQ ID NO: 14751 - DNA, 25 bp, S. cerevisiae
aacaacctctggtatcgaccttgat

SEQ ID NO: 14752 - DNA, 25 bp, S. cerevisiae
aaaaccctcgagacaagcaatggat

SEQ ID NO: 14753 - DNA, 25 bp, S. cerevisiae
aaaatccaccgagcgctaatggtat

SEQ ID NO: 14754 - DNA, 25 bp, S. cerevisiae
aaaatcctcctagagacctggtatt

SEQ ID NO: 14755 - DNA, 25 bp, S. cerevisiae
aaaacacatcctgtaggcgcaaatt

SEQ ID NO: 14756 - DNA, 25 bp, S. cerevisiae
aaaaactgcggttacatggcctaca

SEQ ID NO: 14757 - DNA, 25 bp, S. cerevisiae
aaaagatttcccaccattaccatga

SEQ ID NO: 14758 - DNA, 25 bp, S. cerevisiae
aaaagggcgtactgcatcattcctg

SEQ ID NO: 14759 - DNA, 25 bp, S. cerevisiae
aaaaggtatttctgcctgtgccgtg

SEQ ID NO: 14760 - DNA, 25 bp, S. cerevisiae
aaaaggtctcttccccagcaattat

SEQ ID NO: 14761 - DNA, 25 bp, S. cerevisiae
aaaagcttatctcctactcagactt

SEQ ID NO: 14762 - DNA, 25 bp, S. cerevisiae
aaaacaattgcttctatccgccatt

SEQ ID NO: 14763 - DNA, 25 bp, S. cerevisiae
aaaaagcattcttcttcttccacta

SEQ ID NO: 14764 - DNA, 25 bp, S. cerevisiae
aaaagttccaacagccattccacag

SEQ ID NO: 14765 - DNA, 25 bp, S. cerevisiae
aaaaaccaatccagtgcttcgcttc

SEQ ID NO: 14766 - DNA, 25 bp, S. cerevisiae
aaaaactcatctgccgttatcactg

SEQ ID NO: 14767 - DNA, 25 bp, S. cerevisiae
aaaaactgtgcctggatcgtctctg

SEQ ID NO: 14768 - DNA, 25 bp, S. cerevisiae
aaaagaccatccctggaggactatg

SEQ ID NO: 14769 - DNA, 25 bp, S. cerevisiae
aaaacaccgctcattcagatgccat

SEQ ID NO: 14770 - DNA, 25 bp, S. cerevisiae
aaaaaccaggtgttgcatgcaggga

SEQ ID NO: 14771 - DNA, 25 bp, S. cerevisiae
aaaaacctgttgtcatgccgtctga

SEQ ID NO: 14772 - DNA, 25 bp, S. cerevisiae
aaaaagcctgcttgacagcccgcat

SEQ ID NO: 14773 - DNA, 25 bp, S. cerevisiae
aacagaaaccgctccagaagcttct

SEQ ID NO: 14774 - DNA, 25 bp, S. cerevisiae
aacaaaagcgtctccaaggcatccc

SEQ ID NO: 14775 - DNA, 25 bp, S. cerevisiae
aaaaaacgatcaagccctgtcatcc

SEQ ID NO: 14776 - DNA, 25 bp, S. cerevisiae
aaaataagcgactgtcctcctctta

SEQ ID NO: 14777 - DNA, 25 bp, S. cerevisiae
aaaattagcgccactaccagactac

SEQ ID NO: 14778 - DNA, 25 bp, S. cerevisiae
aaaagctactccgttatcacaatcc

SEQ ID NO: 14779 - DNA, 25 bp, S. cerevisiae
aaaagtcagagtgaagtgccttgct

SEQ ID NO: 14780 - DNA, 25 bp, S. cerevisiae
aaaagtccggaaagctgcccacatg

SEQ ID NO: 14781 - DNA, 25 bp, S. cerevisiae
aaaacaccggaattctgcctctatt

SEQ ID NO: 14782 - DNA, 25 bp, S. cerevisiae
aaaaactacgtcagtcggagcagca

SEQ ID NO: 14783 - DNA, 25 bp, S. cerevisiae
aaaaactacttcaacatcggcactg

SEQ ID NO: 14784 - DNA, 25 bp, S. cerevisiae
aacaattctgacaccaatggcgacg

SEQ ID NO: 14785 - DNA, 25 bp, S. cerevisiae
aaaagcaatcgctctcgaggccaga

SEQ ID NO: 14786 - DNA, 25 bp, S. cerevisiae
aaaagaaagcatcccctggcgcaac

SEQ ID NO: 14787 - DNA, 25 bp, S. cerevisiae
aaaagatacggttcgctagcgcaaa

SEQ ID NO: 14788 - DNA, 25 bp, S. cerevisiae
aaaagaaccgatttcgcgcacatct

SEQ ID NO: 14789 - DNA, 25 bp, S. cerevisiae
aaaaaattcatttctggctcctgca

SEQ ID NO: 14790 - DNA, 25 bp, S. cerevisiae
aaaagacaccaaactggctccaagt

SEQ ID NO: 14791 - DNA, 25 bp, S. cerevisiae
aaaatgacaccctctggccataatt

SEQ ID NO: 14792 - DNA, 25 bp, S. cerevisiae
aaaacacacgccgattggtcatatt

SEQ ID NO: 14793 - DNA, 25 bp, S. cerevisiae
aaaacacagcatgcacattcgttaa

SEQ ID NO: 14794 - DNA, 25 bp, S. cerevisiae
aaaaacaataacaatcgctccagaa

SEQ ID NO: 14795 - DNA, 25 bp, S. cerevisiae
aaaacctcccatgaagctgtggcag

SEQ ID NO: 14796 - DNA, 25 bp, S. cerevisiae
aaaaacatcattccaggcgctggtg

SEQ ID NO: 14797 - DNA, 25 bp, S. cerevisiae
aaaatcaacatagagcggctagctg

SEQ ID NO: 14798 - DNA, 25 bp, S. cerevisiae
aaaacacattccacgatggcactaa

SEQ ID NO: 14799 - DNA, 25 bp, S. cerevisiae
aaaagccccttcaagtagtgatgat

SEQ ID NO: 14800 - DNA, 25 bp, S. cerevisiae
aaaagagagcctgttcatcccgaaa

SEQ ID NO: 14801 - DNA, 25 bp, S. cerevisiae
aaaagacacacttcgccatattgcc

SEQ ID NO: 14802 - DNA, 25 bp, S. cerevisiae
aaaactccatcttcgatttgctctc

SEQ ID NO: 14803 - DNA, 25 bp, S. cerevisiae
aaaagccgatcgacgacgacgacga

SEQ ID NO: 14804 - DNA, 25 bp, S. cerevisiae
aaaagagcgatcctgcggctaagaa

SEQ ID NO: 14805 - DNA, 25 bp, S. cerevisiae
aaaacatctcactctctttctcaag

SEQ ID NO: 14806 - DNA, 25 bp, S. cerevisiae
aaaacagttgcgctacatgcccgta

SEQ ID NO: 14807 - DNA, 25 bp, S. cerevisiae
aacaatggtaactctgcagcttcaa

SEQ ID NO: 14808 - DNA, 25 bp, S. cerevisiae
aaaaggctaagctcgttgctaacat

SEQ ID NO: 14809 - DNA, 25 bp, S. cerevisiae
aaaaccattctctgtcgtggcatct

SEQ ID NO: 14810 - DNA, 25 bp, S. cerevisiae
aaaactcttccgcaagattgcagaa

SEQ ID NO: 14811 - DNA, 25 bp, S. cerevisiae
aaaacgtctcttccaacattgtcaa

SEQ ID NO: 14812 - DNA, 25 bp, S. cerevisiae
aaaatctggcatgggtcatacctgt

SEQ ID NO: 14813 - DNA, 25 bp, S. cerevisiae
aaaacgagcttgcttacgctgctaa

SEQ ID NO: 14814 - DNA, 25 bp, S. cerevisiae
aaaactgatttgcatctaccgaaga

SEQ ID NO: 14815 - DNA, 25 bp, S. cerevisiae
aaaaccttgcagattcgatagatag

SEQ ID NO: 14816 - DNA, 25 bp, S. cerevisiae
aaaagccttgcatattgctcagagt

SEQ ID NO: 14817 - DNA, 25 bp, S. cerevisiae
aaaagccggtatgttcatggtcaaa

SEQ ID NO: 14818 - DNA, 25 bp, S. cerevisiae
aaaatgccggatacgttatgactgc

SEQ ID NO: 14819 - DNA, 25 bp, S. cerevisiae
aaaagctccgagacgttgaattgaa

SEQ ID NO: 14820 - DNA, 25 bp, S. cerevisiae
aaaactactatttttgcagaagcaa

SEQ ID NO: 14821 - DNA, 25 bp, S. cerevisiae
aaaacgcctatttcaccaggaacat

SEQ ID NO: 14822 - DNA, 25 bp, S. cerevisiae
aaaagaccggcctcgggtgcagaga

SEQ ID NO: 14823 - DNA, 25 bp, S. cerevisiae
aaaagaccggtatctgggctggtgt

SEQ ID NO: 14824 - DNA, 25 bp, S. cerevisiae
aaaattgcggttgccgttgctggac

SEQ ID NO: 14825 - DNA, 25 bp, S. cerevisiae
aaaagtctggttgtggattctgagg

SEQ ID NO: 14826 - DNA, 25 bp, S. cerevisiae
aaaacatcgtctctggtgttgctgg

SEQ ID NO: 14827 - DNA, 25 bp, S. cerevisiae
aaaactacgagcactattcagggag

SEQ ID NO: 14828 - DNA, 25 bp, S. cerevisiae
aaaagattccgttccattgaagaag

SEQ ID NO: 14829 - DNA, 25 bp, S. cerevisiae
aaaacaccgcttgctgctgtattat

SEQ ID NO: 14830 - DNA, 25 bp, S. cerevisiae
aaaatggcactgcagcttctgaacc

SEQ ID NO: 14831 - DNA, 25 bp, S. cerevisiae
aaaacgactattctccttcaaacag

SEQ ID NO: 14832 - DNA, 25 bp, S. cerevisiae
aaaatcctggccgtggttcttggtg

SEQ ID NO: 14833 - DNA, 25 bp, S. cerevisiae
aaaaggctgcctgggagttcacaaa

SEQ ID NO: 14834 - DNA, 25 bp, S. cerevisiae
aaaagaagaccgaagctgccaacaa

SEQ ID NO: 14835 - DNA, 25 bp, S. cerevisiae
aagaaagaactctgacgcaaacgtc

SEQ ID NO: 14836 - DNA, 25 bp, S. cerevisiae
aacaaaatccgcagggctatcaccc

SEQ ID NO: 14837 - DNA, 25 bp, S. cerevisiae
aaaagtgtcaccatgggtatctcca

SEQ ID NO: 14838 - DNA, 25 bp, S. cerevisiae
aaaacgattctcattgtgatttccg

SEQ ID NO: 14839 - DNA, 25 bp, S. cerevisiae
aaaaccatctctattctactttcca

SEQ ID NO: 14840 - DNA, 25 bp, S. cerevisiae
aaaacctgtttctcatatctttaga

SEQ ID NO: 14841 - DNA, 25 bp, S. cerevisiae
aaaacatcctgcctgacttgagtag

SEQ ID NO: 14842 - DNA, 25 bp, S. cerevisiae
aaaagtacgacgctgatgtgctcga

SEQ ID NO: 14843 - DNA, 25 bp, S. cerevisiae
aaaagttcggccattgagcgagcaa

SEQ ID NO: 14844 - DNA, 25 bp, S. cerevisiae
aaaatgatttgggttcgttagcaga

SEQ ID NO: 14845 - DNA, 25 bp, S. cerevisiae
aaaactccagatgctggcgttaaga

SEQ ID NO: 14846 - DNA, 25 bp, S. cerevisiae
aaaactgtcatcgtcactgcatgca

SEQ ID NO: 14847 - DNA, 25 bp, S. cerevisiae
aaaacgtcatccgatcacagcagtt

SEQ ID NO: 14848 - DNA, 25 bp, S. cerevisiae
aaaactgttgctgccgatcagtctg

SEQ ID NO: 14849 - DNA, 25 bp, S. cerevisiae
aaaagctggtgttcaaggctcccct

SEQ ID NO: 14850 - DNA, 25 bp, S. cerevisiae
aaaattgctgttcacgttaccgtca

SEQ ID NO: 14851 - DNA, 25 bp, S. cerevisiae
aaaagctggttgaagcacctgtaga

SEQ ID NO: 14852 - DNA, 25 bp, S. cerevisiae
aaaatctgtattcagcccgaagctg

SEQ ID NO: 14853 - DNA, 25 bp, S. cerevisiae
aaaacctaccgaactgttagatgat

SEQ ID NO: 14854 - DNA, 25 bp, S. cerevisiae
aaaaccttccgaacttgatgattag

SEQ ID NO: 14855 - DNA, 25 bp, S. cerevisiae
aaaaccgaccgtattgcagatcaag

SEQ ID NO: 14856 - DNA, 25 bp, S. cerevisiae
aaaacctatcatctgggacctcaag

SEQ ID NO: 14857 - DNA, 25 bp, S. cerevisiae
aaaacgtagctcaaggtatcctcat

SEQ ID NO: 14858 - DNA, 25 bp, S. cerevisiae
aaaactgcattgttccatgcttgca

SEQ ID NO: 14859 - DNA, 25 bp, S. cerevisiae
aaaactcggatatactcgctcgcag

SEQ ID NO: 14860 - DNA, 25 bp, S. cerevisiae
aaaagttgaaggatcctccgcctgc

SEQ ID NO: 14861 - DNA, 25 bp, S. cerevisiae
aaaagtgttctttgatcctgcggtc

SEQ ID NO: 14862 - DNA, 25 bp, S. cerevisiae
aaaagtactgcagcacctctgtctt

SEQ ID NO: 14863 - DNA, 25 bp, S. cerevisiae
aaaagaccatatctctctggaagat

SEQ ID NO: 14864 - DNA, 25 bp, S. cerevisiae
aaaatagctcgcacagtcctgaaga

SEQ ID NO: 14865 - DNA, 25 bp, S. cerevisiae
aaaatttggcgaatgctttgataac

SEQ ID NO: 14866 - DNA, 25 bp, S. cerevisiae
aaaaggacagttcctcatcctcaac

SEQ ID NO: 14867 - DNA, 25 bp, S. cerevisiae
aaaagagttcttcctcaactgcaac

SEQ ID NO: 14868 - DNA, 25 bp, S. cerevisiae
aaaaggtattttcgcaggtgatatc

SEQ ID NO: 14869 - DNA, 25 bp, S. cerevisiae
aaaactggccaactagcgtggtcac

SEQ ID NO: 14870 - DNA, 25 bp, S. cerevisiae
aaaactcgccaaatgactctagata

SEQ ID NO: 14871 - DNA, 25 bp, S. cerevisiae
aaaatccactatatgcttcaaagct

SEQ ID NO: 14872 - DNA, 25 bp, S. cerevisiae
aaaagctcgtttgcttgcagctgtc

SEQ ID NO: 14873 - DNA, 25 bp, S. cerevisiae
aaaatttgcttatgtcgctcctggc

SEQ ID NO: 14874 - DNA, 25 bp, S. cerevisiae
aaaagcttgcatatccggagtacga

SEQ ID NO: 14875 - DNA, 25 bp, S. cerevisiae
aactcgggtacctcagattttactg

SEQ ID NO: 14876 - DNA, 25 bp, S. cerevisiae
gtacccggtagaatcttgaacgttg

SEQ ID NO: 14877 - DNA, 25 bp, S. cerevisiae
aacaccggtcagatgttggcaggtt

SEQ ID NO: 14878 - DNA, 25 bp, S. cerevisiae
aaaactgcgtattcgtagcaagctg

SEQ ID NO: 14879 - DNA, 25 bp, S. cerevisiae
aaaagctgctgggttgtacatacaa

SEQ ID NO: 14880 - DNA, 25 bp, S. cerevisiae
aacaagtgggcataggaggctctca

SEQ ID NO: 14881 - DNA, 25 bp, S. cerevisiae
aaaagactacatggtgtcagtttca

SEQ ID NO: 14882 - DNA, 25 bp, S. cerevisiae
aaaagcccatcgtttcagattccga

SEQ ID NO: 14883 - DNA, 25 bp, S. cerevisiae
aaaacctcacatttactactcctat

SEQ ID NO: 14884 - DNA, 25 bp, S. cerevisiae
aaaagcttcctacacatatctctct

SEQ ID NO: 14885 - DNA, 25 bp, S. cerevisiae
aaaagcgtcctaacatactatccac

SEQ ID NO: 14886 - DNA, 25 bp, S. cerevisiae
aaaagaaaccgatcgcaagcgcgtt

SEQ ID NO: 14887 - DNA, 25 bp, S. cerevisiae
aaaagaacactttcacacaagcaag

SEQ ID NO: 14888 - DNA, 25 bp, S. cerevisiae
aaaagcatatgagctctccgtccta

SEQ ID NO: 14889 - DNA, 25 bp, S. cerevisiae
aaaagcatcagtgccctactggtca

SEQ ID NO: 14890 - DNA, 25 bp, S. cerevisiae
aacaacgtcgtgctgtagagattca

SEQ ID NO: 14891 - DNA, 25 bp, S. cerevisiae
aaaacctcagtcagattcgattcaa

SEQ ID NO: 14892 - DNA, 25 bp, S. cerevisiae
aaaacgatggatccgattgcgaaaa

SEQ ID NO: 14893 - DNA, 25 bp, S. cerevisiae
aaaagagattatcccggctgattaa

SEQ ID NO: 14894 - DNA, 25 bp, S. cerevisiae
aacaaacatgctcttcgggactaca

SEQ ID NO: 14895 - DNA, 25 bp, S. cerevisiae
aacaagacgcatccaactgtacact

SEQ ID NO: 14896 - DNA, 25 bp, S. cerevisiae
aaaacgtgcgtttcttggaacaatg

SEQ ID NO: 14897 - DNA, 25 bp, S. cerevisiae
aaaatgcgcaatcttcagggaatga

SEQ ID NO: 14898 - DNA, 25 bp, S. cerevisiae
aaaaggctttgctgaggacattaca

SEQ ID NO: 14899 - DNA, 25 bp, S. cerevisiae
aacaccacagtgatcgagtttccca

SEQ ID NO: 14900 - DNA, 25 bp, S. cerevisiae
cagatcatgcgttgctgttgcagca

SEQ ID NO: 14901 - DNA, 25 bp, S. cerevisiae
aacatggcgtctatgcagaacacat

SEQ ID NO: 14902 - DNA, 25 bp, S. cerevisiae
aagagggcatgctgagtacaatgat

SEQ ID NO: 14903 - DNA, 25 bp, S. cerevisiae
aacaacgcctccgataatgtatatg

SEQ ID NO: 14904 - DNA, 25 bp, S. cerevisiae
aaaaccgatcacgaagctgcactat

SEQ ID NO: 14905 - DNA, 25 bp, S. cerevisiae
aaaaccaacagcgacattccagatg

SEQ ID NO: 14906 - DNA, 25 bp, S. cerevisiae
aaaaccagctcaccaataccagaag

SEQ ID NO: 14907 - DNA, 25 bp, S. cerevisiae
aaaatcacgccttctatcttttggt

SEQ ID NO: 14908 - DNA, 25 bp, S. cerevisiae
aaaagcattgcccttgattggttag

SEQ ID NO: 14909 - DNA, 25 bp, S. cerevisiae
aaaatcatgcagcagcttggccctt

SEQ ID NO: 14910 - DNA, 25 bp, S. cerevisiae
aaaagcgttaccagctgcagatgat

SEQ ID NO: 14911 - DNA, 25 bp, S. cerevisiae
aaaaccacaagattcctcatcggaa

SEQ ID NO: 14912 - DNA, 25 bp, S. cerevisiae
aaaacctcaagaactgctgcaccaa

SEQ ID NO: 14913 - DNA, 25 bp, S. cerevisiae
aaaattcaacgagctgtccaacaga

SEQ ID NO: 14914 - DNA, 25 bp, S. cerevisiae
aaaattgctgacgacacttcaccac

SEQ ID NO: 14915 - DNA, 25 bp, S. cerevisiae
aaaatatgctttaccgtaccagacg

SEQ ID NO: 14916 - DNA, 25 bp, S. cerevisiae
aaaaccgtagctgcattagctctat

SEQ ID NO: 14917 - DNA, 25 bp, S. cerevisiae
aaaatggcgattttggtgctccaca

SEQ ID NO: 14918 - DNA, 25 bp, S. cerevisiae
aaaatctactaatagctcctcctct

SEQ ID NO: 14919 - DNA, 25 bp, S. cerevisiae
aaaatacgtcatcaccacctatttc

SEQ ID NO: 14920 - DNA, 25 bp, S. cerevisiae
aaaatcatcaatatcaccccaagca

SEQ ID NO: 14921 - DNA, 25 bp, S. cerevisiae
aaaagctctgtcaaacgtccttgcg

SEQ ID NO: 14922 - DNA, 25 bp, S. cerevisiae
aaaagctgctcctaagctatgcctt

SEQ ID NO: 14923 - DNA, 25 bp, S. cerevisiae
aaaagagtgttggagtccttcacca

SEQ ID NO: 14924 - DNA, 25 bp, S. cerevisiae
aaaatggtgtggtacccatctccca

SEQ ID NO: 14925 - DNA, 25 bp, S. cerevisiae
aaaatggatatagccctgtcagaat

SEQ ID NO: 14926 - DNA, 25 bp, S. cerevisiae
aaaatgggttctacttccgctacat

SEQ ID NO: 14927 - DNA, 25 bp, S. cerevisiae
aaaagtgtgcctgttgcttcttctc

SEQ ID NO: 14928 - DNA, 25 bp, S. cerevisiae
aaaagagctgcactcggtctacgtt

SEQ ID NO: 14929 - DNA, 25 bp, S. cerevisiae
aaaagctgattcatgggcctcacgc

SEQ ID NO: 14930 - DNA, 25 bp, S. cerevisiae
aaaatgcttctaatgcgaacccgcc

SEQ ID NO: 14931 - DNA, 25 bp, S. cerevisiae
aaaatgcgttctggcgaacactgcc

SEQ ID NO: 14932 - DNA, 25 bp, S. cerevisiae
aaaatcgacgacattcctctgcaat

SEQ ID NO: 14933 - DNA, 25 bp, S. cerevisiae
aactgcaaacgtggttgggctggac

SEQ ID NO: 14934 - DNA, 25 bp, S. cerevisiae
aacagcaaaatgtgtcggccgcgcc

SEQ ID NO: 14935 - DNA, 25 bp, S. cerevisiae
aactgaagataaggccgctccggca

SEQ ID NO: 14936 - DNA, 25 bp, S. cerevisiae
aacagtattattcatcgggacctaa

SEQ ID NO: 14937 - DNA, 25 bp, S. cerevisiae
aacacgttggccaagattgcccttg

SEQ ID NO: 14938 - DNA, 25 bp, S. cerevisiae
aaaagttggctgctgttccagctgc

SEQ ID NO: 14939 - DNA, 25 bp, S. cerevisiae
aaaagctattcgatgtgtccgccaa

SEQ ID NO: 14940 - DNA, 25 bp, S. cerevisiae
aagaacttatcgcagtttcccgagc

SEQ ID NO: 14941 - DNA, 25 bp, S. cerevisiae
ttttgactgggccaagtttcccgtg

SEQ ID NO: 14942 - DNA, 25 bp, S. cerevisiae
catttgccgggcgaggaaacctact

SEQ ID NO: 14943 - DNA, 25 bp, S. cerevisiae
ctttacacagtgcaggaacaacaat

SEQ ID NO: 14944 - DNA, 25 bp, S. cerevisiae
aaaagatctcgcttttgtctcacgc

SEQ ID NO: 14945 - DNA, 25 bp, S. cerevisiae
aaaatccatcattgcaccttcttac

SEQ ID NO: 14946 - DNA, 25 bp, S. cerevisiae
aacccacgtcgatcttattgaaaag

SEQ ID NO: 14947 - DNA, 25 bp, S. cerevisiae
aacccacagtggaggctttaaagat

SEQ ID NO: 14948 - DNA, 25 bp, S. cerevisiae
aactcgatcgtggagtcgcatcgta

SEQ ID NO: 14949 - DNA, 25 bp, S. cerevisiae
aactggatctgcaatcccgtccata

SEQ ID NO: 14950 - DNA, 25 bp, S. cerevisiae
aacattactgaagtcggcaccatga

SEQ ID NO: 14951 - DNA, 25 bp, S. cerevisiae
aacacttacaagacctgcaatcata

SEQ ID NO: 14952 - DNA, 25 bp, S. cerevisiae
aacacctacaaaggcgcggctggaa

SEQ ID NO: 14953 - DNA, 25 bp, S. cerevisiae
aacaactagcaaaggcagccccata

SEQ ID NO: 14954 - DNA, 25 bp, S. cerevisiae
aaaaggctgcacactcatatggtaa

SEQ ID NO: 14955 - DNA, 25 bp, S. cerevisiae
aaaagatcttgttgctcgcgttcgt

SEQ ID NO: 14956 - DNA, 25 bp, S. cerevisiae
aacaatatcctgcttgactgctcaa

SEQ ID NO: 14957 - DNA, 25 bp, S. cerevisiae
aaaatactcgaatttgcatgccaaa

SEQ ID NO: 14958 - DNA, 25 bp, S. cerevisiae
aaggaagttagatctggcaaacaat

SEQ ID NO: 14959 - DNA, 25 bp, S. cerevisiae
aaaaggctggtctctggccaaataa

SEQ ID NO: 14960 - DNA, 25 bp, S. cerevisiae
aaaaggcacgtctacctgctcaagt

SEQ ID NO: 14961 - DNA, 25 bp, S. cerevisiae
aaaagtccgtcattgactgctcaaa

SEQ ID NO: 14962 - DNA, 25 bp, S. cerevisiae
aaaagatcagccactggtgctaaac

SEQ ID NO: 14963 - DNA, 25 bp, S. cerevisiae
aaaagatggcgagctggcggcaaat

SEQ ID NO: 14964 - DNA, 25 bp, S. cerevisiae
aaaagtttggctgcgctgaagaaaa

SEQ ID NO: 14965 - DNA, 25 bp, S. cerevisiae
aacaattcttcctcctctaataata

SEQ ID NO: 14966 - DNA, 25 bp, S. cerevisiae
aacagttttcgaccccaaagatgtg

SEQ ID NO: 14967 - DNA, 25 bp, S. cerevisiae
aaaagaatctccacgccaaagttga

SEQ ID NO: 14968 - DNA, 25 bp, S. cerevisiae
aaccgtcgtaccatctacaatttga

SEQ ID NO: 14969 - DNA, 25 bp, S. cerevisiae
aacaatgcttgttcgttagcccggt

SEQ ID NO: 14970 - DNA, 25 bp, S. cerevisiae
aaaagtttgtctcaacccgcagatt

SEQ ID NO: 14971 - DNA, 25 bp, S. cerevisiae
aaaatttaggtcatggtcctccatc

SEQ ID NO: 14972 - DNA, 25 bp, S. cerevisiae
aactacgaagaacccatatgcccag

SEQ ID NO: 14973 - DNA, 25 bp, S. cerevisiae
aactacggataccagtcttcaccag

SEQ ID NO: 14974 - DNA, 25 bp, S. cerevisiae
aaaagttctacagtgtcttcgccat

SEQ ID NO: 14975 - DNA, 25 bp, S. cerevisiae
aaaagttctggcaccttggcaataa

SEQ ID NO: 14976 - DNA, 25 bp, S. cerevisiae
aaaatgttctacaaccaggcggcta

SEQ ID NO: 14977 - DNA, 25 bp, S. cerevisiae
aataatgatttaccaacgaccgttg

SEQ ID NO: 14978 - DNA, 25 bp, S. cerevisiae
aaaagagttcagacacaccccttag

SEQ ID NO: 14979 - DNA, 25 bp, S. cerevisiae
aacaagtaaagtccacatcctctgc

SEQ ID NO: 14980 - DNA, 25 bp, S. cerevisiae
aaaagttacctctattcagctctgc

SEQ ID NO: 14981 - DNA, 25 bp, S. cerevisiae
aaaagcactcaagtcattatcgttg

SEQ ID NO: 14982 - DNA, 25 bp, S. cerevisiae
aaaattccattcaggttgcaagagg

SEQ ID NO: 14983 - DNA, 25 bp, S. cerevisiae
aaaattaagctctggttgcgccttt

SEQ ID NO: 14984 - DNA, 25 bp, S. cerevisiae
aacaaaggcaggtggattcggtatt

SEQ ID NO: 14985 - DNA, 25 bp, S. cerevisiae
aaaagggcaggctcgcattctgtgg

SEQ ID NO: 14986 - DNA, 25 bp, S. cerevisiae
aaaagaggactcttctgccattgcc

SEQ ID NO: 14987 - DNA, 25 bp, S. cerevisiae
aaaatacccacatttccaggtccat

SEQ ID NO: 14988 - DNA, 25 bp, S. cerevisiae
aaaataccgagctatcctacgactt

SEQ ID NO: 14989 - DNA, 25 bp, S. cerevisiae
aaaatgacgccattggcgcaaccct

SEQ ID NO: 14990 - DNA, 25 bp, S. cerevisiae
aaaagatcagaattcccgcaggtgt

SEQ ID NO: 14991 - DNA, 25 bp, S. cerevisiae
aaaagacgacattcgcccaacttat

SEQ ID NO: 14992 - DNA, 25 bp, S. cerevisiae
aaaagtcgacatgcccgtcattttt

SEQ ID NO: 14993 - DNA, 25 bp, S. cerevisiae
aaaagacgactgaactcgctgccat

SEQ ID NO: 14994 - DNA, 25 bp, S. cerevisiae
aaaaggcgtctatccacttgcattg

SEQ ID NO: 14995 - DNA, 25 bp, S. cerevisiae
aaaagctagttcttcaacctctaat

SEQ ID NO: 14996 - DNA, 25 bp, S. cerevisiae
aaaagactcgttgcaagagctgctg

SEQ ID NO: 14997 - DNA, 25 bp, S. cerevisiae
aacacttccgttatcttggatccac

SEQ ID NO: 14998 - DNA, 25 bp, S. cerevisiae
aacaatcccgatgtttcgggcggca

SEQ ID NO: 14999 - DNA, 25 bp, S. cerevisiae
aacagaacctactctaccgtgggcg

SEQ ID NO: 15000 - DNA, 25 bp, S. cerevisiae
aaaatacgccactgattccttaggg

SEQ ID NO: 15001 - DNA, 25 bp, S. cerevisiae
aaaagagtcttcctgcaacttgtgg

SEQ ID NO: 15002 - DNA, 25 bp, S. cerevisiae
aaaagacttccacttccactgatgg

SEQ ID NO: 15003 - DNA, 25 bp, S. cerevisiae
aaaaggagtccactcttcaccttgt

SEQ ID NO: 15004 - DNA, 25 bp, S. cerevisiae
aacacgaaggaatttatcaatgatc

SEQ ID NO: 15005 - DNA, 25 bp, S. cerevisiae
aacatcgacaaagctaatcaagtgg

SEQ ID NO: 15006 - DNA, 25 bp, S. cerevisiae
aaaaggtgctattacttgccgtata

SEQ ID NO: 15007 - DNA, 25 bp, S. cerevisiae
aaaagattctgactacattcctgta

SEQ ID NO: 15008 - DNA, 25 bp, S. cerevisiae
aaaagagtgcgccaacatcaccgga

SEQ ID NO: 15009 - DNA, 25 bp, S. cerevisiae
aacgggttgattccacaagacgcag

SEQ ID NO: 15010 - DNA, 25 bp, S. cerevisiae
aacagcgttctctaaaaatacctcg

SEQ ID NO: 15011 - DNA, 25 bp, S. cerevisiae
aacaccgacttacagcttcaactaa

SEQ ID NO: 15012 - DNA, 25 bp, S. cerevisiae
caaccggattttgagaccaacgacg

SEQ ID NO: 15013 - DNA, 25 bp, S. cerevisiae
aacacggttattgatgccaccaaga

SEQ ID NO: 15014 - DNA, 25 bp, S. cerevisiae
aaaagatctcttcctctgcatctaa

SEQ ID NO: 15015 - DNA, 25 bp, S. cerevisiae
aaaatgtctcagtacttccgtcagc

SEQ ID NO: 15016 - DNA, 25 bp, S. cerevisiae
aacaaccatcagttcgtcgttgcga

SEQ ID NO: 15017 - DNA, 25 bp, S. cerevisiae
aacactgcccagaggttcaatcgat

SEQ ID NO: 15018 - DNA, 25 bp, S. cerevisiae
aaaatgctacgtatggtcaatccag

SEQ ID NO: 15019 - DNA, 25 bp, S. cerevisiae
aaaattccactcctgacgatactgt

SEQ ID NO: 15020 - DNA, 25 bp, S. cerevisiae
aaaagtccccgttcaattgctgttg

SEQ ID NO: 15021 - DNA, 25 bp, S. cerevisiae
aacagacacctacagcatttgcagc

SEQ ID NO: 15022 - DNA, 25 bp, S. cerevisiae
aaaatccctctgtgctgaatcagct

SEQ ID NO: 15023 - DNA, 25 bp, S. cerevisiae
aacaatcctcgctgcattgagcatg

SEQ ID NO: 15024 - DNA, 25 bp, S. cerevisiae
aacaaccgtgaagtgctacatggca

SEQ ID NO: 15025 - DNA, 25 bp, S. cerevisiae
aacagcctgggaagtgcatcgtaca

SEQ ID NO: 15026 - DNA, 25 bp, S. cerevisiae
aactgcctacgaatctccatatact

SEQ ID NO: 15027 - DNA, 25 bp, S. cerevisiae
aacagccgctgcaagttcaataact

SEQ ID NO: 15028 - DNA, 25 bp, S. cerevisiae
aaaatgtgcctacttcctatacttc

SEQ ID NO: 15029 - DNA, 25 bp, S. cerevisiae
aaaatgccattaccatcgggcgcta

SEQ ID NO: 15030 - DNA, 25 bp, S. cerevisiae
aaaatgacattgctatccgccggca

SEQ ID NO: 15031 - DNA, 25 bp, S. cerevisiae
aaaattgcacatcctttcaccaaac

SEQ ID NO: 15032 - DNA, 25 bp, S. cerevisiae
aaaagtgacaccctaggcgaaacat

SEQ ID NO: 15033 - DNA, 25 bp, S. cerevisiae
aacaaggacgaggacatccccgaca

SEQ ID NO: 15034 - DNA, 25 bp, S. cerevisiae
aaaagtctcgatggctatgctctcc

SEQ ID NO: 15035 - DNA, 25 bp, S. cerevisiae
aaaagtccattttcgttctctgcac

SEQ ID NO: 15036 - DNA, 25 bp, S. cerevisiae
aacacgaaccatttgctactagaga

SEQ ID NO: 15037 - DNA, 25 bp, S. cerevisiae
aacagagtatatgtttccgcccaca

SEQ ID NO: 15038 - DNA, 25 bp, S. cerevisiae
aaaagtatcatggtgtcgccgccag

SEQ ID NO: 15039 - DNA, 25 bp, S. cerevisiae
aacaagatcatcaggtacaggacct

SEQ ID NO: 15040 - DNA, 25 bp, S. cerevisiae
aacaaactactgactacactgccgg

SEQ ID NO: 15041 - DNA, 25 bp, S. cerevisiae
aacaagcctttctcggctaggtatg

SEQ ID NO: 15042 - DNA, 25 bp, S. cerevisiae
aactacctctatcttggctcaaaag

SEQ ID NO: 15043 - DNA, 25 bp, S. cerevisiae
aaaatagccatttatccgaaagact

SEQ ID NO: 15044 - DNA, 25 bp, S. cerevisiae
aaaaggcgctttggtatatgttgaa

SEQ ID NO: 15045 - DNA, 25 bp, S. cerevisiae
aacaatcaaagagcgggcttcttct

SEQ ID NO: 15046 - DNA, 25 bp, S. cerevisiae
aacactaaatccacggtcatcttct

SEQ ID NO: 15047 - DNA, 25 bp, S. cerevisiae
aaaatcgcagtctctgaccacaggt

SEQ ID NO: 15048 - DNA, 25 bp, S. cerevisiae
aaaatgtcaccatcgggcttgaaag

SEQ ID NO: 15049 - DNA, 25 bp, S. cerevisiae
aaaattgcaagctcgctgttttaag

SEQ ID NO: 15050 - DNA, 25 bp, S. cerevisiae
aacaattcatgtgtcgcttttccgc

SEQ ID NO: 15051 - DNA, 25 bp, S. cerevisiae
aaaaggctaagtctgctggtactca

SEQ ID NO: 15052 - DNA, 25 bp, S. cerevisiae
aaaaggctaagtccgctggtgtcca

SEQ ID NO: 15053 - DNA, 25 bp, S. cerevisiae
aaaaggctacattccatctctggtc

SEQ ID NO: 15054 - DNA, 25 bp, S. cerevisiae
aaaagtctgactccattgctctatg

SEQ ID NO: 15055 - DNA, 25 bp, S. cerevisiae
aaaagtgctttccagatgtcaatga

SEQ ID NO: 15056 - DNA, 25 bp, S. cerevisiae
aaaaggctctttcgcttgctcatga

SEQ ID NO: 15057 - DNA, 25 bp, S. cerevisiae
aacaaagctattctcgtcctagcgc

SEQ ID NO: 15058 - DNA, 25 bp, S. cerevisiae
aacaagtgcggaacccatggatagc

SEQ ID NO: 15059 - DNA, 25 bp, S. cerevisiae
aacacagtgagtgccgacgagagcc

SEQ ID NO: 15060 - DNA, 25 bp, S. cerevisiae
aacacttttccagcaggaagcccaa

SEQ ID NO: 15061 - DNA, 25 bp, S. cerevisiae
aacacttttccacggatattccaat

SEQ ID NO: 15062 - DNA, 25 bp, S. cerevisiae
aaaattttggttcactctgcactgc

SEQ ID NO: 15063 - DNA, 25 bp, S. cerevisiae
aacatactatcatggacggcgccgg

SEQ ID NO: 15064 - DNA, 25 bp, S. cerevisiae
aacatgtccatctgtatcttcggtg

SEQ ID NO: 15065 - DNA, 25 bp, S. cerevisiae
aacagcctcctcctcggagagaatc

SEQ ID NO: 15066 - DNA, 25 bp, S. cerevisiae
aacacctcagcgactagtgatgaag

SEQ ID NO: 15067 - DNA, 25 bp, S. cerevisiae
aacagaaactgctggccagggaaca

SEQ ID NO: 15068 - DNA, 25 bp, S. cerevisiae
aacaacgatccatccgaggagacat

SEQ ID NO: 15069 - DNA, 25 bp, S. cerevisiae
aacaaggaccacatcggcggcacat

SEQ ID NO: 15070 - DNA, 25 bp, S. cerevisiae
aacagcaacagctttccttaaagat

SEQ ID NO: 15071 - DNA, 25 bp, S. cerevisiae
aacagcgcctcttggaaattagaca

SEQ ID NO: 15072 - DNA, 25 bp, S. cerevisiae
aacagagccgactagtacatgtaga

SEQ ID NO: 15073 - DNA, 25 bp, S. cerevisiae
aaaatccactactgccttcttgaaa

SEQ ID NO: 15074 - DNA, 25 bp, S. cerevisiae
aaaatttgccaatgaattcctgaaa

SEQ ID NO: 15075 - DNA, 25 bp, S. cerevisiae
aaaatcattcccatgaggctcaaaa

SEQ ID NO: 15076 - DNA, 25 bp, S. cerevisiae
aaaatacgtcttctcatctgatcta

SEQ ID NO: 15077 - DNA, 25 bp, S. cerevisiae
aaaatcacagtgagcaacttgacaa

SEQ ID NO: 15078 - DNA, 25 bp, S. cerevisiae
aacaatgccggtatttctgtcgaag

SEQ ID NO: 15079 - DNA, 25 bp, S. cerevisiae
aaaattctggtcttgatccaatcgg

SEQ ID NO: 15080 - DNA, 25 bp, S. cerevisiae
aaaattctgcctcaattgaccaggg

SEQ ID NO: 15081 - DNA, 25 bp, S. cerevisiae
aacaattagcctccaaggctgccag

SEQ ID NO: 15082 - DNA, 25 bp, S. cerevisiae
aaaattgaactccaaccatgccggt

SEQ ID NO: 15083 - DNA, 25 bp, S. cerevisiae
aaaatctcaacctgacacatccttg

SEQ ID NO: 15084 - DNA, 25 bp, S. cerevisiae
aaaatattgaactggcttgcgatgg

SEQ ID NO: 15085 - DNA, 25 bp, S. cerevisiae
aaaatcttgacctcctgtgttgctg

SEQ ID NO: 15086 - DNA, 25 bp, S. cerevisiae
aaaatgtcaatgttccctctgcttt

SEQ ID NO: 15087 - DNA, 25 bp, S. cerevisiae
aaaatggcgatgttcctattgcaga

SEQ ID NO: 15088 - DNA, 25 bp, S. cerevisiae
aacaattctggtgtgggaagcgcta

SEQ ID NO: 15089 - DNA, 25 bp, S. cerevisiae
aaaatgcttttggaggtggatgcgc

SEQ ID NO: 15090 - DNA, 25 bp, S. cerevisiae
aacaagcttgttggcgtcggtaacg

SEQ ID NO: 15091 - DNA, 25 bp, S. cerevisiae
aaaatcattgttgtccgtataaggg

SEQ ID NO: 15092 - DNA, 25 bp, S. cerevisiae
aaaattcgattcctccgttgacagg

SEQ ID NO: 15093 - DNA, 25 bp, S. cerevisiae
aaaatctctggaatgcaccaccatc

SEQ ID NO: 15094 - DNA, 25 bp, S. cerevisiae
aacaatcatgatcttgacacagcat

SEQ ID NO: 15095 - DNA, 25 bp, S. cerevisiae
aacaaagtcctctatcactgcaaag

SEQ ID NO: 15096 - DNA, 25 bp, S. cerevisiae
aacaacagatcttttcctgccattg

SEQ ID NO: 15097 - DNA, 25 bp, S. cerevisiae
aacagagtctttccttgattcgggc

SEQ ID NO: 15098 - DNA, 25 bp, S. cerevisiae
aacagcggcagcgagcatggtgatt

SEQ ID NO: 15099 - DNA, 25 bp, S. cerevisiae
aacagtagtagacctagaccacctc

SEQ ID NO: 15100 - DNA, 25 bp, S. cerevisiae
aacaacacttggtctaactacgcct

SEQ ID NO: 15101 - DNA, 25 bp, S. cerevisiae
aacaaggcttcggtaatcttcccat

SEQ ID NO: 15102 - DNA, 25 bp, S. cerevisiae
aacaaatcgttggtaccgtgcacaa

SEQ ID NO: 15103 - DNA, 25 bp, S. cerevisiae
aaaatttctatgacccaagcaccgg

SEQ ID NO: 15104 - DNA, 25 bp, S. cerevisiae
aaaatgtttcttccgcaatgcatgc

SEQ ID NO: 15105 - DNA, 25 bp, S. cerevisiae
aaaattttcttttgtcagcagcaac

SEQ ID NO: 15106 - DNA, 25 bp, S. cerevisiae
aaaattgtccttattgctcacgagc

SEQ ID NO: 15107 - DNA, 25 bp, S. cerevisiae
aaaattcgagctctttggcggcaac

SEQ ID NO: 15108 - DNA, 25 bp, S. cerevisiae
aaaattcgatgctttgttccctcaa

SEQ ID NO: 15109 - DNA, 25 bp, S. cerevisiae
aaaatttgagaaaagctgccccatt

SEQ ID NO: 15110 - DNA, 25 bp, S. cerevisiae
aacaagcttcatgaccaattccaga

SEQ ID NO: 15111 - DNA, 25 bp, S. cerevisiae
aacgtccattgaagataaagccgat

SEQ ID NO: 15112 - DNA, 25 bp, S. cerevisiae
aacaccgtatgagcatatcctccgt

SEQ ID NO: 15113 - DNA, 25 bp, S. cerevisiae
aacaccgcttgggatgatgatgctg

SEQ ID NO: 15114 - DNA, 25 bp, S. cerevisiae
aacagcgagcttccaagatatcata

SEQ ID NO: 15115 - DNA, 25 bp, S. cerevisiae
aacaggcacattttcgtcaaggacg

SEQ ID NO: 15116 - DNA, 25 bp, S. cerevisiae
aagcgaagctgtttggtacggtcca

SEQ ID NO: 15117 - DNA, 25 bp, S. cerevisiae
aacatattttccacagtcagcttcc

SEQ ID NO: 15118 - DNA, 25 bp, S. cerevisiae
aacacggattcatactcccaatatc

SEQ ID NO: 15119 - DNA, 25 bp, S. cerevisiae
aaaattcatgattccttctccaaat

SEQ ID NO: 15120 - DNA, 25 bp, S. cerevisiae
aaaattggcctgatttgggcacttt

SEQ ID NO: 15121 - DNA, 25 bp, S. cerevisiae
aaaattgcgtctttctatgccttgg

SEQ ID NO: 15122 - DNA, 25 bp, S. cerevisiae
aaaattgcgtgtttccagatgtaag

SEQ ID NO: 15123 - DNA, 25 bp, S. cerevisiae
aaaatgcttgtactccacagtgtga

SEQ ID NO: 15124 - DNA, 25 bp, S. cerevisiae
aaaatgcttcattgtcttcccagca

SEQ ID NO: 15125 - DNA, 25 bp, S. cerevisiae
aacaatcgtcttatacccaggtggt

SEQ ID NO: 15126 - DNA, 25 bp, S. cerevisiae
aacaatctcatgctaccgacaaggg

SEQ ID NO: 15127 - DNA, 25 bp, S. cerevisiae
aacaacgctcttgtagctaccggat

SEQ ID NO: 15128 - DNA, 25 bp, S. cerevisiae
aacaacgtttccaaggaggctgcct

SEQ ID NO: 15129 - DNA, 25 bp, S. cerevisiae
aacagagctggttggaactggtgat

SEQ ID NO: 15130 - DNA, 25 bp, S. cerevisiae
aatcggccgtaggtacattttactg

SEQ ID NO: 15131 - DNA, 25 bp, S. cerevisiae
aagaatctcttgcacgtgacggttt

SEQ ID NO: 15132 - DNA, 25 bp, S. cerevisiae
aacaacaccgttagcgacggcggat

SEQ ID NO: 15133 - DNA, 25 bp, S. cerevisiae
aacataactggtgtggccggtttct

SEQ ID NO: 15134 - DNA, 25 bp, S. cerevisiae
aacaaccaggcgacttggctttcaa

SEQ ID NO: 15135 - DNA, 25 bp, S. cerevisiae
aaaatctacctcaagtacttcctca

SEQ ID NO: 15136 - DNA, 25 bp, S. cerevisiae
aaaatagagcacgttcctcttcctg

SEQ ID NO: 15137 - DNA, 25 bp, S. cerevisiae
aacaaaaactttcccttcagctgag

SEQ ID NO: 15138 - DNA, 25 bp, S. cerevisiae
aaaataatgatttccccttgcccag

SEQ ID NO: 15139 - DNA, 25 bp, S. cerevisiae
aaaatattgtcttcgtcttttcaca

SEQ ID NO: 15140 - DNA, 25 bp, S. cerevisiae
aaaattttgtcgctctgctggtaca

SEQ ID NO: 15141 - DNA, 25 bp, S. cerevisiae
aaaatttgtgtcactctgattgtaa

SEQ ID NO: 15142 - DNA, 25 bp, S. cerevisiae
aaaatcggctatgcttctattgtaa

SEQ ID NO: 15143 - DNA, 25 bp, S. cerevisiae
aaaatcgtgttcttttcttgacata

SEQ ID NO: 15144 - DNA, 25 bp, S. cerevisiae
aacaggagtctttgggtagcaattc

SEQ ID NO: 15145 - DNA, 25 bp, S. cerevisiae
aacagcgatgacacggcttacaaat

SEQ ID NO: 15146 - DNA, 25 bp, S. cerevisiae
aaccagatcaggtcgagcttatcag

SEQ ID NO: 15147 - DNA, 25 bp, S. cerevisiae
aacacagctatgcattaggtgagca

SEQ ID NO: 15148 - DNA, 25 bp, S. cerevisiae
aaaatcgtatgtttctttggagcaa

SEQ ID NO: 15149 - DNA, 25 bp, S. cerevisiae
aacaacgttgtaattcctggagcga

SEQ ID NO: 15150 - DNA, 25 bp, S. cerevisiae
aacaatcgtggtaatcgcggcggat

SEQ ID NO: 15151 - DNA, 25 bp, S. cerevisiae
aaaatcagtggtctctggcgcacgt

SEQ ID NO: 15152 - DNA, 25 bp, S. cerevisiae
aaaatccgtgatgccggtccttcag

SEQ ID NO: 15153 - DNA, 25 bp, S. cerevisiae
aacaatcctgttgagggcttcttgt

SEQ ID NO: 15154 - DNA, 25 bp, S. cerevisiae
aacaagctcatttctggaagccagt

SEQ ID NO: 15155 - DNA, 25 bp, S. cerevisiae
aacagcacctgccttgtacgaatgt

SEQ ID NO: 15156 - DNA, 25 bp, S. cerevisiae
aacagtggcgagctcgacgacatta

SEQ ID NO: 15157 - DNA, 25 bp, S. cerevisiae
aacacgtggatgtcccaggtcattt

SEQ ID NO: 15158 - DNA, 25 bp, S. cerevisiae
aaaattgccatacatgatccgcatg

SEQ ID NO: 15159 - DNA, 25 bp, S. cerevisiae
aaaattgcacgattatactcctgta

SEQ ID NO: 15160 - DNA, 25 bp, S. cerevisiae
aaaattcctgctttttcagactcaa

SEQ ID NO: 15161 - DNA, 25 bp, S. cerevisiae
aaaatcacttgcatttctcctcatc

SEQ ID NO: 15162 - DNA, 25 bp, S. cerevisiae
aacagatgatgattgaagcatccat

SEQ ID NO: 15163 - DNA, 25 bp, S. cerevisiae
aacacagtgcagaagactcctacaa

SEQ ID NO: 15164 - DNA, 25 bp, S. cerevisiae
aaaatcaaatccatcgcgtagcaag

SEQ ID NO: 15165 - DNA, 25 bp, S. cerevisiae
aacaagtcttctgccttaactgcat

SEQ ID NO: 15166 - DNA, 25 bp, S. cerevisiae
aaaattgtgctttggttctcagtga

SEQ ID NO: 15167 - DNA, 25 bp, S. cerevisiae
aaaattggctgttggtctatcctga

SEQ ID NO: 15168 - DNA, 25 bp, S. cerevisiae
aacaacattttcaggttcaccagaa

SEQ ID NO: 15169 - DNA, 25 bp, S. cerevisiae
aacagaatgcttatgggtaccacaa

SEQ ID NO: 15170 - DNA, 25 bp, S. cerevisiae
aacagactgctactgcggagtggta

SEQ ID NO: 15171 - DNA, 25 bp, S. cerevisiae
aacaatctgcaactggtcggtgcca

SEQ ID NO: 15172 - DNA, 25 bp, S. cerevisiae
aacaatgcattgtctggattttcca

SEQ ID NO: 15173 - DNA, 25 bp, S. cerevisiae
aacaaatctggtagcatatcgtcga

SEQ ID NO: 15174 - DNA, 25 bp, S. cerevisiae
aacaaattacccatgcaacccagga

SEQ ID NO: 15175 - DNA, 25 bp, S. cerevisiae
aacacacttaccattgaacctcata

SEQ ID NO: 15176 - DNA, 25 bp, S. cerevisiae
aacaccgttgttatgtcctgtgaaa

SEQ ID NO: 15177 - DNA, 25 bp, S. cerevisiae
aacaccgtcgtaacatatccattga

SEQ ID NO: 15178 - DNA, 25 bp, S. cerevisiae
aacacacttgctaaactggccaatg

SEQ ID NO: 15179 - DNA, 25 bp, S. cerevisiae
aacagccgtggaatcgttgccaatt

SEQ ID NO: 15180 - DNA, 25 bp, S. cerevisiae
aacaccagtgtgaccgctcttatat

SEQ ID NO: 15181 - DNA, 25 bp, S. cerevisiae
aacaacgtagtcgaccgtctcatct

SEQ ID NO: 15182 - DNA, 25 bp, S. cerevisiae
aacaattttgtgcaccccaactggt

SEQ ID NO: 15183 - DNA, 25 bp, S. cerevisiae
aacaactttggaacctcacacgatc

SEQ ID NO: 15184 - DNA, 25 bp, S. cerevisiae
aaaattttgccatctgccaacgatc

SEQ ID NO: 15185 - DNA, 25 bp, S. cerevisiae
aaaatttcaccatctgcgccaagca

SEQ ID NO: 15186 - DNA, 25 bp, S. cerevisiae
aaaattcacctcttcggtaagcctg

SEQ ID NO: 15187 - DNA, 25 bp, S. cerevisiae
aaaattggcctcttccagtatatcc

SEQ ID NO: 15188 - DNA, 25 bp, S. cerevisiae
aaaatatggcctggttgactcctcc

SEQ ID NO: 15189 - DNA, 25 bp, S. cerevisiae
aaaattgctacttttgactcctcca

SEQ ID NO: 15190 - DNA, 25 bp, S. cerevisiae
aaaattgccaccttttcacaccctg

SEQ ID NO: 15191 - DNA, 25 bp, S. cerevisiae
aacacgcttcacttctagtacgaga

SEQ ID NO: 15192 - DNA, 25 bp, S. cerevisiae
aacagttgagagcaccaagtcaggt

SEQ ID NO: 15193 - DNA, 25 bp, S. cerevisiae
aacagccattggtacccattgggtg

SEQ ID NO: 15194 - DNA, 25 bp, S. cerevisiae
aactggactatgactgcctaagggt

SEQ ID NO: 15195 - DNA, 25 bp, S. cerevisiae
aacaagaaacgagtgctgctgcagt

SEQ ID NO: 15196 - DNA, 25 bp, S. cerevisiae
aacatcgtgcaatcaatgctgtcag

SEQ ID NO: 15197 - DNA, 25 bp, S. cerevisiae
aacagtccattctgcagagtctgcc

SEQ ID NO: 15198 - DNA, 25 bp, S. cerevisiae
aacatgacactagaggcgtcccggg

SEQ ID NO: 15199 - DNA, 25 bp, S. cerevisiae
cagattgacggagagagggccacat

SEQ ID NO: 15200 - DNA, 25 bp, S. cerevisiae
aaaattgattcacggtcctcatgcc

SEQ ID NO: 15201 - DNA, 25 bp, S. cerevisiae
aaaattcatcatcctccttaatgcc

SEQ ID NO: 15202 - DNA, 25 bp, S. cerevisiae
aaaattctcatcctctttatcagca

SEQ ID NO: 15203 - DNA, 25 bp, S. cerevisiae
aacacctatgctgtggctccaagta

SEQ ID NO: 15204 - DNA, 25 bp, S. cerevisiae
aacagtcttctggatggctcctgaa

SEQ ID NO: 15205 - DNA, 25 bp, S. cerevisiae
aacagaataatctatgggctcaaac

SEQ ID NO: 15206 - DNA, 25 bp, S. cerevisiae
aacaagatcattgagccgctgcaaa

SEQ ID NO: 15207 - DNA, 25 bp, S. cerevisiae
aacagcgttgatgatctcccacaaa

SEQ ID NO: 15208 - DNA, 25 bp, S. cerevisiae
aacagtttgcataacctctactgga

SEQ ID NO: 15209 - DNA, 25 bp, S. cerevisiae
aacagtcaggtacgtttacttgaat

SEQ ID NO: 15210 - DNA, 25 bp, S. cerevisiae
aacagtggtgtatcgttgactctac

SEQ ID NO: 15211 - DNA, 25 bp, S. cerevisiae
aacagtagatggttcgcgcgcacgt

SEQ ID NO: 15212 - DNA, 25 bp, S. cerevisiae
aacacatagatgaagcggccagcgc

SEQ ID NO: 15213 - DNA, 25 bp, S. cerevisiae
cacacaaatgtgcaagtgccaagct

SEQ ID NO: 15214 - DNA, 25 bp, S. cerevisiae
aacaaatttagacgccgcagctgca

SEQ ID NO: 15215 - DNA, 25 bp, S. cerevisiae
aacagaccccgaattgaatgatgag

SEQ ID NO: 15216 - DNA, 25 bp, S. cerevisiae
aacagcagccttcgaattgggacaa

SEQ ID NO: 15217 - DNA, 25 bp, S. cerevisiae
aacaccgcttcaaatatgctgggaa

SEQ ID NO: 15218 - DNA, 25 bp, S. cerevisiae
aacttggcccagaaacccgatgaat

SEQ ID NO: 15219 - DNA, 25 bp, S. cerevisiae
aacttcaaccaaaactccagcaaga

SEQ ID NO: 15220 - DNA, 25 bp, S. cerevisiae
aacttcggccattcttccaacaaga

SEQ ID NO: 15221 - DNA, 25 bp, S. cerevisiae
aagcttaccagcatcgtccaaaaaa

SEQ ID NO: 15222 - DNA, 25 bp, S. cerevisiae
aacagttccagctctaccaagaaat

SEQ ID NO: 15223 - DNA, 25 bp, S. cerevisiae
aacactattagtgaccccagggcaa

SEQ ID NO: 15224 - DNA, 25 bp, S. cerevisiae
aacaagattactcaccgtcacggga

SEQ ID NO: 15225 - DNA, 25 bp, S. cerevisiae
aacggttattaagcctcacgtccag

SEQ ID NO: 15226 - DNA, 25 bp, S. cerevisiae
aacggaattgccaccctactacaag

SEQ ID NO: 15227 - DNA, 25 bp, S. cerevisiae
aacaccaattacagcaccaacgaag

SEQ ID NO: 15228 - DNA, 25 bp, S. cerevisiae
aacaccaattacttcactatacggg

SEQ ID NO: 15229 - DNA, 25 bp, S. cerevisiae
aaccgagttccccactaatggatag

SEQ ID NO: 15230 - DNA, 25 bp, S. cerevisiae
aacagcggttcagcgacttacagaa

SEQ ID NO: 15231 - DNA, 25 bp, S. cerevisiae
aacaggtgttcgctatcactacgaa

SEQ ID NO: 15232 - DNA, 25 bp, S. cerevisiae
aacaatatcttcctctatgagccca

SEQ ID NO: 15233 - DNA, 25 bp, S. cerevisiae
aacactctattggtcactggtccat

SEQ ID NO: 15234 - DNA, 25 bp, S. cerevisiae
aacatctttgtcagcgctaatcact

SEQ ID NO: 15235 - DNA, 25 bp, S. cerevisiae
aatttttgtcaagactttgactggt

SEQ ID NO: 15236 - DNA, 25 bp, S. cerevisiae
aatcttcgttaagactttgactggt

SEQ ID NO: 15237 - DNA, 25 bp, S. cerevisiae
aacacctttagcgaccaatacacat

SEQ ID NO: 15238 - DNA, 25 bp, S. cerevisiae
aacacactggtaggatcttcacatc

SEQ ID NO: 15239 - DNA, 25 bp, S. cerevisiae
aacagagtcgtagatctgccgcacg

SEQ ID NO: 15240 - DNA, 25 bp, S. cerevisiae
aacgcagtcctttatggccaacggt

SEQ ID NO: 15241 - DNA, 25 bp, S. cerevisiae
aacatggatctcacgacgccaaaga

SEQ ID NO: 15242 - DNA, 25 bp, S. cerevisiae
aacaagccatcgaaactgccaacaa

SEQ ID NO: 15243 - DNA, 25 bp, S. cerevisiae
aacttacctagatgccattgccgat

SEQ ID NO: 15244 - DNA, 25 bp, S. cerevisiae
aacttcatcgaagcctttgccaatt

SEQ ID NO: 15245 - DNA, 25 bp, S. cerevisiae
aacaatattgccatccttgtgccag

SEQ ID NO: 15246 - DNA, 25 bp, S. cerevisiae
aacaagattcgccttcttggacgcc

SEQ ID NO: 15247 - DNA, 25 bp, S. cerevisiae
aactttaggtgatggagggccgcat

SEQ ID NO: 15248 - DNA, 25 bp, S. cerevisiae
aactttacccaaaagctagccgctg

SEQ ID NO: 15249 - DNA, 25 bp, S. cerevisiae
aacaattcaccgtcttatgaagggt

SEQ ID NO: 15250 - DNA, 25 bp, S. cerevisiae
gtaaattcgacatcttcaatacggt

SEQ ID NO: 15251 - DNA, 25 bp, S. cerevisiae
aacaatgttgtctttgccttattca

SEQ ID NO: 15252 - DNA, 25 bp, S. cerevisiae
aacaatttggtgtgtctgtgattca

SEQ ID NO: 15253 - DNA, 25 bp, S. cerevisiae
aacaattcggtatcgctgcttctga

SEQ ID NO: 15254 - DNA, 25 bp, S. cerevisiae
aacaatgtacgtttcctctgacaga

SEQ ID NO: 15255 - DNA, 25 bp, S. cerevisiae
aacgacattggtttcaacaaattca

SEQ ID NO: 15256 - DNA, 25 bp, S. cerevisiae
aacgacattggtttccacaagtaca

SEQ ID NO: 15257 - DNA, 25 bp, S. cerevisiae
aacgacattggtttccacaagtaca

SEQ ID NO: 15258 - DNA, 25 bp, S. cerevisiae
aacttgcccgacactgttgtttgga

SEQ ID NO: 15259 - DNA, 25 bp, S. cerevisiae
aacttgcccgccagtgaggtattaa

SEQ ID NO: 15260 - DNA, 25 bp, S. cerevisiae
aacttgaccgccgaacatgttccat

SEQ ID NO: 15261 - DNA, 25 bp, S. cerevisiae
aacattaccctctatcaaggtgcga

SEQ ID NO: 15262 - DNA, 25 bp, S. cerevisiae
aacaatgtctactttgcagccggag

SEQ ID NO: 15263 - DNA, 25 bp, S. cerevisiae
aacaatgattattccctcctgaggt

SEQ ID NO: 15264 - DNA, 25 bp, S. cerevisiae
aacagagatatctcctccaccagtt

SEQ ID NO: 15265 - DNA, 25 bp, S. cerevisiae
aacaagttgcactactgtgtctcct

SEQ ID NO: 15266 - DNA, 25 bp, S. cerevisiae
aacacagttgaatgttcgccctgaa

SEQ ID NO: 15267 - DNA, 25 bp, S. cerevisiae
aacagactagacttgattcgccgcg

SEQ ID NO: 15268 - DNA, 25 bp, S. cerevisiae
aacaacaacatctacgtcagcgagt

SEQ ID NO: 15269 - DNA, 25 bp, S. cerevisiae
aataggcgcagaccacagggtagtc

SEQ ID NO: 15270 - DNA, 25 bp, S. cerevisiae
aatatgggcaccctacgttgattcc

SEQ ID NO: 15271 - DNA, 25 bp, S. cerevisiae
aacaggtcatcgctacagtctggtc

SEQ ID NO: 15272 - DNA, 25 bp, S. cerevisiae
aacagcccatagcatcggttgatga

SEQ ID NO: 15273 - DNA, 25 bp, S. cerevisiae
aacaatcacatgagacggcgtgcaa

SEQ ID NO: 15274 - DNA, 25 bp, S. cerevisiae
aacaatcacatatgagcgctctcga

SEQ ID NO: 15275 - DNA, 25 bp, S. cerevisiae
aacaacataccgcactctggagaga

SEQ ID NO: 15276 - DNA, 25 bp, S. cerevisiae
aacaacatttcaccaatcaccaaga

SEQ ID NO: 15277 - DNA, 25 bp, S. cerevisiae
aacaatcattccaggcatcactgca

SEQ ID NO: 15278 - DNA, 25 bp, S. cerevisiae
aacaattgtctcagtccactcaaag

SEQ ID NO: 15279 - DNA, 25 bp, S. cerevisiae
aactattttattgctaccgtcagaa

SEQ ID NO: 15280 - DNA, 25 bp, S. cerevisiae
aacatttttatataccctggcgcaa

SEQ ID NO: 15281 - DNA, 25 bp, S. cerevisiae
aacagctttcgaagtaggtgattct

SEQ ID NO: 15282 - DNA, 25 bp, S. cerevisiae
aacagtctctgttagtagtggctac

SEQ ID NO: 15283 - DNA, 25 bp, S. cerevisiae
aacagtggcgttctttggtgattct

SEQ ID NO: 15284 - DNA, 25 bp, S. cerevisiae
aagctaaacttttcgaatgccaccg

SEQ ID NO: 15285 - DNA, 25 bp, S. cerevisiae
aacaaaactttgctgcactctcact

SEQ ID NO: 15286 - DNA, 25 bp, S. cerevisiae
aacaacactcttactatccaaacaa

SEQ ID NO: 15287 - DNA, 25 bp, S. cerevisiae
aacattcccgaagttctcaaaccag

SEQ ID NO: 15288 - DNA, 25 bp, S. cerevisiae
aacaacctcatgctcagcagcaatt

SEQ ID NO: 15289 - DNA, 25 bp, S. cerevisiae
aacattcgcgctaaacccggttgag

SEQ ID NO: 15290 - DNA, 25 bp, S. cerevisiae
aacagtgatgaattcggtagcggga

SEQ ID NO: 15291 - DNA, 25 bp, S. cerevisiae
aacatgcaacattacgtattcggga

SEQ ID NO: 15292 - DNA, 25 bp, S. cerevisiae
aacacagtcttcatgaacccttaca

SEQ ID NO: 15293 - DNA, 25 bp, S. cerevisiae
aacaagcttccacttcagaacctat

SEQ ID NO: 15294 - DNA, 25 bp, S. cerevisiae
aacacatttgccgaggctgttacgc

SEQ ID NO: 15295 - DNA, 25 bp, S. cerevisiae
aacacatggtgtacgcccttgagac

SEQ ID NO: 15296 - DNA, 25 bp, S. cerevisiae
aacaagcttgtccatgacccagaag

SEQ ID NO: 15297 - DNA, 25 bp, S. cerevisiae
aacaaatttttggaccgctgcgcta

SEQ ID NO: 15298 - DNA, 25 bp, S. cerevisiae
aacaaagcttttggcgcaggcggtt

SEQ ID NO: 15299 - DNA, 25 bp, S. cerevisiae
aacaaagtttctccagcagctgccg

SEQ ID NO: 15300 - DNA, 25 bp, S. cerevisiae
aacaacattctttacgagggcgccg

SEQ ID NO: 15301 - DNA, 25 bp, S. cerevisiae
aacaaggctgtagaattcgctcaac

SEQ ID NO: 15302 - DNA, 25 bp, S. cerevisiae
aacaaggctgttgatgtgtccaaaa

SEQ ID NO: 15303 - DNA, 25 bp, S. cerevisiae
aacaaggtggtttgccatctccaat

SEQ ID NO: 15304 - DNA, 25 bp, S. cerevisiae
aacaaggtggtgttccatcttctaa

SEQ ID NO: 15305 - DNA, 25 bp, S. cerevisiae
aacacggtgaagttccatttggcaa

SEQ ID NO: 15306 - DNA, 25 bp, S. cerevisiae
aacaggttaagctcattcttccaaa

SEQ ID NO: 15307 - DNA, 25 bp, S. cerevisiae
aacaggccaagttccatggtactaa

SEQ ID NO: 15308 - DNA, 25 bp, S. cerevisiae
aacggtcatggataaggtggctaca

SEQ ID NO: 15309 - DNA, 25 bp, S. cerevisiae
aactgtgtcaaggaaagaatcgtca

SEQ ID NO: 15310 - DNA, 25 bp, S. cerevisiae
aacagcagcgccttcaataataatg

SEQ ID NO: 15311 - DNA, 25 bp, S. cerevisiae
aacacaatcagctcaatgaatcctg

SEQ ID NO: 15312 - DNA, 25 bp, S. cerevisiae
aatgcttcccaagtggtactttctc

SEQ ID NO: 15313 - DNA, 25 bp, S. cerevisiae
aactaaattgcatagccgtggcttc

SEQ ID NO: 15314 - DNA, 25 bp, S. cerevisiae
aacataatttctgagctcgtgggct

SEQ ID NO: 15315 - DNA, 25 bp, S. cerevisiae
aacaaaagattcaagctgcggaagc

SEQ ID NO: 15316 - DNA, 25 bp, S. cerevisiae
aacaccttatattctcttggtagac

SEQ ID NO: 15317 - DNA, 25 bp, S. cerevisiae
aacaaattgagttccttggtgaaga

SEQ ID NO: 15318 - DNA, 25 bp, S. cerevisiae
aacatgggctctaatggcgctccaa

SEQ ID NO: 15319 - DNA, 25 bp, S. cerevisiae
aacatcagagctgtatcccttcaac

SEQ ID NO: 15320 - DNA, 25 bp, S. cerevisiae
aacacagagatcctcttcgcaatca

SEQ ID NO: 15321 - DNA, 25 bp, S. cerevisiae
aacacagcagtcgttcatgccaatg

SEQ ID NO: 15322 - DNA, 25 bp, S. cerevisiae
aacagggatcacaatctgccagaaa

SEQ ID NO: 15323 - DNA, 25 bp, S. cerevisiae
aacagctctctaaacgccatgaaac

SEQ ID NO: 15324 - DNA, 25 bp, S. cerevisiae
aacacctctgcaaacgttattccag

SEQ ID NO: 15325 - DNA, 25 bp, S. cerevisiae
aacatcctattagcggtgattcccc

SEQ ID NO: 15326 - DNA, 25 bp, S. cerevisiae
aacatcgttatgtccggtggtacca

SEQ ID NO: 15327 - DNA, 25 bp, S. cerevisiae
aacacatctaccataagccgtgaga

SEQ ID NO: 15328 - DNA, 25 bp, S. cerevisiae
aacaccatacgttagtgcactgaaa

SEQ ID NO: 15329 - DNA, 25 bp, S. cerevisiae
aacacacaatcgaatgagcctctga

SEQ ID NO: 15330 - DNA, 25 bp, S. cerevisiae
aacagcaaatcgtcgcaggcactga

SEQ ID NO: 15331 - DNA, 25 bp, S. cerevisiae
aacaaagggctggtggtctctccat

SEQ ID NO: 15332 - DNA, 25 bp, S. cerevisiae
aacaggtggccgaaggtgctgccca

SEQ ID NO: 15333 - DNA, 25 bp, S. cerevisiae
aacactgtggcaggtcacgtggcaa

SEQ ID NO: 15334 - DNA, 25 bp, S. cerevisiae
aacacatctgtttcttactccaaat

SEQ ID NO: 15335 - DNA, 25 bp, S. cerevisiae
aacacatggtgtggtgaacctgcaa

SEQ ID NO: 15336 - DNA, 25 bp, S. cerevisiae
aacagattggtggtgctacgtatta

SEQ ID NO: 15337 - DNA, 25 bp, S. cerevisiae
aacaaaattcattgctcagcgtatt

SEQ ID NO: 15338 - DNA, 25 bp, S. cerevisiae
aacaaagacctcttgccagttgtag

SEQ ID NO: 15339 - DNA, 25 bp, S. cerevisiae
aacaactgttgggtgtagtctctaa

SEQ ID NO: 15340 - DNA, 25 bp, S. cerevisiae
aacaaaccacgtgatggtctacacg

SEQ ID NO: 15341 - DNA, 25 bp, S. cerevisiae
aacaacactcaggtaacgttcgaag

SEQ ID NO: 15342 - DNA, 25 bp, S. cerevisiae
aacaacagttgcttaccacattcca

SEQ ID NO: 15343 - DNA, 25 bp, S. cerevisiae
aacacactgatattgggcccatttc

SEQ ID NO: 15344 - DNA, 25 bp, S. cerevisiae
aacatcagcatcttcatgggtcaga

SEQ ID NO: 15345 - DNA, 25 bp, S. cerevisiae
aacacagcccgtggttcaagtgcaa

SEQ ID NO: 15346 - DNA, 25 bp, S. cerevisiae
aacttgctagctacgattccaggaa

SEQ ID NO: 15347 - DNA, 25 bp, S. cerevisiae
aacattgccagcttcgtcatggtgg

SEQ ID NO: 15348 - DNA, 25 bp, S. cerevisiae
aacagatcatatttccgctgcgggc

SEQ ID NO: 15349 - DNA, 25 bp, S. cerevisiae
aacttttgaagtgacaatcgcgcga

SEQ ID NO: 15350 - DNA, 25 bp, S. cerevisiae
aactttcaggaaaactctggtgtca

SEQ ID NO: 15351 - DNA, 25 bp, S. cerevisiae
aacagttcaaccagactcgcagtta

SEQ ID NO: 15352 - DNA, 25 bp, S. cerevisiae
aacagttggaacaggctcaagcaca

SEQ ID NO: 15353 - DNA, 25 bp, S. cerevisiae
aacactgtggatgagctgccttggt

SEQ ID NO: 15354 - DNA, 25 bp, S. cerevisiae
aacaggtgccattatctctatcaag

SEQ ID NO: 15355 - DNA, 25 bp, S. cerevisiae
aacatgatgaataagttcgctgaaa

SEQ ID NO: 15356 - DNA, 25 bp, S. cerevisiae
aacttttaagttcgcatgtaggtca

SEQ ID NO: 15357 - DNA, 25 bp, S. cerevisiae
aactcgatttatcagggcagtggct

SEQ ID NO: 15358 - DNA, 25 bp, S. cerevisiae
aacaccgcagatttcccgcagaaat

SEQ ID NO: 15359 - DNA, 25 bp, S. cerevisiae
aacatcccgatgtggccaataataa

SEQ ID NO: 15360 - DNA, 25 bp, S. cerevisiae
aactcctcggttacccagagagaat

SEQ ID NO: 15361 - DNA, 25 bp, S. cerevisiae
aactcgccggttacaccatagtgga

SEQ ID NO: 15362 - DNA, 25 bp, S. cerevisiae
aacatctccaggctacagcccagga

SEQ ID NO: 15363 - DNA, 25 bp, S. cerevisiae
aactccgagggcgacgacgatgatg

SEQ ID NO: 15364 - DNA, 25 bp, S. cerevisiae
aacctagatggtgccacagcgacat

SEQ ID NO: 15365 - DNA, 25 bp, S. cerevisiae
aacagctcagaggattcgcaaaaat

SEQ ID NO: 15366 - DNA, 25 bp, S. cerevisiae
aacatgtcagacttcgtaccaattg

SEQ ID NO: 15367 - DNA, 25 bp, S. cerevisiae
aacagtcaacttctagctctcagga

SEQ ID NO: 15368 - DNA, 25 bp, S. cerevisiae
aacactttagagtcttttgccccat

SEQ ID NO: 15369 - DNA, 25 bp, S. cerevisiae
aacatctgtatttggagttccccga

SEQ ID NO: 15370 - DNA, 25 bp, S. cerevisiae
aacaggtcattttcgtatcccctga

SEQ ID NO: 15371 - DNA, 25 bp, S. cerevisiae
aacaggattgcatacgtaccacgtc

SEQ ID NO: 15372 - DNA, 25 bp, S. cerevisiae
aacttggcatcatcggagacctctg

SEQ ID NO: 15373 - DNA, 25 bp, S. cerevisiae
aacttgaatgcttacatggacgcta

SEQ ID NO: 15374 - DNA, 25 bp, S. cerevisiae
aacttcgcaagtctggtttccacat

SEQ ID NO: 15375 - DNA, 25 bp, S. cerevisiae
aactttctgttgatggtattcctca

SEQ ID NO: 15376 - DNA, 25 bp, S. cerevisiae
aacactttgttgatttctggtccat

SEQ ID NO: 15377 - DNA, 25 bp, S. cerevisiae
aacagttgggtgattctccttcgca

SEQ ID NO: 15378 - DNA, 25 bp, S. cerevisiae
aacagttttctgattctcacggcga

SEQ ID NO: 15379 - DNA, 25 bp, S. cerevisiae
aacactgtttatcatttggcgcaga

SEQ ID NO: 15380 - DNA, 25 bp, S. cerevisiae
aacagtttctcacgttgcaggaaga

SEQ ID NO: 15381 - DNA, 25 bp, S. cerevisiae
aacagtttctcattgtgtcggcgga

SEQ ID NO: 15382 - DNA, 25 bp, S. cerevisiae
aacagtttcgcataatgaggcccag

SEQ ID NO: 15383 - DNA, 25 bp, S. cerevisiae
aacaggtatctggatcgacggtaac

SEQ ID NO: 15384 - DNA, 25 bp, S. cerevisiae
aagcagtttcatcgacgaccttgac

SEQ ID NO: 15385 - DNA, 25 bp, S. cerevisiae
aactctagcgtgacatcgacgggtc

SEQ ID NO: 15386 - DNA, 25 bp, S. cerevisiae
aacattcctgtcaagacatcggctg

SEQ ID NO: 15387 - DNA, 25 bp, S. cerevisiae
aacacatccgtcaagttggtttctc

SEQ ID NO: 15388 - DNA, 25 bp, S. cerevisiae
aacacactttgtggtacgccttctt

SEQ ID NO: 15389 - DNA, 25 bp, S. cerevisiae
aacacatttgttcgaaagcctcctg

SEQ ID NO: 15390 - DNA, 25 bp, S. cerevisiae
aactttaccaacatctctacacatt

SEQ ID NO: 15391 - DNA, 25 bp, S. cerevisiae
aactattggccgatgcaacggtcgc

SEQ ID NO: 15392 - DNA, 25 bp, S. cerevisiae
aacactatccgttacaacgctaaga

SEQ ID NO: 15393 - DNA, 25 bp, S. cerevisiae
aacgtacggagcttgcgaatgcgcc

SEQ ID NO: 15394 - DNA, 25 bp, S. cerevisiae
aacacatctactatcttgcggactg

SEQ ID NO: 15395 - DNA, 25 bp, S. cerevisiae
aacatgagtgatcctagctgcgcgc

SEQ ID NO: 15396 - DNA, 25 bp, S. cerevisiae
aagcgatggttggttcaagaccggt

SEQ ID NO: 15397 - DNA, 25 bp, S. cerevisiae
aacagtgatttggatggcctaccct

SEQ ID NO: 15398 - DNA, 25 bp, S. cerevisiae
aacactgccaaagtgagctctactt

SEQ ID NO: 15399 - DNA, 25 bp, S. cerevisiae
aacagcagcggatgtcctctttgta

SEQ ID NO: 15400 - DNA, 25 bp, S. cerevisiae
aacacgactcaatgcatttccagac

SEQ ID NO: 15401 - DNA, 25 bp, S. cerevisiae
aacactcgcagagctcgatgttgga

SEQ ID NO: 15402 - DNA, 25 bp, S. cerevisiae
aactggccttaatcgtgggtattca

SEQ ID NO: 15403 - DNA, 25 bp, S. cerevisiae
aacaggtctaagtgcgtcaggtaaa

SEQ ID NO: 15404 - DNA, 25 bp, S. cerevisiae
aacagtttacgcttctagaggtaca

SEQ ID NO: 15405 - DNA, 25 bp, S. cerevisiae
aactttctgacccattcttgtttga

SEQ ID NO: 15406 - DNA, 25 bp, S. cerevisiae
aactttctagcacagataggatacg

SEQ ID NO: 15407 - DNA, 25 bp, S. cerevisiae
aactagactgagaaaggaatacctt

SEQ ID NO: 15408 - DNA, 25 bp, S. cerevisiae
aactatcaagagcaatacaacaagc

SEQ ID NO: 15409 - DNA, 25 bp, S. cerevisiae
aactaatgacacaattcccaccagg

SEQ ID NO: 15410 - DNA, 25 bp, S. cerevisiae
aactattgatagcaacgcctccatt

SEQ ID NO: 15411 - DNA, 25 bp, S. cerevisiae
aacattgaggctttaagtatcaaac

SEQ ID NO: 15412 - DNA, 25 bp, S. cerevisiae
aacttggtctttagcttattcaggt

SEQ ID NO: 15413 - DNA, 25 bp, S. cerevisiae
aacactagtgtcttattgctgccaa

SEQ ID NO: 15414 - DNA, 25 bp, S. cerevisiae
aacagatactggttggctgctgcca

SEQ ID NO: 15415 - DNA, 25 bp, S. cerevisiae
aacagaattgcgcatgagctgccta

SEQ ID NO: 15416 - DNA, 25 bp, S. cerevisiae
aacgatgcgggattacggcacccta

SEQ ID NO: 15417 - DNA, 25 bp, S. cerevisiae
aactacagcggttcaaggactccaa

SEQ ID NO: 15418 - DNA, 25 bp, S. cerevisiae
aactacaggtcttctaaattggcaa

SEQ ID NO: 15419 - DNA, 25 bp, S. cerevisiae
aacttctttgcaaccgtctactgtt

SEQ ID NO: 15420 - DNA, 25 bp, S. cerevisiae
aactattgcgttccacggaggttca

SEQ ID NO: 15421 - DNA, 25 bp, S. cerevisiae
aacttctccattccatgcggttttt

SEQ ID NO: 15422 - DNA, 25 bp, S. cerevisiae
aacatgtctctactgacgaggttct

SEQ ID NO: 15423 - DNA, 25 bp, S. cerevisiae
aacactcctgcatgtatccgtaatt

SEQ ID NO: 15424 - DNA, 25 bp, S. cerevisiae
aacacctcatcgttatgacgacaat

SEQ ID NO: 15425 - DNA, 25 bp, S. cerevisiae
aagctgtcttcgcaaagcggtcggt

SEQ ID NO: 15426 - DNA, 25 bp, S. cerevisiae
aactgttttgcataacggccgtgat

SEQ ID NO: 15427 - DNA, 25 bp, S. cerevisiae
aacttttcgcaaacacaggtggata

SEQ ID NO: 15428 - DNA, 25 bp, S. cerevisiae
aacttcctttgcatcaagaattaac

SEQ ID NO: 15429 - DNA, 25 bp, S. cerevisiae
aacatctgccacattcttaaggatt

SEQ ID NO: 15430 - DNA, 25 bp, S. cerevisiae
aacactgtgcctttgttaccaattg

SEQ ID NO: 15431 - DNA, 25 bp, S. cerevisiae
aacactgatgctattgtcgtcgcct

SEQ ID NO: 15432 - DNA, 25 bp, S. cerevisiae
aacagattgctcttcccttatatga

SEQ ID NO: 15433 - DNA, 25 bp, S. cerevisiae
aacagtctcaaagcttcgatggcga

SEQ ID NO: 15434 - DNA, 25 bp, S. cerevisiae
aacaggttacccatcgtctggtatt

SEQ ID NO: 15435 - DNA, 25 bp, S. cerevisiae
aacagttttcttcatttcggtatca

SEQ ID NO: 15436 - DNA, 25 bp, S. cerevisiae
aacagtgtctctctaatatttgcga

SEQ ID NO: 15437 - DNA, 25 bp, S. cerevisiae
aacttggctgctttcgattttgagc

SEQ ID NO: 15438 - DNA, 25 bp, S. cerevisiae
aactgcgtcgtgtggtgttgcgtta

SEQ ID NO: 15439 - DNA, 25 bp, S. cerevisiae
aacatcttagatttgcacgctgcgt

SEQ ID NO: 15440 - DNA, 25 bp, S. cerevisiae
aacatcttcaatttggcgtcctcta

SEQ ID NO: 15441 - DNA, 25 bp, S. cerevisiae
aacatattttctttgactctccctt

SEQ ID NO: 15442 - DNA, 25 bp, S. cerevisiae
aacagactttgtttgctggtccctt

SEQ ID NO: 15443 - DNA, 25 bp, S. cerevisiae
aacatgttttgttcgcggttccaat

SEQ ID NO: 15444 - DNA, 25 bp, S. cerevisiae
aacagtgcgttgtcaccggatctaa

SEQ ID NO: 15445 - DNA, 25 bp, S. cerevisiae
aacttggttgatctccacatctcaa

SEQ ID NO: 15446 - DNA, 25 bp, S. cerevisiae
aacattggccagtgatgaccccata

SEQ ID NO: 15447 - DNA, 25 bp, S. cerevisiae
aacatatcattgacggtggcaccat

SEQ ID NO: 15448 - DNA, 25 bp, S. cerevisiae
aactccataactggtggaacaccct

SEQ ID NO: 15449 - DNA, 25 bp, S. cerevisiae
aaccaaggcctgatggaacttttga

SEQ ID NO: 15450 - DNA, 25 bp, S. cerevisiae
aaccgggtctatgtgagcgtttcga

SEQ ID NO: 15451 - DNA, 25 bp, S. cerevisiae
aacatccactttacgtggcgtttgt

SEQ ID NO: 15452 - DNA, 25 bp, S. cerevisiae
aactccataacatacctgtcgaagg

SEQ ID NO: 15453 - DNA, 25 bp, S. cerevisiae
aactactgtacatacctattggtgc

SEQ ID NO: 15454 - DNA, 25 bp, S. cerevisiae
aacatgactgtggttccctattgca

SEQ ID NO: 15455 - DNA, 25 bp, S. cerevisiae
aacagatgttgtggctcgaaattca

SEQ ID NO: 15456 - DNA, 25 bp, S. cerevisiae
aacagagcttttgccgagtttattg

SEQ ID NO: 15457 - DNA, 25 bp, S. cerevisiae
aacagcagtcttacactcaggtttt

SEQ ID NO: 15458 - DNA, 25 bp, S. cerevisiae
aactgacccaatattgactgccact

SEQ ID NO: 15459 - DNA, 25 bp, S. cerevisiae
aactacagatgaggttgttcgccat

SEQ ID NO: 15460 - DNA, 25 bp, S. cerevisiae
aacatggcaggcaatctttttggtg

SEQ ID NO: 15461 - DNA, 25 bp, S. cerevisiae
aacagtttgtggacttattgggcga

SEQ ID NO: 15462 - DNA, 25 bp, S. cerevisiae
aacagtgttcgcctttttgaggtga

SEQ ID NO: 15463 - DNA, 25 bp, S. cerevisiae
aacattttcaaaactctgcatgagg

SEQ ID NO: 15464 - DNA, 25 bp, S. cerevisiae
aacagtttgcaacccttgaaggacg

SEQ ID NO: 15465 - DNA, 25 bp, S. cerevisiae
aacgttccaaccgtagtgaagagct

SEQ ID NO: 15466 - DNA, 25 bp, S. cerevisiae
aactattccattgtctgggacgaga

SEQ ID NO: 15467 - DNA, 25 bp, S. cerevisiae
aacttgccaaatacgccataagcgc

SEQ ID NO: 15468 - DNA, 25 bp, S. cerevisiae
aacatttggagaggtcgcttcagac

SEQ ID NO: 15469 - DNA, 25 bp, S. cerevisiae
aactccgtaacttggcttgcaaaca

SEQ ID NO: 15470 - DNA, 25 bp, S. cerevisiae
aactcctaaagatgtgcctgcgaac

SEQ ID NO: 15471 - DNA, 25 bp, S. cerevisiae
aactgactaacgtagtcgtgccgaa

SEQ ID NO: 15472 - DNA, 25 bp, S. cerevisiae
gactcaaagaacaaggacaggccag

SEQ ID NO: 15473 - DNA, 25 bp, S. cerevisiae
aactttcctgaactgacagcatctg

SEQ ID NO: 15474 - DNA, 25 bp, S. cerevisiae
aacttcatcaatgtcactccaaagg

SEQ ID NO: 15475 - DNA, 25 bp, S. cerevisiae
aacagtatacatgctatcacccaca

SEQ ID NO: 15476 - DNA, 25 bp, S. cerevisiae
aacagtcatcatacatcccagggaa

SEQ ID NO: 15477 - DNA, 25 bp, S. cerevisiae
aacagaatcatttgcccagcgtgaa

SEQ ID NO: 15478 - DNA, 25 bp, S. cerevisiae
aacagctttacaaccttttatcaat

SEQ ID NO: 15479 - DNA, 25 bp, S. cerevisiae
aacaggtcattctcgtgtactgata

SEQ ID NO: 15480 - DNA, 25 bp, S. cerevisiae
aacaggttcatctcgacaatgccaa

SEQ ID NO: 15481 - DNA, 25 bp, S. cerevisiae
aacagattttcctatggctcttcat

SEQ ID NO: 15482 - DNA, 25 bp, S. cerevisiae
aacagatccttcttacgtgtcttct

SEQ ID NO: 15483 - DNA, 25 bp, S. cerevisiae
aacagatacactttcactctctttc

SEQ ID NO: 15484 - DNA, 25 bp, S. cerevisiae
aacagattatctgccattccagtct

SEQ ID NO: 15485 - DNA, 25 bp, S. cerevisiae
aactctaccgctaaatcaccggatg

SEQ ID NO: 15486 - DNA, 25 bp, S. cerevisiae
aactttcgactctaatgcctgcgga

SEQ ID NO: 15487 - DNA, 25 bp, S. cerevisiae
aactgtaataagattctcctgcccc

SEQ ID NO: 15488 - DNA, 25 bp, S. cerevisiae
aacagtattacgatcctgctaccgg

SEQ ID NO: 15489 - DNA, 25 bp, S. cerevisiae
aacgtttacgtgtggttcgcatggc

SEQ ID NO: 15490 - DNA, 25 bp, S. cerevisiae
aacttttactatcccgttagccatg

SEQ ID NO: 15491 - DNA, 25 bp, S. cerevisiae
aactatggtgctttcccacaaactt

SEQ ID NO: 15492 - DNA, 25 bp, S. cerevisiae
aacgaggcccttgtcacaaagcaaa

SEQ ID NO: 15493 - DNA, 25 bp, S. cerevisiae
aacttgaacacgcaacttaggcaaa

SEQ ID NO: 15494 - DNA, 25 bp, S. cerevisiae
aactgtacaacttcttatgggacga

SEQ ID NO: 15495 - DNA, 25 bp, S. cerevisiae
aacttccttcggtatgttcctacat

SEQ ID NO: 15496 - DNA, 25 bp, S. cerevisiae
aactctgcggttgagttgaccttag

SEQ ID NO: 15497 - DNA, 25 bp, S. cerevisiae
aactttggtttcatgtgggcttata

SEQ ID NO: 15498 - DNA, 25 bp, S. cerevisiae
aactttggtattgtctgtctttgtg

SEQ ID NO: 15499 - DNA, 25 bp, S. cerevisiae
aactctcttggttgggcttttgaag

SEQ ID NO: 15500 - DNA, 25 bp, S. cerevisiae
aactccttttccatcatttcttggt

SEQ ID NO: 15501 - DNA, 25 bp, S. cerevisiae
aacggatttactctacttttagcat

SEQ ID NO: 15502 - DNA, 25 bp, S. cerevisiae
aactatgtttaccaacctgtccatg

SEQ ID NO: 15503 - DNA, 25 bp, S. cerevisiae
aactcattacaagatcccagcctgg

SEQ ID NO: 15504 - DNA, 25 bp, S. cerevisiae
aactaaagcattgacgccagagcgt

SEQ ID NO: 15505 - DNA, 25 bp, S. cerevisiae
aactacgagtagtatctgcaaacaa

SEQ ID NO: 15506 - DNA, 25 bp, S. cerevisiae
aactttaccactttgatggctgctt

SEQ ID NO: 15507 - DNA, 25 bp, S. cerevisiae
aacatgttttacactcttcgtgcgc

SEQ ID NO: 15508 - DNA, 25 bp, S. cerevisiae
aacatttcttaattcacgtcgctcg

SEQ ID NO: 15509 - DNA, 25 bp, S. cerevisiae
aacatgttgaccatcgtcatctcag

SEQ ID NO: 15510 - DNA, 25 bp, S. cerevisiae
aacatcatgctgtccaattttgctc

SEQ ID NO: 15511 - DNA, 25 bp, S. cerevisiae
aacatcactacagttttctcacacg

SEQ ID NO: 15512 - DNA, 25 bp, S. cerevisiae
aactacttcaagatgtttccggctt

SEQ ID NO: 15513 - DNA, 25 bp, S. cerevisiae
aacatgatctccaatggtgcctttg

SEQ ID NO: 15514 - DNA, 25 bp, S. cerevisiae
aacagtgctctagttccattggaac

SEQ ID NO: 15515 - DNA, 25 bp, S. cerevisiae
aactacttagacgtcaaggcaatca

SEQ ID NO: 15516 - DNA, 25 bp, S. cerevisiae
aacatcattggccactagcacagtc

SEQ ID NO: 15517 - DNA, 25 bp, S. cerevisiae
aacatcatcttctttatcacaaccg

SEQ ID NO: 15518 - DNA, 25 bp, S. cerevisiae
aagaccttttgcaaactgacgtagt

SEQ ID NO: 15519 - DNA, 25 bp, S. cerevisiae
aactaagaagcaagcttccgccgcc

SEQ ID NO: 15520 - DNA, 25 bp, S. cerevisiae
aactacgacgctaagtccgttgcag

SEQ ID NO: 15521 - DNA, 25 bp, S. cerevisiae
aactatcccctttgacgagttggag

SEQ ID NO: 15522 - DNA, 25 bp, S. cerevisiae
aacattcggaaaagcaagatgcgta

SEQ ID NO: 15523 - DNA, 25 bp, S. cerevisiae
aacatctctagatctaccaggcgta

SEQ ID NO: 15524 - DNA, 25 bp, S. cerevisiae
aacagttttcacttgccagacgaag

SEQ ID NO: 15525 - DNA, 25 bp, S. cerevisiae
aacaggtttagcttcgctgcttgat

SEQ ID NO: 15526 - DNA, 25 bp, S. cerevisiae
aacagttctgattctttgcattctt

SEQ ID NO: 15527 - DNA, 25 bp, S. cerevisiae
aacagtgtggatatgtccgctttga

SEQ ID NO: 15528 - DNA, 25 bp, S. cerevisiae
aacatcctggatcctgattatttgt

SEQ ID NO: 15529 - DNA, 25 bp, S. cerevisiae
aactccgccgtcaagaaatgtctag

SEQ ID NO: 15530 - DNA, 25 bp, S. cerevisiae
aacttactgatgtcaaccctgtcta

SEQ ID NO: 15531 - DNA, 25 bp, S. cerevisiae
aactatcacttcttgcaacctattc

SEQ ID NO: 15532 - DNA, 25 bp, S. cerevisiae
aactcacagccggagcacactgatg

SEQ ID NO: 15533 - DNA, 25 bp, S. cerevisiae
aacatacataccagagagcttgact

SEQ ID NO: 15534 - DNA, 25 bp, S. cerevisiae
aacatattatccagtgggctctcta

SEQ ID NO: 15535 - DNA, 25 bp, S. cerevisiae
aacattttcttgatgggcgctttct

SEQ ID NO: 15536 - DNA, 25 bp, S. cerevisiae
aacttgtatgttatcaaggctttgc

SEQ ID NO: 15537 - DNA, 25 bp, S. cerevisiae
aacttgtatgtcattaaggctttac

SEQ ID NO: 15538 - DNA, 25 bp, S. cerevisiae
aacttgtatgtcattaaggctttac

SEQ ID NO: 15539 - DNA, 25 bp, S. cerevisiae
aatccagaatttcttcgaacccgca

SEQ ID NO: 15540 - DNA, 25 bp, S. cerevisiae
aaccagaatttatctcaggcctcct

SEQ ID NO: 15541 - DNA, 25 bp, S. cerevisiae
aacggaatatttagcgccaccgcct

SEQ ID NO: 15542 - DNA, 25 bp, S. cerevisiae
aacatggcaacttatcggccgcagc

SEQ ID NO: 15543 - DNA, 25 bp, S. cerevisiae
aacagtgccatatatcactccagcc

SEQ ID NO: 15544 - DNA, 25 bp, S. cerevisiae
aactggtcaactcattaagggtctt

SEQ ID NO: 15545 - DNA, 25 bp, S. cerevisiae
aactgggccccatttgtagctggtt

SEQ ID NO: 15546 - DNA, 25 bp, S. cerevisiae
aactattcgctgacctatcacaaga

SEQ ID NO: 15547 - DNA, 25 bp, S. cerevisiae
aacttcctgaggtttctagcagcgg

SEQ ID NO: 15548 - DNA, 25 bp, S. cerevisiae
aacaggtgccactttgggagcggaa

SEQ ID NO: 15549 - DNA, 25 bp, S. cerevisiae
aacatggcctccctaggaacgctga

SEQ ID NO: 15550 - DNA, 25 bp, S. cerevisiae
aacagggcctgtatcgcgaggctgt

SEQ ID NO: 15551 - DNA, 25 bp, S. cerevisiae
aacttggcacttttggaggatcatc

SEQ ID NO: 15552 - DNA, 25 bp, S. cerevisiae
aacttgtggctttggtagcggcatc

SEQ ID NO: 15553 - DNA, 25 bp, S. cerevisiae
aactctgcgccatttggtctaggtg

SEQ ID NO: 15554 - DNA, 25 bp, S. cerevisiae
aacatgctcccaattgcgacggtag

SEQ ID NO: 15555 - DNA, 25 bp, S. cerevisiae
aacattcttgcaattcggtggtggc

SEQ ID NO: 15556 - DNA, 25 bp, S. cerevisiae
aacatgtgcaaagtacgcctgcggg

SEQ ID NO: 15557 - DNA, 25 bp, S. cerevisiae
aacatgtgcatgaaccaggactctt

SEQ ID NO: 15558 - DNA, 25 bp, S. cerevisiae
aacattcattgatcctactgctgct

SEQ ID NO: 15559 - DNA, 25 bp, S. cerevisiae
aacaggcacgagtcctactggaagt

SEQ ID NO: 15560 - DNA, 25 bp, S. cerevisiae
aacatcgagcctacttcattgacgt

SEQ ID NO: 15561 - DNA, 25 bp, S. cerevisiae
aacatcgtactcgttgctttccatt

SEQ ID NO: 15562 - DNA, 25 bp, S. cerevisiae
aacatgctttcgttttcgttttcag

SEQ ID NO: 15563 - DNA, 25 bp, S. cerevisiae
aacttgctgcttgtgatttgaacga

SEQ ID NO: 15564 - DNA, 25 bp, S. cerevisiae
aacctatgattcttgtcggaccggg

SEQ ID NO: 15565 - DNA, 25 bp, S. cerevisiae
aacatcatttggaaagcggcctggt

SEQ ID NO: 15566 - DNA, 25 bp, S. cerevisiae
aacattggccgcgttggttgtcgta

SEQ ID NO: 15567 - DNA, 25 bp, S. cerevisiae
aacattggcgctgctttgatcggtg

SEQ ID NO: 15568 - DNA, 25 bp, S. cerevisiae
aactattgccgggttgtgcgtaatg

SEQ ID NO: 15569 - DNA, 25 bp, S. cerevisiae
aacatttgtgacattttctccgcgg

SEQ ID NO: 15570 - DNA, 25 bp, S. cerevisiae
aacattgttagcatacttccggaag

SEQ ID NO: 15571 - DNA, 25 bp, S. cerevisiae
aactatgtagagatgctttcacgca

SEQ ID NO: 15572 - DNA, 25 bp, S. cerevisiae
aactcagatgacacgattcttcgga

SEQ ID NO: 15573 - DNA, 25 bp, S. cerevisiae
aactggatcagctgccattttaggc

SEQ ID NO: 15574 - DNA, 25 bp, S. cerevisiae
aactggaagcttcggaggaaccaca

SEQ ID NO: 15575 - DNA, 25 bp, S. cerevisiae
aactggagagtggtggccgtaaact

SEQ ID NO: 15576 - DNA, 25 bp, S. cerevisiae
aacatcggactatccatgctggcaa

SEQ ID NO: 15577 - DNA, 25 bp, S. cerevisiae
aacatgggattttgccgctgtgcac

SEQ ID NO: 15578 - DNA, 25 bp, S. cerevisiae
aacatgtggtttagcgtttgccgaa

SEQ ID NO: 15579 - DNA, 25 bp, S. cerevisiae
aactagccgggaatacatgtcgcag

SEQ ID NO: 15580 - DNA, 25 bp, S. cerevisiae
aactagtcttgaaaccattacacgg

SEQ ID NO: 15581 - DNA, 25 bp, S. cerevisiae
aactacgccgttggactgtctctgt

SEQ ID NO: 15582 - DNA, 25 bp, S. cerevisiae
aacatacctccttccaagaagctgt

SEQ ID NO: 15583 - DNA, 25 bp, S. cerevisiae
aacattctgcgcctagccaaataag

SEQ ID NO: 15584 - DNA, 25 bp, S. cerevisiae
aactattcagctctcgtcacgaaag

SEQ ID NO: 15585 - DNA, 25 bp, S. cerevisiae
aacttatgcattctcgtcgtcatta

SEQ ID NO: 15586 - DNA, 25 bp, S. cerevisiae
aacttcagattggtctacgatgtca

SEQ ID NO: 15587 - DNA, 25 bp, S. cerevisiae
aactttgattggtcctggtgctaaa

SEQ ID NO: 15588 - DNA, 25 bp, S. cerevisiae
aactcgcttaaattccatgccaacg

SEQ ID NO: 15589 - DNA, 25 bp, S. cerevisiae
aacgcgctaagatacgaccaacttt

SEQ ID NO: 15590 - DNA, 25 bp, S. cerevisiae
aactttagaatcgacgccgtactct

SEQ ID NO: 15591 - DNA, 25 bp, S. cerevisiae
aacttgatggaagacgccgccactg

SEQ ID NO: 15592 - DNA, 25 bp, S. cerevisiae
aacttgagacaacagcagccgcagc

SEQ ID NO: 15593 - DNA, 25 bp, S. cerevisiae
aacattaacttcgtggcggcagcaa

SEQ ID NO: 15594 - DNA, 25 bp, S. cerevisiae
aacttgggtcaatttttgcaggcaa

SEQ ID NO: 15595 - DNA, 25 bp, S. cerevisiae
aacattgggtcctcagggcatgaca

SEQ ID NO: 15596 - DNA, 25 bp, S. cerevisiae
aacatgcttctgagctttcgagtaa

SEQ ID NO: 15597 - DNA, 25 bp, S. cerevisiae
aacatctctcgttctgtatcatcga

SEQ ID NO: 15598 - DNA, 25 bp, S. cerevisiae
aactccatgaggtagatctggtttt

SEQ ID NO: 15599 - DNA, 25 bp, S. cerevisiae
aactcgtggcgtgcgtggtctgtat

SEQ ID NO: 15600 - DNA, 25 bp, S. cerevisiae
aacttggacctcagatgccatctta

SEQ ID NO: 15601 - DNA, 25 bp, S. cerevisiae
aacgtagaccatctgattcactcca

SEQ ID NO: 15602 - DNA, 25 bp, S. cerevisiae
aacatttgccacctttacattcgaa

SEQ ID NO: 15603 - DNA, 25 bp, S. cerevisiae
aacttctgcgctttgtataacttaa

SEQ ID NO: 15604 - DNA, 25 bp, S. cerevisiae
aactcccactcccaataatcgatga

SEQ ID NO: 15605 - DNA, 25 bp, S. cerevisiae
aacattcagagcttcttgtccatcg

SEQ ID NO: 15606 - DNA, 25 bp, S. cerevisiae
aacattagagatgtctgtcgacgaa

SEQ ID NO: 15607 - DNA, 25 bp, S. cerevisiae
aacattgaccattcatcgccgatca

SEQ ID NO: 15608 - DNA, 25 bp, S. cerevisiae
aacattgcatccattgaggcgattc

SEQ ID NO: 15609 - DNA, 25 bp, S. cerevisiae
aaccgtcttttgagcagttcaggga

SEQ ID NO: 15610 - DNA, 25 bp, S. cerevisiae
aactcgtttttcacatgacgccgat

SEQ ID NO: 15611 - DNA, 25 bp, S. cerevisiae
aactttcttttcacccagcagtagt

SEQ ID NO: 15612 - DNA, 25 bp, S. cerevisiae
aacttttaacttacgccacattgag

SEQ ID NO: 15613 - DNA, 25 bp, S. cerevisiae
aactttttctcatctagtgttagca

SEQ ID NO: 15614 - DNA, 25 bp, S. cerevisiae
aactttcatattttccagtgttcga

SEQ ID NO: 15615 - DNA, 25 bp, S. cerevisiae
aacgtttttattgacacacccattg

SEQ ID NO: 15616 - DNA, 25 bp, S. cerevisiae
aactaactgatctcgatggcgtacc

SEQ ID NO: 15617 - DNA, 25 bp, S. cerevisiae
aagctaccatagtgccaagttttga

SEQ ID NO: 15618 - DNA, 25 bp, S. cerevisiae
aactacgacggtggcaactaaagca

SEQ ID NO: 15619 - DNA, 25 bp, S. cerevisiae
aactggtcacggtcatgtcaactat

SEQ ID NO: 15620 - DNA, 25 bp, S. cerevisiae
aactcgaagagttccagaatgaaat

SEQ ID NO: 15621 - DNA, 25 bp, S. cerevisiae
aactgccaacaaggctgaccaattg

SEQ ID NO: 15622 - DNA, 25 bp, S. cerevisiae
aacttggtagaacttccctatacag

SEQ ID NO: 15623 - DNA, 25 bp, S. cerevisiae
aactatgttggatctgacgacttac

SEQ ID NO: 15624 - DNA, 25 bp, S. cerevisiae
aacattttggaacgccaaccctcag

SEQ ID NO: 15625 - DNA, 25 bp, S. cerevisiae
aacatttctggttcggcacaggctt

SEQ ID NO: 15626 - DNA, 25 bp, S. cerevisiae
aactctggcccaaactaatgacttt

SEQ ID NO: 15627 - DNA, 25 bp, S. cerevisiae
aactatacccgaaatgacagacttg

SEQ ID NO: 15628 - DNA, 25 bp, S. cerevisiae
aacttacacttttttccattgcatg

SEQ ID NO: 15629 - DNA, 25 bp, S. cerevisiae
aacttttgcatgttttccagaactc

SEQ ID NO: 15630 - DNA, 25 bp, S. cerevisiae
aactttcagattagattccggccat

SEQ ID NO: 15631 - DNA, 25 bp, S. cerevisiae
aacttcatgtttgattccgaccttg

SEQ ID NO: 15632 - DNA, 25 bp, S. cerevisiae
aactttgttcttcatattctcctgc

SEQ ID NO: 15633 - DNA, 25 bp, S. cerevisiae
aactttttcctttgagtctgctcca

SEQ ID NO: 15634 - DNA, 25 bp, S. cerevisiae
aacattgtctccttatttgccgaac

SEQ ID NO: 15635 - DNA, 25 bp, S. cerevisiae
aacttgttgaaattctccagtgcca

SEQ ID NO: 15636 - DNA, 25 bp, S. cerevisiae
aactcttagacgtatctctcctgga

SEQ ID NO: 15637 - DNA, 25 bp, S. cerevisiae
aactcacctaattcgcatgacatgg

SEQ ID NO: 15638 - DNA, 25 bp, S. cerevisiae
aactaccagatatcgaaagcgctat

SEQ ID NO: 15639 - DNA, 25 bp, S. cerevisiae
aacgtcgccagtataacttctccat

SEQ ID NO: 15640 - DNA, 25 bp, S. cerevisiae
aaccccacctatgaagctctttgtt

SEQ ID NO: 15641 - DNA, 25 bp, S. cerevisiae
aaccctaccattgttggcggtctct

SEQ ID NO: 15642 - DNA, 25 bp, S. cerevisiae
aactcctgggcaatcgtgctgtcta

SEQ ID NO: 15643 - DNA, 25 bp, S. cerevisiae
aactctcgcgcctattgttgatttt

SEQ ID NO: 15644 - DNA, 25 bp, S. cerevisiae
aactcatttggaacccagcttcaac

SEQ ID NO: 15645 - DNA, 25 bp, S. cerevisiae
aactctcttgcgcactgggattcaa

SEQ ID NO: 15646 - DNA, 25 bp, S. cerevisiae
aacttggccacatttgcacgcaata

SEQ ID NO: 15647 - DNA, 25 bp, S. cerevisiae
aacttgggcatcttctaggtatcac

SEQ ID NO: 15648 - DNA, 25 bp, S. cerevisiae
aactctgctagaaagctacgtgtcc

SEQ ID NO: 15649 - DNA, 25 bp, S. cerevisiae
aactgtaacccattcattgcatcct

SEQ ID NO: 15650 - DNA, 25 bp, S. cerevisiae
aacttcttgactacttgttccacct

SEQ ID NO: 15651 - DNA, 25 bp, S. cerevisiae
aacttgctgagtccatgcttttgaa

SEQ ID NO: 15652 - DNA, 25 bp, S. cerevisiae
aacattgctagaccctttgagctca

SEQ ID NO: 15653 - DNA, 25 bp, S. cerevisiae
aagcccctgtggtctgttgggacgt

SEQ ID NO: 15654 - DNA, 25 bp, S. cerevisiae
aactcgttagcgtcgtaaaggcaca

SEQ ID NO: 15655 - DNA, 25 bp, S. cerevisiae
aataggctgtacaggctccgacgga

SEQ ID NO: 15656 - DNA, 25 bp, S. cerevisiae
aacgaggtacatgttccgatgggat

SEQ ID NO: 15657 - DNA, 25 bp, S. cerevisiae
aactcaggactgcaacgacgaagat

SEQ ID NO: 15658 - DNA, 25 bp, S. cerevisiae
aactttgcaggccatgatgcgtcgc

SEQ ID NO: 15659 - DNA, 25 bp, S. cerevisiae
aactgttgcagcgacaatggctcct

SEQ ID NO: 15660 - DNA, 25 bp, S. cerevisiae
aacattgtgcgtaatagcgctcttt

SEQ ID NO: 15661 - DNA, 25 bp, S. cerevisiae
aacttgtgggctggtttcaatcaaa

SEQ ID NO: 15662 - DNA, 25 bp, S. cerevisiae
aacgtaggtctcgttggccacagaa

SEQ ID NO: 15663 - DNA, 25 bp, S. cerevisiae
aacgattggattgtcggtcagaaat

SEQ ID NO: 15664 - DNA, 25 bp, S. cerevisiae
aacttcttcagttatccgacgttga

SEQ ID NO: 15665 - DNA, 25 bp, S. cerevisiae
aactacttctgttgatccaaccact

SEQ ID NO: 15666 - DNA, 25 bp, S. cerevisiae
aacttcttctgctatatcggttcct

SEQ ID NO: 15667 - DNA, 25 bp, S. cerevisiae
aacttaagtggcctgttgctcgata

SEQ ID NO: 15668 - DNA, 25 bp, S. cerevisiae
aactttatgtggttgctactcgctc

SEQ ID NO: 15669 - DNA, 25 bp, S. cerevisiae
aacttgattgagtctggctaccagc

SEQ ID NO: 15670 - DNA, 25 bp, S. cerevisiae
aacttttctaggtttgactcttcag

SEQ ID NO: 15671 - DNA, 25 bp, S. cerevisiae
aacttcttcagcattgtttccttgg

SEQ ID NO: 15672 - DNA, 25 bp, S. cerevisiae
aactatcccatcttagtgcattcca

SEQ ID NO: 15673 - DNA, 25 bp, S. cerevisiae
aactacctgacattcatcctatcaa

SEQ ID NO: 15674 - DNA, 25 bp, S. cerevisiae
aactacctaaaactgcacaaatttg

SEQ ID NO: 15675 - DNA, 25 bp, S. cerevisiae
aactacgtcacgaagccattatact

SEQ ID NO: 15676 - DNA, 25 bp, S. cerevisiae
aactaggctcgcagtatttcatact

SEQ ID NO: 15677 - DNA, 25 bp, S. cerevisiae
aacttcactgttttcctaggtcata

SEQ ID NO: 15678 - DNA, 25 bp, S. cerevisiae
aactatcggctttgactacggttgt

SEQ ID NO: 15679 - DNA, 25 bp, S. cerevisiae
aactcacgtagttgctattgccgaa

SEQ ID NO: 15680 - DNA, 25 bp, S. cerevisiae
aactagcgtagtttgttgcctcgat

SEQ ID NO: 15681 - DNA, 25 bp, S. cerevisiae
aacttgcagagctatacattgtgac

SEQ ID NO: 15682 - DNA, 25 bp, S. cerevisiae
aacttgcagcactatactcatcgga

SEQ ID NO: 15683 - DNA, 25 bp, S. cerevisiae
aacgcagatggcaatgactccggag

SEQ ID NO: 15684 - DNA, 25 bp, S. cerevisiae
aacggttgggatgtctttgatttca

SEQ ID NO: 15685 - DNA, 25 bp, S. cerevisiae
aacgggatcccgctcattgtaggac

SEQ ID NO: 15686 - DNA, 25 bp, S. cerevisiae
aactgcttgatgtacggtttccata

SEQ ID NO: 15687 - DNA, 25 bp, S. cerevisiae
aacttcagaggtagaggcggcgcca

SEQ ID NO: 15688 - DNA, 25 bp, S. cerevisiae
aactgtcaaagtatggaggcaccaa

SEQ ID NO: 15689 - DNA, 25 bp, S. cerevisiae
aacctgaaagtgaaccggccaagag

SEQ ID NO: 15690 - DNA, 25 bp, S. cerevisiae
aagcggaaggaatcccctcaatgga

SEQ ID NO: 15691 - DNA, 25 bp, S. cerevisiae
aacttctgaagagagatggcctgct

SEQ ID NO: 15692 - DNA, 25 bp, S. cerevisiae
aactatctcaggtggattctcagtc

SEQ ID NO: 15693 - DNA, 25 bp, S. cerevisiae
aactgcacacgtttattgggttgta

SEQ ID NO: 15694 - DNA, 25 bp, S. cerevisiae
aactgccagcagatacaattacttt

SEQ ID NO: 15695 - DNA, 25 bp, S. cerevisiae
aactgccactggaacggtacctgta

SEQ ID NO: 15696 - DNA, 25 bp, S. cerevisiae
aactggagctaatagggaccgtcaa

SEQ ID NO: 15697 - DNA, 25 bp, S. cerevisiae
aactttgttgtctattgctatccat

SEQ ID NO: 15698 - DNA, 25 bp, S. cerevisiae
aactctcatctttctgactacttgg

SEQ ID NO: 15699 - DNA, 25 bp, S. cerevisiae
aactatgcttgggtctcttatttta

SEQ ID NO: 15700 - DNA, 25 bp, S. cerevisiae
aactattctgtggttcatgctgaga

SEQ ID NO: 15701 - DNA, 25 bp, S. cerevisiae
aactttgctgtagtctccatgcatg

SEQ ID NO: 15702 - DNA, 25 bp, S. cerevisiae
aactatggcagatgctgtccgtgaa

SEQ ID NO: 15703 - DNA, 25 bp, S. cerevisiae
aactatgtggatcggtgcatttgcg

SEQ ID NO: 15704 - DNA, 25 bp, S. cerevisiae
aactttctcgctgtcgtctatgggt

SEQ ID NO: 15705 - DNA, 25 bp, S. cerevisiae
aacttactagtcacgccagatgggc

SEQ ID NO: 15706 - DNA, 25 bp, S. cerevisiae
gacttaactgcttgggctcagacgc

SEQ ID NO: 15707 - DNA, 25 bp, S. cerevisiae
tatcttcaaggcgaggttgcaaccc

SEQ ID NO: 15708 - DNA, 25 bp, S. cerevisiae
caacgttcacaattacggtttcctg

SEQ ID NO: 15709 - DNA, 25 bp, S. cerevisiae
caacgtaacaagagcggcctttcct

SEQ ID NO: 15710 - DNA, 25 bp, S. cerevisiae
aactgttgaaggtgacgcctggccg

SEQ ID NO: 15711 - DNA, 25 bp, S. cerevisiae
aactgttgaagttggcatcacgggt

SEQ ID NO: 15712 - DNA, 25 bp, S. cerevisiae
aactttaagcttacaatggcctgaa

SEQ ID NO: 15713 - DNA, 25 bp, S. cerevisiae
aacgagaacaactcaggcgctctgc

SEQ ID NO: 15714 - DNA, 25 bp, S. cerevisiae
aactgactatgaacttacctccatc

SEQ ID NO: 15715 - DNA, 25 bp, S. cerevisiae
aactaccatttttgtactcatccca

SEQ ID NO: 15716 - DNA, 25 bp, S. cerevisiae
aactgtttacttgtactgatccaaa

SEQ ID NO: 15717 - DNA, 25 bp, S. cerevisiae
aacgtctgatttggcctcccttgat

SEQ ID NO: 15718 - DNA, 25 bp, S. cerevisiae
aactgattgccaagtactcctctta

SEQ ID NO: 15719 - DNA, 25 bp, S. cerevisiae
aactgataccggagctgtcttttct

SEQ ID NO: 15720 - DNA, 25 bp, S. cerevisiae
aacttatactggatgttctttctaa

SEQ ID NO: 15721 - DNA, 25 bp, S. cerevisiae
aacttattctatatgtcctggagac

SEQ ID NO: 15722 - DNA, 25 bp, S. cerevisiae
aactttttgctgatgtcaccactgt

SEQ ID NO: 15723 - DNA, 25 bp, S. cerevisiae
aactttaacattgcttccttccctg

SEQ ID NO: 15724 - DNA, 25 bp, S. cerevisiae
aacttttaatgtgccttcctccgag

SEQ ID NO: 15725 - DNA, 25 bp, S. cerevisiae
aactgtttaggtgtcttgcccggcg

SEQ ID NO: 15726 - DNA, 25 bp, S. cerevisiae
aactggtgtgccgaacctgaacatg

SEQ ID NO: 15727 - DNA, 25 bp, S. cerevisiae
aactgggatacgagtctgaacgtga

SEQ ID NO: 15728 - DNA, 25 bp, S. cerevisiae
aacggtgaccgtgaatctacaaaga

SEQ ID NO: 15729 - DNA, 25 bp, S. cerevisiae
aactcggccaagtccaatagatcaa

SEQ ID NO: 15730 - DNA, 25 bp, S. cerevisiae
aactcaagatcctccaagaagccag

SEQ ID NO: 15731 - DNA, 25 bp, S. cerevisiae
aagcagatgggccatacgggaccat

SEQ ID NO: 15732 - DNA, 25 bp, S. cerevisiae
aacgatgccgcatttgggtacttat

SEQ ID NO: 15733 - DNA, 25 bp, S. cerevisiae
aactgatcaatcttttgggactttg

SEQ ID NO: 15734 - DNA, 25 bp, S. cerevisiae
aactctcgcagttgtatgggccatt

SEQ ID NO: 15735 - DNA, 25 bp, S. cerevisiae
aactacgatgtatttggcttaccaa

SEQ ID NO: 15736 - DNA, 25 bp, S. cerevisiae
aactttcggtttagattctcaggat

SEQ ID NO: 15737 - DNA, 25 bp, S. cerevisiae
aacctatttggcgaagaccttcgtg

SEQ ID NO: 15738 - DNA, 25 bp, S. cerevisiae
aactctttaaccaaacatcagggct

SEQ ID NO: 15739 - DNA, 25 bp, S. cerevisiae
aactatccttcctgatctatgcgag

SEQ ID NO: 15740 - DNA, 25 bp, S. cerevisiae
aactatgctgtccatccggatgagt

SEQ ID NO: 15741 - DNA, 25 bp, S. cerevisiae
aactttagcgcaccgaatgtttcgt

SEQ ID NO: 15742 - DNA, 25 bp, S. cerevisiae
aactctttccatgccacatgtttgg

SEQ ID NO: 15743 - DNA, 25 bp, S. cerevisiae
aactcatttttggtctattctttgt

SEQ ID NO: 15744 - DNA, 25 bp, S. cerevisiae
aactctattttcctctttgtacttg

SEQ ID NO: 15745 - DNA, 25 bp, S. cerevisiae
aactcagtgggctcagtatcagaag

SEQ ID NO: 15746 - DNA, 25 bp, S. cerevisiae
aactaacatcacacttgctggaaga

SEQ ID NO: 15747 - DNA, 25 bp, S. cerevisiae
aactccaatccttgctttctatgga

SEQ ID NO: 15748 - DNA, 25 bp, S. cerevisiae
aactcttctgaagctctttaccaaa

SEQ ID NO: 15749 - DNA, 25 bp, S. cerevisiae
aactcttgcgcaatatcgatttgac

SEQ ID NO: 15750 - DNA, 25 bp, S. cerevisiae
aactgcgccattgatccaacgaaag

SEQ ID NO: 15751 - DNA, 25 bp, S. cerevisiae
aactagcgctatggccgcaactaaa

SEQ ID NO: 15752 - DNA, 25 bp, S. cerevisiae
aactcacttctttagtcggttctga

SEQ ID NO: 15753 - DNA, 25 bp, S. cerevisiae
aaccaatttttgcacgcggatcttc

SEQ ID NO: 15754 - DNA, 25 bp, S. cerevisiae
aactcgattgttctacctaatggtt

SEQ ID NO: 15755 - DNA, 25 bp, S. cerevisiae
aactctactgttaccaccaaatcgt

SEQ ID NO: 15756 - DNA, 25 bp, S. cerevisiae
aactatagctatatcgacgaaacct

SEQ ID NO: 15757 - DNA, 25 bp, S. cerevisiae
aactgtccttgcactatcgagaagc

SEQ ID NO: 15758 - DNA, 25 bp, S. cerevisiae
aactgtatctttcctaccagcaagc

SEQ ID NO: 15759 - DNA, 25 bp, S. cerevisiae
aacgaatcaatatctactgccccgg

SEQ ID NO: 15760 - DNA, 25 bp, S. cerevisiae
aaggaacaccagcaacgactacgac

SEQ ID NO: 15761 - DNA, 25 bp, S. cerevisiae
aagcctaccaagagactggtccaaa

SEQ ID NO: 15762 - DNA, 25 bp, S. cerevisiae
aagactcgaagataaacagttcaaa

SEQ ID NO: 15763 - DNA, 25 bp, S. cerevisiae
cgaaggttgaaacccgagcttcctg

SEQ ID NO: 15764 - DNA, 25 bp, S. cerevisiae
aacgagtttactaccgacattgcct

SEQ ID NO: 15765 - DNA, 25 bp, S. cerevisiae
aacgacagtctacttcgggcgaggc

SEQ ID NO: 15766 - DNA, 25 bp, S. cerevisiae
aactggcttgtcttggcacgtatac

SEQ ID NO: 15767 - DNA, 25 bp, S. cerevisiae
aactcttcacatacatacctgcggt

SEQ ID NO: 15768 - DNA, 25 bp, S. cerevisiae
aactagcctcgatttcattgtgtcc

SEQ ID NO: 15769 - DNA, 25 bp, S. cerevisiae
aactccagcctatgagcattgtcca

SEQ ID NO: 15770 - DNA, 25 bp, S. cerevisiae
aactccgcgtatcagaatgcctcga

SEQ ID NO: 15771 - DNA, 25 bp, S. cerevisiae
aactccgctagaaagttgcgtgtcc

SEQ ID NO: 15772 - DNA, 25 bp, S. cerevisiae
aactatctttggaccaattccgcct

SEQ ID NO: 15773 - DNA, 25 bp, S. cerevisiae
aactcactctatgtacgtgttgcaa

SEQ ID NO: 15774 - DNA, 25 bp, S. cerevisiae
aactcctctcgattgatcgttggta

SEQ ID NO: 15775 - DNA, 25 bp, S. cerevisiae
aactcaatctcagcagtttggcgct

SEQ ID NO: 15776 - DNA, 25 bp, S. cerevisiae
aactgcagcacctgagtttcgcgta

SEQ ID NO: 15777 - DNA, 25 bp, S. cerevisiae
aactgctgccgaagagtccgacgaa

SEQ ID NO: 15778 - DNA, 25 bp, S. cerevisiae
aacggaagtgtatcgcaacgtgcat

SEQ ID NO: 15779 - DNA, 25 bp, S. cerevisiae
aactggccagttgatcgaagatgtc

SEQ ID NO: 15780 - DNA, 25 bp, S. cerevisiae
aacgggctacggacatctcagacag

SEQ ID NO: 15781 - DNA, 25 bp, S. cerevisiae
aacggaattctggacggagctttgt

SEQ ID NO: 15782 - DNA, 25 bp, S. cerevisiae
aactgccactcattataatcccaaa

SEQ ID NO: 15783 - DNA, 25 bp, S. cerevisiae
aactgcgacgcattgaacacctact

SEQ ID NO: 15784 - DNA, 25 bp, S. cerevisiae
aactgctaccacaaagtcctatttt

SEQ ID NO: 15785 - DNA, 25 bp, S. cerevisiae
aactgtggccaataatgttgtcgaa

SEQ ID NO: 15786 - DNA, 25 bp, S. cerevisiae
aactgctggacatgctagagcctct

SEQ ID NO: 15787 - DNA, 25 bp, S. cerevisiae
aactgatgtagctgttcctgtgtcg

SEQ ID NO: 15788 - DNA, 25 bp, S. cerevisiae
aactggctacaattgtccaggatga

SEQ ID NO: 15789 - DNA, 25 bp, S. cerevisiae
aactgggtgggctttcacaatgctg

SEQ ID NO: 15790 - DNA, 25 bp, S. cerevisiae
aactgaggtcgttgttcatccttgc

SEQ ID NO: 15791 - DNA, 25 bp, S. cerevisiae
aactccagtattgggcaatccggtt

SEQ ID NO: 15792 - DNA, 25 bp, S. cerevisiae
aactgtgctgatgataggtatcccg

SEQ ID NO: 15793 - DNA, 25 bp, S. cerevisiae
aacggtcatggccatggtccaattt

SEQ ID NO: 15794 - DNA, 25 bp, S. cerevisiae
aactgaatatgccacatgccaccaa

SEQ ID NO: 15795 - DNA, 25 bp, S. cerevisiae
aactactgcatattctgcgtacaga

SEQ ID NO: 15796 - DNA, 25 bp, S. cerevisiae
aactcagtcaattccggatcatcac

SEQ ID NO: 15797 - DNA, 25 bp, S. cerevisiae
aactctgtcgattggatctactcct

SEQ ID NO: 15798 - DNA, 25 bp, S. cerevisiae
aactcatttccaaatctggctgttt

SEQ ID NO: 15799 - DNA, 25 bp, S. cerevisiae
aactgatattcctccttgtgactta

SEQ ID NO: 15800 - DNA, 25 bp, S. cerevisiae
aactggcaggtcattttgcgaccaa

SEQ ID NO: 15801 - DNA, 25 bp, S. cerevisiae
aactcgcatgggattttgctatcac

SEQ ID NO: 15802 - DNA, 25 bp, S. cerevisiae
aattcgtcggtacaaggcatccctt

SEQ ID NO: 15803 - DNA, 25 bp, S. cerevisiae
gaatacccgggatcagaactccttt

SEQ ID NO: 15804 - DNA, 25 bp, S. cerevisiae
aactactcttgtgtccggtggtgaa

SEQ ID NO: 15805 - DNA, 25 bp, S. cerevisiae
aactatgtttggtttcacgcggata

SEQ ID NO: 15806 - DNA, 25 bp, S. cerevisiae
aactcgtttgcgtaagcgtatggtc

SEQ ID NO: 15807 - DNA, 25 bp, S. cerevisiae
aactagttctcgcacagattctgag

SEQ ID NO: 15808 - DNA, 25 bp, S. cerevisiae
aacggcattccgctagttatagagt

SEQ ID NO: 15809 - DNA, 25 bp, S. cerevisiae
aactggaccccgtactatatgagaa

SEQ ID NO: 15810 - DNA, 25 bp, S. cerevisiae
aagctttacggttggaattgcagaa

SEQ ID NO: 15811 - DNA, 25 bp, S. cerevisiae
aactctattgggaagtacctggtca

SEQ ID NO: 15812 - DNA, 25 bp, S. cerevisiae
aactgaagcaggttttttcgccata

SEQ ID NO: 15813 - DNA, 25 bp, S. cerevisiae
aactactgtggtttgctctgttgtc

SEQ ID NO: 15814 - DNA, 25 bp, S. cerevisiae
aactactgattttgatggctattgg

SEQ ID NO: 15815 - DNA, 25 bp, S. cerevisiae
aacgatggatccctaggctcattgg

SEQ ID NO: 15816 - DNA, 25 bp, S. cerevisiae
aacgcatcacatgccattcgtttgg

SEQ ID NO: 15817 - DNA, 25 bp, S. cerevisiae
aactgctcaatgactctcctttgga

SEQ ID NO: 15818 - DNA, 25 bp, S. cerevisiae
aactgctagtactatctctgggtta

SEQ ID NO: 15819 - DNA, 25 bp, S. cerevisiae
aactcgatgcttcatcagcgggttt

SEQ ID NO: 15820 - DNA, 25 bp, S. cerevisiae
aactctgtgaatccactggtgggtt

SEQ ID NO: 15821 - DNA, 25 bp, S. cerevisiae
aactcatgtggtgcactggtgttgt

SEQ ID NO: 15822 - DNA, 25 bp, S. cerevisiae
aactaatggattggcgcgtgtacta

SEQ ID NO: 15823 - DNA, 25 bp, S. cerevisiae
aactactgtgctttccattgaccaa

SEQ ID NO: 15824 - DNA, 25 bp, S. cerevisiae
aactctactcataatcctagtgaca

SEQ ID NO: 15825 - DNA, 25 bp, S. cerevisiae
aactgcgacatcttctcctgggaaa

SEQ ID NO: 15826 - DNA, 25 bp, S. cerevisiae
aactgtgcagtttcatctttaccta

SEQ ID NO: 15827 - DNA, 25 bp, S. cerevisiae
aactcggatagactttctccaatgg

SEQ ID NO: 15828 - DNA, 25 bp, S. cerevisiae
aactcaagtggactggcatcctcaa

SEQ ID NO: 15829 - DNA, 25 bp, S. cerevisiae
aactgcagcactgggtgtatcacta

SEQ ID NO: 15830 - DNA, 25 bp, S. cerevisiae
aacggccgcttatcacttactgtcg

SEQ ID NO: 15831 - DNA, 25 bp, S. cerevisiae
aacgactaccaatactgtagctgct

SEQ ID NO: 15832 - DNA, 25 bp, S. cerevisiae
aactggctgaccacgaagacgcgtt

SEQ ID NO: 15833 - DNA, 25 bp, S. cerevisiae
caatcggtgactatttaaacggcca

SEQ ID NO: 15834 - DNA, 25 bp, S. cerevisiae
aacggtatcgagcttcacaagggca

SEQ ID NO: 15835 - DNA, 25 bp, S. cerevisiae
aacgttattaagctcccaggtgcag

SEQ ID NO: 15836 - DNA, 25 bp, S. cerevisiae
aacgttgttgaatctaccgggctat

SEQ ID NO: 15837 - DNA, 25 bp, S. cerevisiae
aagcgtcgttaatattagcggtgca

SEQ ID NO: 15838 - DNA, 25 bp, S. cerevisiae
aacgtctatttgaaattattggtca

SEQ ID NO: 15839 - DNA, 25 bp, S. cerevisiae
aactgtgtagggatattttcagaca

SEQ ID NO: 15840 - DNA, 25 bp, S. cerevisiae
aactctgctgatgggttcgttataa

SEQ ID NO: 15841 - DNA, 25 bp, S. cerevisiae
aactgacctgcatcaagatctcgat

SEQ ID NO: 15842 - DNA, 25 bp, S. cerevisiae
aactgaggctgctaagaagtctgaa

SEQ ID NO: 15843 - DNA, 25 bp, S. cerevisiae
aactgggcagtttcaagcgcagcgc

SEQ ID NO: 15844 - DNA, 25 bp, S. cerevisiae
aactctgaagtatcacccttgcgaa

SEQ ID NO: 15845 - DNA, 25 bp, S. cerevisiae
aactctcaagtctttggtgttgcca

SEQ ID NO: 15846 - DNA, 25 bp, S. cerevisiae
aactgcatccgttcaatggttcgaa

SEQ ID NO: 15847 - DNA, 25 bp, S. cerevisiae
aactgctcctgtcgaagaaggcgaa

SEQ ID NO: 15848 - DNA, 25 bp, S. cerevisiae
aactgctctcagtgtgtgttggaaa

SEQ ID NO: 15849 - DNA, 25 bp, S. cerevisiae
aactccatatttattggtcttgata

SEQ ID NO: 15850 - DNA, 25 bp, S. cerevisiae
aactcccgttatttgtgaatccgct

SEQ ID NO: 15851 - DNA, 25 bp, S. cerevisiae
aactgttcggtatgtgtgagtccct

SEQ ID NO: 15852 - DNA, 25 bp, S. cerevisiae
aacgatatgcccagttacttactag

SEQ ID NO: 15853 - DNA, 25 bp, S. cerevisiae
aacgatacctcttttttgaatatgg

SEQ ID NO: 15854 - DNA, 25 bp, S. cerevisiae
aacgatccacttcttatgtcaattt

SEQ ID NO: 15855 - DNA, 25 bp, S. cerevisiae
aactgacaactctcttgacatcact

SEQ ID NO: 15856 - DNA, 25 bp, S. cerevisiae
aactcctcttcggttgtagatataa

SEQ ID NO: 15857 - DNA, 25 bp, S. cerevisiae
aactccacttggtattaacactaag

SEQ ID NO: 15858 - DNA, 25 bp, S. cerevisiae
aactccagcactccgtataaacaaa

SEQ ID NO: 15859 - DNA, 25 bp, S. cerevisiae
aactgccacctcatttagaaaacgt

SEQ ID NO: 15860 - DNA, 25 bp, S. cerevisiae
aacgtcaccaagttacagcccaacg

SEQ ID NO: 15861 - DNA, 25 bp, S. cerevisiae
aactgataatacgtctggcgccctt

SEQ ID NO: 15862 - DNA, 25 bp, S. cerevisiae
aactgtgaattcttcgggccaactt

SEQ ID NO: 15863 - DNA, 25 bp, S. cerevisiae
aactcgatatatttctgggcttact

SEQ ID NO: 15864 - DNA, 25 bp, S. cerevisiae
aactctattatgatcggctgggcag

SEQ ID NO: 15865 - DNA, 25 bp, S. cerevisiae
aacgtcattacggttcctggcaggg

SEQ ID NO: 15866 - DNA, 25 bp, S. cerevisiae
aacggcatctgatcgtatacctgca

SEQ ID NO: 15867 - DNA, 25 bp, S. cerevisiae
aactgtttcttatgcaagactgcca

SEQ ID NO: 15868 - DNA, 25 bp, S. cerevisiae
aacgatattccaccaaaacagctcc

SEQ ID NO: 15869 - DNA, 25 bp, S. cerevisiae
aatcgaactccggttggacacctgt

SEQ ID NO: 15870 - DNA, 25 bp, S. cerevisiae
aacgacatttcgtgggacgctcatg

SEQ ID NO: 15871 - DNA, 25 bp, S. cerevisiae
aacgacctggagttgcagcaatttc

SEQ ID NO: 15872 - DNA, 25 bp, S. cerevisiae
aacgagtcttggtgttgttccatat

SEQ ID NO: 15873 - DNA, 25 bp, S. cerevisiae
aacgattaaggatcttttgccattt

SEQ ID NO: 15874 - DNA, 25 bp, S. cerevisiae
aaccctagtgggtcgaatacgaatg

SEQ ID NO: 15875 - DNA, 25 bp, S. cerevisiae
aacccgatacggtcgtcagactaat

SEQ ID NO: 15876 - DNA, 25 bp, S. cerevisiae
aacggaatttggtcgtctactcatt

SEQ ID NO: 15877 - DNA, 25 bp, S. cerevisiae
aacggaatctttggagcttacagca

SEQ ID NO: 15878 - DNA, 25 bp, S. cerevisiae
aacggttcagttcctccattgaaag

SEQ ID NO: 15879 - DNA, 25 bp, S. cerevisiae
aactgtttggatcaactcatctaac

SEQ ID NO: 15880 - DNA, 25 bp, S. cerevisiae
aacgttcgagttgccacaacctgat

SEQ ID NO: 15881 - DNA, 25 bp, S. cerevisiae
aaccttgtgggactgtaactctatg

SEQ ID NO: 15882 - DNA, 25 bp, S. cerevisiae
aacgcttttgcgtaggaaggcaatg

SEQ ID NO: 15883 - DNA, 25 bp, S. cerevisiae
aactgcttcttggatagtaccacga

SEQ ID NO: 15884 - DNA, 25 bp, S. cerevisiae
aactgctttggccagaatatccatt

SEQ ID NO: 15885 - DNA, 25 bp, S. cerevisiae
aactctcctggcgaaatttattgtt

SEQ ID NO: 15886 - DNA, 25 bp, S. cerevisiae
aactgctacggtgagatgtctgatt

SEQ ID NO: 15887 - DNA, 25 bp, S. cerevisiae
aacgtcagcgatggtggatttgaac

SEQ ID NO: 15888 - DNA, 25 bp, S. cerevisiae
aacgtagatgttttgcagcgtactg

SEQ ID NO: 15889 - DNA, 25 bp, S. cerevisiae
aactgctttgcctgttattgaaacc

SEQ ID NO: 15890 - DNA, 25 bp, S. cerevisiae
aactctccctctctgaattgaaaac

SEQ ID NO: 15891 - DNA, 25 bp, S. cerevisiae
aactctttaagatcgctcactgtca

SEQ ID NO: 15892 - DNA, 25 bp, S. cerevisiae
aactcgggcaaagacttcacgtaca

SEQ ID NO: 15893 - DNA, 25 bp, S. cerevisiae
aagtcagggcaatgtacctacctcc

SEQ ID NO: 15894 - DNA, 25 bp, S. cerevisiae
aaccatgggactgtcacactatcct

SEQ ID NO: 15895 - DNA, 25 bp, S. cerevisiae
aacggtgtacaagtccaggattcca

SEQ ID NO: 15896 - DNA, 25 bp, S. cerevisiae
aagcaggtgtccaaattcaagtttt

SEQ ID NO: 15897 - DNA, 25 bp, S. cerevisiae
aacgaccccaaattcaagctctgaa

SEQ ID NO: 15898 - DNA, 25 bp, S. cerevisiae
aactccagttcaatccaaggccaga

SEQ ID NO: 15899 - DNA, 25 bp, S. cerevisiae
aacgctcatgttgcttcacaatctc

SEQ ID NO: 15900 - DNA, 25 bp, S. cerevisiae
aactgctgcagctgtctctcaaatt

SEQ ID NO: 15901 - DNA, 25 bp, S. cerevisiae
aactccggcagatttcgctaaacta

SEQ ID NO: 15902 - DNA, 25 bp, S. cerevisiae
aactcggcaggtttactaatcctca

SEQ ID NO: 15903 - DNA, 25 bp, S. cerevisiae
aactgtcgggtcaatggcatcgtga

SEQ ID NO: 15904 - DNA, 25 bp, S. cerevisiae
aactgccggctgaaagagcttgtgc

SEQ ID NO: 15905 - DNA, 25 bp, S. cerevisiae
aacctcgtgagctgaagcttgtcgc

SEQ ID NO: 15906 - DNA, 25 bp, S. cerevisiae
aactccgtgaggcataatctgtccc

SEQ ID NO: 15907 - DNA, 25 bp, S. cerevisiae
aactccaatttcctagatgcgtcac

SEQ ID NO: 15908 - DNA, 25 bp, S. cerevisiae
aactgagactctactgggcgaaaca

SEQ ID NO: 15909 - DNA, 25 bp, S. cerevisiae
aactgagagcccatgttgctgaaat

SEQ ID NO: 15910 - DNA, 25 bp, S. cerevisiae
aactgtgaacattttcgctgcgaat

SEQ ID NO: 15911 - DNA, 25 bp, S. cerevisiae
aactgatgaacttggtacttgatga

SEQ ID NO: 15912 - DNA, 25 bp, S. cerevisiae
aacgatgagttgtacgcgcagctga

SEQ ID NO: 15913 - DNA, 25 bp, S. cerevisiae
aactgttcatcctatatcaagcaag

SEQ ID NO: 15914 - DNA, 25 bp, S. cerevisiae
aactgccgcttctaatcaacaagtc

SEQ ID NO: 15915 - DNA, 25 bp, S. cerevisiae
aactccatcaactagtccaagcggt

SEQ ID NO: 15916 - DNA, 25 bp, S. cerevisiae
aactccgctgatgttcatatactgt

SEQ ID NO: 15917 - DNA, 25 bp, S. cerevisiae
aactcctggctggtcttatacgata

SEQ ID NO: 15918 - DNA, 25 bp, S. cerevisiae
aactcgctgccattttttatcaagg

SEQ ID NO: 15919 - DNA, 25 bp, S. cerevisiae
aacgcctacaacagattccgcattt

SEQ ID NO: 15920 - DNA, 25 bp, S. cerevisiae
aacgcacattaaggccattttggga

SEQ ID NO: 15921 - DNA, 25 bp, S. cerevisiae
aacgccccaattgtcgttggtagag

SEQ ID NO: 15922 - DNA, 25 bp, S. cerevisiae
aactgatgttcctgtcgtttatctg

SEQ ID NO: 15923 - DNA, 25 bp, S. cerevisiae
aactgacattccaaggctgtttccg

SEQ ID NO: 15924 - DNA, 25 bp, S. cerevisiae
aactgaagatccatgggcctatccg

SEQ ID NO: 15925 - DNA, 25 bp, S. cerevisiae
aactgtcattggtattcgtggtagc

SEQ ID NO: 15926 - DNA, 25 bp, S. cerevisiae
aactgttgggtctttggctgtacga

SEQ ID NO: 15927 - DNA, 25 bp, S. cerevisiae
aactgtctctgggtgaggctttcaa

SEQ ID NO: 15928 - DNA, 25 bp, S. cerevisiae
aacgctcttggcgaagtttctccgg

SEQ ID NO: 15929 - DNA, 25 bp, S. cerevisiae
aacgtttgcctaaatattcttcgag

SEQ ID NO: 15930 - DNA, 25 bp, S. cerevisiae
aacgttaccagcagtttctagcgat

SEQ ID NO: 15931 - DNA, 25 bp, S. cerevisiae
aagcgatgctactattgccggtaac

SEQ ID NO: 15932 - DNA, 25 bp, S. cerevisiae
aactgcgtttattgtcgagcacgat

SEQ ID NO: 15933 - DNA, 25 bp, S. cerevisiae
aactgcatcgttgtcatctgtgact

SEQ ID NO: 15934 - DNA, 25 bp, S. cerevisiae
aactgcatctgattccatatggaca

SEQ ID NO: 15935 - DNA, 25 bp, S. cerevisiae
aactgtggatgttctcatggatcat

SEQ ID NO: 15936 - DNA, 25 bp, S. cerevisiae
aactgtggtgattcgcgatgtattc

SEQ ID NO: 15937 - DNA, 25 bp, S. cerevisiae
aactgcagttacctgcgaatcctgc

SEQ ID NO: 15938 - DNA, 25 bp, S. cerevisiae
aactcctacctattcatttcatcaa

SEQ ID NO: 15939 - DNA, 25 bp, S. cerevisiae
aacgagtccggtgtctaccattgtg

SEQ ID NO: 15940 - DNA, 25 bp, S. cerevisiae
aactgtattagtaatatgcttgtaa

SEQ ID NO: 15941 - DNA, 25 bp, S. cerevisiae
aacgaaccagttgatctgctgtcag

SEQ ID NO: 15942 - DNA, 25 bp, S. cerevisiae
aacgacaccgaagacttgccagtag

SEQ ID NO: 15943 - DNA, 25 bp, S. cerevisiae
aacgatcgactgtttacgccaacaa

SEQ ID NO: 15944 - DNA, 25 bp, S. cerevisiae
aacggcgtcaaaatgccccaagaca

SEQ ID NO: 15945 - DNA, 25 bp, S. cerevisiae
aactgagctctgtgaatcttttact

SEQ ID NO: 15946 - DNA, 25 bp, S. cerevisiae
aactggttatggcatcttccaccat

SEQ ID NO: 15947 - DNA, 25 bp, S. cerevisiae
aacgtagagcatcgaacttccatcc

SEQ ID NO: 15948 - DNA, 25 bp, S. cerevisiae
aagcggcatgaatgagcacgatcaa

SEQ ID NO: 15949 - DNA, 25 bp, S. cerevisiae
aacgcatcgcaattagccagtgcaa

SEQ ID NO: 15950 - DNA, 25 bp, S. cerevisiae
aactggtggctatcgagcattcttt

SEQ ID NO: 15951 - DNA, 25 bp, S. cerevisiae
aactgtgttgcgatctacttttcca

SEQ ID NO: 15952 - DNA, 25 bp, S. cerevisiae
aactgtttgaattatccggtcgcca

SEQ ID NO: 15953 - DNA, 25 bp, S. cerevisiae
aacgtcgtgaagtggcggtcgcaac

SEQ ID NO: 15954 - DNA, 25 bp, S. cerevisiae
aagggcgtatagtggttgttcaaca

SEQ ID NO: 15955 - DNA, 25 bp, S. cerevisiae
aacggcgaaccgagcattcatgtaa

SEQ ID NO: 15956 - DNA, 25 bp, S. cerevisiae
aacgatgctcacaacgggttactta

SEQ ID NO: 15957 - DNA, 25 bp, S. cerevisiae
aacgggcacgtctggtatagcggac

SEQ ID NO: 15958 - DNA, 25 bp, S. cerevisiae
aagttacacgttccttacgaggcag

SEQ ID NO: 15959 - DNA, 25 bp, S. cerevisiae
aagtgtaacgagtgaattcgcccaa

SEQ ID NO: 15960 - DNA, 25 bp, S. cerevisiae
aagacgaaggaccagagcaccctac

SEQ ID NO: 15961 - DNA, 25 bp, S. cerevisiae
aacgccagaggaaaagcagccttac

SEQ ID NO: 15962 - DNA, 25 bp, S. cerevisiae
aacgacaagagacatggcagcactg

SEQ ID NO: 15963 - DNA, 25 bp, S. cerevisiae
aacgctgcagaagcactggaccaaa

SEQ ID NO: 15964 - DNA, 25 bp, S. cerevisiae
aactggaattcctttgccgttgatt

SEQ ID NO: 15965 - DNA, 25 bp, S. cerevisiae
aactgccgttcctttcctgcgtgta

SEQ ID NO: 15966 - DNA, 25 bp, S. cerevisiae
aactgccgcattattaaccgatgtc

SEQ ID NO: 15967 - DNA, 25 bp, S. cerevisiae
aaccgttaaagatgttcacagtgac

SEQ ID NO: 15968 - DNA, 25 bp, S. cerevisiae
cacttgttccttattccctggagaa

SEQ ID NO: 15969 - DNA, 25 bp, S. cerevisiae
aacgtatgccgttctgtccctggga

SEQ ID NO: 15970 - DNA, 25 bp, S. cerevisiae
aactccatgttcttgttgactgcta

SEQ ID NO: 15971 - DNA, 25 bp, S. cerevisiae
aacgcagcattctagtcattcatac

SEQ ID NO: 15972 - DNA, 25 bp, S. cerevisiae
aacgatcttcccattacatctagag

SEQ ID NO: 15973 - DNA, 25 bp, S. cerevisiae
aactgctgctgtttttgttgcgttt

SEQ ID NO: 15974 - DNA, 25 bp, S. cerevisiae
aacggctgttgctctctacaatttt

SEQ ID NO: 15975 - DNA, 25 bp, S. cerevisiae
aacgatcgctgatactctaagtttt

SEQ ID NO: 15976 - DNA, 25 bp, S. cerevisiae
aactgtagatgggttccagggccgt

SEQ ID NO: 15977 - DNA, 25 bp, S. cerevisiae
aatcgtggtcacattgccgggaact

SEQ ID NO: 15978 - DNA, 25 bp, S. cerevisiae
aactgggaagggtccggcatcatca

SEQ ID NO: 15979 - DNA, 25 bp, S. cerevisiae
aactgatacaagtgatccgagcaaa

SEQ ID NO: 15980 - DNA, 25 bp, S. cerevisiae
aactgctacggtggttctgcaagaa

SEQ ID NO: 15981 - DNA, 25 bp, S. cerevisiae
aactggtccgccgtgctagagaaaa

SEQ ID NO: 15982 - DNA, 25 bp, S. cerevisiae
aacgtcctcgacgtctcgaaagata

SEQ ID NO: 15983 - DNA, 25 bp, S. cerevisiae
aagccaaggctccagctgatgctga

SEQ ID NO: 15984 - DNA, 25 bp, S. cerevisiae
aacgattcctgtgtaaacctgagtc

SEQ ID NO: 15985 - DNA, 25 bp, S. cerevisiae
gattcgttacgggtagaccaatact

SEQ ID NO: 15986 - DNA, 25 bp, S. cerevisiae
aacggctgaagcactatatcaccat

SEQ ID NO: 15987 - DNA, 25 bp, S. cerevisiae
aactgtgacaccaacgaagccgctt

SEQ ID NO: 15988 - DNA, 25 bp, S. cerevisiae
aactgagacagcactgaacgccctt

SEQ ID NO: 15989 - DNA, 25 bp, S. cerevisiae
aacgaagcatcgtaaccgccactta

SEQ ID NO: 15990 - DNA, 25 bp, S. cerevisiae
aacgtatgacgatgagcccactgta

SEQ ID NO: 15991 - DNA, 25 bp, S. cerevisiae
aactgattgactttgggagcgctgt

SEQ ID NO: 15992 - DNA, 25 bp, S. cerevisiae
aacgaagcgcatcctggtgctactg

SEQ ID NO: 15993 - DNA, 25 bp, S. cerevisiae
aacgatcaactacttcatcttccaa

SEQ ID NO: 15994 - DNA, 25 bp, S. cerevisiae
aacggcttctattagcggctccaga

SEQ ID NO: 15995 - DNA, 25 bp, S. cerevisiae
aacggttgcttagcgagtactgctc

SEQ ID NO: 15996 - DNA, 25 bp, S. cerevisiae
aactggttcgtggtgcttatattca

SEQ ID NO: 15997 - DNA, 25 bp, S. cerevisiae
aacggagatcgttgtcgcagacatt

SEQ ID NO: 15998 - DNA, 25 bp, S. cerevisiae
aactggctccgtttcatggaattga

SEQ ID NO: 15999 - DNA, 25 bp, S. cerevisiae
aactgtcccctccatatggattata

SEQ ID NO: 16000 - DNA, 25 bp, S. cerevisiae
aacgtacgactccatcagtcataca

SEQ ID NO: 16001 - DNA, 25 bp, S. cerevisiae
aacgatacgtctgcatactacgagg

SEQ ID NO: 16002 - DNA, 25 bp, S. cerevisiae
aacggtgtggttgctttacagagac

SEQ ID NO: 16003 - DNA, 25 bp, S. cerevisiae
aactgtgagtgcgtgacattttgta

SEQ ID NO: 16004 - DNA, 25 bp, S. cerevisiae
aacgtggtgccaagctctacaagaa

SEQ ID NO: 16005 - DNA, 25 bp, S. cerevisiae
aacgaacaccatattgactcgaggt

SEQ ID NO: 16006 - DNA, 25 bp, S. cerevisiae
aactgaattccatgctggcgaacga

SEQ ID NO: 16007 - DNA, 25 bp, S. cerevisiae
aactgaaacatcttgtgggacctga

SEQ ID NO: 16008 - DNA, 25 bp, S. cerevisiae
aactgaaggctaggctgtggatccg

SEQ ID NO: 16009 - DNA, 25 bp, S. cerevisiae
aacgaaggttgtctggctgcatgtc

SEQ ID NO: 16010 - DNA, 25 bp, S. cerevisiae
aactgcaaagcacactggacgatga

SEQ ID NO: 16011 - DNA, 25 bp, S. cerevisiae
aactgaagcaggtacttgctcgaaa

SEQ ID NO: 16012 - DNA, 25 bp, S. cerevisiae
aacgttgctgacatgaccttggact

SEQ ID NO: 16013 - DNA, 25 bp, S. cerevisiae
aacgtgttgaacagagattttgagc

SEQ ID NO: 16014 - DNA, 25 bp, S. cerevisiae
aacggtctgactctgaattctctat

SEQ ID NO: 16015 - DNA, 25 bp, S. cerevisiae
aacgggttccacagcatattcatta

SEQ ID NO: 16016 - DNA, 25 bp, S. cerevisiae
aacgaatgaatactgcggatacttt

SEQ ID NO: 16017 - DNA, 25 bp, S. cerevisiae
aacgcacgatgctgtggccaagttt

SEQ ID NO: 16018 - DNA, 25 bp, S. cerevisiae
aaccacgtcaagagaggaggctatg

SEQ ID NO: 16019 - DNA, 25 bp, S. cerevisiae
aaccggtcactcacataaggccatg

SEQ ID NO: 16020 - DNA, 25 bp, S. cerevisiae
aacggatttcattgactctgacggt

SEQ ID NO: 16021 - DNA, 25 bp, S. cerevisiae
aacggtagcacttgcatctgcaggg

SEQ ID NO: 16022 - DNA, 25 bp, S. cerevisiae
aacgcggtgtttgctctattcctat

SEQ ID NO: 16023 - DNA, 25 bp, S. cerevisiae
aacgggatcaaattcagctggccat

SEQ ID NO: 16024 - DNA, 25 bp, S. cerevisiae
aacgggatgcattactctcggccaa

SEQ ID NO: 16025 - DNA, 25 bp, S. cerevisiae
aacgggcttgccttgaatgcttata

SEQ ID NO: 16026 - DNA, 25 bp, S. cerevisiae
aacgaatttcctacaagacatgatg

SEQ ID NO: 16027 - DNA, 25 bp, S. cerevisiae
aacgagttctccactagtcaagcta

SEQ ID NO: 16028 - DNA, 25 bp, S. cerevisiae
aacgagttcacgtttcctgaactga

SEQ ID NO: 16029 - DNA, 25 bp, S. cerevisiae
aacggcttacggcattggaattcaa

SEQ ID NO: 16030 - DNA, 25 bp, S. cerevisiae
aacgtttacgtccattctcatattc

SEQ ID NO: 16031 - DNA, 25 bp, S. cerevisiae
aactgattctacatctgacgctaat

SEQ ID NO: 16032 - DNA, 25 bp, S. cerevisiae
aagctattgctttgttgaccattgg

SEQ ID NO: 16033 - DNA, 25 bp, S. cerevisiae
aacgtcaatcttgttgccctattta

SEQ ID NO: 16034 - DNA, 25 bp, S. cerevisiae
aaccatcacctagttcatcggtaga

SEQ ID NO: 16035 - DNA, 25 bp, S. cerevisiae
aacgctcaacgaagccgcaggtagt

SEQ ID NO: 16036 - DNA, 25 bp, S. cerevisiae
aacgcctaagctcgagccggtggta

SEQ ID NO: 16037 - DNA, 25 bp, S. cerevisiae
aaccgttgtgtagctcgagtgtcat

SEQ ID NO: 16038 - DNA, 25 bp, S. cerevisiae
aacggctgttaagctggacactgaa

SEQ ID NO: 16039 - DNA, 25 bp, S. cerevisiae
aactggtattacttctgaccctgat

SEQ ID NO: 16040 - DNA, 25 bp, S. cerevisiae
aactggtcatcagagtgcagcccga

SEQ ID NO: 16041 - DNA, 25 bp, S. cerevisiae
aactggtctatggtgtcgatcctga

SEQ ID NO: 16042 - DNA, 25 bp, S. cerevisiae
aactggtccaattacgctggtggta

SEQ ID NO: 16043 - DNA, 25 bp, S. cerevisiae
aactggcttccacaacatggttata

SEQ ID NO: 16044 - DNA, 25 bp, S. cerevisiae
aacgagttccaagagatggtccaga

SEQ ID NO: 16045 - DNA, 25 bp, S. cerevisiae
aacggtgtctctaccgatgttcaag

SEQ ID NO: 16046 - DNA, 25 bp, S. cerevisiae
aacggtgatcttgaggacctctaca

SEQ ID NO: 16047 - DNA, 25 bp, S. cerevisiae
aacgttatcattgagcctggcgaac

SEQ ID NO: 16048 - DNA, 25 bp, S. cerevisiae
aaccatctttcggtattggccgtat

SEQ ID NO: 16049 - DNA, 25 bp, S. cerevisiae
aacgcccttcctcacggtagatgat

SEQ ID NO: 16050 - DNA, 25 bp, S. cerevisiae
aacgactttcctccagtgggattgc

SEQ ID NO: 16051 - DNA, 25 bp, S. cerevisiae
aacgatcttcagctacggtgggcag

SEQ ID NO: 16052 - DNA, 25 bp, S. cerevisiae
aactggtggttctaagacctgtcaa

SEQ ID NO: 16053 - DNA, 25 bp, S. cerevisiae
aacggctttggcaaacctagcaagg

SEQ ID NO: 16054 - DNA, 25 bp, S. cerevisiae
aactggttttgtcatggcatggaca

SEQ ID NO: 16055 - DNA, 25 bp, S. cerevisiae
aacggtctttatttgaagtgtgcct

SEQ ID NO: 16056 - DNA, 25 bp, S. cerevisiae
aactgtgatcttttcgtcactgacg

SEQ ID NO: 16057 - DNA, 25 bp, S. cerevisiae
aagctagaccattacgggcgtcgga

SEQ ID NO: 16058 - DNA, 25 bp, S. cerevisiae
aagcctgcacctgacgggttcgaaa

SEQ ID NO: 16059 - DNA, 25 bp, S. cerevisiae
aactgtgtgaatcggtttttggata

SEQ ID NO: 16060 - DNA, 25 bp, S. cerevisiae
aactgtgctgttgggttcatttgct

SEQ ID NO: 16061 - DNA, 25 bp, S. cerevisiae
aactggccacatttaccatctatct

SEQ ID NO: 16062 - DNA, 25 bp, S. cerevisiae
aactgggcagggagtcttctttcat

SEQ ID NO: 16063 - DNA, 25 bp, S. cerevisiae
aactgggcaagaagtcattttttgg

SEQ ID NO: 16064 - DNA, 25 bp, S. cerevisiae
aactggatttccttactcattggta

SEQ ID NO: 16065 - DNA, 25 bp, S. cerevisiae
aacggtgtctttggagtgctcggtt

SEQ ID NO: 16066 - DNA, 25 bp, S. cerevisiae
aacgacagtgtctggtccgtcatag

SEQ ID NO: 16067 - DNA, 25 bp, S. cerevisiae
aacgatagaggctggtctggcacaa

SEQ ID NO: 16068 - DNA, 25 bp, S. cerevisiae
aacgaaatgccatggttgcaaacca

SEQ ID NO: 16069 - DNA, 25 bp, S. cerevisiae
aactggcctccatggttcaagaaca

SEQ ID NO: 16070 - DNA, 25 bp, S. cerevisiae
aagcctgccaaatctggttacccaa

SEQ ID NO: 16071 - DNA, 25 bp, S. cerevisiae
aaccagaacagttcgcgtgttccta

SEQ ID NO: 16072 - DNA, 25 bp, S. cerevisiae
aaccagtagagtccgatcgtttaga

SEQ ID NO: 16073 - DNA, 25 bp, S. cerevisiae
aaccgtggtgctcaacgatattcca

SEQ ID NO: 16074 - DNA, 25 bp, S. cerevisiae
aaccttcatcggtgacgtattgtca

SEQ ID NO: 16075 - DNA, 25 bp, S. cerevisiae
aacccactgaaacaacccatttgag

SEQ ID NO: 16076 - DNA, 25 bp, S. cerevisiae
aaccgccgaaattaacactgacttg

SEQ ID NO: 16077 - DNA, 25 bp, S. cerevisiae
aactggtggtgcttcttctgctgct

SEQ ID NO: 16078 - DNA, 25 bp, S. cerevisiae
aactggattctggtatttcttcaaa

SEQ ID NO: 16079 - DNA, 25 bp, S. cerevisiae
aacggatcccaatttttcatcacca

SEQ ID NO: 16080 - DNA, 25 bp, S. cerevisiae
aacgtattcctccactcctaaagag

SEQ ID NO: 16081 - DNA, 25 bp, S. cerevisiae
aacctatacggatagcaagccgatt

SEQ ID NO: 16082 - DNA, 25 bp, S. cerevisiae
aagccataaagggtcgaacgcgagt

SEQ ID NO: 16083 - DNA, 25 bp, S. cerevisiae
aaccgaatgaccgatttggcgccat

SEQ ID NO: 16084 - DNA, 25 bp, S. cerevisiae
aacgcgcacgcagctaatttggtca

SEQ ID NO: 16085 - DNA, 25 bp, S. cerevisiae
aacgtataactcctgctattgcaaa

SEQ ID NO: 16086 - DNA, 25 bp, S. cerevisiae
aacggtggacattctgctatgggat

SEQ ID NO: 16087 - DNA, 25 bp, S. cerevisiae
aacggcattgccacgctgtgagaat

SEQ ID NO: 16088 - DNA, 25 bp, S. cerevisiae
aacggtgcagcctacgattgaaatc

SEQ ID NO: 16089 - DNA, 25 bp, S. cerevisiae
aacggtattcggctagcactgaaaa

SEQ ID NO: 16090 - DNA, 25 bp, S. cerevisiae
aacgggctttgtgatgttcctcata

SEQ ID NO: 16091 - DNA, 25 bp, S. cerevisiae
aatgctccaggtgggttaccaggtc

SEQ ID NO: 16092 - DNA, 25 bp, S. cerevisiae
aatcccggttgttatgctactggtt

SEQ ID NO: 16093 - DNA, 25 bp, S. cerevisiae
aatcggcaaggtacagaaggacact

SEQ ID NO: 16094 - DNA, 25 bp, S. cerevisiae
aacgtgctacgtacaaggcgaagtt

SEQ ID NO: 16095 - DNA, 25 bp, S. cerevisiae
aaccgatcccttgcaagacagtgtg

SEQ ID NO: 16096 - DNA, 25 bp, S. cerevisiae
aacggatcgctcaccatttctgtaa

SEQ ID NO: 16097 - DNA, 25 bp, S. cerevisiae
aacggctcatcacttatttttaaca

SEQ ID NO: 16098 - DNA, 25 bp, S. cerevisiae
aactggcagaatcgattcgtcttga

SEQ ID NO: 16099 - DNA, 25 bp, S. cerevisiae
aacgagtgctcaaaacaatggtacg

SEQ ID NO: 16100 - DNA, 25 bp, S. cerevisiae
aacgagctgctggaagaactgctaa

SEQ ID NO: 16101 - DNA, 25 bp, S. cerevisiae
aacggctatggtagatgactcggca

SEQ ID NO: 16102 - DNA, 25 bp, S. cerevisiae
aaggtcaagggaaagatggtgcaat

SEQ ID NO: 16103 - DNA, 25 bp, S. cerevisiae
aagagtcgaccaattgaacttgaat

SEQ ID NO: 16104 - DNA, 25 bp, S. cerevisiae
aacgcccatccaggtgaagtcgaac

SEQ ID NO: 16105 - DNA, 25 bp, S. cerevisiae
aacgcttacgcaggtattgccacaa

SEQ ID NO: 16106 - DNA, 25 bp, S. cerevisiae
aacgctaagccagcttctgaactga

SEQ ID NO: 16107 - DNA, 25 bp, S. cerevisiae
aacgctatcatgtccttgtctaaat

SEQ ID NO: 16108 - DNA, 25 bp, S. cerevisiae
aacgctttctccacatgtactaatt

SEQ ID NO: 16109 - DNA, 25 bp, S. cerevisiae
aagcttttccctcatgaaccaatag

SEQ ID NO: 16110 - DNA, 25 bp, S. cerevisiae
aaccgttccctgagaggccgatggt

SEQ ID NO: 16111 - DNA, 25 bp, S. cerevisiae
aacgcttaccttgtaggcgccatgg

SEQ ID NO: 16112 - DNA, 25 bp, S. cerevisiae
aacggtactgttactgccgctaacg

SEQ ID NO: 16113 - DNA, 25 bp, S. cerevisiae
aacggtactattcctaatctcaaca

SEQ ID NO: 16114 - DNA, 25 bp, S. cerevisiae
aaccgtccgtgggaaattcaagcat

SEQ ID NO: 16115 - DNA, 25 bp, S. cerevisiae
aatcctcccgtgtttacagtcaatt

SEQ ID NO: 16116 - DNA, 25 bp, S. cerevisiae
aacgctaacgtttttctgaataatg

SEQ ID NO: 16117 - DNA, 25 bp, S. cerevisiae
aacgctcccgttaatcaaagtacag

SEQ ID NO: 16118 - DNA, 25 bp, S. cerevisiae
aaccgcctccttggtggtatgtcaa

SEQ ID NO: 16119 - DNA, 25 bp, S. cerevisiae
aaccgcctccaaaatgaacttcaag

SEQ ID NO: 16120 - DNA, 25 bp, S. cerevisiae
aaccccacctctaatggagctggaa

SEQ ID NO: 16121 - DNA, 25 bp, S. cerevisiae
aacccaccgaagtagatttcagtca

SEQ ID NO: 16122 - DNA, 25 bp, S. cerevisiae
aaccacactaaatacactccagaca

SEQ ID NO: 16123 - DNA, 25 bp, S. cerevisiae
aaccaattgaacttaggccccactg

SEQ ID NO: 16124 - DNA, 25 bp, S. cerevisiae
aacgctggatggtttagttcctgac

SEQ ID NO: 16125 - DNA, 25 bp, S. cerevisiae
aacgctgtctggtttggtggctcgc

SEQ ID NO: 16126 - DNA, 25 bp, S. cerevisiae
aacgtatcatttacaggtgctactc

SEQ ID NO: 16127 - DNA, 25 bp, S. cerevisiae
aagcgaattgcccaaagtcaccgtg

SEQ ID NO: 16128 - DNA, 25 bp, S. cerevisiae
aacgactttgcagacgtgcccattc

SEQ ID NO: 16129 - DNA, 25 bp, S. cerevisiae
aacgcactaagcactatctcagtat

SEQ ID NO: 16130 - DNA, 25 bp, S. cerevisiae
aacgcagccggtttgattggtgatg

SEQ ID NO: 16131 - DNA, 25 bp, S. cerevisiae
aacgattcagagtggcttcgtgaaa

SEQ ID NO: 16132 - DNA, 25 bp, S. cerevisiae
aaccagttcaacaaggtcccagaag

SEQ ID NO: 16133 - DNA, 25 bp, S. cerevisiae
aacgtcttgaagatcgtcccaaagg

SEQ ID NO: 16134 - DNA, 25 bp, S. cerevisiae
aacgtgtttgtctatttaccagcag

SEQ ID NO: 16135 - DNA, 25 bp, S. cerevisiae
aacggtatcgttacttacgctgcca

SEQ ID NO: 16136 - DNA, 25 bp, S. cerevisiae
aacggtgtcgttactcaagatttca

SEQ ID NO: 16137 - DNA, 25 bp, S. cerevisiae
aacgttagtgttcatcctaccagta

SEQ ID NO: 16138 - DNA, 25 bp, S. cerevisiae
aaccttcaggttcatactatgcgtt

SEQ ID NO: 16139 - DNA, 25 bp, S. cerevisiae
aacgttactgttaagacttctgatg

SEQ ID NO: 16140 - DNA, 25 bp, S. cerevisiae
aacgtctgattgtttcatactttga

SEQ ID NO: 16141 - DNA, 25 bp, S. cerevisiae
aacgtcgttgtaacatcaagatctg

SEQ ID NO: 16142 - DNA, 25 bp, S. cerevisiae
aacgcttcttatcctgaccatgatt

SEQ ID NO: 16143 - DNA, 25 bp, S. cerevisiae
aacgtctctttcttatccattgatg

SEQ ID NO: 16144 - DNA, 25 bp, S. cerevisiae
aacgtgacagctctagcatcgctat

SEQ ID NO: 16145 - DNA, 25 bp, S. cerevisiae
aagcggaagtacagcacctgctaca

SEQ ID NO: 16146 - DNA, 25 bp, S. cerevisiae
aagagggaggactctcgcgtatcct

SEQ ID NO: 16147 - DNA, 25 bp, S. cerevisiae
aacctgtcgtacctgcggaatacta

SEQ ID NO: 16148 - DNA, 25 bp, S. cerevisiae
aacgcgtcaagattggtttgcccat

SEQ ID NO: 16149 - DNA, 25 bp, S. cerevisiae
aacggtgaaacaactaatcctctag

SEQ ID NO: 16150 - DNA, 25 bp, S. cerevisiae
aacggtgaagaagttgccatcagct

SEQ ID NO: 16151 - DNA, 25 bp, S. cerevisiae
aacgattcctcattgtattctactg

SEQ ID NO: 16152 - DNA, 25 bp, S. cerevisiae
aacgtgcctccaaggctttgattga

SEQ ID NO: 16153 - DNA, 25 bp, S. cerevisiae
aacgggcactaaagttgatgacgac

SEQ ID NO: 16154 - DNA, 25 bp, S. cerevisiae
aacgcctcccagtgaagatgacgac

SEQ ID NO: 16155 - DNA, 25 bp, S. cerevisiae
aaccggcacctgtcgaagcagaaat

SEQ ID NO: 16156 - DNA, 25 bp, S. cerevisiae
aaccaccaggtccaacagcaaaatg

SEQ ID NO: 16157 - DNA, 25 bp, S. cerevisiae
aaccatgccggtctcaaactgaatg

SEQ ID NO: 16158 - DNA, 25 bp, S. cerevisiae
aaccactggcttaccgaactgagag

SEQ ID NO: 16159 - DNA, 25 bp, S. cerevisiae
aacgccagacttaccgtcagatgat

SEQ ID NO: 16160 - DNA, 25 bp, S. cerevisiae
aacccatgggttattcctcggcaat

SEQ ID NO: 16161 - DNA, 25 bp, S. cerevisiae
aacgccagtggatttgtacccaact

SEQ ID NO: 16162 - DNA, 25 bp, S. cerevisiae
taccgccgtaacatggaggccaacg

SEQ ID NO: 16163 - DNA, 25 bp, S. cerevisiae
aacgatactgtaatttctgatgcta

SEQ ID NO: 16164 - DNA, 25 bp, S. cerevisiae
aacgatgagatctttgaattgggag

SEQ ID NO: 16165 - DNA, 25 bp, S. cerevisiae
aacgatggtacttgctatttcagag

SEQ ID NO: 16166 - DNA, 25 bp, S. cerevisiae
aacgatgtgtatgacttagagcaac

SEQ ID NO: 16167 - DNA, 25 bp, S. cerevisiae
aacgacgctgatgaattcaccaaac

SEQ ID NO: 16168 - DNA, 25 bp, S. cerevisiae
aatctagcccttcaaatccagaaca

SEQ ID NO: 16169 - DNA, 25 bp, S. cerevisiae
aacccctttagtacatcagagacca

SEQ ID NO: 16170 - DNA, 25 bp, S. cerevisiae
aacctcccttggacagccttggaag

SEQ ID NO: 16171 - DNA, 25 bp, S. cerevisiae
aacgccatccggaaagcttctggaa

SEQ ID NO: 16172 - DNA, 25 bp, S. cerevisiae
aacccatggcgctatcgttttttga

SEQ ID NO: 16173 - DNA, 25 bp, S. cerevisiae
aaccgctggcaggacttttattgag

SEQ ID NO: 16174 - DNA, 25 bp, S. cerevisiae
aacccgagagcaacgcgttcaatgt

SEQ ID NO: 16175 - DNA, 25 bp, S. cerevisiae
aacgtggagagctggcctgtaagta

SEQ ID NO: 16176 - DNA, 25 bp, S. cerevisiae
aaccacgaagacgactttgggctag

SEQ ID NO: 16177 - DNA, 25 bp, S. cerevisiae
aaccacgccaactctgttcgagaat

SEQ ID NO: 16178 - DNA, 25 bp, S. cerevisiae
aagccatacttacacgaatctcgac

SEQ ID NO: 16179 - DNA, 25 bp, S. cerevisiae
aaccacggatattaccatttctgag

SEQ ID NO: 16180 - DNA, 25 bp, S. cerevisiae
aagccaccgcatgtcaaatttttga

SEQ ID NO: 16181 - DNA, 25 bp, S. cerevisiae
aacgacgttttattcctatgtagct

SEQ ID NO: 16182 - DNA, 25 bp, S. cerevisiae
aacgacgttttcttagctgctgtaa

SEQ ID NO: 16183 - DNA, 25 bp, S. cerevisiae
aacgtcgtcgttccaggtgctttag

SEQ ID NO: 16184 - DNA, 25 bp, S. cerevisiae
aacgtcgtggcacttgcatgtggtt

SEQ ID NO: 16185 - DNA, 25 bp, S. cerevisiae
aacgtctgggatcttggtggtcaaa

SEQ ID NO: 16186 - DNA, 25 bp, S. cerevisiae
aacccatggaccgttattggcataa

SEQ ID NO: 16187 - DNA, 25 bp, S. cerevisiae
aaccgaacaccattttccatcaaag

SEQ ID NO: 16188 - DNA, 25 bp, S. cerevisiae
aaccaaaacagcacattcatccaag

SEQ ID NO: 16189 - DNA, 25 bp, S. cerevisiae
aaccacgcaaatttattagccagag

SEQ ID NO: 16190 - DNA, 25 bp, S. cerevisiae
aacgcaccatccttttaagacagct

SEQ ID NO: 16191 - DNA, 25 bp, S. cerevisiae
aacgatgttaggacagttcgactat

SEQ ID NO: 16192 - DNA, 25 bp, S. cerevisiae
aacgcatttcgatgggatctggtga

SEQ ID NO: 16193 - DNA, 25 bp, S. cerevisiae
aacgtcttcaaggagcgtctggctg

SEQ ID NO: 16194 - DNA, 25 bp, S. cerevisiae
aaccctgaagaatactccatctgga

SEQ ID NO: 16195 - DNA, 25 bp, S. cerevisiae
aacgttagttgagtttgccgcgcac

SEQ ID NO: 16196 - DNA, 25 bp, S. cerevisiae
aacgttaatgggacattctccgcac

SEQ ID NO: 16197 - DNA, 25 bp, S. cerevisiae
aacgagctgcgtcttttattaaaag

SEQ ID NO: 16198 - DNA, 25 bp, S. cerevisiae
aacgagtctcaagcttcttgcgata

SEQ ID NO: 16199 - DNA, 25 bp, S. cerevisiae
aacgagctaggtgatgtattcgaca

SEQ ID NO: 16200 - DNA, 25 bp, S. cerevisiae
aacgatagtctcactttgggcgata

SEQ ID NO: 16201 - DNA, 25 bp, S. cerevisiae
aacgaagctcgcacttttggcatga

SEQ ID NO: 16202 - DNA, 25 bp, S. cerevisiae
aacgaatgcattccgttcctggaaa

SEQ ID NO: 16203 - DNA, 25 bp, S. cerevisiae
aacgatatggttattcgagcaaatc

SEQ ID NO: 16204 - DNA, 25 bp, S. cerevisiae
aacgatataactaatccggctattc

SEQ ID NO: 16205 - DNA, 25 bp, S. cerevisiae
aacgatcttggtaatcccgctttca

SEQ ID NO: 16206 - DNA, 25 bp, S. cerevisiae
aacgttagtgtttgccatccttgga

SEQ ID NO: 16207 - DNA, 25 bp, S. cerevisiae
aacgcatatcaaatcacccagtcta

SEQ ID NO: 16208 - DNA, 25 bp, S. cerevisiae
aacgatataatgtcaccgcttcctg

SEQ ID NO: 16209 - DNA, 25 bp, S. cerevisiae
aacgatggcgatgaagagcttttct

SEQ ID NO: 16210 - DNA, 25 bp, S. cerevisiae
aacgatgttgcttaatgcggattta

SEQ ID NO: 16211 - DNA, 25 bp, S. cerevisiae
aacgactgtctttacgccatttacg

SEQ ID NO: 16212 - DNA, 25 bp, S. cerevisiae
aacgactttaatgcctatttggagc

SEQ ID NO: 16213 - DNA, 25 bp, S. cerevisiae
aacgacattttggttctaatggaat

SEQ ID NO: 16214 - DNA, 25 bp, S. cerevisiae
aagtaacatttcatggtccaggcca

SEQ ID NO: 16215 - DNA, 25 bp, S. cerevisiae
aacctacttgtgctagtacaggcca

SEQ ID NO: 16216 - DNA, 25 bp, S. cerevisiae
aacctggtaatgctatgtccggcga

SEQ ID NO: 16217 - DNA, 25 bp, S. cerevisiae
aacgctgatgccatttaggcctggt

SEQ ID NO: 16218 - DNA, 25 bp, S. cerevisiae
aaccgcggcagtcattggatctgaa

SEQ ID NO: 16219 - DNA, 25 bp, S. cerevisiae
aacgccggcgtgattgccacagaaa

SEQ ID NO: 16220 - DNA, 25 bp, S. cerevisiae
aaccaaggccatggtgccaccaata

SEQ ID NO: 16221 - DNA, 25 bp, S. cerevisiae
aaccacagactcaaggacccataag

SEQ ID NO: 16222 - DNA, 25 bp, S. cerevisiae
aaccatatcgatactgaggcccaaa

SEQ ID NO: 16223 - DNA, 25 bp, S. cerevisiae
aacgaagttatctagtccgaacaga

SEQ ID NO: 16224 - DNA, 25 bp, S. cerevisiae
aacgcaggttaattgattccagtaa

SEQ ID NO: 16225 - DNA, 25 bp, S. cerevisiae
aacgccgttaccactatggctgaaa

SEQ ID NO: 16226 - DNA, 25 bp, S. cerevisiae
aaccgtttcttctcttatcaataca

SEQ ID NO: 16227 - DNA, 25 bp, S. cerevisiae
aaccgtgtagttcttgtagaccaca

SEQ ID NO: 16228 - DNA, 25 bp, S. cerevisiae
aaccgttcaaacattggcgagccct

SEQ ID NO: 16229 - DNA, 25 bp, S. cerevisiae
aacgttttatgttgtctgtgtctaa

SEQ ID NO: 16230 - DNA, 25 bp, S. cerevisiae
aacgttttcttgtttgcgtcatcga

SEQ ID NO: 16231 - DNA, 25 bp, S. cerevisiae
aacgtttctttgtcatcggatgcat

SEQ ID NO: 16232 - DNA, 25 bp, S. cerevisiae
aacgaagtccttttgcacaagatta

SEQ ID NO: 16233 - DNA, 25 bp, S. cerevisiae
aacgccctaaatgcatgtatctaat

SEQ ID NO: 16234 - DNA, 25 bp, S. cerevisiae
aacgctccacaattactcaacgatt

SEQ ID NO: 16235 - DNA, 25 bp, S. cerevisiae
aacgctactaactggcaatggtctg

SEQ ID NO: 16236 - DNA, 25 bp, S. cerevisiae
aacgccacccattcaggtgagtttt

SEQ ID NO: 16237 - DNA, 25 bp, S. cerevisiae
aacccaacttgtggtgctggtgttt

SEQ ID NO: 16238 - DNA, 25 bp, S. cerevisiae
aagccgcgtgcgaatacccgatggg

SEQ ID NO: 16239 - DNA, 25 bp, S. cerevisiae
aacgccggcgtctcagttgaagatg

SEQ ID NO: 16240 - DNA, 25 bp, S. cerevisiae
caacctctcttacactgggacttaa

SEQ ID NO: 16241 - DNA, 25 bp, S. cerevisiae
aaccctgattcagcggtatggtctt

SEQ ID NO: 16242 - DNA, 25 bp, S. cerevisiae
aacgctatccctggcatgtatctga

SEQ ID NO: 16243 - DNA, 25 bp, S. cerevisiae
aacgcattccgatcatctgagcaat

SEQ ID NO: 16244 - DNA, 25 bp, S. cerevisiae
aacgcacgccgttcataatggatgt

SEQ ID NO: 16245 - DNA, 25 bp, S. cerevisiae
aaccattgcgcgttcattgaaggat

SEQ ID NO: 16246 - DNA, 25 bp, S. cerevisiae
aagagttaagttctcacccgctaga

SEQ ID NO: 16247 - DNA, 25 bp, S. cerevisiae
aacgttggcaaaatccatcgctcct

SEQ ID NO: 16248 - DNA, 25 bp, S. cerevisiae
aagcgatggcaacaatgaccccgta

SEQ ID NO: 16249 - DNA, 25 bp, S. cerevisiae
aagccgaacaagaacaagccgatgt

SEQ ID NO: 16250 - DNA, 25 bp, S. cerevisiae
aagctcaaaccaaagtgcgccagtg

SEQ ID NO: 16251 - DNA, 25 bp, S. cerevisiae
aagcgggctaaagtgtccaatacaa

SEQ ID NO: 16252 - DNA, 25 bp, S. cerevisiae
aacgcaaaacgtggctcctatagaa

SEQ ID NO: 16253 - DNA, 25 bp, S. cerevisiae
aacgctgaagtcatgccatctcaat

SEQ ID NO: 16254 - DNA, 25 bp, S. cerevisiae
aacgcaggagactatcgattcatta

SEQ ID NO: 16255 - DNA, 25 bp, S. cerevisiae
aacctgagaagccaccagttgtcaa

SEQ ID NO: 16256 - DNA, 25 bp, S. cerevisiae
aacccagccccgatgagtgaaataa

SEQ ID NO: 16257 - DNA, 25 bp, S. cerevisiae
aagcccaccgttttgcatgaagata

SEQ ID NO: 16258 - DNA, 25 bp, S. cerevisiae
aagtcgcatgcgcactgggttaatc

SEQ ID NO: 16259 - DNA, 25 bp, S. cerevisiae
aagccgttgcccagtgttacatctt

SEQ ID NO: 16260 - DNA, 25 bp, S. cerevisiae
aacgacttcgtcaggatgtacagca

SEQ ID NO: 16261 - DNA, 25 bp, S. cerevisiae
aacgctatggacttcaactatggat

SEQ ID NO: 16262 - DNA, 25 bp, S. cerevisiae
aacgaggacctaacgctaacagcag

SEQ ID NO: 16263 - DNA, 25 bp, S. cerevisiae
aacgcaaaattcacctgtcctgatg

SEQ ID NO: 16264 - DNA, 25 bp, S. cerevisiae
aacctagtgcctgtgtttgcatttg

SEQ ID NO: 16265 - DNA, 25 bp, S. cerevisiae
aaccgcaactgctgtttctcagatt

SEQ ID NO: 16266 - DNA, 25 bp, S. cerevisiae
aacccaaggccactttcttgagaat

SEQ ID NO: 16267 - DNA, 25 bp, S. cerevisiae
aaccaaccttggtgtgtcatcggta

SEQ ID NO: 16268 - DNA, 25 bp, S. cerevisiae
aacgagattgagaccctttgtaacg

SEQ ID NO: 16269 - DNA, 25 bp, S. cerevisiae
aacgctgtcggtatcctaggaaata

SEQ ID NO: 16270 - DNA, 25 bp, S. cerevisiae
aagcggattttcactatttactctc

SEQ ID NO: 16271 - DNA, 25 bp, S. cerevisiae
aaccgtttgtatcctagttttcatg

SEQ ID NO: 16272 - DNA, 25 bp, S. cerevisiae
aaccgatgtattgcgcgagtttcca

SEQ ID NO: 16273 - DNA, 25 bp, S. cerevisiae
aagccggttccattggtatttctga

SEQ ID NO: 16274 - DNA, 25 bp, S. cerevisiae
aagcggtgtagaattgcgtatttat

SEQ ID NO: 16275 - DNA, 25 bp, S. cerevisiae
aagcgagaccagatctacaatttga

SEQ ID NO: 16276 - DNA, 25 bp, S. cerevisiae
aagccaaccgttgaagactccaagg

SEQ ID NO: 16277 - DNA, 25 bp, S. cerevisiae
aaccgagcctgttttagagtcctca

SEQ ID NO: 16278 - DNA, 25 bp, S. cerevisiae
aacgctgcagttttttacatctttg

SEQ ID NO: 16279 - DNA, 25 bp, S. cerevisiae
aagcggacattctgttaattcctca

SEQ ID NO: 16280 - DNA, 25 bp, S. cerevisiae
aaccgacaacggcagcatttctata

SEQ ID NO: 16281 - DNA, 25 bp, S. cerevisiae
aaccgaacgcggtcatttgtattca

SEQ ID NO: 16282 - DNA, 25 bp, S. cerevisiae
aaccgacggcagcaagttgggtcaa

SEQ ID NO: 16283 - DNA, 25 bp, S. cerevisiae
aaccaggcaccgaaagttgggatgc

SEQ ID NO: 16284 - DNA, 25 bp, S. cerevisiae
aaccgccttgaacatccttagtaga

SEQ ID NO: 16285 - DNA, 25 bp, S. cerevisiae
aaccgcagataaattgacgcaacct

SEQ ID NO: 16286 - DNA, 25 bp, S. cerevisiae
aaccgcgtcaagaaatcccaggcat

SEQ ID NO: 16287 - DNA, 25 bp, S. cerevisiae
aagccggcataccaactgctacaga

SEQ ID NO: 16288 - DNA, 25 bp, S. cerevisiae
aagcccactgaccacggaaagacag

SEQ ID NO: 16289 - DNA, 25 bp, S. cerevisiae
aaccagtgaccctgctcaagtaagc

SEQ ID NO: 16290 - DNA, 25 bp, S. cerevisiae
aacgagtacgcgattgccaatagag

SEQ ID NO: 16291 - DNA, 25 bp, S. cerevisiae
aaccgccaccgaattatcacgagag

SEQ ID NO: 16292 - DNA, 25 bp, S. cerevisiae
aaccctcaccgaatatgtattgggc

SEQ ID NO: 16293 - DNA, 25 bp, S. cerevisiae
aaccctgacactaatgagccatttg

SEQ ID NO: 16294 - DNA, 25 bp, S. cerevisiae
aaccctgaatctacatcgccaaatt

SEQ ID NO: 16295 - DNA, 25 bp, S. cerevisiae
aaccctcttgctggacgtataatgg

SEQ ID NO: 16296 - DNA, 25 bp, S. cerevisiae
aacccacttgtttcagcttatcagg

SEQ ID NO: 16297 - DNA, 25 bp, S. cerevisiae
aagccccattgcgtaagacccagtg

SEQ ID NO: 16298 - DNA, 25 bp, S. cerevisiae
aaccgccattgctgaagactttgat

SEQ ID NO: 16299 - DNA, 25 bp, S. cerevisiae
aaccgccatctttcaagtcgatttt

SEQ ID NO: 16300 - DNA, 25 bp, S. cerevisiae
aaccgcccttgtggaatcgtatgag

SEQ ID NO: 16301 - DNA, 25 bp, S. cerevisiae
aacgctcccggtgattggttgattc

SEQ ID NO: 16302 - DNA, 25 bp, S. cerevisiae
aacgcacccggtaattctcttgata

SEQ ID NO: 16303 - DNA, 25 bp, S. cerevisiae
aaccatttgggtaacttcttgagag

SEQ ID NO: 16304 - DNA, 25 bp, S. cerevisiae
aagccactggtgctaactggttcat

SEQ ID NO: 16305 - DNA, 25 bp, S. cerevisiae
aacccagggctggtacagaagctaa

SEQ ID NO: 16306 - DNA, 25 bp, S. cerevisiae
aaccaggctgtttcgataaaggatg

SEQ ID NO: 16307 - DNA, 25 bp, S. cerevisiae
aacgactatgctaccgccatgggag

SEQ ID NO: 16308 - DNA, 25 bp, S. cerevisiae
aacgcttatccgctacaggtgtaaa

SEQ ID NO: 16309 - DNA, 25 bp, S. cerevisiae
aaccgttcaaatggctaccttgtca

SEQ ID NO: 16310 - DNA, 25 bp, S. cerevisiae
aaccgttgacttagcttcctgtgat

SEQ ID NO: 16311 - DNA, 25 bp, S. cerevisiae
aaccttttgagggattgtttgcaca

SEQ ID NO: 16312 - DNA, 25 bp, S. cerevisiae
aacctacccagtcgaagttgctgaa

SEQ ID NO: 16313 - DNA, 25 bp, S. cerevisiae
aacctacccagtcgaagttgctgaa

SEQ ID NO: 16314 - DNA, 25 bp, S. cerevisiae
aaccgcctcacttggaagcgttatt

SEQ ID NO: 16315 - DNA, 25 bp, S. cerevisiae
aacgccctattctgcacagcgtgat

SEQ ID NO: 16316 - DNA, 25 bp, S. cerevisiae
aacgcaactttctccaagctgatcg

SEQ ID NO: 16317 - DNA, 25 bp, S. cerevisiae
aacgcaattttgctgcttctgagca

SEQ ID NO: 16318 - DNA, 25 bp, S. cerevisiae
aacgacattttggtcttgatggaat

SEQ ID NO: 16319 - DNA, 25 bp, S. cerevisiae
aacgccattgttggtcatgcaggtg

SEQ ID NO: 16320 - DNA, 25 bp, S. cerevisiae
aacgctattgttcacgatggcatta

SEQ ID NO: 16321 - DNA, 25 bp, S. cerevisiae
aacgcttcgcttctacaaatcatga

SEQ ID NO: 16322 - DNA, 25 bp, S. cerevisiae
aagcggcttctaatgtacctaatgt

SEQ ID NO: 16323 - DNA, 25 bp, S. cerevisiae
aacgaaattcatataggcgcaagta

SEQ ID NO: 16324 - DNA, 25 bp, S. cerevisiae
aacccagttcaggtggaggccagaa

SEQ ID NO: 16325 - DNA, 25 bp, S. cerevisiae
gaacccgttaggcaactacaagata

SEQ ID NO: 16326 - DNA, 25 bp, S. cerevisiae
aagcggctacaacaaatttattcaa

SEQ ID NO: 16327 - DNA, 25 bp, S. cerevisiae
aaccacattgactatcactgactgt

SEQ ID NO: 16328 - DNA, 25 bp, S. cerevisiae
aagcctgctaagttcacaaatgagt

SEQ ID NO: 16329 - DNA, 25 bp, S. cerevisiae
aaccgctgtcgcacatatagcatga

SEQ ID NO: 16330 - DNA, 25 bp, S. cerevisiae
aacgctctagttcttctacagtgtg

SEQ ID NO: 16331 - DNA, 25 bp, S. cerevisiae
aacctctactggatttgcattatgt

SEQ ID NO: 16332 - DNA, 25 bp, S. cerevisiae
aacctggccagctaacctggtggaa

SEQ ID NO: 16333 - DNA, 25 bp, S. cerevisiae
aacctgatgccgtagaccttttgga

SEQ ID NO: 16334 - DNA, 25 bp, S. cerevisiae
aacctgagtgaaacgtcttcggaat

SEQ ID NO: 16335 - DNA, 25 bp, S. cerevisiae
aaccgtgtcattacgttgtggtaca

SEQ ID NO: 16336 - DNA, 25 bp, S. cerevisiae
aaccgcataaaaccttttgctcgtg

SEQ ID NO: 16337 - DNA, 25 bp, S. cerevisiae
aatcgcgataacagtcttagaccgt

SEQ ID NO: 16338 - DNA, 25 bp, S. cerevisiae
aaccttatcctggtcactatttcac

SEQ ID NO: 16339 - DNA, 25 bp, S. cerevisiae
aacgctttagctgtccataacttct

SEQ ID NO: 16340 - DNA, 25 bp, S. cerevisiae
aacgctctgacactttccataacat

SEQ ID NO: 16341 - DNA, 25 bp, S. cerevisiae
aacgccggtttcaaacttgatctgt

SEQ ID NO: 16342 - DNA, 25 bp, S. cerevisiae
aacgcccaatttactgctgctaaaa

SEQ ID NO: 16343 - DNA, 25 bp, S. cerevisiae
aacgcgatgacctctttgcatgtta

SEQ ID NO: 16344 - DNA, 25 bp, S. cerevisiae
aagcctggaccattcttgtgaagtg

SEQ ID NO: 16345 - DNA, 25 bp, S. cerevisiae
aacgctgctgttaagggccacggca

SEQ ID NO: 16346 - DNA, 25 bp, S. cerevisiae
aagccaatgaactgccacaaccaag

SEQ ID NO: 16347 - DNA, 25 bp, S. cerevisiae
aacgcaattgtataccttatccgag

SEQ ID NO: 16348 - DNA, 25 bp, S. cerevisiae
aacgctatatttctttcttctgaac

SEQ ID NO: 16349 - DNA, 25 bp, S. cerevisiae
aacgcacttgatacctatggaacac

SEQ ID NO: 16350 - DNA, 25 bp, S. cerevisiae
aacgcagattgttccagatgtcaac

SEQ ID NO: 16351 - DNA, 25 bp, S. cerevisiae
aaccatatgagttcacgcatgcaaa

SEQ ID NO: 16352 - DNA, 25 bp, S. cerevisiae
aacgctgttttgtggtggtctgtca

SEQ ID NO: 16353 - DNA, 25 bp, S. cerevisiae
aacgctttgggtgctggtgtcttcg

SEQ ID NO: 16354 - DNA, 25 bp, S. cerevisiae
aacgcattagggtctctcgatttgg

SEQ ID NO: 16355 - DNA, 25 bp, S. cerevisiae
aacgccacgtattctgggcttggag

SEQ ID NO: 16356 - DNA, 25 bp, S. cerevisiae
aacgccattgctaatgctaggtcag

SEQ ID NO: 16357 - DNA, 25 bp, S. cerevisiae
aacgccgctgcaattcaagaggaag

SEQ ID NO: 16358 - DNA, 25 bp, S. cerevisiae
aaccgcgctaatccaatgcacgaag

SEQ ID NO: 16359 - DNA, 25 bp, S. cerevisiae
aagccggcgaatccacaaagcacag

SEQ ID NO: 16360 - DNA, 25 bp, S. cerevisiae
aaccggaacgccaacaacatagtga

SEQ ID NO: 16361 - DNA, 25 bp, S. cerevisiae
aaccggaccgccacattataatgag

SEQ ID NO: 16362 - DNA, 25 bp, S. cerevisiae
aagctggtgcagacgttatcatgtt

SEQ ID NO: 16363 - DNA, 25 bp, S. cerevisiae
aagcggcgacaagttactgtaacga

SEQ ID NO: 16364 - DNA, 25 bp, S. cerevisiae
aagctgccccggtataatgtacacg

SEQ ID NO: 16365 - DNA, 25 bp, S. cerevisiae
aagcccagctcggtatttttagcgc

SEQ ID NO: 16366 - DNA, 25 bp, S. cerevisiae
aacgcccatgcatacttcgatgaaa

SEQ ID NO: 16367 - DNA, 25 bp, S. cerevisiae
aaccgatgagcgttggcagcaccag

SEQ ID NO: 16368 - DNA, 25 bp, S. cerevisiae
aacgctatacgatgaacctgctgat

SEQ ID NO: 16369 - DNA, 25 bp, S. cerevisiae
aacgctgccgccgttttaagcaagc

SEQ ID NO: 16370 - DNA, 25 bp, S. cerevisiae
aacgctgaccaagcttgctacagaa

SEQ ID NO: 16371 - DNA, 25 bp, S. cerevisiae
aagcctttcacggagttgatcacct

SEQ ID NO: 16372 - DNA, 25 bp, S. cerevisiae
aaccttcgcaagttctgtgtcagcg

SEQ ID NO: 16373 - DNA, 25 bp, S. cerevisiae
aagccttcaacgttcaggaatttgt

SEQ ID NO: 16374 - DNA, 25 bp, S. cerevisiae
aaccttgctgccgattcagaggatg

SEQ ID NO: 16375 - DNA, 25 bp, S. cerevisiae
aacctgtcaccagtctctgatattg

SEQ ID NO: 16376 - DNA, 25 bp, S. cerevisiae
aaccgctcctgtactgaatattcca

SEQ ID NO: 16377 - DNA, 25 bp, S. cerevisiae
aaccgtccgtgcattaaatccattc

SEQ ID NO: 16378 - DNA, 25 bp, S. cerevisiae
aacgcgaatcgtggcattgtcattg

SEQ ID NO: 16379 - DNA, 25 bp, S. cerevisiae
aacgcggcgcttggattattcatgt

SEQ ID NO: 16380 - DNA, 25 bp, S. cerevisiae
aacgcgccaccaattgtaaagtttg

SEQ ID NO: 16381 - DNA, 25 bp, S. cerevisiae
aagcggcgagccattcaaaagattt

SEQ ID NO: 16382 - DNA, 25 bp, S. cerevisiae
aagcccgacccatcaacaatgaatg

SEQ ID NO: 16383 - DNA, 25 bp, S. cerevisiae
aaccctcactcattcaaacaagcga

SEQ ID NO: 16384 - DNA, 25 bp, S. cerevisiae
aacgcgcccatataaatatccgcta

SEQ ID NO: 16385 - DNA, 25 bp, S. cerevisiae
aagcgacaacagcagaatttcccaa

SEQ ID NO: 16386 - DNA, 25 bp, S. cerevisiae
aagccattacaaggtattttccata

SEQ ID NO: 16387 - DNA, 25 bp, S. cerevisiae
aaccattgcaggtgaactaatccat

SEQ ID NO: 16388 - DNA, 25 bp, S. cerevisiae
aacccttggaagagtcagatcagag

SEQ ID NO: 16389 - DNA, 25 bp, S. cerevisiae
aacgccttgggcctaatatcattga

SEQ ID NO: 16390 - DNA, 25 bp, S. cerevisiae
aaccagattactcaaacgctccaat

SEQ ID NO: 16391 - DNA, 25 bp, S. cerevisiae
aagccacatccatagagatacctcc

SEQ ID NO: 16392 - DNA, 25 bp, S. cerevisiae
aatggcaatgcgagagttggcgttc

SEQ ID NO: 16393 - DNA, 25 bp, S. cerevisiae
aagccacgtttgttttcgattcgag

SEQ ID NO: 16394 - DNA, 25 bp, S. cerevisiae
caacggctttgagcagactgcggat

SEQ ID NO: 16395 - DNA, 25 bp, S. cerevisiae
aagcccattggagcagagatcgttt

SEQ ID NO: 16396 - DNA, 25 bp, S. cerevisiae
aacgccttggcatcgaacctgatga

SEQ ID NO: 16397 - DNA, 25 bp, S. cerevisiae
aaccgtgtggttgtcataaatcgag

SEQ ID NO: 16398 - DNA, 25 bp, S. cerevisiae
aaccggtgagttgctttgctacgac

SEQ ID NO: 16399 - DNA, 25 bp, S. cerevisiae
aaccctggtgtctggtatttccatt

SEQ ID NO: 16400 - DNA, 25 bp, S. cerevisiae
aacccactggtatagttgctttcag

SEQ ID NO: 16401 - DNA, 25 bp, S. cerevisiae
aacccctttgctatcaatgtttctc

SEQ ID NO: 16402 - DNA, 25 bp, S. cerevisiae
aaccattcgtatcccaagtttgcaa

SEQ ID NO: 16403 - DNA, 25 bp, S. cerevisiae
aaccattcagttcccgatttagata

SEQ ID NO: 16404 - DNA, 25 bp, S. cerevisiae
aaccacttgcgcttgttatttacat

SEQ ID NO: 16405 - DNA, 25 bp, S. cerevisiae
aaccattctggcacatttatttcac

SEQ ID NO: 16406 - DNA, 25 bp, S. cerevisiae
aacctcatctataatttttaccctg

SEQ ID NO: 16407 - DNA, 25 bp, S. cerevisiae
aaccctgtttatgactgtatcccta

SEQ ID NO: 16408 - DNA, 25 bp, S. cerevisiae
aaccgcattggttggcatcttatcc

SEQ ID NO: 16409 - DNA, 25 bp, S. cerevisiae
aagcggcatcgacttggatctggac

SEQ ID NO: 16410 - DNA, 25 bp, S. cerevisiae
aagccagatgatgctgcaacagcag

SEQ ID NO: 16411 - DNA, 25 bp, S. cerevisiae
aagccatgcagctctcacataaggg

SEQ ID NO: 16412 - DNA, 25 bp, S. cerevisiae
aagccagccatcttctaaaggtgcc

SEQ ID NO: 16413 - DNA, 25 bp, S. cerevisiae
aaccacatacttggagcctgaatat

SEQ ID NO: 16414 - DNA, 25 bp, S. cerevisiae
aaccattggttggacctgatgacaa

SEQ ID NO: 16415 - DNA, 25 bp, S. cerevisiae
aaccggagttatataccatcatggg

SEQ ID NO: 16416 - DNA, 25 bp, S. cerevisiae
aaccgagatcaaaatggacccatgg

SEQ ID NO: 16417 - DNA, 25 bp, S. cerevisiae
aaccgcgaagcaaatgtacctcctg

SEQ ID NO: 16418 - DNA, 25 bp, S. cerevisiae
aacccagaagttgtacctgccatca

SEQ ID NO: 16419 - DNA, 25 bp, S. cerevisiae
aagcccgcaagattcgatagcctcg

SEQ ID NO: 16420 - DNA, 25 bp, S. cerevisiae
aaccacgagaatcctataccagcga

SEQ ID NO: 16421 - DNA, 25 bp, S. cerevisiae
aacctcaggacaaattcactcgcga

SEQ ID NO: 16422 - DNA, 25 bp, S. cerevisiae
aacgccagtatttttcctgcggata

SEQ ID NO: 16423 - DNA, 25 bp, S. cerevisiae
aaccaatcacccgacattcttgagt

SEQ ID NO: 16424 - DNA, 25 bp, S. cerevisiae
aaccataacatcgacacttccagag

SEQ ID NO: 16425 - DNA, 25 bp, S. cerevisiae
aagcgagattttccataatccagag

SEQ ID NO: 16426 - DNA, 25 bp, S. cerevisiae
aacctgcaagtactggcctgttagc

SEQ ID NO: 16427 - DNA, 25 bp, S. cerevisiae
aaccaggaccaaagtttactatcag

SEQ ID NO: 16428 - DNA, 25 bp, S. cerevisiae
aagcctggcccattagtattaccaa

SEQ ID NO: 16429 - DNA, 25 bp, S. cerevisiae
aagccaagcgcatgtactccattgt

SEQ ID NO: 16430 - DNA, 25 bp, S. cerevisiae
aaccatctgcgttatgacactagtg

SEQ ID NO: 16431 - DNA, 25 bp, S. cerevisiae
aaccactttgactatcactgactgt

SEQ ID NO: 16432 - DNA, 25 bp, S. cerevisiae
aagccagctggtaacaacgatcgtg

SEQ ID NO: 16433 - DNA, 25 bp, S. cerevisiae
aagccagctatctccaaggctctat

SEQ ID NO: 16434 - DNA, 25 bp, S. cerevisiae
aagctgccggtatcaaggttatcca

SEQ ID NO: 16435 - DNA, 25 bp, S. cerevisiae
aagccactggtatcaagggttcaat

SEQ ID NO: 16436 - DNA, 25 bp, S. cerevisiae
aacctctaggctcattgggtgctaa

SEQ ID NO: 16437 - DNA, 25 bp, S. cerevisiae
aagccaggcaatctaacttggacaa

SEQ ID NO: 16438 - DNA, 25 bp, S. cerevisiae
aaccaatctaatgttctctgacgaa

SEQ ID NO: 16439 - DNA, 25 bp, S. cerevisiae
aatgccaacggtgttgacgcaccaa

SEQ ID NO: 16440 - DNA, 25 bp, S. cerevisiae
aaccagctcttgttgcagctaacag

SEQ ID NO: 16441 - DNA, 25 bp, S. cerevisiae
aacctgctcttgatgactattctgc

SEQ ID NO: 16442 - DNA, 25 bp, S. cerevisiae
aagctccagtggacaccaaaacgaa

SEQ ID NO: 16443 - DNA, 25 bp, S. cerevisiae
aagcgggaggtcaaccactggcata

SEQ ID NO: 16444 - DNA, 25 bp, S. cerevisiae
aacctcctttgccttcgaggaatgt

SEQ ID NO: 16445 - DNA, 25 bp, S. cerevisiae
aagccgccatttcttctatcaaaag

SEQ ID NO: 16446 - DNA, 25 bp, S. cerevisiae
aacctcctgctactgtttgggctga

SEQ ID NO: 16447 - DNA, 25 bp, S. cerevisiae
aaccactactgtttctccaaagaca

SEQ ID NO: 16448 - DNA, 25 bp, S. cerevisiae
aaccgcttcttatggccatttcaca

SEQ ID NO: 16449 - DNA, 25 bp, S. cerevisiae
aagccgttcctcaaaggcctggtca

SEQ ID NO: 16450 - DNA, 25 bp, S. cerevisiae
aagcgcattcttctaagttcggtga

SEQ ID NO: 16451 - DNA, 25 bp, S. cerevisiae
aagcgccagttatcagtgagtccct

SEQ ID NO: 16452 - DNA, 25 bp, S. cerevisiae
aacctgatgctgaaacgtggtcccc

SEQ ID NO: 16453 - DNA, 25 bp, S. cerevisiae
aagcctaccgataagactgtccagt

SEQ ID NO: 16454 - DNA, 25 bp, S. cerevisiae
aagcctaccgtaagaccataccagt

SEQ ID NO: 16455 - DNA, 25 bp, S. cerevisiae
aagcctcacactttataccatttcg

SEQ ID NO: 16456 - DNA, 25 bp, S. cerevisiae
aaccgccacttcaaactatattcat

SEQ ID NO: 16457 - DNA, 25 bp, S. cerevisiae
aaccgttggtgttacgatgagccac

SEQ ID NO: 16458 - DNA, 25 bp, S. cerevisiae
aaccgctttggttcacgatggtcta

SEQ ID NO: 16459 - DNA, 25 bp, S. cerevisiae
aaccgctactatttcctgatggatt

SEQ ID NO: 16460 - DNA, 25 bp, S. cerevisiae
aaccgtagattgtctccaagggata

SEQ ID NO: 16461 - DNA, 25 bp, S. cerevisiae
aaccgtattgctttcgaatcggcca

SEQ ID NO: 16462 - DNA, 25 bp, S. cerevisiae
aagcggaattgtctcggtcgtcata

SEQ ID NO: 16463 - DNA, 25 bp, S. cerevisiae
aaccgcagttttccgatgacgttat

SEQ ID NO: 16464 - DNA, 25 bp, S. cerevisiae
aacctgagtctttttgatgctcggt

SEQ ID NO: 16465 - DNA, 25 bp, S. cerevisiae
aaccggttgttatttgaatgcagaa

SEQ ID NO: 16466 - DNA, 25 bp, S. cerevisiae
aaccgtgtttgacctggcaaatgaa

SEQ ID NO: 16467 - DNA, 25 bp, S. cerevisiae
aagcctgacgcttctagagacgaat

SEQ ID NO: 16468 - DNA, 25 bp, S. cerevisiae
aagccgtttgacaaggcactgcaaa

SEQ ID NO: 16469 - DNA, 25 bp, S. cerevisiae
aaccgggacacattgaagccacgac

SEQ ID NO: 16470 - DNA, 25 bp, S. cerevisiae
aagccggttaccaagacgatccaca

SEQ ID NO: 16471 - DNA, 25 bp, S. cerevisiae
aaccggttgctcaatatgacttcca

SEQ ID NO: 16472 - DNA, 25 bp, S. cerevisiae
aacctgattcgtgcagaacttctga

SEQ ID NO: 16473 - DNA, 25 bp, S. cerevisiae
aacctcttggcgctgcatgcaaaaa

SEQ ID NO: 16474 - DNA, 25 bp, S. cerevisiae
aagcgtcgtggctcgatggaaagca

SEQ ID NO: 16475 - DNA, 25 bp, S. cerevisiae
aaccttacgtcctgctgaaatcagc

SEQ ID NO: 16476 - DNA, 25 bp, S. cerevisiae
aacctgatagcgtcgatactggtat

SEQ ID NO: 16477 - DNA, 25 bp, S. cerevisiae
aacctgaccatttgttatgcttcgg

SEQ ID NO: 16478 - DNA, 25 bp, S. cerevisiae
aaccattttccattgttcgcattat

SEQ ID NO: 16479 - DNA, 25 bp, S. cerevisiae
aacctgctagctattcctaactttg

SEQ ID NO: 16480 - DNA, 25 bp, S. cerevisiae
aaccacgttgttgccttgatcgaaa

SEQ ID NO: 16481 - DNA, 25 bp, S. cerevisiae
aagcgggtgtttgccttgattgcaa

SEQ ID NO: 16482 - DNA, 25 bp, S. cerevisiae
aaccgatgatattttccttcttggc

SEQ ID NO: 16483 - DNA, 25 bp, S. cerevisiae
aaccagcgatattctcaatgtagga

SEQ ID NO: 16484 - DNA, 25 bp, S. cerevisiae
aagcgcatcaggctcaattagatca

SEQ ID NO: 16485 - DNA, 25 bp, S. cerevisiae
aaccattctggtttagcgactggaa

SEQ ID NO: 16486 - DNA, 25 bp, S. cerevisiae
aaggaattgaaacagcagtcggaga

SEQ ID NO: 16487 - DNA, 25 bp, S. cerevisiae
aagtaattgcaaccgaggccgtgga

SEQ ID NO: 16488 - DNA, 25 bp, S. cerevisiae
cggtttttattcatcgcggcgaggc

SEQ ID NO: 16489 - DNA, 25 bp, S. cerevisiae
aagtggagaagcctgtgatcaagaa

SEQ ID NO: 16490 - DNA, 25 bp, S. cerevisiae
aagctggtgacaagctagagcaagc

SEQ ID NO: 16491 - DNA, 25 bp, S. cerevisiae
aagctgaggatcttcaagccagact

SEQ ID NO: 16492 - DNA, 25 bp, S. cerevisiae
aagctcggccggcagtcagatctat

SEQ ID NO: 16493 - DNA, 25 bp, S. cerevisiae
aaccgtgcactagaatcgtcttggc

SEQ ID NO: 16494 - DNA, 25 bp, S. cerevisiae
aacctggacaatgttctgactctag

SEQ ID NO: 16495 - DNA, 25 bp, S. cerevisiae
aacctggtgaatgtgtgctgactaa

SEQ ID NO: 16496 - DNA, 25 bp, S. cerevisiae
aagccacggaagttgtgccatccag

SEQ ID NO: 16497 - DNA, 25 bp, S. cerevisiae
aagccagaggtcaagccagaagtca

SEQ ID NO: 16498 - DNA, 25 bp, S. cerevisiae
aaccatcggtgaggccatggacaca

SEQ ID NO: 16499 - DNA, 25 bp, S. cerevisiae
aagcgcagcgctccggataagataa

SEQ ID NO: 16500 - DNA, 25 bp, S. cerevisiae
aagccacctgcggagattattgaag

SEQ ID NO: 16501 - DNA, 25 bp, S. cerevisiae
aagccgctttccttggatcaacata

SEQ ID NO: 16502 - DNA, 25 bp, S. cerevisiae
aagcctgttacgttggcttactgac

SEQ ID NO: 16503 - DNA, 25 bp, S. cerevisiae
aagccccgagcatttctgaaacgaa

SEQ ID NO: 16504 - DNA, 25 bp, S. cerevisiae
aaccgtcgtcgtatgtctatgattc

SEQ ID NO: 16505 - DNA, 25 bp, S. cerevisiae
aacctgatgagttttctttcgaacg

SEQ ID NO: 16506 - DNA, 25 bp, S. cerevisiae
aatcattagacgtttcctccgacag

SEQ ID NO: 16507 - DNA, 25 bp, S. cerevisiae
aagccgccaagtacttccgtgaaca

SEQ ID NO: 16508 - DNA, 25 bp, S. cerevisiae
aagcccaaggtcacccaattatcat

SEQ ID NO: 16509 - DNA, 25 bp, S. cerevisiae
aagcctggcgaagatcttgactatt

SEQ ID NO: 16510 - DNA, 25 bp, S. cerevisiae
aaccttctcaagacaacttcatcac

SEQ ID NO: 16511 - DNA, 25 bp, S. cerevisiae
aaccattctgcccaaatttctgcaa

SEQ ID NO: 16512 - DNA, 25 bp, S. cerevisiae
aagctatgcagtgccaactttcgca

SEQ ID NO: 16513 - DNA, 25 bp, S. cerevisiae
aagcgtacatgatgccgttattgaa

SEQ ID NO: 16514 - DNA, 25 bp, S. cerevisiae
aagcgagagcgatcctttggtacaa

SEQ ID NO: 16515 - DNA, 25 bp, S. cerevisiae
aagcctgaacctttagttcttgatg

SEQ ID NO: 16516 - DNA, 25 bp, S. cerevisiae
aagccgatgcggtcaaggattattg

SEQ ID NO: 16517 - DNA, 25 bp, S. cerevisiae
caaccgcaggttgggcaacggcgac

SEQ ID NO: 16518 - DNA, 25 bp, S. cerevisiae
aacctggtgatgaggctacggctga

SEQ ID NO: 16519 - DNA, 25 bp, S. cerevisiae
aagcgtgaatccagtgctacctcta

SEQ ID NO: 16520 - DNA, 25 bp, S. cerevisiae
aagcggagatgttcggatccctctt

SEQ ID NO: 16521 - DNA, 25 bp, S. cerevisiae
aagccgatcagcctacgaatttttg

SEQ ID NO: 16522 - DNA, 25 bp, S. cerevisiae
aagccgctaccgtcaatgttgcaga

SEQ ID NO: 16523 - DNA, 25 bp, S. cerevisiae
aagccgctatttctctatctacgga

SEQ ID NO: 16524 - DNA, 25 bp, S. cerevisiae
aagcccaactcacctaaagaaactg

SEQ ID NO: 16525 - DNA, 25 bp, S. cerevisiae
aagccatggcttcccctgaagagaa

SEQ ID NO: 16526 - DNA, 25 bp, S. cerevisiae
aagctctagattccccgtagatgaa

SEQ ID NO: 16527 - DNA, 25 bp, S. cerevisiae
aagctcaaacgtgctcttaatgaaa

SEQ ID NO: 16528 - DNA, 25 bp, S. cerevisiae
aagtcgtggcgggtgctcaaatact

SEQ ID NO: 16529 - DNA, 25 bp, S. cerevisiae
aacctttcagatactgctgctttaa

SEQ ID NO: 16530 - DNA, 25 bp, S. cerevisiae
aagccagttatgttcgctcgttcag

SEQ ID NO: 16531 - DNA, 25 bp, S. cerevisiae
aagctcgctatcacaactaacttgt

SEQ ID NO: 16532 - DNA, 25 bp, S. cerevisiae
aagcccgacacgtagttattcatga

SEQ ID NO: 16533 - DNA, 25 bp, S. cerevisiae
aacctacaggtttcatcgctttcta

SEQ ID NO: 16534 - DNA, 25 bp, S. cerevisiae
aagccattcagggacaatcgttcat

SEQ ID NO: 16535 - DNA, 25 bp, S. cerevisiae
aagcgacgattccactgtacgggta

SEQ ID NO: 16536 - DNA, 25 bp, S. cerevisiae
aaccttacacactacatcacgatta

SEQ ID NO: 16537 - DNA, 25 bp, S. cerevisiae
aaccttcatacagttgttcgattga

SEQ ID NO: 16538 - DNA, 25 bp, S. cerevisiae
aacctcataactgctattcgtgcta

SEQ ID NO: 16539 - DNA, 25 bp, S. cerevisiae
aagccctagaggagctgttgtctaa

SEQ ID NO: 16540 - DNA, 25 bp, S. cerevisiae
aagctcctttggaagcatgttttca

SEQ ID NO: 16541 - DNA, 25 bp, S. cerevisiae
aagcgttccggtgactatcattgat

SEQ ID NO: 16542 - DNA, 25 bp, S. cerevisiae
aagcgtttgcgcgtggcacaatgca

SEQ ID NO: 16543 - DNA, 25 bp, S. cerevisiae
aaccatggttgggagcgcagacagc

SEQ ID NO: 16544 - DNA, 25 bp, S. cerevisiae
aagctgaagttgttgccgtaggccc

SEQ ID NO: 16545 - DNA, 25 bp, S. cerevisiae
aagcccatgcctttatcaacagatc

SEQ ID NO: 16546 - DNA, 25 bp, S. cerevisiae
aagcgccgatgtagctgcagggcta

SEQ ID NO: 16547 - DNA, 25 bp, S. cerevisiae
aagctgccggttggactggtatact

SEQ ID NO: 16548 - DNA, 25 bp, S. cerevisiae
aagcacctccaatagcaatttgagt

SEQ ID NO: 16549 - DNA, 25 bp, S. cerevisiae
aagctcctcgaattcccaattcaat

SEQ ID NO: 16550 - DNA, 25 bp, S. cerevisiae
aagccccagatgtcattccaggtga

SEQ ID NO: 16551 - DNA, 25 bp, S. cerevisiae
aagccagctcgaagcatacgacgaa

SEQ ID NO: 16552 - DNA, 25 bp, S. cerevisiae
aagcgcacctgttgaactgacgaca

SEQ ID NO: 16553 - DNA, 25 bp, S. cerevisiae
aagccactgtaggtgacaacgacaa

SEQ ID NO: 16554 - DNA, 25 bp, S. cerevisiae
aagccagctgctaccgaaactgaaa

SEQ ID NO: 16555 - DNA, 25 bp, S. cerevisiae
aagccagctgccaagaaaacatcaa

SEQ ID NO: 16556 - DNA, 25 bp, S. cerevisiae
aagccagctgctaagtccattgtca

SEQ ID NO: 16557 - DNA, 25 bp, S. cerevisiae
aagccagtcatgatcgccaatctat

SEQ ID NO: 16558 - DNA, 25 bp, S. cerevisiae
aagccattcatttaccaattctgcc

SEQ ID NO: 16559 - DNA, 25 bp, S. cerevisiae
aagcctacagaagttttatcgtgtt

SEQ ID NO: 16560 - DNA, 25 bp, S. cerevisiae
aagcctaccacgatctgatgattga

SEQ ID NO: 16561 - DNA, 25 bp, S. cerevisiae
aaccactacattatctcaatctgac

SEQ ID NO: 16562 - DNA, 25 bp, S. cerevisiae
aacctttctctgaatctcaatctca

SEQ ID NO: 16563 - DNA, 25 bp, S. cerevisiae
aaccttatcgttacactcatcatct

SEQ ID NO: 16564 - DNA, 25 bp, S. cerevisiae
aagcgagttagatggcgacgattca

SEQ ID NO: 16565 - DNA, 25 bp, S. cerevisiae
aagcgcgctaagttggcccaatctt

SEQ ID NO: 16566 - DNA, 25 bp, S. cerevisiae
aagctggagaggttcctaatccctt

SEQ ID NO: 16567 - DNA, 25 bp, S. cerevisiae
aagcggaaggctaccacaacgacca

SEQ ID NO: 16568 - DNA, 25 bp, S. cerevisiae
aagcggtaccttgagataatgtcca

SEQ ID NO: 16569 - DNA, 25 bp, S. cerevisiae
aagtggtaaaccctgataatcctga

SEQ ID NO: 16570 - DNA, 25 bp, S. cerevisiae
aagttatcacgtcgccagagtacct

SEQ ID NO: 16571 - DNA, 25 bp, S. cerevisiae
aagtcggttcgtgcagtttattctg

SEQ ID NO: 16572 - DNA, 25 bp, S. cerevisiae
aagcgcggtttctcagtatatttct

SEQ ID NO: 16573 - DNA, 25 bp, S. cerevisiae
aagcccgttttggtgaatgagttat

SEQ ID NO: 16574 - DNA, 25 bp, S. cerevisiae
aagcccttgttctctggtgaaagcg

SEQ ID NO: 16575 - DNA, 25 bp, S. cerevisiae
aagcccgtgtatgtatggtgcaaat

SEQ ID NO: 16576 - DNA, 25 bp, S. cerevisiae
aagcccgagcaattgtatggtcatc

SEQ ID NO: 16577 - DNA, 25 bp, S. cerevisiae
aagcctgctgcagaaggagctgcca

SEQ ID NO: 16578 - DNA, 25 bp, S. cerevisiae
aagcggcatcatatttctataccat

SEQ ID NO: 16579 - DNA, 25 bp, S. cerevisiae
aagccaatcatctttatctgtcctc

SEQ ID NO: 16580 - DNA, 25 bp, S. cerevisiae
aagctacccatttggactatcgatc

SEQ ID NO: 16581 - DNA, 25 bp, S. cerevisiae
aagcttccacaatggacgcagcgtc

SEQ ID NO: 16582 - DNA, 25 bp, S. cerevisiae
aagcttttgccagatggtgacgccg

SEQ ID NO: 16583 - DNA, 25 bp, S. cerevisiae
aagcgtattcaaggacatggaccaa

SEQ ID NO: 16584 - DNA, 25 bp, S. cerevisiae
aagccggtcaaaatcgatgcctcca

SEQ ID NO: 16585 - DNA, 25 bp, S. cerevisiae
aaccaggttctggtgctacccataa

SEQ ID NO: 16586 - DNA, 25 bp, S. cerevisiae
aagccttgcctttgattgttaatac

SEQ ID NO: 16587 - DNA, 25 bp, S. cerevisiae
aaccattgcctgactatttgataaa

SEQ ID NO: 16588 - DNA, 25 bp, S. cerevisiae
aaccattttgatcttgctgtctaat

SEQ ID NO: 16589 - DNA, 25 bp, S. cerevisiae
aagctgatttaattccgttgttcca

SEQ ID NO: 16590 - DNA, 25 bp, S. cerevisiae
aagcttcccaagcttggttgcccaa

SEQ ID NO: 16591 - DNA, 25 bp, S. cerevisiae
aagccattgaagttttaggtccgca

SEQ ID NO: 16592 - DNA, 25 bp, S. cerevisiae
aagcctgtcggtattgtggtcccta

SEQ ID NO: 16593 - DNA, 25 bp, S. cerevisiae
aagctttagccgatcttatttcgta

SEQ ID NO: 16594 - DNA, 25 bp, S. cerevisiae
aagcctttcttgatgcccgttgaag

SEQ ID NO: 16595 - DNA, 25 bp, S. cerevisiae
aagcctttcttgatcaatgtcttac

SEQ ID NO: 16596 - DNA, 25 bp, S. cerevisiae
aagccatttattgatcacgtcatgt

SEQ ID NO: 16597 - DNA, 25 bp, S. cerevisiae
aagcctttactttccaccagttgag

SEQ ID NO: 16598 - DNA, 25 bp, S. cerevisiae
aagctgtcatcttctgtaacaccag

SEQ ID NO: 16599 - DNA, 25 bp, S. cerevisiae
aagcttataggattttagcgccaag

SEQ ID NO: 16600 - DNA, 25 bp, S. cerevisiae
aagctgtaaatacttctcgtccaag

SEQ ID NO: 16601 - DNA, 25 bp, S. cerevisiae
aaccaaatggcttcacttgtgctaa

SEQ ID NO: 16602 - DNA, 25 bp, S. cerevisiae
aagcgtccatcatatatgccttcca

SEQ ID NO: 16603 - DNA, 25 bp, S. cerevisiae
aagcctgcacctcttgcagtagaag

SEQ ID NO: 16604 - DNA, 25 bp, S. cerevisiae
aagccagactctcttggtatcacga

SEQ ID NO: 16605 - DNA, 25 bp, S. cerevisiae
aagcgcaaactactgtggcaatcac

SEQ ID NO: 16606 - DNA, 25 bp, S. cerevisiae
aaccaaacttcggagcagcagcaac

SEQ ID NO: 16607 - DNA, 25 bp, S. cerevisiae
aaccactgaggaactggcgcagcaa

SEQ ID NO: 16608 - DNA, 25 bp, S. cerevisiae
aagccacgtggcatctgaaatgtct

SEQ ID NO: 16609 - DNA, 25 bp, S. cerevisiae
aagccttctgccttttctgcaaaag

SEQ ID NO: 16610 - DNA, 25 bp, S. cerevisiae
aagcctgttctgaagttttcccagt

SEQ ID NO: 16611 - DNA, 25 bp, S. cerevisiae
aagcctgctgttacatctcaattgg

SEQ ID NO: 16612 - DNA, 25 bp, S. cerevisiae
aagcccttcgttatttgatggatct

SEQ ID NO: 16613 - DNA, 25 bp, S. cerevisiae
aagccagggctgtcaacaacaatat

SEQ ID NO: 16614 - DNA, 25 bp, S. cerevisiae
aagcgcagcaacacatacaagaaat

SEQ ID NO: 16615 - DNA, 25 bp, S. cerevisiae
aagctgcaggcactctatatgaata

SEQ ID NO: 16616 - DNA, 25 bp, S. cerevisiae
aagctggcttatcaagaattcgttg

SEQ ID NO: 16617 - DNA, 25 bp, S. cerevisiae
aagctgttacaactactttcgataa

SEQ ID NO: 16618 - DNA, 25 bp, S. cerevisiae
aagcgccttggacacacacacagaa

SEQ ID NO: 16619 - DNA, 25 bp, S. cerevisiae
aagcgccttgccaaacagtcaggaa

SEQ ID NO: 16620 - DNA, 25 bp, S. cerevisiae
aagcagcgggccgtaatagcgctaa

SEQ ID NO: 16621 - DNA, 25 bp, S. cerevisiae
aagccggtgccagagctgaagctga

SEQ ID NO: 16622 - DNA, 25 bp, S. cerevisiae
aagcctcgcccacttaaattggaga

SEQ ID NO: 16623 - DNA, 25 bp, S. cerevisiae
aagcctttcccggacatttggcagt

SEQ ID NO: 16624 - DNA, 25 bp, S. cerevisiae
aagcctacttcggtaattctgacgg

SEQ ID NO: 16625 - DNA, 25 bp, S. cerevisiae
aagccactcttcgttcatatcctga

SEQ ID NO: 16626 - DNA, 25 bp, S. cerevisiae
aagccaattgttatttgcactgaca

SEQ ID NO: 16627 - DNA, 25 bp, S. cerevisiae
aagccactatctaagaacgccgatg

SEQ ID NO: 16628 - DNA, 25 bp, S. cerevisiae
aaggttcgatagaggcaggcctaac

SEQ ID NO: 16629 - DNA, 25 bp, S. cerevisiae
aagctgttcttagtggtgcggttaa

SEQ ID NO: 16630 - DNA, 25 bp, S. cerevisiae
aagctttcagaaaggctgccggaaa

SEQ ID NO: 16631 - DNA, 25 bp, S. cerevisiae
aagcacttcgaattgggtggtgaaa

SEQ ID NO: 16632 - DNA, 25 bp, S. cerevisiae
aagctggcaagcgtttggctttcgt

SEQ ID NO: 16633 - DNA, 25 bp, S. cerevisiae
aagccagggttcattgctgacctac

SEQ ID NO: 16634 - DNA, 25 bp, S. cerevisiae
aagcctaattgtgggttatgcgatc

SEQ ID NO: 16635 - DNA, 25 bp, S. cerevisiae
aagccataatttttcgagcagggta

SEQ ID NO: 16636 - DNA, 25 bp, S. cerevisiae
aagctctaattcatttcagggtgtt

SEQ ID NO: 16637 - DNA, 25 bp, S. cerevisiae
aagccattattcaaagccgcaccag

SEQ ID NO: 16638 - DNA, 25 bp, S. cerevisiae
aagccttattggtgccaggtcacag

SEQ ID NO: 16639 - DNA, 25 bp, S. cerevisiae
aagctttatggtctcgagttcacgg

SEQ ID NO: 16640 - DNA, 25 bp, S. cerevisiae
aagcgtctttgtcagttggttccac

SEQ ID NO: 16641 - DNA, 25 bp, S. cerevisiae
aagctttgttttttcctcatttgat

SEQ ID NO: 16642 - DNA, 25 bp, S. cerevisiae
aagcgctggctctaaattcactact

SEQ ID NO: 16643 - DNA, 25 bp, S. cerevisiae
ttacctttcaaatatacgagccgtt

SEQ ID NO: 16644 - DNA, 25 bp, S. cerevisiae
aatcccttcaaacaaaccacgtgat

SEQ ID NO: 16645 - DNA, 25 bp, S. cerevisiae
aatcccttcagctaataacgtacgt

SEQ ID NO: 16646 - DNA, 25 bp, S. cerevisiae
aagccacttcagatgattccgatca

SEQ ID NO: 16647 - DNA, 25 bp, S. cerevisiae
aagccgctatcgagattcgcgacga

SEQ ID NO: 16648 - DNA, 25 bp, S. cerevisiae
aagctcggaggcagttcgtatccaa

SEQ ID NO: 16649 - DNA, 25 bp, S. cerevisiae
aagcgggaagccaaaagtctcttga

SEQ ID NO: 16650 - DNA, 25 bp, S. cerevisiae
aagcgaggaattgacgagtatctgg

SEQ ID NO: 16651 - DNA, 25 bp, S. cerevisiae
aagctcgatcctgacatgttgttgc

SEQ ID NO: 16652 - DNA, 25 bp, S. cerevisiae
aagccgaagctgaagcttggcattg

SEQ ID NO: 16653 - DNA, 25 bp, S. cerevisiae
aagccagttattttgcacaacgcaa

SEQ ID NO: 16654 - DNA, 25 bp, S. cerevisiae
aagccatttatttcttcagaccaat

SEQ ID NO: 16655 - DNA, 25 bp, S. cerevisiae
aagccattcaagatcttcgagcacg

SEQ ID NO: 16656 - DNA, 25 bp, S. cerevisiae
aagccttagacttctttagcagagg

SEQ ID NO: 16657 - DNA, 25 bp, S. cerevisiae
aagctttggacttcttcgccagagg

SEQ ID NO: 16658 - DNA, 25 bp, S. cerevisiae
aagctttggataagtacgccggcgg

SEQ ID NO: 16659 - DNA, 25 bp, S. cerevisiae
aagccatttgcacatattctctcgc

SEQ ID NO: 16660 - DNA, 25 bp, S. cerevisiae
aagctcttctccgattaacacacat

SEQ ID NO: 16661 - DNA, 25 bp, S. cerevisiae
aagcctcatttctttagcaagccac

SEQ ID NO: 16662 - DNA, 25 bp, S. cerevisiae
aagcgtccaaactagacccaagaag

SEQ ID NO: 16663 - DNA, 25 bp, S. cerevisiae
aagctctcaatatcaaacccacaaa

SEQ ID NO: 16664 - DNA, 25 bp, S. cerevisiae
aagcgcataatctgcagaatcctaa

SEQ ID NO: 16665 - DNA, 25 bp, S. cerevisiae
aagcctgattcaactgctgtgcgca

SEQ ID NO: 16666 - DNA, 25 bp, S. cerevisiae
aagcactgggctaggtacaccgatg

SEQ ID NO: 16667 - DNA, 25 bp, S. cerevisiae
aagcgagcgcactgaattctacaaa

SEQ ID NO: 16668 - DNA, 25 bp, S. cerevisiae
aagcgaacctgcagtctcatttgaa

SEQ ID NO: 16669 - DNA, 25 bp, S. cerevisiae
aagcggctgtgaaggccattgcctt

SEQ ID NO: 16670 - DNA, 25 bp, S. cerevisiae
aagctggttagctgctggcgcgtat

SEQ ID NO: 16671 - DNA, 25 bp, S. cerevisiae
aagcgcaaatgtgccaaaccttttt

SEQ ID NO: 16672 - DNA, 25 bp, S. cerevisiae
aagcagcctcgtcccaaagagacag

SEQ ID NO: 16673 - DNA, 25 bp, S. cerevisiae
aagcctgccgtgctcaagggattga

SEQ ID NO: 16674 - DNA, 25 bp, S. cerevisiae
aagcctgacttgctggtcgtattaa

SEQ ID NO: 16675 - DNA, 25 bp, S. cerevisiae
aagctgcaactttggcattctatgt

SEQ ID NO: 16676 - DNA, 25 bp, S. cerevisiae
aagccttttatcgagcaaatgcacg

SEQ ID NO: 16677 - DNA, 25 bp, S. cerevisiae
aagcctgttttccacaagaaagcta

SEQ ID NO: 16678 - DNA, 25 bp, S. cerevisiae
aagccttcttatcatgcgctgttga

SEQ ID NO: 16679 - DNA, 25 bp, S. cerevisiae
aagctcttcttctatagcgacttgt

SEQ ID NO: 16680 - DNA, 25 bp, S. cerevisiae
aagcttctcaagagcagctacgtta

SEQ ID NO: 16681 - DNA, 25 bp, S. cerevisiae
aagcttcctgaagatcgacgtgcag

SEQ ID NO: 16682 - DNA, 25 bp, S. cerevisiae
aagcattcggagacttcgacggaaa

SEQ ID NO: 16683 - DNA, 25 bp, S. cerevisiae
aagcgacgacgaagatctgccacaa

SEQ ID NO: 16684 - DNA, 25 bp, S. cerevisiae
aagcgcctgaggactgttcaagcaa

SEQ ID NO: 16685 - DNA, 25 bp, S. cerevisiae
aagcctcaacatactctgtcataca

SEQ ID NO: 16686 - DNA, 25 bp, S. cerevisiae
aagcctgaatcaagtctctacctgg

SEQ ID NO: 16687 - DNA, 25 bp, S. cerevisiae
aagctgcttatgatggtgccgaaaa

SEQ ID NO: 16688 - DNA, 25 bp, S. cerevisiae
aagccgccaatcgttgttgtcacaa

SEQ ID NO: 16689 - DNA, 25 bp, S. cerevisiae
aagctctccaccgttgttttgagac

SEQ ID NO: 16690 - DNA, 25 bp, S. cerevisiae
aagcttccctggtgtgttcttgaaa

SEQ ID NO: 16691 - DNA, 25 bp, S. cerevisiae
aagctcgcccatgacttttgggaga

SEQ ID NO: 16692 - DNA, 25 bp, S. cerevisiae
caaacgcctttatcccaattgcaaa

SEQ ID NO: 16693 - DNA, 25 bp, S. cerevisiae
aagaccgtatctattccaaggaaat

SEQ ID NO: 16694 - DNA, 25 bp, S. cerevisiae
gaaagtgtatttgaaccagggacct

SEQ ID NO: 16695 - DNA, 25 bp, S. cerevisiae
aagctctgttcccttatgttggtac

SEQ ID NO: 16696 - DNA, 25 bp, S. cerevisiae
aagcgattccttacaggttgacgaa

SEQ ID NO: 16697 - DNA, 25 bp, S. cerevisiae
aagctgttcgcacaagggtacgtac

SEQ ID NO: 16698 - DNA, 25 bp, S. cerevisiae
aagctggcacgcctaaagtctactt

SEQ ID NO: 16699 - DNA, 25 bp, S. cerevisiae
aagctgtcttttttggatctcacac

SEQ ID NO: 16700 - DNA, 25 bp, S. cerevisiae
aagcctattcttcatcgtcagcaac

SEQ ID NO: 16701 - DNA, 25 bp, S. cerevisiae
aagcgctactattgttactcctact

SEQ ID NO: 16702 - DNA, 25 bp, S. cerevisiae
aagctgcccatgtgttaattgtcta

SEQ ID NO: 16703 - DNA, 25 bp, S. cerevisiae
aagccctgaaagctcacaatggtga

SEQ ID NO: 16704 - DNA, 25 bp, S. cerevisiae
aagacgtaccagttgccaagcgtag

SEQ ID NO: 16705 - DNA, 25 bp, S. cerevisiae
aagccgtttatgttccagccgatga

SEQ ID NO: 16706 - DNA, 25 bp, S. cerevisiae
aagctcgtggcgtaggaaccggcaa

SEQ ID NO: 16707 - DNA, 25 bp, S. cerevisiae
aagccgactacattggcaattataa

SEQ ID NO: 16708 - DNA, 25 bp, S. cerevisiae
aagccgttaatcttcacttgaacac

SEQ ID NO: 16709 - DNA, 25 bp, S. cerevisiae
aagccgttacacgtacacgcagaga

SEQ ID NO: 16710 - DNA, 25 bp, S. cerevisiae
aagcgcttataacctgaccgacgaa

SEQ ID NO: 16711 - DNA, 25 bp, S. cerevisiae
aagcgttgatagcactacggcacaa

SEQ ID NO: 16712 - DNA, 25 bp, S. cerevisiae
aagcttaagatgcaatacgacacca

SEQ ID NO: 16713 - DNA, 25 bp, S. cerevisiae
aagctgatgctgacttctaagccag

SEQ ID NO: 16714 - DNA, 25 bp, S. cerevisiae
aagttgggactatccattgcagaag

SEQ ID NO: 16715 - DNA, 25 bp, S. cerevisiae
aagctcttggacaccactagagagg

SEQ ID NO: 16716 - DNA, 25 bp, S. cerevisiae
aagcgctactgtacctaccaaaggt

SEQ ID NO: 16717 - DNA, 25 bp, S. cerevisiae
aagcgatttgcttccacagggtcat

SEQ ID NO: 16718 - DNA, 25 bp, S. cerevisiae
aagcgtaatctctactcctggtaac

SEQ ID NO: 16719 - DNA, 25 bp, S. cerevisiae
aagcggtactctaccatctggtata

SEQ ID NO: 16720 - DNA, 25 bp, S. cerevisiae
aagccggacttaatcattgccattg

SEQ ID NO: 16721 - DNA, 25 bp, S. cerevisiae
aagcctgttcttaatgcttccactg

SEQ ID NO: 16722 - DNA, 25 bp, S. cerevisiae
aagcgtccctgtcattagttcatat

SEQ ID NO: 16723 - DNA, 25 bp, S. cerevisiae
aagcttgcccgttgtgtatgttttc

SEQ ID NO: 16724 - DNA, 25 bp, S. cerevisiae
aagcgtgctggtgcttttgggctca

SEQ ID NO: 16725 - DNA, 25 bp, S. cerevisiae
aatctaagttacctgatacaagaac

SEQ ID NO: 16726 - DNA, 25 bp, S. cerevisiae
aagcgctagcgcaaatgcccatcat

SEQ ID NO: 16727 - DNA, 25 bp, S. cerevisiae
aagcgctagtgcaaaggaagttatc

SEQ ID NO: 16728 - DNA, 25 bp, S. cerevisiae
aagcgtttgctcaaggcggatttgc

SEQ ID NO: 16729 - DNA, 25 bp, S. cerevisiae
aagctattgtctacagcggcaagtg

SEQ ID NO: 16730 - DNA, 25 bp, S. cerevisiae
aagcattactttagccgaacgtcaa

SEQ ID NO: 16731 - DNA, 25 bp, S. cerevisiae
ctagtgaagtcttaccccacaggta

SEQ ID NO: 16732 - DNA, 25 bp, S. cerevisiae
aagcttattgactcgttacctggtg

SEQ ID NO: 16733 - DNA, 25 bp, S. cerevisiae
aagctttctagcaataccatgtaca

SEQ ID NO: 16734 - DNA, 25 bp, S. cerevisiae
aagcttgtcgtgctaccaaatcatg

SEQ ID NO: 16735 - DNA, 25 bp, S. cerevisiae
aagctagggtagaacaacgattgtc

SEQ ID NO: 16736 - DNA, 25 bp, S. cerevisiae
aagcggcgatgcaagtgaaaccaat

SEQ ID NO: 16737 - DNA, 25 bp, S. cerevisiae
aagcggcgcagacttgttagtaaca

SEQ ID NO: 16738 - DNA, 25 bp, S. cerevisiae
aagcgttgtgttgctgtgtttcaaa

SEQ ID NO: 16739 - DNA, 25 bp, S. cerevisiae
aagcgtgttgttagccttattatga

SEQ ID NO: 16740 - DNA, 25 bp, S. cerevisiae
aagccgcattgtacaggttatctgg

SEQ ID NO: 16741 - DNA, 25 bp, S. cerevisiae
aagcagactggtacgtcgcgtttcg

SEQ ID NO: 16742 - DNA, 25 bp, S. cerevisiae
aagcaagcggaacatctttgtcaga

SEQ ID NO: 16743 - DNA, 25 bp, S. cerevisiae
aagactcagtagctattaaaccaat

SEQ ID NO: 16744 - DNA, 25 bp, S. cerevisiae
aagaccgggcaatttaacgctcagg

SEQ ID NO: 16745 - DNA, 25 bp, S. cerevisiae
aaggagggacattttgacaagttga

SEQ ID NO: 16746 - DNA, 25 bp, S. cerevisiae
aagctgatgggattttttcacaaaa

SEQ ID NO: 16747 - DNA, 25 bp, S. cerevisiae
aagctagcggtattatgccatctaa

SEQ ID NO: 16748 - DNA, 25 bp, S. cerevisiae
aagctgaaggtaatgatgccgctca

SEQ ID NO: 16749 - DNA, 25 bp, S. cerevisiae
aagacaaggctatgtcgccgttcac

SEQ ID NO: 16750 - DNA, 25 bp, S. cerevisiae
aagaacaaatggctcggcgtttcct

SEQ ID NO: 16751 - DNA, 25 bp, S. cerevisiae
aagcacgaaaggctgctgccgtatt

SEQ ID NO: 16752 - DNA, 25 bp, S. cerevisiae
aaggctagaagacccaatggatttt

SEQ ID NO: 16753 - DNA, 25 bp, S. cerevisiae
aagctgctgagagaggcctttttct

SEQ ID NO: 16754 - DNA, 25 bp, S. cerevisiae
aagcattgagtaagcacccctttct

SEQ ID NO: 16755 - DNA, 25 bp, S. cerevisiae
aagctataacaggtttcccactcga

SEQ ID NO: 16756 - DNA, 25 bp, S. cerevisiae
aagtttcaaaataacctcgctcaag

SEQ ID NO: 16757 - DNA, 25 bp, S. cerevisiae
aagctactttaacaccatcctcaag

SEQ ID NO: 16758 - DNA, 25 bp, S. cerevisiae
aagctactttagacaatcccgacga

SEQ ID NO: 16759 - DNA, 25 bp, S. cerevisiae
aagggagctccaactgggttgacga

SEQ ID NO: 16760 - DNA, 25 bp, S. cerevisiae
aagctctacaagtggcctgccagaa

SEQ ID NO: 16761 - DNA, 25 bp, S. cerevisiae
aagagctaaagctgccattcggcaa

SEQ ID NO: 16762 - DNA, 25 bp, S. cerevisiae
aagcagcatcattagaggcctctag

SEQ ID NO: 16763 - DNA, 25 bp, S. cerevisiae
aagctgataccagggcatgctctca

SEQ ID NO: 16764 - DNA, 25 bp, S. cerevisiae
aagaaacagacagcttctcctttgt

SEQ ID NO: 16765 - DNA, 25 bp, S. cerevisiae
aatgcaagaaactcatctactttta

SEQ ID NO: 16766 - DNA, 25 bp, S. cerevisiae
aagaaggcaaccgactacgttctag

SEQ ID NO: 16767 - DNA, 25 bp, S. cerevisiae
aagaaggcggtgcagtacctctttc

SEQ ID NO: 16768 - DNA, 25 bp, S. cerevisiae
caagcaaggccccaaaattccattt

SEQ ID NO: 16769 - DNA, 25 bp, S. cerevisiae
aagctgcaactttgggataccgctg

SEQ ID NO: 16770 - DNA, 25 bp, S. cerevisiae
aagcaggacttagcgctaccgcata

SEQ ID NO: 16771 - DNA, 25 bp, S. cerevisiae
aagctggacttgaaggacacgccta

SEQ ID NO: 16772 - DNA, 25 bp, S. cerevisiae
aagcttttgctttcgatcctttgat

SEQ ID NO: 16773 - DNA, 25 bp, S. cerevisiae
aagcattggtccgtagcaggcgaat

SEQ ID NO: 16774 - DNA, 25 bp, S. cerevisiae
aagcttggtctggtaactggtccca

SEQ ID NO: 16775 - DNA, 25 bp, S. cerevisiae
aagctggtggctttgaacgttccta

SEQ ID NO: 16776 - DNA, 25 bp, S. cerevisiae
aagctttactgggtcaactactgaa

SEQ ID NO: 16777 - DNA, 25 bp, S. cerevisiae
aagctaaccagcgtttgacacggaa

SEQ ID NO: 16778 - DNA, 25 bp, S. cerevisiae
aagctgatacaaacgactacctaga

SEQ ID NO: 16779 - DNA, 25 bp, S. cerevisiae
aagctatatcacatccgttcctaaa

SEQ ID NO: 16780 - DNA, 25 bp, S. cerevisiae
aagcgtcttttcattgtgcacggaa

SEQ ID NO: 16781 - DNA, 25 bp, S. cerevisiae
aagcgcgtatatagcatctgtcact

SEQ ID NO: 16782 - DNA, 25 bp, S. cerevisiae
aagcagcagtattccatcatctaga

SEQ ID NO: 16783 - DNA, 25 bp, S. cerevisiae
aagcgttagacaccattccaatgac

SEQ ID NO: 16784 - DNA, 25 bp, S. cerevisiae
aagcgctctcaacgaatatgccaag

SEQ ID NO: 16785 - DNA, 25 bp, S. cerevisiae
aagagttaaggccaatgctgctaag

SEQ ID NO: 16786 - DNA, 25 bp, S. cerevisiae
aagctgtgaagttaccgcgtggtga

SEQ ID NO: 16787 - DNA, 25 bp, S. cerevisiae
aagggcacgtcgaccatcagtggga

SEQ ID NO: 16788 - DNA, 25 bp, S. cerevisiae
aagcgccaaacgactctgtgggtga

SEQ ID NO: 16789 - DNA, 25 bp, S. cerevisiae
aagcattaaccatggctaagggcaa

SEQ ID NO: 16790 - DNA, 25 bp, S. cerevisiae
aagctttacaactgccacgtgtgga

SEQ ID NO: 16791 - DNA, 25 bp, S. cerevisiae
aagctattacttctgctggctctgg

SEQ ID NO: 16792 - DNA, 25 bp, S. cerevisiae
aagctgaagtttcttccatgcctac

SEQ ID NO: 16793 - DNA, 25 bp, S. cerevisiae
aagtacaacataatccgtccctttg

SEQ ID NO: 16794 - DNA, 25 bp, S. cerevisiae
aagctgacaaggacaccgtcaccaa

SEQ ID NO: 16795 - DNA, 25 bp, S. cerevisiae
aagcttcagcttgctcatgagcagg

SEQ ID NO: 16796 - DNA, 25 bp, S. cerevisiae
aagctatcagtatttggcgcatgta

SEQ ID NO: 16797 - DNA, 25 bp, S. cerevisiae
aagctgtcgatgtttctccattgag

SEQ ID NO: 16798 - DNA, 25 bp, S. cerevisiae
aagctgaagatgtaccccgatggag

SEQ ID NO: 16799 - DNA, 25 bp, S. cerevisiae
aagcgatgagcatttctcccgtgta

SEQ ID NO: 16800 - DNA, 25 bp, S. cerevisiae
aagcttctctatacagtctctgcat

SEQ ID NO: 16801 - DNA, 25 bp, S. cerevisiae
aagcagaggctccaaacactcatga

SEQ ID NO: 16802 - DNA, 25 bp, S. cerevisiae
catcagcaccggcagacaatctaat

SEQ ID NO: 16803 - DNA, 25 bp, S. cerevisiae
aagctcacggtactcaatgttgcat

SEQ ID NO: 16804 - DNA, 25 bp, S. cerevisiae
aagctaatctctacaccatttgctg

SEQ ID NO: 16805 - DNA, 25 bp, S. cerevisiae
aagctgcttcttacatccatctatc

SEQ ID NO: 16806 - DNA, 25 bp, S. cerevisiae
aagcgttctggattctttatcgtta

SEQ ID NO: 16807 - DNA, 25 bp, S. cerevisiae
aagctttcgagtcattcttgtgatg

SEQ ID NO: 16808 - DNA, 25 bp, S. cerevisiae
aagctgtcactgctatttccataca

SEQ ID NO: 16809 - DNA, 25 bp, S. cerevisiae
aagcggcccatcaaaggtgcctcaa

SEQ ID NO: 16810 - DNA, 25 bp, S. cerevisiae
aagggctccagcatgggcggctttt

SEQ ID NO: 16811 - DNA, 25 bp, S. cerevisiae
aagcggatccgcacaggcaactact

SEQ ID NO: 16812 - DNA, 25 bp, S. cerevisiae
aagcgaaatcactcggcagctttct

SEQ ID NO: 16813 - DNA, 25 bp, S. cerevisiae
aagctaacacactcggcacaatttt

SEQ ID NO: 16814 - DNA, 25 bp, S. cerevisiae
aagcatgtatgaatctccggcacaa

SEQ ID NO: 16815 - DNA, 25 bp, S. cerevisiae
aagctacccttgactgacgagcaaa

SEQ ID NO: 16816 - DNA, 25 bp, S. cerevisiae
aagctggcgccttgattcctgaaaa

SEQ ID NO: 16817 - DNA, 25 bp, S. cerevisiae
aagctcgtccgttttgcgatggaaa

SEQ ID NO: 16818 - DNA, 25 bp, S. cerevisiae
aagctccgctgattatccgtggaaa

SEQ ID NO: 16819 - DNA, 25 bp, S. cerevisiae
aagctcgtgaaccaaggctggccta

SEQ ID NO: 16820 - DNA, 25 bp, S. cerevisiae
aagctgaatcaagcactcttcgacc

SEQ ID NO: 16821 - DNA, 25 bp, S. cerevisiae
aagctgtataaaacgcccattccca

SEQ ID NO: 16822 - DNA, 25 bp, S. cerevisiae
aagctcagcatttaactccgagtga

SEQ ID NO: 16823 - DNA, 25 bp, S. cerevisiae
aagctagatgcagactcacctgaga

SEQ ID NO: 16824 - DNA, 25 bp, S. cerevisiae
aagcatagtagctcgattcgacccc

SEQ ID NO: 16825 - DNA, 25 bp, S. cerevisiae
aagcaggttctgagatttgccaccc

SEQ ID NO: 16826 - DNA, 25 bp, S. cerevisiae
aagcaggtgactctttacccttgac

SEQ ID NO: 16827 - DNA, 25 bp, S. cerevisiae
aagcggatgacgtttctgttgctcc

SEQ ID NO: 16828 - DNA, 25 bp, S. cerevisiae
aagcgatgatgctagttctttctca

SEQ ID NO: 16829 - DNA, 25 bp, S. cerevisiae
aagcaaattttcactcatcctaaag

SEQ ID NO: 16830 - DNA, 25 bp, S. cerevisiae
aagttgcctaaaccatggtcaccca

SEQ ID NO: 16831 - DNA, 25 bp, S. cerevisiae
aagaattggaatcgccagggtccca

SEQ ID NO: 16832 - DNA, 25 bp, S. cerevisiae
aagaggtacgttcatggcgtcccaa

SEQ ID NO: 16833 - DNA, 25 bp, S. cerevisiae
aagctgtttctttggtcgactgtta

SEQ ID NO: 16834 - DNA, 25 bp, S. cerevisiae
aagacagcagcaaagccaaccctta

SEQ ID NO: 16835 - DNA, 25 bp, S. cerevisiae
aagctcgcgacttacagagtgctct

SEQ ID NO: 16836 - DNA, 25 bp, S. cerevisiae
aagctactaccagctagtgccagaa

SEQ ID NO: 16837 - DNA, 25 bp, S. cerevisiae
aagcatgcgagaggccctgggttca

SEQ ID NO: 16838 - DNA, 25 bp, S. cerevisiae
aagctgctgatagggcacatcgtgt

SEQ ID NO: 16839 - DNA, 25 bp, S. cerevisiae
aagcatgctgtctctgaaggtacta

SEQ ID NO: 16840 - DNA, 25 bp, S. cerevisiae
aagcatgtgttctagatctggtatt

SEQ ID NO: 16841 - DNA, 25 bp, S. cerevisiae
aagctcgtcacaagcatcatggata

SEQ ID NO: 16842 - DNA, 25 bp, S. cerevisiae
aagcagcaatcctctgggtccaaag

SEQ ID NO: 16843 - DNA, 25 bp, S. cerevisiae
gaagcacatagagcgtccggacggt

SEQ ID NO: 16844 - DNA, 25 bp, S. cerevisiae
aagcactctaccaaaggcgaccgtt

SEQ ID NO: 16845 - DNA, 25 bp, S. cerevisiae
aagcaactgaacgtcgaggccacca

SEQ ID NO: 16846 - DNA, 25 bp, S. cerevisiae
aagcaatacggaaccttcgcaaggc

SEQ ID NO: 16847 - DNA, 25 bp, S. cerevisiae
aagcattaccgctgttctcaaattg

SEQ ID NO: 16848 - DNA, 25 bp, S. cerevisiae
aagcttttgggtgatctggtcagtc

SEQ ID NO: 16849 - DNA, 25 bp, S. cerevisiae
aagcttttcttagattcaatcaccg

SEQ ID NO: 16850 - DNA, 25 bp, S. cerevisiae
aagcttggctttttctggtgatggt

SEQ ID NO: 16851 - DNA, 25 bp, S. cerevisiae
aagcggcctggtaatattgcataaa

SEQ ID NO: 16852 - DNA, 25 bp, S. cerevisiae
aagcgtgcttctccatcaaaaaatg

SEQ ID NO: 16853 - DNA, 25 bp, S. cerevisiae
aagcaggttcatccatctagacaag

SEQ ID NO: 16854 - DNA, 25 bp, S. cerevisiae
aagcagccttccatacgaatcgaaa

SEQ ID NO: 16855 - DNA, 25 bp, S. cerevisiae
aagctgctgcttcatatttagccaa

SEQ ID NO: 16856 - DNA, 25 bp, S. cerevisiae
aagcggcttgctatggaacaggaaa

SEQ ID NO: 16857 - DNA, 25 bp, S. cerevisiae
aagcagagctttctagaaggtaaac

SEQ ID NO: 16858 - DNA, 25 bp, S. cerevisiae
aagcgggtccagtacagttatcaaa

SEQ ID NO: 16859 - DNA, 25 bp, S. cerevisiae
aagcggcctccaccgaggaatacaa

SEQ ID NO: 16860 - DNA, 25 bp, S. cerevisiae
aagctgcccttcctggccaaaaaag

SEQ ID NO: 16861 - DNA, 25 bp, S. cerevisiae
aagctgctcgtatctgtgccaacaa

SEQ ID NO: 16862 - DNA, 25 bp, S. cerevisiae
aagctcatagttttgccattacaga

SEQ ID NO: 16863 - DNA, 25 bp, S. cerevisiae
aagcattgtctttgattattgacga

SEQ ID NO: 16864 - DNA, 25 bp, S. cerevisiae
aagctttttgcaactaacacaagtg

SEQ ID NO: 16865 - DNA, 25 bp, S. cerevisiae
aagctttcttgcactggtatactag

SEQ ID NO: 16866 - DNA, 25 bp, S. cerevisiae
aagcactccgacctttctgatgagt

SEQ ID NO: 16867 - DNA, 25 bp, S. cerevisiae
aagctgctcttgtagtatacgacgt

SEQ ID NO: 16868 - DNA, 25 bp, S. cerevisiae
aagctgcagttattgttccatttga

SEQ ID NO: 16869 - DNA, 25 bp, S. cerevisiae
aagctgctggtatcttctatttcag

SEQ ID NO: 16870 - DNA, 25 bp, S. cerevisiae
aagctgctggtgatttgtctttccc

SEQ ID NO: 16871 - DNA, 25 bp, S. cerevisiae
aagctcggtctttcactgtcgtgat

SEQ ID NO: 16872 - DNA, 25 bp, S. cerevisiae
aagcaaggtgttttgttgccaacta

SEQ ID NO: 16873 - DNA, 25 bp, S. cerevisiae
aagagggtacggacttggccatcga

SEQ ID NO: 16874 - DNA, 25 bp, S. cerevisiae
aagcagggtatgtcaggcttacctc

SEQ ID NO: 16875 - DNA, 25 bp, S. cerevisiae
aagacaagtcactgctagctatcct

SEQ ID NO: 16876 - DNA, 25 bp, S. cerevisiae
aagactaatgtctcgaccattcggg

SEQ ID NO: 16877 - DNA, 25 bp, S. cerevisiae
aagacgtttcaagggccattgccgg

SEQ ID NO: 16878 - DNA, 25 bp, S. cerevisiae
caaagtctactttcccaaggccagg

SEQ ID NO: 16879 - DNA, 25 bp, S. cerevisiae
aagaagtcactttccctcggtagtg

SEQ ID NO: 16880 - DNA, 25 bp, S. cerevisiae
aagacttctttcttccaagctttgg

SEQ ID NO: 16881 - DNA, 25 bp, S. cerevisiae
aagctatcgcttacttgccaaacta

SEQ ID NO: 16882 - DNA, 25 bp, S. cerevisiae
aagctatcatgccacgttctaaact

SEQ ID NO: 16883 - DNA, 25 bp, S. cerevisiae
aagcattgcaagctgaactcgctga

SEQ ID NO: 16884 - DNA, 25 bp, S. cerevisiae
aagcattgcggcctgaagttcgaga

SEQ ID NO: 16885 - DNA, 25 bp, S. cerevisiae
aattagacccagaggcggattcgtt

SEQ ID NO: 16886 - DNA, 25 bp, S. cerevisiae
aagaggttcaacagtcaggtacgtt

SEQ ID NO: 16887 - DNA, 25 bp, S. cerevisiae
aagcattttactcggatctggtcac

SEQ ID NO: 16888 - DNA, 25 bp, S. cerevisiae
aagcttattttgctgagctgggcaa

SEQ ID NO: 16889 - DNA, 25 bp, S. cerevisiae
aagcagctggatagagcctcatcgt

SEQ ID NO: 16890 - DNA, 25 bp, S. cerevisiae
aatggcatgcagttgctgccttgtg

SEQ ID NO: 16891 - DNA, 25 bp, S. cerevisiae
aagctgccaattgccttgtctggtt

SEQ ID NO: 16892 - DNA, 25 bp, S. cerevisiae
aagtcaagaccaccgatttataaat

SEQ ID NO: 16893 - DNA, 25 bp, S. cerevisiae
aagatgcaagcactcccggtaaaga

SEQ ID NO: 16894 - DNA, 25 bp, S. cerevisiae
aagacgggcacttcatgcttactaa

SEQ ID NO: 16895 - DNA, 25 bp, S. cerevisiae
aagaatgaagtttccgctatgccaa

SEQ ID NO: 16896 - DNA, 25 bp, S. cerevisiae
aagtttccactacttcaatctccat

SEQ ID NO: 16897 - DNA, 25 bp, S. cerevisiae
aagctttccaaagatgacctgacat

SEQ ID NO: 16898 - DNA, 25 bp, S. cerevisiae
aagctgctgttgtcggtattccaga

SEQ ID NO: 16899 - DNA, 25 bp, S. cerevisiae
aagctcatccggtttattgtctaca

SEQ ID NO: 16900 - DNA, 25 bp, S. cerevisiae
aagctttcttcattgttgaactcga

SEQ ID NO: 16901 - DNA, 25 bp, S. cerevisiae
aagcttgccttgcagttgaactcta

SEQ ID NO: 16902 - DNA, 25 bp, S. cerevisiae
aagctttattgggtgtgccgtatac

SEQ ID NO: 16903 - DNA, 25 bp, S. cerevisiae
aagctgtgtttgacgttcctcaata

SEQ ID NO: 16904 - DNA, 25 bp, S. cerevisiae
aagatgtgtcggtccattgccgaat

SEQ ID NO: 16905 - DNA, 25 bp, S. cerevisiae
aagcacgcaggttccggtcaagaag

SEQ ID NO: 16906 - DNA, 25 bp, S. cerevisiae
aagcaatggcgttcaggacgatggt

SEQ ID NO: 16907 - DNA, 25 bp, S. cerevisiae
aagaccgtgtgcaggacgtgcagtt

SEQ ID NO: 16908 - DNA, 25 bp, S. cerevisiae
aagaccgtgaattcgtgccttgttc

SEQ ID NO: 16909 - DNA, 25 bp, S. cerevisiae
aagaagagttcgtcagtgccactga

SEQ ID NO: 16910 - DNA, 25 bp, S. cerevisiae
aagaacagtatttgggccctgccgt

SEQ ID NO: 16911 - DNA, 25 bp, S. cerevisiae
aagctaatgttttggcctcttcaag

SEQ ID NO: 16912 - DNA, 25 bp, S. cerevisiae
aagcttgctcgatccttaactggaa

SEQ ID NO: 16913 - DNA, 25 bp, S. cerevisiae
aagctttcttgaacactttctcgaa

SEQ ID NO: 16914 - DNA, 25 bp, S. cerevisiae
aagctccttggatttctttcgatga

SEQ ID NO: 16915 - DNA, 25 bp, S. cerevisiae
aagcttttgcgcttgatcctttgat

SEQ ID NO: 16916 - DNA, 25 bp, S. cerevisiae
aagctatatctcagtgtcacttttc

SEQ ID NO: 16917 - DNA, 25 bp, S. cerevisiae
aagaatatactccttcaggcttttt

SEQ ID NO: 16918 - DNA, 25 bp, S. cerevisiae
aagaattcttacacggttactgagg

SEQ ID NO: 16919 - DNA, 25 bp, S. cerevisiae
aagacaagggcctccgtatcaaagg

SEQ ID NO: 16920 - DNA, 25 bp, S. cerevisiae
aagacgcagtggcactcgaggacaa

SEQ ID NO: 16921 - DNA, 25 bp, S. cerevisiae
aagcaggttctggtacaccgagaga

SEQ ID NO: 16922 - DNA, 25 bp, S. cerevisiae
aagcatcatcactctcgaatgccag

SEQ ID NO: 16923 - DNA, 25 bp, S. cerevisiae
aagctgagctcgataaggtctgtga

SEQ ID NO: 16924 - DNA, 25 bp, S. cerevisiae
aagcttgtctcaatcaagtgccgat

SEQ ID NO: 16925 - DNA, 25 bp, S. cerevisiae
aagcagctgttattccacattggtg

SEQ ID NO: 16926 - DNA, 25 bp, S. cerevisiae
aagttcggtggcctgatcattcaga

SEQ ID NO: 16927 - DNA, 25 bp, S. cerevisiae
aagcatacaaatccctgaagccaag

SEQ ID NO: 16928 - DNA, 25 bp, S. cerevisiae
aagcatttgacgatcttcgcgacag

SEQ ID NO: 16929 - DNA, 25 bp, S. cerevisiae
aagcttgatcaacctttggcagaag

SEQ ID NO: 16930 - DNA, 25 bp, S. cerevisiae
aagctgcccacactgcttatagtga

SEQ ID NO: 16931 - DNA, 25 bp, S. cerevisiae
aagcagcccaagattgtcagcattg

SEQ ID NO: 16932 - DNA, 25 bp, S. cerevisiae
aagcttcccgttttgcagattggat

SEQ ID NO: 16933 - DNA, 25 bp, S. cerevisiae
aagttccggtgatgacgatcttgat

SEQ ID NO: 16934 - DNA, 25 bp, S. cerevisiae
aagttccaggcgctactatcttgag

SEQ ID NO: 16935 - DNA, 25 bp, S. cerevisiae
aattaccgaggtcactacagaggaa

SEQ ID NO: 16936 - DNA, 25 bp, S. cerevisiae
aagcaaacctgttaagccaacaaat

SEQ ID NO: 16937 - DNA, 25 bp, S. cerevisiae
aagcaggtggccctctcagaaatag

SEQ ID NO: 16938 - DNA, 25 bp, S. cerevisiae
aagcatggtgccgttcacatgtcca

SEQ ID NO: 16939 - DNA, 25 bp, S. cerevisiae
aagaggtccagttccagtacaccgt

SEQ ID NO: 16940 - DNA, 25 bp, S. cerevisiae
aagaatggcacaaaccgcaacccag

SEQ ID NO: 16941 - DNA, 25 bp, S. cerevisiae
caagaatcccatgccctaagactag

SEQ ID NO: 16942 - DNA, 25 bp, S. cerevisiae
aagaatattgcagacgtaatgacca

SEQ ID NO: 16943 - DNA, 25 bp, S. cerevisiae
aagcttttgctggaagttatcaccc

SEQ ID NO: 16944 - DNA, 25 bp, S. cerevisiae
aagcacataattgggccgatcgtca

SEQ ID NO: 16945 - DNA, 25 bp, S. cerevisiae
aagcatgccctacacggcactgcta

SEQ ID NO: 16946 - DNA, 25 bp, S. cerevisiae
aagcattcgctatcgcaagccatta

SEQ ID NO: 16947 - DNA, 25 bp, S. cerevisiae
aagcttcctcccgtgacaatgatgt

SEQ ID NO: 16948 - DNA, 25 bp, S. cerevisiae
aagcacttaccgagcaagccgttat

SEQ ID NO: 16949 - DNA, 25 bp, S. cerevisiae
aataatgtcgtgagcctatacccca

SEQ ID NO: 16950 - DNA, 25 bp, S. cerevisiae
aagaagacggtgcactgtacccaca

SEQ ID NO: 16951 - DNA, 25 bp, S. cerevisiae
aagaagtcgggttggcatcaccctc

SEQ ID NO: 16952 - DNA, 25 bp, S. cerevisiae
aagcaatccactcatgtattcttcc

SEQ ID NO: 16953 - DNA, 25 bp, S. cerevisiae
aagcagtgtccaaatgttctcgtag

SEQ ID NO: 16954 - DNA, 25 bp, S. cerevisiae
aagcaggatccaaaattataccagt

SEQ ID NO: 16955 - DNA, 25 bp, S. cerevisiae
aagcagttcacttgtatttcccaat

SEQ ID NO: 16956 - DNA, 25 bp, S. cerevisiae
aagcagagctacagtcatcttcctt

SEQ ID NO: 16957 - DNA, 25 bp, S. cerevisiae
aagaatctgaatgatctcgctcgat

SEQ ID NO: 16958 - DNA, 25 bp, S. cerevisiae
aagcatatttattcctaccagttca

SEQ ID NO: 16959 - DNA, 25 bp, S. cerevisiae
aagcatatgggtgcccttgcgtaca

SEQ ID NO: 16960 - DNA, 25 bp, S. cerevisiae
aagaataggctccttatccgtacca

SEQ ID NO: 16961 - DNA, 25 bp, S. cerevisiae
aagcaccgcttgataatccaactgt

SEQ ID NO: 16962 - DNA, 25 bp, S. cerevisiae
aagacttggcaagatccagcgacca

SEQ ID NO: 16963 - DNA, 25 bp, S. cerevisiae
aagcacaattcgttttctgaatcga

SEQ ID NO: 16964 - DNA, 25 bp, S. cerevisiae
aagcactttcgctgtctcgaatagc

SEQ ID NO: 16965 - DNA, 25 bp, S. cerevisiae
aagagctcagttctgtgcccaattg

SEQ ID NO: 16966 - DNA, 25 bp, S. cerevisiae
aagaatagttgcctgtgccgtcttg

SEQ ID NO: 16967 - DNA, 25 bp, S. cerevisiae
aagcaattcttccttgacgatgtcg

SEQ ID NO: 16968 - DNA, 25 bp, S. cerevisiae
aagaggaagttttttgccattgcag

SEQ ID NO: 16969 - DNA, 25 bp, S. cerevisiae
aagcttcaggaatcaccgcaggtgc

SEQ ID NO: 16970 - DNA, 25 bp, S. cerevisiae
aagaattgttagtcgcatacgccag

SEQ ID NO: 16971 - DNA, 25 bp, S. cerevisiae
aagctaagttgactgctgctaccaa

SEQ ID NO: 16972 - DNA, 25 bp, S. cerevisiae
aagcagatcgcttacattgccgcat

SEQ ID NO: 16973 - DNA, 25 bp, S. cerevisiae
aagcaacttgcttacggtgaagatg

SEQ ID NO: 16974 - DNA, 25 bp, S. cerevisiae
aagcaaggcttctactggtgacaat

SEQ ID NO: 16975 - DNA, 25 bp, S. cerevisiae
aagcaacgcatattggcctggacca

SEQ ID NO: 16976 - DNA, 25 bp, S. cerevisiae
aagacagaagattcggcaggaacgt

SEQ ID NO: 16977 - DNA, 25 bp, S. cerevisiae
aagacagcaagaatggcgcctccac

SEQ ID NO: 16978 - DNA, 25 bp, S. cerevisiae
aagaagggccaaaccgctgctggtg

SEQ ID NO: 16979 - DNA, 25 bp, S. cerevisiae
aagaagggccaacctgtagccgtat

SEQ ID NO: 16980 - DNA, 25 bp, S. cerevisiae
aagaagattccctcgctagacagga

SEQ ID NO: 16981 - DNA, 25 bp, S. cerevisiae
aagataaacgcctccgaacttgcaa

SEQ ID NO: 16982 - DNA, 25 bp, S. cerevisiae
aagaagtcttcgaagatcacgattt

SEQ ID NO: 16983 - DNA, 25 bp, S. cerevisiae
aagcaaaactgctggcaacgccggt

SEQ ID NO: 16984 - DNA, 25 bp, S. cerevisiae
aagcaaggacttcagcagcgtatca

SEQ ID NO: 16985 - DNA, 25 bp, S. cerevisiae
aagcaacggcttctgtggatatgga

SEQ ID NO: 16986 - DNA, 25 bp, S. cerevisiae
aagcagttgctttctcctatgggaa

SEQ ID NO: 16987 - DNA, 25 bp, S. cerevisiae
aagacttgctgtttcgtcgggatga

SEQ ID NO: 16988 - DNA, 25 bp, S. cerevisiae
aagaccatggagtggcccggtgatt

SEQ ID NO: 16989 - DNA, 25 bp, S. cerevisiae
aagaacattgatagtcccgtgaccg

SEQ ID NO: 16990 - DNA, 25 bp, S. cerevisiae
aagaactgccgttacgatctcgtag

SEQ ID NO: 16991 - DNA, 25 bp, S. cerevisiae
aagaaagcgcctcgaggagccgtac

SEQ ID NO: 16992 - DNA, 25 bp, S. cerevisiae
aagataagctacacggactggaaca

SEQ ID NO: 16993 - DNA, 25 bp, S. cerevisiae
aagaggtctactttggactggcccg

SEQ ID NO: 16994 - DNA, 25 bp, S. cerevisiae
aagactctgtacagatggctaccca

SEQ ID NO: 16995 - DNA, 25 bp, S. cerevisiae
aagaccgtcagaaagagtatcgcct

SEQ ID NO: 16996 - DNA, 25 bp, S. cerevisiae
aagaacaatgagaacggtatcgtta

SEQ ID NO: 16997 - DNA, 25 bp, S. cerevisiae
aagaatgttgaaccgcccatcgaaa

SEQ ID NO: 16998 - DNA, 25 bp, S. cerevisiae
aagaaaagatatccgcccacaatga

SEQ ID NO: 16999 - DNA, 25 bp, S. cerevisiae
aagaaatggtaaggccccagaagct

SEQ ID NO: 17000 - DNA, 25 bp, S. cerevisiae
aagcagaacgtaactccatccatga

SEQ ID NO: 17001 - DNA, 25 bp, S. cerevisiae
aagaaactggaatggcacttttggc

SEQ ID NO: 17002 - DNA, 25 bp, S. cerevisiae
aagactactgcggaaccacttatag

SEQ ID NO: 17003 - DNA, 25 bp, S. cerevisiae
aaggccaagggatctcactaaggaa

SEQ ID NO: 17004 - DNA, 25 bp, S. cerevisiae
aagaccaagtggacctcaggaagag

SEQ ID NO: 17005 - DNA, 25 bp, S. cerevisiae
aagaccacggtgtccagattcaggg

SEQ ID NO: 17006 - DNA, 25 bp, S. cerevisiae
aagaaacagactccagcaggttcgg

SEQ ID NO: 17007 - DNA, 25 bp, S. cerevisiae
aagaaaccacctgcttttgctaaga

SEQ ID NO: 17008 - DNA, 25 bp, S. cerevisiae
aagaactcgctgaggctacccgtaa

SEQ ID NO: 17009 - DNA, 25 bp, S. cerevisiae
aagaaatcagcagcggcaagcccaa

SEQ ID NO: 17010 - DNA, 25 bp, S. cerevisiae
aagagaatcactgcggcggatgcct

SEQ ID NO: 17011 - DNA, 25 bp, S. cerevisiae
aagaaactttgacggcttcagactt

SEQ ID NO: 17012 - DNA, 25 bp, S. cerevisiae
aagaacatcctttcgactgtaacgg

SEQ ID NO: 17013 - DNA, 25 bp, S. cerevisiae
aagaattcagccaagagacgtaaga

SEQ ID NO: 17014 - DNA, 25 bp, S. cerevisiae
aagaagccaaatctccacggatacg

SEQ ID NO: 17015 - DNA, 25 bp, S. cerevisiae
aagcaagccaagactgatgcagcca

SEQ ID NO: 17016 - DNA, 25 bp, S. cerevisiae
aagaagctgcaagccgaacgtcgtc

SEQ ID NO: 17017 - DNA, 25 bp, S. cerevisiae
aagaagatcagagcccaccgtggta

SEQ ID NO: 17018 - DNA, 25 bp, S. cerevisiae
aagtcaacgactctactggcgttat

SEQ ID NO: 17019 - DNA, 25 bp, S. cerevisiae
aagtcaacgaccttctcaaagaaat

SEQ ID NO: 17020 - DNA, 25 bp, S. cerevisiae
aagcaaaccccaagatcgtagaaat

SEQ ID NO: 17021 - DNA, 25 bp, S. cerevisiae
aagaggttcccgcagttttgcagct

SEQ ID NO: 17022 - DNA, 25 bp, S. cerevisiae
aagcaggttccttcaagttattgat

SEQ ID NO: 17023 - DNA, 25 bp, S. cerevisiae
aagaactgttcttggcggcggttgc

SEQ ID NO: 17024 - DNA, 25 bp, S. cerevisiae
aagaaggttatcctcttccacgtca

SEQ ID NO: 17025 - DNA, 25 bp, S. cerevisiae
aagcaattcctcctgaccaaaggtg

SEQ ID NO: 17026 - DNA, 25 bp, S. cerevisiae
aagaatttccctctcaacggtgata

SEQ ID NO: 17027 - DNA, 25 bp, S. cerevisiae
aagatgcatcaaaccgttaacggaa

SEQ ID NO: 17028 - DNA, 25 bp, S. cerevisiae
aagaatatgccaccgtttaccaact

SEQ ID NO: 17029 - DNA, 25 bp, S. cerevisiae
aagcatgtcatctattttctccaat

SEQ ID NO: 17030 - DNA, 25 bp, S. cerevisiae
aagcattgtctattttctggcagtg

SEQ ID NO: 17031 - DNA, 25 bp, S. cerevisiae
aagcacttcagctgcttctgagctg

SEQ ID NO: 17032 - DNA, 25 bp, S. cerevisiae
aagcaagctgccgagttcttgggca

SEQ ID NO: 17033 - DNA, 25 bp, S. cerevisiae
aagacagcccagactttggacgaaa

SEQ ID NO: 17034 - DNA, 25 bp, S. cerevisiae
aagaataccaagatgtgcgacgaca

SEQ ID NO: 17035 - DNA, 25 bp, S. cerevisiae
aagtcattctactcataccacgaac

SEQ ID NO: 17036 - DNA, 25 bp, S. cerevisiae
aagacatttgcgtctaggttcgcca

SEQ ID NO: 17037 - DNA, 25 bp, S. cerevisiae
aagacaaacgctgcaggttctcgac

SEQ ID NO: 17038 - DNA, 25 bp, S. cerevisiae
aagacataactctgggcttccttca

SEQ ID NO: 17039 - DNA, 25 bp, S. cerevisiae
caaaaagcaccaaggccttactggt

SEQ ID NO: 17040 - DNA, 25 bp, S. cerevisiae
aagaggaggcctgccgccaaaggta

SEQ ID NO: 17041 - DNA, 25 bp, S. cerevisiae
aagaaaagatccattgccggtgatg

SEQ ID NO: 17042 - DNA, 25 bp, S. cerevisiae
aagaaaattgccactcgcggtgcat

SEQ ID NO: 17043 - DNA, 25 bp, S. cerevisiae
aagactaccaacaccggagagcggc

SEQ ID NO: 17044 - DNA, 25 bp, S. cerevisiae
aagcatgccatactggatccactgt

SEQ ID NO: 17045 - DNA, 25 bp, S. cerevisiae
aagcttctgattcgaggactgccta

SEQ ID NO: 17046 - DNA, 25 bp, S. cerevisiae
aagcatgattgattcggtgattgac

SEQ ID NO: 17047 - DNA, 25 bp, S. cerevisiae
aagcattgactgtataccctcagcc

SEQ ID NO: 17048 - DNA, 25 bp, S. cerevisiae
aagcatctgcaccttctactgaaga

SEQ ID NO: 17049 - DNA, 25 bp, S. cerevisiae
aagttgccatgatgctggtcctgaa

SEQ ID NO: 17050 - DNA, 25 bp, S. cerevisiae
aagaaactgcaactggcctctacaa

SEQ ID NO: 17051 - DNA, 25 bp, S. cerevisiae
aagcaacactgaggtcaccgctaaa

SEQ ID NO: 17052 - DNA, 25 bp, S. cerevisiae
aagcaaactgcatccacatcgatga

SEQ ID NO: 17053 - DNA, 25 bp, S. cerevisiae
gacaaaacgctagcaactggaaggc

SEQ ID NO: 17054 - DNA, 25 bp, S. cerevisiae
aatacacctcgagacgggaagcctg

SEQ ID NO: 17055 - DNA, 25 bp, S. cerevisiae
aagacacctcccattcaggaagttg

SEQ ID NO: 17056 - DNA, 25 bp, S. cerevisiae
aagcacctggttactcaagcacttg

SEQ ID NO: 17057 - DNA, 25 bp, S. cerevisiae
aagcagcacatcttacagatcggaa

SEQ ID NO: 17058 - DNA, 25 bp, S. cerevisiae
aagcacgcctcaaaatctggtttct

SEQ ID NO: 17059 - DNA, 25 bp, S. cerevisiae
aagcagcggctgaaaatcttcgttt

SEQ ID NO: 17060 - DNA, 25 bp, S. cerevisiae
aagacagtctgttatttctcagatg

SEQ ID NO: 17061 - DNA, 25 bp, S. cerevisiae
aagcaagccatcaaatattctcgtg

SEQ ID NO: 17062 - DNA, 25 bp, S. cerevisiae
aagcaacctcattgactactgccat

SEQ ID NO: 17063 - DNA, 25 bp, S. cerevisiae
aagagatttaaccatgacgccgcca

SEQ ID NO: 17064 - DNA, 25 bp, S. cerevisiae
aagaattacagtacgactccaccct

SEQ ID NO: 17065 - DNA, 25 bp, S. cerevisiae
aagaggagagttgccaccacagccg

SEQ ID NO: 17066 - DNA, 25 bp, S. cerevisiae
aagagctgacgttaagaccgccact

SEQ ID NO: 17067 - DNA, 25 bp, S. cerevisiae
aagactgctcgtggtaaggccgctt

SEQ ID NO: 17068 - DNA, 25 bp, S. cerevisiae
aagcactgtcgtgaagtggccgcat

SEQ ID NO: 17069 - DNA, 25 bp, S. cerevisiae
aagcaagtcggtgttggtaagttga

SEQ ID NO: 17070 - DNA, 25 bp, S. cerevisiae
aagcacgccccttgaggactgaaga

SEQ ID NO: 17071 - DNA, 25 bp, S. cerevisiae
aagcaatctcaggtgctggtttctc

SEQ ID NO: 17072 - DNA, 25 bp, S. cerevisiae
aagcatggtgccgtccatctttcta

SEQ ID NO: 17073 - DNA, 25 bp, S. cerevisiae
aagagggcgcactcaacattctcaa

SEQ ID NO: 17074 - DNA, 25 bp, S. cerevisiae
aagacggccaatacggaccaaatat

SEQ ID NO: 17075 - DNA, 25 bp, S. cerevisiae
aagagcgtcctaaagaacccagatt

SEQ ID NO: 17076 - DNA, 25 bp, S. cerevisiae
aagcaaatctccagcgatacccaat

SEQ ID NO: 17077 - DNA, 25 bp, S. cerevisiae
aagcataattccaccttcttcaatt

SEQ ID NO: 17078 - DNA, 25 bp, S. cerevisiae
aagcttgctcttaagctgtcaaaga

SEQ ID NO: 17079 - DNA, 25 bp, S. cerevisiae
aagcaattgctcaagttccagacaa

SEQ ID NO: 17080 - DNA, 25 bp, S. cerevisiae
aagcactattccgtttcttcaaagg

SEQ ID NO: 17081 - DNA, 25 bp, S. cerevisiae
aagaatcttcagtttttccaccacg

SEQ ID NO: 17082 - DNA, 25 bp, S. cerevisiae
aagcacgatatacacgcctgtttct

SEQ ID NO: 17083 - DNA, 25 bp, S. cerevisiae
aagcactctaatcaagtctcttcct

SEQ ID NO: 17084 - DNA, 25 bp, S. cerevisiae
aagcatgtataccttggcgttgtct

SEQ ID NO: 17085 - DNA, 25 bp, S. cerevisiae
aagcaagctttgtacaccggtttca

SEQ ID NO: 17086 - DNA, 25 bp, S. cerevisiae
aagaattagcaactgcccgtctggc

SEQ ID NO: 17087 - DNA, 25 bp, S. cerevisiae
aagaattgtcagactcccattctcg

SEQ ID NO: 17088 - DNA, 25 bp, S. cerevisiae
aagaatggtcaggtacctcccgtgc

SEQ ID NO: 17089 - DNA, 25 bp, S. cerevisiae
aagacagtgaagatacgcccggcgt

SEQ ID NO: 17090 - DNA, 25 bp, S. cerevisiae
aagcacggaagtgactcgtcgcgcc

SEQ ID NO: 17091 - DNA, 25 bp, S. cerevisiae
aagaaggaagatgcgctcctccctt

SEQ ID NO: 17092 - DNA, 25 bp, S. cerevisiae
aagaaacgacgcaattgccttcctc

SEQ ID NO: 17093 - DNA, 25 bp, S. cerevisiae
aagaaatctaagacttccacgccca

SEQ ID NO: 17094 - DNA, 25 bp, S. cerevisiae
aagaagacaacgacaacctcgcctg

SEQ ID NO: 17095 - DNA, 25 bp, S. cerevisiae
aagcaatactgttaggttctcacct

SEQ ID NO: 17096 - DNA, 25 bp, S. cerevisiae
aagaagggctctcgctgcttgtagt

SEQ ID NO: 17097 - DNA, 25 bp, S. cerevisiae
aagagatagaccctcacgcctagat

SEQ ID NO: 17098 - DNA, 25 bp, S. cerevisiae
aagcacactttcaagaccgctgttg

SEQ ID NO: 17099 - DNA, 25 bp, S. cerevisiae
aagcaggcgcattcactcaagatgt

SEQ ID NO: 17100 - DNA, 25 bp, S. cerevisiae
aagagcagcaagtcaccaaggtgtt

SEQ ID NO: 17101 - DNA, 25 bp, S. cerevisiae
aagaaactgcagcaaccaccatttc

SEQ ID NO: 17102 - DNA, 25 bp, S. cerevisiae
aagaaatctcacgaaccactgccat

SEQ ID NO: 17103 - DNA, 25 bp, S. cerevisiae
aagcacgctacggaatcttcagatt

SEQ ID NO: 17104 - DNA, 25 bp, S. cerevisiae
aagacagctcaccagaatgcttcaa

SEQ ID NO: 17105 - DNA, 25 bp, S. cerevisiae
aagcacagtctacgctgcagtgtca

SEQ ID NO: 17106 - DNA, 25 bp, S. cerevisiae
aagacagctatcctgctgaggcaga

SEQ ID NO: 17107 - DNA, 25 bp, S. cerevisiae
aagacagttcattgtggcagatact

SEQ ID NO: 17108 - DNA, 25 bp, S. cerevisiae
aagcacatattcttcgggaaccaat

SEQ ID NO: 17109 - DNA, 25 bp, S. cerevisiae
aagaattatcattgccgccgactgc

SEQ ID NO: 17110 - DNA, 25 bp, S. cerevisiae
aagcaatctttttgagcggcacagc

SEQ ID NO: 17111 - DNA, 25 bp, S. cerevisiae
aagagtctgttatagctaccaccgc

SEQ ID NO: 17112 - DNA, 25 bp, S. cerevisiae
aagaaggtacctctactgcaactga

SEQ ID NO: 17113 - DNA, 25 bp, S. cerevisiae
aagaagcttaccagttctcacacgg

SEQ ID NO: 17114 - DNA, 25 bp, S. cerevisiae
taggaagccttaccgttggcaacga

SEQ ID NO: 17115 - DNA, 25 bp, S. cerevisiae
aagcatcctttggtctgggaggcga

SEQ ID NO: 17116 - DNA, 25 bp, S. cerevisiae
aagaactcctgctacgttgactgga

SEQ ID NO: 17117 - DNA, 25 bp, S. cerevisiae
aagaatcttcagtacgcataacggt

SEQ ID NO: 17118 - DNA, 25 bp, S. cerevisiae
aagcaaatcttggtcctcaacggga

SEQ ID NO: 17119 - DNA, 25 bp, S. cerevisiae
aagcaaactctcttctgcagaattg

SEQ ID NO: 17120 - DNA, 25 bp, S. cerevisiae
aagcaggcctcttgctgtgcagaaa

SEQ ID NO: 17121 - DNA, 25 bp, S. cerevisiae
aagcacgcagtgctcttgtgaagat

SEQ ID NO: 17122 - DNA, 25 bp, S. cerevisiae
aagacgcaccagtattgatgttcaa

SEQ ID NO: 17123 - DNA, 25 bp, S. cerevisiae
aagcaccatcgccagtgttgttaaa

SEQ ID NO: 17124 - DNA, 25 bp, S. cerevisiae
aagcacgttggcaagcccatttcac

SEQ ID NO: 17125 - DNA, 25 bp, S. cerevisiae
aagcaggtttgcatgttcattcaga

SEQ ID NO: 17126 - DNA, 25 bp, S. cerevisiae
caacgagactggtttaactggcaaa

SEQ ID NO: 17127 - DNA, 25 bp, S. cerevisiae
aagcaggtcctgttgtaactgacaa

SEQ ID NO: 17128 - DNA, 25 bp, S. cerevisiae
aagcagagctcagggttcgtaccat

SEQ ID NO: 17129 - DNA, 25 bp, S. cerevisiae
aagagggatgcgtttggtacaataa

SEQ ID NO: 17130 - DNA, 25 bp, S. cerevisiae
aagacggataatatggctacggacc

SEQ ID NO: 17131 - DNA, 25 bp, S. cerevisiae
aagcaccgaggaagctgccgacgaa

SEQ ID NO: 17132 - DNA, 25 bp, S. cerevisiae
aagaaccaggatttgcacgagccaa

SEQ ID NO: 17133 - DNA, 25 bp, S. cerevisiae
aagaagcgggcagtccattggtcta

SEQ ID NO: 17134 - DNA, 25 bp, S. cerevisiae
aagaactgggcgatattgtcgatga

SEQ ID NO: 17135 - DNA, 25 bp, S. cerevisiae
aagaattggctggatccggtcgtcg

SEQ ID NO: 17136 - DNA, 25 bp, S. cerevisiae
aagaattaggtaccgacgctgctca

SEQ ID NO: 17137 - DNA, 25 bp, S. cerevisiae
aagaattattgacccgctagcgtcc

SEQ ID NO: 17138 - DNA, 25 bp, S. cerevisiae
aagaaatattacctggcccttctct

SEQ ID NO: 17139 - DNA, 25 bp, S. cerevisiae
aagacagtttcaccttacgctattc

SEQ ID NO: 17140 - DNA, 25 bp, S. cerevisiae
aagactcccaagaccacgaagctgc

SEQ ID NO: 17141 - DNA, 25 bp, S. cerevisiae
aagactgcagtcaagatgcccgtag

SEQ ID NO: 17142 - DNA, 25 bp, S. cerevisiae
aagcagctcagggatacgacagcaa

SEQ ID NO: 17143 - DNA, 25 bp, S. cerevisiae
aagcagagatggattcagtcagtaa

SEQ ID NO: 17144 - DNA, 25 bp, S. cerevisiae
aagcagcggtacttttagtgatcta

SEQ ID NO: 17145 - DNA, 25 bp, S. cerevisiae
aagcagcaggctacttattaagtgt

SEQ ID NO: 17146 - DNA, 25 bp, S. cerevisiae
aagcagcagggtggatttgagcaat

SEQ ID NO: 17147 - DNA, 25 bp, S. cerevisiae
aagcaagcggagctcatgcatcaaa

SEQ ID NO: 17148 - DNA, 25 bp, S. cerevisiae
aagaaggctctgttgctgcaaatac

SEQ ID NO: 17149 - DNA, 25 bp, S. cerevisiae
aagaatgagcctgtgccttctgtca

SEQ ID NO: 17150 - DNA, 25 bp, S. cerevisiae
aagagatgctaacttccgtgctcca

SEQ ID NO: 17151 - DNA, 25 bp, S. cerevisiae
aagatagttactttggtgcttacca

SEQ ID NO: 17152 - DNA, 25 bp, S. cerevisiae
aagatgccttttttgagtttattca

SEQ ID NO: 17153 - DNA, 25 bp, S. cerevisiae
aagaattgtcttccacaatcgggaa

SEQ ID NO: 17154 - DNA, 25 bp, S. cerevisiae
aagcaattactttttcatccgcgga

SEQ ID NO: 17155 - DNA, 25 bp, S. cerevisiae
aagcaactactttttcacacaccac

SEQ ID NO: 17156 - DNA, 25 bp, S. cerevisiae
aagcacctccagtttaatgaagcct

SEQ ID NO: 17157 - DNA, 25 bp, S. cerevisiae
aagcaccaattccattttgcctgtt

SEQ ID NO: 17158 - DNA, 25 bp, S. cerevisiae
aagacgatcaagctatttcgcgcct

SEQ ID NO: 17159 - DNA, 25 bp, S. cerevisiae
aagactgtcaacctggtatcagcga

SEQ ID NO: 17160 - DNA, 25 bp, S. cerevisiae
aagacatcatcagtacggttccgat

SEQ ID NO: 17161 - DNA, 25 bp, S. cerevisiae
aagaatcatcagaccaagtgcgttg

SEQ ID NO: 17162 - DNA, 25 bp, S. cerevisiae
aagacaacttttgtgcttggcacga

SEQ ID NO: 17163 - DNA, 25 bp, S. cerevisiae
aagaccaattttctgctttgcaaaa

SEQ ID NO: 17164 - DNA, 25 bp, S. cerevisiae
aagaatactgttgatctgccccagt

SEQ ID NO: 17165 - DNA, 25 bp, S. cerevisiae
aagaaaggcgctgatcaccctgagt

SEQ ID NO: 17166 - DNA, 25 bp, S. cerevisiae
aagaacagacgcacatacgcctttg

SEQ ID NO: 17167 - DNA, 25 bp, S. cerevisiae
aagacaagacgctgtttgctgcttt

SEQ ID NO: 17168 - DNA, 25 bp, S. cerevisiae
aagaagagcacctgtcacgcatatt

SEQ ID NO: 17169 - DNA, 25 bp, S. cerevisiae
aagacaaccatttgccattattttg

SEQ ID NO: 17170 - DNA, 25 bp, S. cerevisiae
aagacaggcgccatcgatgtttttg

SEQ ID NO: 17171 - DNA, 25 bp, S. cerevisiae
aagaactcagccctcgtctgtttga

SEQ ID NO: 17172 - DNA, 25 bp, S. cerevisiae
aagaagagcttctcgtctgtctgta

SEQ ID NO: 17173 - DNA, 25 bp, S. cerevisiae
aagaaggtcgcgagctctgttgcaa

SEQ ID NO: 17174 - DNA, 25 bp, S. cerevisiae
aagaagaatcctatcctgtggcctc

SEQ ID NO: 17175 - DNA, 25 bp, S. cerevisiae
aagagagaacacttgcccctggccg

SEQ ID NO: 17176 - DNA, 25 bp, S. cerevisiae
aagagaagaatgaacccaggtccat

SEQ ID NO: 17177 - DNA, 25 bp, S. cerevisiae
aagaatgattctaacccacgtcgat

SEQ ID NO: 17178 - DNA, 25 bp, S. cerevisiae
aagaatattttgacgcataccgcga

SEQ ID NO: 17179 - DNA, 25 bp, S. cerevisiae
aagcaccttttgatatacctctaga

SEQ ID NO: 17180 - DNA, 25 bp, S. cerevisiae
aagactttctatttaactcattcaa

SEQ ID NO: 17181 - DNA, 25 bp, S. cerevisiae
aagaatcgcgtcactatcctattaa

SEQ ID NO: 17182 - DNA, 25 bp, S. cerevisiae
aagcaactctggatccccaatcaaa

SEQ ID NO: 17183 - DNA, 25 bp, S. cerevisiae
aagaagctgaggaagccgctccaca

SEQ ID NO: 17184 - DNA, 25 bp, S. cerevisiae
aagcacaggatgaaaccactcccac

SEQ ID NO: 17185 - DNA, 25 bp, S. cerevisiae
aagacaattgtacccactagcatcc

SEQ ID NO: 17186 - DNA, 25 bp, S. cerevisiae
aagaattggttgcatcccttactcc

SEQ ID NO: 17187 - DNA, 25 bp, S. cerevisiae
aagcaatgatcgttctgcacccaaa

SEQ ID NO: 17188 - DNA, 25 bp, S. cerevisiae
aagaagtctgccaagactgccaaag

SEQ ID NO: 17189 - DNA, 25 bp, S. cerevisiae
aagaagcgggcttggctgccataat

SEQ ID NO: 17190 - DNA, 25 bp, S. cerevisiae
aagacccgtggtgttgccatgaatc

SEQ ID NO: 17191 - DNA, 25 bp, S. cerevisiae
aagaagtgggccttgcagctagtct

SEQ ID NO: 17192 - DNA, 25 bp, S. cerevisiae
aagaacggattcttgccttctctac

SEQ ID NO: 17193 - DNA, 25 bp, S. cerevisiae
aagaaccaattcttgctccatctgt

SEQ ID NO: 17194 - DNA, 25 bp, S. cerevisiae
aagcaacctatgacctgtacactaa

SEQ ID NO: 17195 - DNA, 25 bp, S. cerevisiae
aagactgcactggttatcatgtttt

SEQ ID NO: 17196 - DNA, 25 bp, S. cerevisiae
caaaagcgccttgaagtttttcgca

SEQ ID NO: 17197 - DNA, 25 bp, S. cerevisiae
aagaatctctttgacgtttttgcgt

SEQ ID NO: 17198 - DNA, 25 bp, S. cerevisiae
aagacgttcagcttcccaaggatat

SEQ ID NO: 17199 - DNA, 25 bp, S. cerevisiae
aagagactatacgagggcctacata

SEQ ID NO: 17200 - DNA, 25 bp, S. cerevisiae
aagcaactgcttcatggtgttaagt

SEQ ID NO: 17201 - DNA, 25 bp, S. cerevisiae
aagcaactttgcctctttgataagc

SEQ ID NO: 17202 - DNA, 25 bp, S. cerevisiae
aagaccattggatttgttgagacct

SEQ ID NO: 17203 - DNA, 25 bp, S. cerevisiae
aagacctctagatctcttgagacct

SEQ ID NO: 17204 - DNA, 25 bp, S. cerevisiae
aagacggtccatcttgggtcgttgc

SEQ ID NO: 17205 - DNA, 25 bp, S. cerevisiae
aagatcctgtttgtggtagtggttc

SEQ ID NO: 17206 - DNA, 25 bp, S. cerevisiae
aagacattggatgaggttgccctgg

SEQ ID NO: 17207 - DNA, 25 bp, S. cerevisiae
aagaattggatcaagttgtgggaga

SEQ ID NO: 17208 - DNA, 25 bp, S. cerevisiae
aagactggaatccacctttgggatt

SEQ ID NO: 17209 - DNA, 25 bp, S. cerevisiae
aagattaaaccctctgtgagcgata

SEQ ID NO: 17210 - DNA, 25 bp, S. cerevisiae
aagttacaaatcgacgaggccctat

SEQ ID NO: 17211 - DNA, 25 bp, S. cerevisiae
aagaaacaagacttcgatgctgcga

SEQ ID NO: 17212 - DNA, 25 bp, S. cerevisiae
aagagcacttgacgtttggtccgtg

SEQ ID NO: 17213 - DNA, 25 bp, S. cerevisiae
aagaacttgagccagtacctcctgt

SEQ ID NO: 17214 - DNA, 25 bp, S. cerevisiae
aagatacctcgatcaatcctacggg

SEQ ID NO: 17215 - DNA, 25 bp, S. cerevisiae
aagacccctggtctgtcaaatgcta

SEQ ID NO: 17216 - DNA, 25 bp, S. cerevisiae
aagaccccattgaacgcaagaccta

SEQ ID NO: 17217 - DNA, 25 bp, S. cerevisiae
aagatcctctcagaaaacggtgtac

SEQ ID NO: 17218 - DNA, 25 bp, S. cerevisiae
aagacccgcagtgaatttagatgat

SEQ ID NO: 17219 - DNA, 25 bp, S. cerevisiae
aagacacaccacaggaacttgccat

SEQ ID NO: 17220 - DNA, 25 bp, S. cerevisiae
aagaaccctcttgatatcgagcctc

SEQ ID NO: 17221 - DNA, 25 bp, S. cerevisiae
aagaaggactttgcatgtaatggta

SEQ ID NO: 17222 - DNA, 25 bp, S. cerevisiae
aagaagcgccttccagtgataaaaa

SEQ ID NO: 17223 - DNA, 25 bp, S. cerevisiae
aagacgtctttggaggctatcatag

SEQ ID NO: 17224 - DNA, 25 bp, S. cerevisiae
aagactgtcttaatgacgcattgtt

SEQ ID NO: 17225 - DNA, 25 bp, S. cerevisiae
aagacgtgctgctttgactgacttt

SEQ ID NO: 17226 - DNA, 25 bp, S. cerevisiae
aagacttgccttccctgatggtatt

SEQ ID NO: 17227 - DNA, 25 bp, S. cerevisiae
aagatcccgatgaacaacaattatt

SEQ ID NO: 17228 - DNA, 25 bp, S. cerevisiae
aagtccaggtgcataaattgtttat

SEQ ID NO: 17229 - DNA, 25 bp, S. cerevisiae
aagttgggccgtcgtagatgtcttt

SEQ ID NO: 17230 - DNA, 25 bp, S. cerevisiae
aagacatggtccctgcgatagtgcg

SEQ ID NO: 17231 - DNA, 25 bp, S. cerevisiae
aagaagttgcctccacagcagcttc

SEQ ID NO: 17232 - DNA, 25 bp, S. cerevisiae
aagcaaccgtgattgcacgcagtat

SEQ ID NO: 17233 - DNA, 25 bp, S. cerevisiae
aagacagccattactgccagcagta

SEQ ID NO: 17234 - DNA, 25 bp, S. cerevisiae
aagaatgtcgaaacggctcgctcca

SEQ ID NO: 17235 - DNA, 25 bp, S. cerevisiae
aagaatatcccaataagccaccgca

SEQ ID NO: 17236 - DNA, 25 bp, S. cerevisiae
aagacattagtccaaggtccaagat

SEQ ID NO: 17237 - DNA, 25 bp, S. cerevisiae
aagagcacatcacccttctttaaaa

SEQ ID NO: 17238 - DNA, 25 bp, S. cerevisiae
aagaatggcagctccgtgtccacga

SEQ ID NO: 17239 - DNA, 25 bp, S. cerevisiae
aagcaagagttgtttccctgccaga

SEQ ID NO: 17240 - DNA, 25 bp, S. cerevisiae
aagaattactaacttcgcgcctcaa

SEQ ID NO: 17241 - DNA, 25 bp, S. cerevisiae
aagaactaccaacttgcgtcagcaa

SEQ ID NO: 17242 - DNA, 25 bp, S. cerevisiae
aagaagttgcttggttcgatcgcgt

SEQ ID NO: 17243 - DNA, 25 bp, S. cerevisiae
aagaagcttctgctgcctatgagtc

SEQ ID NO: 17244 - DNA, 25 bp, S. cerevisiae
aagaaggtatttccggtgtcgcacg

SEQ ID NO: 17245 - DNA, 25 bp, S. cerevisiae
aagaaggtatttgcgagtgccgaat

SEQ ID NO: 17246 - DNA, 25 bp, S. cerevisiae
aagacgggtttcatggtgtagcaat

SEQ ID NO: 17247 - DNA, 25 bp, S. cerevisiae
aagaagcctttgacagccatggaaa

SEQ ID NO: 17248 - DNA, 25 bp, S. cerevisiae
aagaacaactatgggcggtgacgat

SEQ ID NO: 17249 - DNA, 25 bp, S. cerevisiae
aagacatttttagttggcatcgttg

SEQ ID NO: 17250 - DNA, 25 bp, S. cerevisiae
aagaatcctttctttcctcgatatc

SEQ ID NO: 17251 - DNA, 25 bp, S. cerevisiae
aagaacgactctgttactgccgaag

SEQ ID NO: 17252 - DNA, 25 bp, S. cerevisiae
aaggacggcatagcttactacaaac

SEQ ID NO: 17253 - DNA, 25 bp, S. cerevisiae
aagaacgttgtaccagcatctgcca

SEQ ID NO: 17254 - DNA, 25 bp, S. cerevisiae
aagaacactttcacagtctgcgctt

SEQ ID NO: 17255 - DNA, 25 bp, S. cerevisiae
aagaactcctctattgatgctgcct

SEQ ID NO: 17256 - DNA, 25 bp, S. cerevisiae
aagaactcgggtgtcagagcctgct

SEQ ID NO: 17257 - DNA, 25 bp, S. cerevisiae
aagaattagatcgtggtaccctgct

SEQ ID NO: 17258 - DNA, 25 bp, S. cerevisiae
aagaatataatgctcgctaccctct

SEQ ID NO: 17259 - DNA, 25 bp, S. cerevisiae
aagactcgaagatgagcgccgcgct

SEQ ID NO: 17260 - DNA, 25 bp, S. cerevisiae
aagaatctatccaggccgacaattt

SEQ ID NO: 17261 - DNA, 25 bp, S. cerevisiae
aagaatctaccgtgtccaaagagac

SEQ ID NO: 17262 - DNA, 25 bp, S. cerevisiae
aagaactaattgttgccgctaagca

SEQ ID NO: 17263 - DNA, 25 bp, S. cerevisiae
aagaaattgaattgccacctggtgt

SEQ ID NO: 17264 - DNA, 25 bp, S. cerevisiae
aagaagagacttggcctccttggtc

SEQ ID NO: 17265 - DNA, 25 bp, S. cerevisiae
aagaaagcttcacggcgagtcggct

SEQ ID NO: 17266 - DNA, 25 bp, S. cerevisiae
aagaatttctgcagcgggtcgggtc

SEQ ID NO: 17267 - DNA, 25 bp, S. cerevisiae
aagaagtctctgatgctgctgcggg

SEQ ID NO: 17268 - DNA, 25 bp, S. cerevisiae
aagatcgtcgagagctgcgtcggtt

SEQ ID NO: 17269 - DNA, 25 bp, S. cerevisiae
aagacttcgaactcgctgtgggtaa

SEQ ID NO: 17270 - DNA, 25 bp, S. cerevisiae
aagactttgtattgtccgtggccac

SEQ ID NO: 17271 - DNA, 25 bp, S. cerevisiae
aagaaattatgctcccaggctgcca

SEQ ID NO: 17272 - DNA, 25 bp, S. cerevisiae
aagaagatacttgccgagtccggtt

SEQ ID NO: 17273 - DNA, 25 bp, S. cerevisiae
aagaaagttctcttctggtcaccat

SEQ ID NO: 17274 - DNA, 25 bp, S. cerevisiae
aagatacgtccttttgtacaacaat

SEQ ID NO: 17275 - DNA, 25 bp, S. cerevisiae
aagaacgtcatctgtgcgtagcaag

SEQ ID NO: 17276 - DNA, 25 bp, S. cerevisiae
aagaacgcaacgctggatcacatca

SEQ ID NO: 17277 - DNA, 25 bp, S. cerevisiae
aagacttagtcttcccaactgaaat

SEQ ID NO: 17278 - DNA, 25 bp, S. cerevisiae
aagacgatcattgagggcccggaat

SEQ ID NO: 17279 - DNA, 25 bp, S. cerevisiae
aagacagctactacactacccggaa

SEQ ID NO: 17280 - DNA, 25 bp, S. cerevisiae
aagagtcaagtaccattcaacaagt

SEQ ID NO: 17281 - DNA, 25 bp, S. cerevisiae
aagacctgatattacccaccaatgt

SEQ ID NO: 17282 - DNA, 25 bp, S. cerevisiae
aagactttaataggccttcaaggca

SEQ ID NO: 17283 - DNA, 25 bp, S. cerevisiae
aagacccaaatctacgctgtcaagg

SEQ ID NO: 17284 - DNA, 25 bp, S. cerevisiae
aagacactacaacccctgttgtgga

SEQ ID NO: 17285 - DNA, 25 bp, S. cerevisiae
aagacacatatcacggctttctcgg

SEQ ID NO: 17286 - DNA, 25 bp, S. cerevisiae
aagaacattatgacgtcgcctccaa

SEQ ID NO: 17287 - DNA, 25 bp, S. cerevisiae
aagaagatgcttacagacccgaaca

SEQ ID NO: 17288 - DNA, 25 bp, S. cerevisiae
aagaaggccccgtactgaggataga

SEQ ID NO: 17289 - DNA, 25 bp, S. cerevisiae
aagaatgctgccaccaacgttaaag

SEQ ID NO: 17290 - DNA, 25 bp, S. cerevisiae
aagactgccccatcagaccaaaagt

SEQ ID NO: 17291 - DNA, 25 bp, S. cerevisiae
aagacccaacagtgcagccggaaat

SEQ ID NO: 17292 - DNA, 25 bp, S. cerevisiae
aagaactaatcattcccttggaaat

SEQ ID NO: 17293 - DNA, 25 bp, S. cerevisiae
aagacctccaatatccctggaattc

SEQ ID NO: 17294 - DNA, 25 bp, S. cerevisiae
aagacctccttgatgcaccgttatg

SEQ ID NO: 17295 - DNA, 25 bp, S. cerevisiae
aagacattttctatgcccttggtgc

SEQ ID NO: 17296 - DNA, 25 bp, S. cerevisiae
aagaggtttctgatcctttggaagc

SEQ ID NO: 17297 - DNA, 25 bp, S. cerevisiae
aagaaacggccatttctgtcgccaa

SEQ ID NO: 17298 - DNA, 25 bp, S. cerevisiae
aagaaaccgcaatcgctggcagaaa

SEQ ID NO: 17299 - DNA, 25 bp, S. cerevisiae
aagacaacacgcatcctgacgagta

SEQ ID NO: 17300 - DNA, 25 bp, S. cerevisiae
aagagacattcgtttgcggtacttc

SEQ ID NO: 17301 - DNA, 25 bp, S. cerevisiae
aagaaatatcgcatccagggaattg

SEQ ID NO: 17302 - DNA, 25 bp, S. cerevisiae
aagaacatgtcacttccgcggaaga

SEQ ID NO: 17303 - DNA, 25 bp, S. cerevisiae
aagagacagacgttacagaaagaga

SEQ ID NO: 17304 - DNA, 25 bp, S. cerevisiae
aagagacgttacacagagcatcgaa

SEQ ID NO: 17305 - DNA, 25 bp, S. cerevisiae
aagacgcgttgacttgcagccacga

SEQ ID NO: 17306 - DNA, 25 bp, S. cerevisiae
aagaagcgttcacatcacgacgatg

SEQ ID NO: 17307 - DNA, 25 bp, S. cerevisiae
aagaaggctgaccaccaagacgacg

SEQ ID NO: 17308 - DNA, 25 bp, S. cerevisiae
aagagcagtgtacgacctaccggcg

SEQ ID NO: 17309 - DNA, 25 bp, S. cerevisiae
aagacatataccgttcaggaactca

SEQ ID NO: 17310 - DNA, 25 bp, S. cerevisiae
aagactcaagcttccactgttgaaa

SEQ ID NO: 17311 - DNA, 25 bp, S. cerevisiae
aagactcaagtcatgcaatggctga

SEQ ID NO: 17312 - DNA, 25 bp, S. cerevisiae
aagactatcagtcgcgcgttcgatc

SEQ ID NO: 17313 - DNA, 25 bp, S. cerevisiae
aagactgttctcttcgatactcatc

SEQ ID NO: 17314 - DNA, 25 bp, S. cerevisiae
aagactgcgtggttctcatacatag

SEQ ID NO: 17315 - DNA, 25 bp, S. cerevisiae
aagactcgcaagtttcacatcagtt

SEQ ID NO: 17316 - DNA, 25 bp, S. cerevisiae
aagaggctcaaatttgcaatcgcat

SEQ ID NO: 17317 - DNA, 25 bp, S. cerevisiae
aagaggtgccaactacgacgctgaa

SEQ ID NO: 17318 - DNA, 25 bp, S. cerevisiae
aagagcgctgatgagtactccctgt

SEQ ID NO: 17319 - DNA, 25 bp, S. cerevisiae
aagactatctccctataatgcggta

SEQ ID NO: 17320 - DNA, 25 bp, S. cerevisiae
aagactccacaactcaaactactga

SEQ ID NO: 17321 - DNA, 25 bp, S. cerevisiae
aagaccaaactcacaacatactgcc

SEQ ID NO: 17322 - DNA, 25 bp, S. cerevisiae
aagactcttcgcagacacttgtggt

SEQ ID NO: 17323 - DNA, 25 bp, S. cerevisiae
aagacggttaagtgcctatctggaa

SEQ ID NO: 17324 - DNA, 25 bp, S. cerevisiae
aagaggagtttctcgccgatttgaa

SEQ ID NO: 17325 - DNA, 25 bp, S. cerevisiae
aagagggtcttcaaccaccaactgt

SEQ ID NO: 17326 - DNA, 25 bp, S. cerevisiae
aagaccatttctgacactgctgctg

SEQ ID NO: 17327 - DNA, 25 bp, S. cerevisiae
aagactggttcaagagctctctctg

SEQ ID NO: 17328 - DNA, 25 bp, S. cerevisiae
caagacggttaatctcgtgatcaat

SEQ ID NO: 17329 - DNA, 25 bp, S. cerevisiae
aagactggttacaccgtgagcttaa

SEQ ID NO: 17330 - DNA, 25 bp, S. cerevisiae
aagatgagcaagcagctgccctggc

SEQ ID NO: 17331 - DNA, 25 bp, S. cerevisiae
aagtcatgtgaaccgcatgggcagt

SEQ ID NO: 17332 - DNA, 25 bp, S. cerevisiae
aagatctgggaccatgctgcaggca

SEQ ID NO: 17333 - DNA, 25 bp, S. cerevisiae
aagatgtggagaagggcacgccctt

SEQ ID NO: 17334 - DNA, 25 bp, S. cerevisiae
aagagaagatggatggcccgccttg

SEQ ID NO: 17335 - DNA, 25 bp, S. cerevisiae
aagagctaaggatcctcacgcctat

SEQ ID NO: 17336 - DNA, 25 bp, S. cerevisiae
aagagggcacgagcttaaccattca

SEQ ID NO: 17337 - DNA, 25 bp, S. cerevisiae
aagaagctcgtggtttgaatatcaa

SEQ ID NO: 17338 - DNA, 25 bp, S. cerevisiae
aagaagcctgatttatatacgatta

SEQ ID NO: 17339 - DNA, 25 bp, S. cerevisiae
aagaactcgcaatgtgatcccataa

SEQ ID NO: 17340 - DNA, 25 bp, S. cerevisiae
aataaactgcctttgtccttagccg

SEQ ID NO: 17341 - DNA, 25 bp, S. cerevisiae
aagagcaactgcaaattccctgtag

SEQ ID NO: 17342 - DNA, 25 bp, S. cerevisiae
aagaaaactacattcgccgatgagt

SEQ ID NO: 17343 - DNA, 25 bp, S. cerevisiae
aagacaagactgtcaaggacttgac

SEQ ID NO: 17344 - DNA, 25 bp, S. cerevisiae
aagaaagctcttccggatattaccg

SEQ ID NO: 17345 - DNA, 25 bp, S. cerevisiae
aagaacggtctgcagggtccagcaa

SEQ ID NO: 17346 - DNA, 25 bp, S. cerevisiae
aagaacggtttgactcagcagccca

SEQ ID NO: 17347 - DNA, 25 bp, S. cerevisiae
aagatataggtgcttccgacgtcca

SEQ ID NO: 17348 - DNA, 25 bp, S. cerevisiae
aagatccaagtggttcggcatcctt

SEQ ID NO: 17349 - DNA, 25 bp, S. cerevisiae
aagacctgcgtcctacggctatttt

SEQ ID NO: 17350 - DNA, 25 bp, S. cerevisiae
aagaagctcgttccttgttatctga

SEQ ID NO: 17351 - DNA, 25 bp, S. cerevisiae
aagacggcgttcctgaattgatcat

SEQ ID NO: 17352 - DNA, 25 bp, S. cerevisiae
aagaactgctattcaattcgccgcc

SEQ ID NO: 17353 - DNA, 25 bp, S. cerevisiae
aagacattacttctcagggcgccgg

SEQ ID NO: 17354 - DNA, 25 bp, S. cerevisiae
aagaccaaattcctctgtgtggccg

SEQ ID NO: 17355 - DNA, 25 bp, S. cerevisiae
aagagcccaataaatttcagcccag

SEQ ID NO: 17356 - DNA, 25 bp, S. cerevisiae
aagactccagtaggtgtgtcgccca

SEQ ID NO: 17357 - DNA, 25 bp, S. cerevisiae
aagactttgcatatggcttgcccca

SEQ ID NO: 17358 - DNA, 25 bp, S. cerevisiae
aagagtgccgttgaccacgaagcaa

SEQ ID NO: 17359 - DNA, 25 bp, S. cerevisiae
aagaaccctcatgacatcattgaag

SEQ ID NO: 17360 - DNA, 25 bp, S. cerevisiae
aagaacctgccggacatgattgaag

SEQ ID NO: 17361 - DNA, 25 bp, S. cerevisiae
aagaggtcctccaattcagaatttt

SEQ ID NO: 17362 - DNA, 25 bp, S. cerevisiae
gtcggatttcccactaattttattg

SEQ ID NO: 17363 - DNA, 25 bp, S. cerevisiae
aatgttttccagagctacttcctat

SEQ ID NO: 17364 - DNA, 25 bp, S. cerevisiae
aagatgtccccgtgtgtattgtaat

SEQ ID NO: 17365 - DNA, 25 bp, S. cerevisiae
aagatactgtgcctttcgcaattat

SEQ ID NO: 17366 - DNA, 25 bp, S. cerevisiae
aagacttgcaggacattgcttccga

SEQ ID NO: 17367 - DNA, 25 bp, S. cerevisiae
aagacttcgtcaaggcattccaggt

SEQ ID NO: 17368 - DNA, 25 bp, S. cerevisiae
aagactatttcaacgaagccggcat

SEQ ID NO: 17369 - DNA, 25 bp, S. cerevisiae
aagagctgtttcaacgtcaccgaag

SEQ ID NO: 17370 - DNA, 25 bp, S. cerevisiae
aagactcttgatgaactctccgatg

SEQ ID NO: 17371 - DNA, 25 bp, S. cerevisiae
aagacgttgaactacgccctcagta

SEQ ID NO: 17372 - DNA, 25 bp, S. cerevisiae
aagactttcggtgcctctgtcagaa

SEQ ID NO: 17373 - DNA, 25 bp, S. cerevisiae
aatcctttacttgttagcggtgacg

SEQ ID NO: 17374 - DNA, 25 bp, S. cerevisiae
aagactttagatcccttgttcgcga

SEQ ID NO: 17375 - DNA, 25 bp, S. cerevisiae
aagactggtaatgccggtccaagac

SEQ ID NO: 17376 - DNA, 25 bp, S. cerevisiae
aagagcgctgctaaaccgttccaaa

SEQ ID NO: 17377 - DNA, 25 bp, S. cerevisiae
aagagctatctcaaacctttcctac

SEQ ID NO: 17378 - DNA, 25 bp, S. cerevisiae
aagacattgatactaccttccctca

SEQ ID NO: 17379 - DNA, 25 bp, S. cerevisiae
aagaaatagctctcggatacttccg

SEQ ID NO: 17380 - DNA, 25 bp, S. cerevisiae
aagagactcccataggttttccgct

SEQ ID NO: 17381 - DNA, 25 bp, S. cerevisiae
aagagactaccatatcgtacgccga

SEQ ID NO: 17382 - DNA, 25 bp, S. cerevisiae
aagaactagctgatacctacgccaa

SEQ ID NO: 17383 - DNA, 25 bp, S. cerevisiae
aagaaatggctgctccttcatccga

SEQ ID NO: 17384 - DNA, 25 bp, S. cerevisiae
aagacactggcactatcctttcaga

SEQ ID NO: 17385 - DNA, 25 bp, S. cerevisiae
aagacaagctgcctgaactgttgaa

SEQ ID NO: 17386 - DNA, 25 bp, S. cerevisiae
aagaaatttgctctggcctgattga

SEQ ID NO: 17387 - DNA, 25 bp, S. cerevisiae
aagaacttgtctctgtggctgatcc

SEQ ID NO: 17388 - DNA, 25 bp, S. cerevisiae
aagaacttggccgttggtgctatcc

SEQ ID NO: 17389 - DNA, 25 bp, S. cerevisiae
aagaactttgcgtttggcctctaca

SEQ ID NO: 17390 - DNA, 25 bp, S. cerevisiae
aagactgttcatgtagacctatcca

SEQ ID NO: 17391 - DNA, 25 bp, S. cerevisiae
aagatgttccatgtcgacgtggcta

SEQ ID NO: 17392 - DNA, 25 bp, S. cerevisiae
aagaaatctgctgtcaagcctcgcc

SEQ ID NO: 17393 - DNA, 25 bp, S. cerevisiae
aagaaatcatcactttccaccatca

SEQ ID NO: 17394 - DNA, 25 bp, S. cerevisiae
aagatcataccgcttaccattaagg

SEQ ID NO: 17395 - DNA, 25 bp, S. cerevisiae
aagacaggccaaatttccctctagg

SEQ ID NO: 17396 - DNA, 25 bp, S. cerevisiae
aagaccgtcaaacgtgcctccaagg

SEQ ID NO: 17397 - DNA, 25 bp, S. cerevisiae
aagagacgtcaatgggcagcccgaa

SEQ ID NO: 17398 - DNA, 25 bp, S. cerevisiae
aagaccgtcattgggtgcagcactt

SEQ ID NO: 17399 - DNA, 25 bp, S. cerevisiae
aagaccgtcgctggtggtgcttaca

SEQ ID NO: 17400 - DNA, 25 bp, S. cerevisiae
aagaccgccccaatggagattgaga

SEQ ID NO: 17401 - DNA, 25 bp, S. cerevisiae
aagacctactacgtggagagaagca

SEQ ID NO: 17402 - DNA, 25 bp, S. cerevisiae
aagagctttctacgagggccaacga

SEQ ID NO: 17403 - DNA, 25 bp, S. cerevisiae
aagagcttttcaagaccgccaacag

SEQ ID NO: 17404 - DNA, 25 bp, S. cerevisiae
aagaggttacattactagacacaga

SEQ ID NO: 17405 - DNA, 25 bp, S. cerevisiae
aagacgttactccagtcccatcaga

SEQ ID NO: 17406 - DNA, 25 bp, S. cerevisiae
aagacatggtttcctattgccaaga

SEQ ID NO: 17407 - DNA, 25 bp, S. cerevisiae
aagacatcgctaacaccttcgagaa

SEQ ID NO: 17408 - DNA, 25 bp, S. cerevisiae
aagagccctaagacgtatcgcaaag

SEQ ID NO: 17409 - DNA, 25 bp, S. cerevisiae
aagactcctcatttcgtttacaaga

SEQ ID NO: 17410 - DNA, 25 bp, S. cerevisiae
aagactgttcattccattttaagat

SEQ ID NO: 17411 - DNA, 25 bp, S. cerevisiae
aagactgctcttgcggaagtccagg

SEQ ID NO: 17412 - DNA, 25 bp, S. cerevisiae
aagagactgcttacaactggtggtg

SEQ ID NO: 17413 - DNA, 25 bp, S. cerevisiae
aagaggcattgctgacaaggctgga

SEQ ID NO: 17414 - DNA, 25 bp, S. cerevisiae
aagagccttcatctctgtccatgga

SEQ ID NO: 17415 - DNA, 25 bp, S. cerevisiae
aagagacctatttctccacatctga

SEQ ID NO: 17416 - DNA, 25 bp, S. cerevisiae
aagaccagtggtcccataagcggaa

SEQ ID NO: 17417 - DNA, 25 bp, S. cerevisiae
aagagccgttgatgctataagggaa

SEQ ID NO: 17418 - DNA, 25 bp, S. cerevisiae
aagagacgactatgccaatgggtta

SEQ ID NO: 17419 - DNA, 25 bp, S. cerevisiae
aagagggactgatccgcatcgcgtt

SEQ ID NO: 17420 - DNA, 25 bp, S. cerevisiae
aagaggttgcgcaacacggctcggt

SEQ ID NO: 17421 - DNA, 25 bp, S. cerevisiae
aagaaatctggcacccgcagcaggt

SEQ ID NO: 17422 - DNA, 25 bp, S. cerevisiae
aagaaacgtgctgtcattgaaagta

SEQ ID NO: 17423 - DNA, 25 bp, S. cerevisiae
aagagccatcccattcagaagattt

SEQ ID NO: 17424 - DNA, 25 bp, S. cerevisiae
aagacaaccgattctcagagacaag

SEQ ID NO: 17425 - DNA, 25 bp, S. cerevisiae
aagactatccgatttagagctgaaa

SEQ ID NO: 17426 - DNA, 25 bp, S. cerevisiae
aagagcttctgtttggaacgacaca

SEQ ID NO: 17427 - DNA, 25 bp, S. cerevisiae
aagactgttgtgctggtacctcaat

SEQ ID NO: 17428 - DNA, 25 bp, S. cerevisiae
aagaggccctcggtgaattgaaaga

SEQ ID NO: 17429 - DNA, 25 bp, S. cerevisiae
aagggcagagtcgtggtaccaacaa

SEQ ID NO: 17430 - DNA, 25 bp, S. cerevisiae
aagaggccaaggatgtcaccaccac

SEQ ID NO: 17431 - DNA, 25 bp, S. cerevisiae
aagaggccgcgggtgtaatccatag

SEQ ID NO: 17432 - DNA, 25 bp, S. cerevisiae
aagagggccgcgttgatggactcca

SEQ ID NO: 17433 - DNA, 25 bp, S. cerevisiae
taaggcgagggatgctaaaccgatc

SEQ ID NO: 17434 - DNA, 25 bp, S. cerevisiae
aagagttctggctgctaaggccgct

SEQ ID NO: 17435 - DNA, 25 bp, S. cerevisiae
aagagactcttctagtacgtccaga

SEQ ID NO: 17436 - DNA, 25 bp, S. cerevisiae
aagagctttgggactcactggcgga

SEQ ID NO: 17437 - DNA, 25 bp, S. cerevisiae
aagactactagttgtcctcggcatc

SEQ ID NO: 17438 - DNA, 25 bp, S. cerevisiae
aagagtactcaatgtctgccgaatt

SEQ ID NO: 17439 - DNA, 25 bp, S. cerevisiae
aagactcttcaattgcctgacgatt

SEQ ID NO: 17440 - DNA, 25 bp, S. cerevisiae
aagagatccacctacttcatgttca

SEQ ID NO: 17441 - DNA, 25 bp, S. cerevisiae
aagagttgcttggtgccacgattct

SEQ ID NO: 17442 - DNA, 25 bp, S. cerevisiae
aagagcatatccttcaccagagcat

SEQ ID NO: 17443 - DNA, 25 bp, S. cerevisiae
aagagcgatcctttcagcaggctaa

SEQ ID NO: 17444 - DNA, 25 bp, S. cerevisiae
aagagccagaccttgcgattgcaga

SEQ ID NO: 17445 - DNA, 25 bp, S. cerevisiae
aagagcatagatccattcagcaaag

SEQ ID NO: 17446 - DNA, 25 bp, S. cerevisiae
aagatgcgactactgccagcaagaa

SEQ ID NO: 17447 - DNA, 25 bp, S. cerevisiae
aagagccacttgtcacagtagcaga

SEQ ID NO: 17448 - DNA, 25 bp, S. cerevisiae
aagagcacaaatggagcagctagaa

SEQ ID NO: 17449 - DNA, 25 bp, S. cerevisiae
aagagacttcatgggagctgcagat

SEQ ID NO: 17450 - DNA, 25 bp, S. cerevisiae
aagatacttcttggacgccttacca

SEQ ID NO: 17451 - DNA, 25 bp, S. cerevisiae
aagacgctcagtacgctcgagttat

SEQ ID NO: 17452 - DNA, 25 bp, S. cerevisiae
aagactgtatgtgccattgctttga

SEQ ID NO: 17453 - DNA, 25 bp, S. cerevisiae
aagagctatatttgacgaactggta

SEQ ID NO: 17454 - DNA, 25 bp, S. cerevisiae
aagacgataatactcctgccggtca

SEQ ID NO: 17455 - DNA, 25 bp, S. cerevisiae
aagacgctaattcattcgctgttcc

SEQ ID NO: 17456 - DNA, 25 bp, S. cerevisiae
aagacgctaagttactctctgaggt

SEQ ID NO: 17457 - DNA, 25 bp, S. cerevisiae
aagacgtgcaaattgtcatccacat

SEQ ID NO: 17458 - DNA, 25 bp, S. cerevisiae
aagagcgcattttcagatttactgt

SEQ ID NO: 17459 - DNA, 25 bp, S. cerevisiae
aagaccatttgcgtgcttctaccat

SEQ ID NO: 17460 - DNA, 25 bp, S. cerevisiae
aagacgcaagcggatgtttaacaat

SEQ ID NO: 17461 - DNA, 25 bp, S. cerevisiae
aagaccaagccggtatttgcgaatt

SEQ ID NO: 17462 - DNA, 25 bp, S. cerevisiae
aagacgaactcttaactccaatcct

SEQ ID NO: 17463 - DNA, 25 bp, S. cerevisiae
aagacgacttctttagcaccaacta

SEQ ID NO: 17464 - DNA, 25 bp, S. cerevisiae
aagagcgacctcatgctatacctga

SEQ ID NO: 17465 - DNA, 25 bp, S. cerevisiae
aagaccttcgtgttatcctatgcag

SEQ ID NO: 17466 - DNA, 25 bp, S. cerevisiae
aatgaacagacggtgctcgaccagc

SEQ ID NO: 17467 - DNA, 25 bp, S. cerevisiae
aatgctacaacggagctttcggtgc

SEQ ID NO: 17468 - DNA, 25 bp, S. cerevisiae
aagatctcaacgttgttactggtgt

SEQ ID NO: 17469 - DNA, 25 bp, S. cerevisiae
aagatcccagtactttcacaaggta

SEQ ID NO: 17470 - DNA, 25 bp, S. cerevisiae
aagactccaccgatctcaacagtgt

SEQ ID NO: 17471 - DNA, 25 bp, S. cerevisiae
aagacccgcggtcatcaaggcattg

SEQ ID NO: 17472 - DNA, 25 bp, S. cerevisiae
aagacgccgctgctgagaacggatt

SEQ ID NO: 17473 - DNA, 25 bp, S. cerevisiae
aagagtgtacgacggccgcgcttca

SEQ ID NO: 17474 - DNA, 25 bp, S. cerevisiae
aagaggttcgagtatgccggttcac

SEQ ID NO: 17475 - DNA, 25 bp, S. cerevisiae
aagaggttctggtatcgtcgcttct

SEQ ID NO: 17476 - DNA, 25 bp, S. cerevisiae
aagaggtcatttgcttggcgtcttt

SEQ ID NO: 17477 - DNA, 25 bp, S. cerevisiae
aagatggatccgattccgctttcaa

SEQ ID NO: 17478 - DNA, 25 bp, S. cerevisiae
aagaggcatttttggccgattccat

SEQ ID NO: 17479 - DNA, 25 bp, S. cerevisiae
aagaggcttcttctcttttccatta

SEQ ID NO: 17480 - DNA, 25 bp, S. cerevisiae
aagaccctggatatctccattgact

SEQ ID NO: 17481 - DNA, 25 bp, S. cerevisiae
aagaccttagtcattgctccatact

SEQ ID NO: 17482 - DNA, 25 bp, S. cerevisiae
aagaccgtagaccagcttccaacat

SEQ ID NO: 17483 - DNA, 25 bp, S. cerevisiae
aagactatcggtgcgctccaaatgg

SEQ ID NO: 17484 - DNA, 25 bp, S. cerevisiae
aagactttgctgtctaccaatatgt

SEQ ID NO: 17485 - DNA, 25 bp, S. cerevisiae
aagagatgatcgcaacagccaaatc

SEQ ID NO: 17486 - DNA, 25 bp, S. cerevisiae
aagacggctatctttctcgtaacac

SEQ ID NO: 17487 - DNA, 25 bp, S. cerevisiae
aagactgttccatttcaagtgaatc

SEQ ID NO: 17488 - DNA, 25 bp, S. cerevisiae
aagaggctacgttgttctggccaaa

SEQ ID NO: 17489 - DNA, 25 bp, S. cerevisiae
aagagcgcttggtgcttgcattcca

SEQ ID NO: 17490 - DNA, 25 bp, S. cerevisiae
aagagattccgtcgataaggctaat

SEQ ID NO: 17491 - DNA, 25 bp, S. cerevisiae
aagagttcgcctacccatatttttg

SEQ ID NO: 17492 - DNA, 25 bp, S. cerevisiae
aagagatctcggtcctcgcatattt

SEQ ID NO: 17493 - DNA, 25 bp, S. cerevisiae
aagagccctggaattgcctgaagta

SEQ ID NO: 17494 - DNA, 25 bp, S. cerevisiae
aagaccttgaagttggctagagctc

SEQ ID NO: 17495 - DNA, 25 bp, S. cerevisiae
aagacctgtcaaccgagctggattc

SEQ ID NO: 17496 - DNA, 25 bp, S. cerevisiae
aagaggcattcaactgggccttgaa

SEQ ID NO: 17497 - DNA, 25 bp, S. cerevisiae
aagggctttacagtggacttacctg

SEQ ID NO: 17498 - DNA, 25 bp, S. cerevisiae
gaaggtttcccaagagagttttctg

SEQ ID NO: 17499 - DNA, 25 bp, S. cerevisiae
aagttcttacctgaagtgcgattct

SEQ ID NO: 17500 - DNA, 25 bp, S. cerevisiae
aagtacctcgacgtacgtcctcttg

SEQ ID NO: 17501 - DNA, 25 bp, S. cerevisiae
aagactgttcgctagtcaaccttct

SEQ ID NO: 17502 - DNA, 25 bp, S. cerevisiae
aagactggctggtgcttacctgtgg

SEQ ID NO: 17503 - DNA, 25 bp, S. cerevisiae
aagagctggcttttttgaacggagg

SEQ ID NO: 17504 - DNA, 25 bp, S. cerevisiae
aaggctggatattcccttagacggg

SEQ ID NO: 17505 - DNA, 25 bp, S. cerevisiae
aagtcggtattcactttgccgtggc

SEQ ID NO: 17506 - DNA, 25 bp, S. cerevisiae
aagtcgtaattcatcctaaccaagg

SEQ ID NO: 17507 - DNA, 25 bp, S. cerevisiae
aatgtggtagacatcccgaacccag

SEQ ID NO: 17508 - DNA, 25 bp, S. cerevisiae
aagagtttgttgaacggtcccagca

SEQ ID NO: 17509 - DNA, 25 bp, S. cerevisiae
aagaggttgccgatcaagccgctac

SEQ ID NO: 17510 - DNA, 25 bp, S. cerevisiae
aagacgcttcgacagcaacgccaag

SEQ ID NO: 17511 - DNA, 25 bp, S. cerevisiae
aagagccctcggaagcagtagacaa

SEQ ID NO: 17512 - DNA, 25 bp, S. cerevisiae
aagacctctccagtcaagatgggat

SEQ ID NO: 17513 - DNA, 25 bp, S. cerevisiae
aagacctgcctgcaccaacgatggt

SEQ ID NO: 17514 - DNA, 25 bp, S. cerevisiae
aagatcagccactggtgctaaacgt

SEQ ID NO: 17515 - DNA, 25 bp, S. cerevisiae
aagattgccaagacctttaccgtcg

SEQ ID NO: 17516 - DNA, 25 bp, S. cerevisiae
aagagtgtcaagaccggctacttat

SEQ ID NO: 17517 - DNA, 25 bp, S. cerevisiae
aagatggcataagctcgccctttat

SEQ ID NO: 17518 - DNA, 25 bp, S. cerevisiae
aagaggccagtgacctgattcgtga

SEQ ID NO: 17519 - DNA, 25 bp, S. cerevisiae
aagattcaagtagagcgcagcgtca

SEQ ID NO: 17520 - DNA, 25 bp, S. cerevisiae
aagagattttctgcgattgcctacg

SEQ ID NO: 17521 - DNA, 25 bp, S. cerevisiae
aagagaattgctaccgctatcgaaa

SEQ ID NO: 17522 - DNA, 25 bp, S. cerevisiae
aagtccaatggacgcctttgatagc

SEQ ID NO: 17523 - DNA, 25 bp, S. cerevisiae
aagacgtgggcatcgttgcacaaca

SEQ ID NO: 17524 - DNA, 25 bp, S. cerevisiae
aagactgttcacattggccgaatcc

SEQ ID NO: 17525 - DNA, 25 bp, S. cerevisiae
aagacgttctcaattggctcaacaa

SEQ ID NO: 17526 - DNA, 25 bp, S. cerevisiae
aagaggatttcactttgccaaccag

SEQ ID NO: 17527 - DNA, 25 bp, S. cerevisiae
aagaggagcctcctattgtcacacc

SEQ ID NO: 17528 - DNA, 25 bp, S. cerevisiae
aagagtctactgcttttacatccca

SEQ ID NO: 17529 - DNA, 25 bp, S. cerevisiae
aagagtcctgcaatggttggagaca

SEQ ID NO: 17530 - DNA, 25 bp, S. cerevisiae
aagagctcgtgatttattgcgtcaa

SEQ ID NO: 17531 - DNA, 25 bp, S. cerevisiae
aagagtgtaccatgttgctgagcaa

SEQ ID NO: 17532 - DNA, 25 bp, S. cerevisiae
aagagagctggcctatagcgcttca

SEQ ID NO: 17533 - DNA, 25 bp, S. cerevisiae
aagacgctactgtgtgcttgcagga

SEQ ID NO: 17534 - DNA, 25 bp, S. cerevisiae
aagacgcctcgttgctgttgcggaa

SEQ ID NO: 17535 - DNA, 25 bp, S. cerevisiae
aagataggcgcgctgttatggataa

SEQ ID NO: 17536 - DNA, 25 bp, S. cerevisiae
aagattggtggttctttagctagaa

SEQ ID NO: 17537 - DNA, 25 bp, S. cerevisiae
aagagcggtctttcttcttgttcta

SEQ ID NO: 17538 - DNA, 25 bp, S. cerevisiae
aagacggcggattcaacattgcaaa

SEQ ID NO: 17539 - DNA, 25 bp, S. cerevisiae
aagaccattctgtcactttgagaga

SEQ ID NO: 17540 - DNA, 25 bp, S. cerevisiae
aagacgcttctgtttatcgtgcgga

SEQ ID NO: 17541 - DNA, 25 bp, S. cerevisiae
aagacctgttccgatttgttgctgg

SEQ ID NO: 17542 - DNA, 25 bp, S. cerevisiae
aagaccatgctgactccttgggtag

SEQ ID NO: 17543 - DNA, 25 bp, S. cerevisiae
aagatcggtgctccatttgctgcaa

SEQ ID NO: 17544 - DNA, 25 bp, S. cerevisiae
aagaccagcagctaacttggcgcaa

SEQ ID NO: 17545 - DNA, 25 bp, S. cerevisiae
aagagatcaggtgacccttgaggaa

SEQ ID NO: 17546 - DNA, 25 bp, S. cerevisiae
aagaccaggatttcacccggtgaat

SEQ ID NO: 17547 - DNA, 25 bp, S. cerevisiae
aagaccgtcatgtcatcttcttggc

SEQ ID NO: 17548 - DNA, 25 bp, S. cerevisiae
aagacctctgccatctctcaaatta

SEQ ID NO: 17549 - DNA, 25 bp, S. cerevisiae
aagatttatctctaccgacatatta

SEQ ID NO: 17550 - DNA, 25 bp, S. cerevisiae
aagtaagcaactcctcagacacgtt

SEQ ID NO: 17551 - DNA, 25 bp, S. cerevisiae
aagatcaagcgagtccatcggcgac

SEQ ID NO: 17552 - DNA, 25 bp, S. cerevisiae
aagagcaataccgaaccgcctgagg

SEQ ID NO: 17553 - DNA, 25 bp, S. cerevisiae
aagttggtcttaaacatttctgttg

SEQ ID NO: 17554 - DNA, 25 bp, S. cerevisiae
aagattgagtttccctcacttcgtg

SEQ ID NO: 17555 - DNA, 25 bp, S. cerevisiae
aagattttgacttggtcgttgccga

SEQ ID NO: 17556 - DNA, 25 bp, S. cerevisiae
aagagcttcgggttcgggcctgtca

SEQ ID NO: 17557 - DNA, 25 bp, S. cerevisiae
aagatgctggttacacgttccctaa

SEQ ID NO: 17558 - DNA, 25 bp, S. cerevisiae
aagagaggcgccaacagggtcagaa

SEQ ID NO: 17559 - DNA, 25 bp, S. cerevisiae
aagagaagctgccaatgccggtaaa

SEQ ID NO: 17560 - DNA, 25 bp, S. cerevisiae
aagagaactctcaggtggctacgaa

SEQ ID NO: 17561 - DNA, 25 bp, S. cerevisiae
aagagtactactggttttcacaata

SEQ ID NO: 17562 - DNA, 25 bp, S. cerevisiae
aagagtggtctcagctttacaaatg

SEQ ID NO: 17563 - DNA, 25 bp, S. cerevisiae
aagagtggcttacctttacttgatt

SEQ ID NO: 17564 - DNA, 25 bp, S. cerevisiae
aagagaccaattactagccgccgaa

SEQ ID NO: 17565 - DNA, 25 bp, S. cerevisiae
aagagtccacgaactagctcgggta

SEQ ID NO: 17566 - DNA, 25 bp, S. cerevisiae
aagtggagaacccttggaagagtca

SEQ ID NO: 17567 - DNA, 25 bp, S. cerevisiae
aagatgctctaagttccactaatgc

SEQ ID NO: 17568 - DNA, 25 bp, S. cerevisiae
aagaggaacatcaccgctctgcgga

SEQ ID NO: 17569 - DNA, 25 bp, S. cerevisiae
aagaggtcaatcagcagtgccgcag

SEQ ID NO: 17570 - DNA, 25 bp, S. cerevisiae
aagagcggctacatgatgctgccca

SEQ ID NO: 17571 - DNA, 25 bp, S. cerevisiae
aagaggctgctttagaagcatccaa

SEQ ID NO: 17572 - DNA, 25 bp, S. cerevisiae
aagaggcgtcacttcaagctcaaga

SEQ ID NO: 17573 - DNA, 25 bp, S. cerevisiae
aagatggtccacgtccattcaaggt

SEQ ID NO: 17574 - DNA, 25 bp, S. cerevisiae
aagatgggcgccgatcactacattg

SEQ ID NO: 17575 - DNA, 25 bp, S. cerevisiae
aagatcctccgcgatgactgaatat

SEQ ID NO: 17576 - DNA, 25 bp, S. cerevisiae
aagatacacccgacagttgctatat

SEQ ID NO: 17577 - DNA, 25 bp, S. cerevisiae
aagtacccacaattgtttcagttat

SEQ ID NO: 17578 - DNA, 25 bp, S. cerevisiae
aagagtatcgcctgtgtcttgaccg

SEQ ID NO: 17579 - DNA, 25 bp, S. cerevisiae
aagatgatgtatccgttccttgacc

SEQ ID NO: 17580 - DNA, 25 bp, S. cerevisiae
aagagcttagtccattcgcatctgt

SEQ ID NO: 17581 - DNA, 25 bp, S. cerevisiae
aagagcattcttgattccatttgta

SEQ ID NO: 17582 - DNA, 25 bp, S. cerevisiae
aatgtctacttgaaattgttagtca

SEQ ID NO: 17583 - DNA, 25 bp, S. cerevisiae
aagttccggaatacagtggcgccaa

SEQ ID NO: 17584 - DNA, 25 bp, S. cerevisiae
aagtcctgggtctcgtgaagccaag

SEQ ID NO: 17585 - DNA, 25 bp, S. cerevisiae
aagttcagacgtcttgccattggaa

SEQ ID NO: 17586 - DNA, 25 bp, S. cerevisiae
aagtctaccgacgtggatttgtaca

SEQ ID NO: 17587 - DNA, 25 bp, S. cerevisiae
aagatcgtccaagaggccttcatta

SEQ ID NO: 17588 - DNA, 25 bp, S. cerevisiae
aagatcgatgctccaaacgccgttt

SEQ ID NO: 17589 - DNA, 25 bp, S. cerevisiae
aagaggattcactacatcgggtcat

SEQ ID NO: 17590 - DNA, 25 bp, S. cerevisiae
aagggatcacaatacgcggcctggc

SEQ ID NO: 17591 - DNA, 25 bp, S. cerevisiae
aagaggctccaatttccaaggctct

SEQ ID NO: 17592 - DNA, 25 bp, S. cerevisiae
aagatggatccactcctttggtgat

SEQ ID NO: 17593 - DNA, 25 bp, S. cerevisiae
aagagtttcaaggtattcagcggca

SEQ ID NO: 17594 - DNA, 25 bp, S. cerevisiae
aagagtttagaagatgggcagccaa

SEQ ID NO: 17595 - DNA, 25 bp, S. cerevisiae
aagacctttatcgaattcgccctct

SEQ ID NO: 17596 - DNA, 25 bp, S. cerevisiae
aatgtcccttgacaggtggtctttt

SEQ ID NO: 17597 - DNA, 25 bp, S. cerevisiae
aagtcgcgatgcacggagaccacgt

SEQ ID NO: 17598 - DNA, 25 bp, S. cerevisiae
aagatccgtctagggatacctccgg

SEQ ID NO: 17599 - DNA, 25 bp, S. cerevisiae
aagattcggctacgcaatcacctgc

SEQ ID NO: 17600 - DNA, 25 bp, S. cerevisiae
aagatcatctgtggcaacgaccgct

SEQ ID NO: 17601 - DNA, 25 bp, S. cerevisiae
aagagcttccgcaatatcaggtcct

SEQ ID NO: 17602 - DNA, 25 bp, S. cerevisiae
aagagttttgactactttcccagat

SEQ ID NO: 17603 - DNA, 25 bp, S. cerevisiae
aagttgtttgacgacttcgaccagt

SEQ ID NO: 17604 - DNA, 25 bp, S. cerevisiae
aagtcctaatcatactaccaccgat

SEQ ID NO: 17605 - DNA, 25 bp, S. cerevisiae
aagatccaccaatacttattccaag

SEQ ID NO: 17606 - DNA, 25 bp, S. cerevisiae
aagatccaccaatacttattccaag

SEQ ID NO: 17607 - DNA, 25 bp, S. cerevisiae
aagatcgttcactttcgtattccgg

SEQ ID NO: 17608 - DNA, 25 bp, S. cerevisiae
aagagcgagttccaatccttgcaat

SEQ ID NO: 17609 - DNA, 25 bp, S. cerevisiae
aagagcgatgttccttacttgcagt

SEQ ID NO: 17610 - DNA, 25 bp, S. cerevisiae
aagagcgtgatttctataccgcaga

SEQ ID NO: 17611 - DNA, 25 bp, S. cerevisiae
aagagggcatcttctggagacgaga

SEQ ID NO: 17612 - DNA, 25 bp, S. cerevisiae
aagttgagttcctcgactagcacct

SEQ ID NO: 17613 - DNA, 25 bp, S. cerevisiae
aagtaagttacctgccttcacctat

SEQ ID NO: 17614 - DNA, 25 bp, S. cerevisiae
aagttggcagcaataccgtgttcca

SEQ ID NO: 17615 - DNA, 25 bp, S. cerevisiae
aagagtggtgcttacggtgataaac

SEQ ID NO: 17616 - DNA, 25 bp, S. cerevisiae
aagagacggtaaggctccagaagct

SEQ ID NO: 17617 - DNA, 25 bp, S. cerevisiae
aagtcatcgggatcttccgactcgt

SEQ ID NO: 17618 - DNA, 25 bp, S. cerevisiae
aagtttgcaggctcttaagccccat

SEQ ID NO: 17619 - DNA, 25 bp, S. cerevisiae
aagtatgctggtgtcgtaaccccgt

SEQ ID NO: 17620 - DNA, 25 bp, S. cerevisiae
aagatcctcgaaactataccttccg

SEQ ID NO: 17621 - DNA, 25 bp, S. cerevisiae
aagtcatctcttctctacgtataac

SEQ ID NO: 17622 - DNA, 25 bp, S. cerevisiae
aagttctggttattggcgcttcaac

SEQ ID NO: 17623 - DNA, 25 bp, S. cerevisiae
aagtactggcctgttagcttcctcg

SEQ ID NO: 17624 - DNA, 25 bp, S. cerevisiae
aatgtaagaggtccactcaccagcc

SEQ ID NO: 17625 - DNA, 25 bp, S. cerevisiae
aagatagaggtcaacttccgtgctt

SEQ ID NO: 17626 - DNA, 25 bp, S. cerevisiae
aagatcaaggtcttctgccattgcc

SEQ ID NO: 17627 - DNA, 25 bp, S. cerevisiae
aagaggaagctgtcgctcatccaga

SEQ ID NO: 17628 - DNA, 25 bp, S. cerevisiae
aagagagggccaccatttcaacacg

SEQ ID NO: 17629 - DNA, 25 bp, S. cerevisiae
aagagaggtgccactgctatcacca

SEQ ID NO: 17630 - DNA, 25 bp, S. cerevisiae
aagataccaatgttaccatcgcgcc

SEQ ID NO: 17631 - DNA, 25 bp, S. cerevisiae
aagattacagttaacgtcgcccgct

SEQ ID NO: 17632 - DNA, 25 bp, S. cerevisiae
aagattggaatcctacgttgcctcc

SEQ ID NO: 17633 - DNA, 25 bp, S. cerevisiae
aagatttagtccaacagtctccaaa

SEQ ID NO: 17634 - DNA, 25 bp, S. cerevisiae
aagatattgccaaaccttcgccaaa

SEQ ID NO: 17635 - DNA, 25 bp, S. cerevisiae
aagataatgtagacccgctgcaccg

SEQ ID NO: 17636 - DNA, 25 bp, S. cerevisiae
aagatggcgtaaagtcgctcccgca

SEQ ID NO: 17637 - DNA, 25 bp, S. cerevisiae
aagatgggctttccacaccagtaaa

SEQ ID NO: 17638 - DNA, 25 bp, S. cerevisiae
aagatccgcttttccaccaaataga

SEQ ID NO: 17639 - DNA, 25 bp, S. cerevisiae
aagatacctttctgcaacgaatgaa

SEQ ID NO: 17640 - DNA, 25 bp, S. cerevisiae
aagagcacgctcctggtacaataag

SEQ ID NO: 17641 - DNA, 25 bp, S. cerevisiae
aagagtagctgccttggaagaacaa

SEQ ID NO: 17642 - DNA, 25 bp, S. cerevisiae
aaggttggcctctggatgaaaatgg

SEQ ID NO: 17643 - DNA, 25 bp, S. cerevisiae
aagattgtccccttaagcgaactgg

SEQ ID NO: 17644 - DNA, 25 bp, S. cerevisiae
aagttggccccagctagagttagaa

SEQ ID NO: 17645 - DNA, 25 bp, S. cerevisiae
aagattaccccagctattgcggaac

SEQ ID NO: 17646 - DNA, 25 bp, S. cerevisiae
aagatgaaccgcaaccttttggaat

SEQ ID NO: 17647 - DNA, 25 bp, S. cerevisiae
aagagtgtacgtttccagcaatggg

SEQ ID NO: 17648 - DNA, 25 bp, S. cerevisiae
aagagatcatcaagtgttccacaag

SEQ ID NO: 17649 - DNA, 25 bp, S. cerevisiae
aagagatctcgcctattccacagga

SEQ ID NO: 17650 - DNA, 25 bp, S. cerevisiae
aagagaatgctccttcttccacgag

SEQ ID NO: 17651 - DNA, 25 bp, S. cerevisiae
aagagatatgcatcttcattacccc

SEQ ID NO: 17652 - DNA, 25 bp, S. cerevisiae
aagatgatatgcctcatgccactaa

SEQ ID NO: 17653 - DNA, 25 bp, S. cerevisiae
aagattaatgatggacaaattcgcc

SEQ ID NO: 17654 - DNA, 25 bp, S. cerevisiae
aatgatttggcaaaaagttccagcc

SEQ ID NO: 17655 - DNA, 25 bp, S. cerevisiae
aagatcttgacagagcacgcttccc

SEQ ID NO: 17656 - DNA, 25 bp, S. cerevisiae
aagattgaacagctgcacccattcc

SEQ ID NO: 17657 - DNA, 25 bp, S. cerevisiae
aagatgttacagctgacccctatat

SEQ ID NO: 17658 - DNA, 25 bp, S. cerevisiae
aagatgttaccccagttccatctga

SEQ ID NO: 17659 - DNA, 25 bp, S. cerevisiae
aagagtttcagtccagcttcttctg

SEQ ID NO: 17660 - DNA, 25 bp, S. cerevisiae
aagatcgttattcccttctctagag

SEQ ID NO: 17661 - DNA, 25 bp, S. cerevisiae
aagattattacctactttatatgag

SEQ ID NO: 17662 - DNA, 25 bp, S. cerevisiae
aagagtttccgcaacctgtcagaga

SEQ ID NO: 17663 - DNA, 25 bp, S. cerevisiae
aagagattttccagccttggcagcc

SEQ ID NO: 17664 - DNA, 25 bp, S. cerevisiae
aagtttagttccattcacctactca

SEQ ID NO: 17665 - DNA, 25 bp, S. cerevisiae
aagagatttctctaaggcctctccg

SEQ ID NO: 17666 - DNA, 25 bp, S. cerevisiae
aagagtgctcgttcaaggcttctcc

SEQ ID NO: 17667 - DNA, 25 bp, S. cerevisiae
aagttcagcgaggacaatttcaata

SEQ ID NO: 17668 - DNA, 25 bp, S. cerevisiae
aagattgacctcttgaaatccgcta

SEQ ID NO: 17669 - DNA, 25 bp, S. cerevisiae
aagattactggctggattacgcaat

SEQ ID NO: 17670 - DNA, 25 bp, S. cerevisiae
aagatagccgcgtggatgcgctact

SEQ ID NO: 17671 - DNA, 25 bp, S. cerevisiae
aagagaccgcaaggcggcgtcatta

SEQ ID NO: 17672 - DNA, 25 bp, S. cerevisiae
aagagtctgtaaatttggcatgcaa

SEQ ID NO: 17673 - DNA, 25 bp, S. cerevisiae
aagagatctacggatttggctcaaa

SEQ ID NO: 17674 - DNA, 25 bp, S. cerevisiae
aagagttgggtcattctgctaacat

SEQ ID NO: 17675 - DNA, 25 bp, S. cerevisiae
aagatgtttgagcaattgtctaaag

SEQ ID NO: 17676 - DNA, 25 bp, S. cerevisiae
aagtcaaccgtattctagtagcagc

SEQ ID NO: 17677 - DNA, 25 bp, S. cerevisiae
aaggaacctgtctctgactggactg

SEQ ID NO: 17678 - DNA, 25 bp, S. cerevisiae
aatgatcaccggtgttccatggtac

SEQ ID NO: 17679 - DNA, 25 bp, S. cerevisiae
aataacggccacatttacgaagaag

SEQ ID NO: 17680 - DNA, 25 bp, S. cerevisiae
aattacgccacgattaccgaagaag

SEQ ID NO: 17681 - DNA, 25 bp, S. cerevisiae
aagtaccctcgagtaagccgaatag

SEQ ID NO: 17682 - DNA, 25 bp, S. cerevisiae
aagatatcgctcaggtgccagccga

SEQ ID NO: 17683 - DNA, 25 bp, S. cerevisiae
aagatcctacttcttggatgtcaaa

SEQ ID NO: 17684 - DNA, 25 bp, S. cerevisiae
aagattcatttacggcagatgccaa

SEQ ID NO: 17685 - DNA, 25 bp, S. cerevisiae
aagagtatgctccatttgcttccga

SEQ ID NO: 17686 - DNA, 25 bp, S. cerevisiae
aagatcgactccttggttgccaacg

SEQ ID NO: 17687 - DNA, 25 bp, S. cerevisiae
aagatgcggctcttttgttgagcaa

SEQ ID NO: 17688 - DNA, 25 bp, S. cerevisiae
aagatggcgatctctcgttggagaa

SEQ ID NO: 17689 - DNA, 25 bp, S. cerevisiae
aagagatgcctctgagcgagtcatt

SEQ ID NO: 17690 - DNA, 25 bp, S. cerevisiae
aagagatccatttgctatgatgagt

SEQ ID NO: 17691 - DNA, 25 bp, S. cerevisiae
aagagtacatctacacattgcgtgg

SEQ ID NO: 17692 - DNA, 25 bp, S. cerevisiae
aagagatagttttgcttccacgaaa

SEQ ID NO: 17693 - DNA, 25 bp, S. cerevisiae
aagatttttgcgtttcctgttgctg

SEQ ID NO: 17694 - DNA, 25 bp, S. cerevisiae
aagagtctttgggtctaagttcaga

SEQ ID NO: 17695 - DNA, 25 bp, S. cerevisiae
aagatacagaacctcctccagatgg

SEQ ID NO: 17696 - DNA, 25 bp, S. cerevisiae
aagatgcccgcattttcgagaatga

SEQ ID NO: 17697 - DNA, 25 bp, S. cerevisiae
aagatcctgcactttcttgaagaag

SEQ ID NO: 17698 - DNA, 25 bp, S. cerevisiae
aagatgcctgcacattctcatcaag

SEQ ID NO: 17699 - DNA, 25 bp, S. cerevisiae
aagattgctaggatccaaggctgat

SEQ ID NO: 17700 - DNA, 25 bp, S. cerevisiae
gaatggaccggccatcggacttagc

SEQ ID NO: 17701 - DNA, 25 bp, S. cerevisiae
aagatagtcgtgaacggccatctcc

SEQ ID NO: 17702 - DNA, 25 bp, S. cerevisiae
aagtatgtcggtagtgccgtaccaa

SEQ ID NO: 17703 - DNA, 25 bp, S. cerevisiae
aagttgggagatagtgccgatccta

SEQ ID NO: 17704 - DNA, 25 bp, S. cerevisiae
aagagtgcgggctgtcctgatactt

SEQ ID NO: 17705 - DNA, 25 bp, S. cerevisiae
aagagtggtttattccttcccatca

SEQ ID NO: 17706 - DNA, 25 bp, S. cerevisiae
aagaggtttttgtaccgcaccatga

SEQ ID NO: 17707 - DNA, 25 bp, S. cerevisiae
aagagtacttcaaacctgcggcatg

SEQ ID NO: 17708 - DNA, 25 bp, S. cerevisiae
aagtaaatccaattcaagcggcagt

SEQ ID NO: 17709 - DNA, 25 bp, S. cerevisiae
aagttccaatcctatcgagcgaagt

SEQ ID NO: 17710 - DNA, 25 bp, S. cerevisiae
aagtctgcgcaatcacagcgacgag

SEQ ID NO: 17711 - DNA, 25 bp, S. cerevisiae
aagattctgagatgactgccaagca

SEQ ID NO: 17712 - DNA, 25 bp, S. cerevisiae
aagattctgccgactttcaagcacg

SEQ ID NO: 17713 - DNA, 25 bp, S. cerevisiae
aagatgttgctagggtctgccatgc

SEQ ID NO: 17714 - DNA, 25 bp, S. cerevisiae
aagagttgtatacgctcaccactat

SEQ ID NO: 17715 - DNA, 25 bp, S. cerevisiae
aagagtgtgcttaagctgccctata

SEQ ID NO: 17716 - DNA, 25 bp, S. cerevisiae
aagagtggcctttctccaattgaga

SEQ ID NO: 17717 - DNA, 25 bp, S. cerevisiae
aagaggactctcaaccgacagaaga

SEQ ID NO: 17718 - DNA, 25 bp, S. cerevisiae
aagggccttgcaagccagaaagaaa

SEQ ID NO: 17719 - DNA, 25 bp, S. cerevisiae
aagaggcttgtgtcgccatcaaaga

SEQ ID NO: 17720 - DNA, 25 bp, S. cerevisiae
aagagtctcttgcatggcaatacga

SEQ ID NO: 17721 - DNA, 25 bp, S. cerevisiae
aagattcgatcactatggccaagga

SEQ ID NO: 17722 - DNA, 25 bp, S. cerevisiae
aagatgtcagtactgcaggcgcaaa

SEQ ID NO: 17723 - DNA, 25 bp, S. cerevisiae
aagatgctcagtggtctacgctaca

SEQ ID NO: 17724 - DNA, 25 bp, S. cerevisiae
aagtacctacggacactagcacgac

SEQ ID NO: 17725 - DNA, 25 bp, S. cerevisiae
aagtatgcgttatcactcttcgagc

SEQ ID NO: 17726 - DNA, 25 bp, S. cerevisiae
aagagtcttttttgagatcagttca

SEQ ID NO: 17727 - DNA, 25 bp, S. cerevisiae
aagaggcctatggacgttgcatttc

SEQ ID NO: 17728 - DNA, 25 bp, S. cerevisiae
aagagtctctagtggttcatcatta

SEQ ID NO: 17729 - DNA, 25 bp, S. cerevisiae
aagaggcctcgctgaattcatcttc

SEQ ID NO: 17730 - DNA, 25 bp, S. cerevisiae
aagatgcccaaccagaatccatttc

SEQ ID NO: 17731 - DNA, 25 bp, S. cerevisiae
aagtggtgcaagctatttctttttt

SEQ ID NO: 17732 - DNA, 25 bp, S. cerevisiae
aagtcagtgcttcttccttcttttt

SEQ ID NO: 17733 - DNA, 25 bp, S. cerevisiae
aagtaattctcgatccgcctaaaat

SEQ ID NO: 17734 - DNA, 25 bp, S. cerevisiae
aagattaccctgatgttcctaaagt

SEQ ID NO: 17735 - DNA, 25 bp, S. cerevisiae
aaggtaatggcgctgtttctaacag

SEQ ID NO: 17736 - DNA, 25 bp, S. cerevisiae
aagtatgaaggcacgtttcgacaag

SEQ ID NO: 17737 - DNA, 25 bp, S. cerevisiae
aagttgctaggcacgctgaatccac

SEQ ID NO: 17738 - DNA, 25 bp, S. cerevisiae
aagattcaacatgggctagtccaca

SEQ ID NO: 17739 - DNA, 25 bp, S. cerevisiae
aagatcgacgcaatggtggccacaa

SEQ ID NO: 17740 - DNA, 25 bp, S. cerevisiae
aagatagcagcctaggttcccatag

SEQ ID NO: 17741 - DNA, 25 bp, S. cerevisiae
aagatacgccataggaatgctttcg

SEQ ID NO: 17742 - DNA, 25 bp, S. cerevisiae
aagatcctgacagtggtgttgccgg

SEQ ID NO: 17743 - DNA, 25 bp, S. cerevisiae
aagtcctgaaggatttcccgcgatt

SEQ ID NO: 17744 - DNA, 25 bp, S. cerevisiae
aagtatctgacatgttcgaccgcgc

SEQ ID NO: 17745 - DNA, 25 bp, S. cerevisiae
aagtatgccaagctgaggagccctc

SEQ ID NO: 17746 - DNA, 25 bp, S. cerevisiae
aagtagccgtctctggtcaggcata

SEQ ID NO: 17747 - DNA, 25 bp, S. cerevisiae
aagtcaccgttgctggtgttgtcac

SEQ ID NO: 17748 - DNA, 25 bp, S. cerevisiae
aagttggcggagctggttccatccc

SEQ ID NO: 17749 - DNA, 25 bp, S. cerevisiae
aagatttgttggctcgttgactctc

SEQ ID NO: 17750 - DNA, 25 bp, S. cerevisiae
aagatcttttacctgatttcgacca

SEQ ID NO: 17751 - DNA, 25 bp, S. cerevisiae
aagttgaagtccctaacactagcgc

SEQ ID NO: 17752 - DNA, 25 bp, S. cerevisiae
aagatgaaatcgttccacccttcca

SEQ ID NO: 17753 - DNA, 25 bp, S. cerevisiae
aagtataattttcgccccatttcag

SEQ ID NO: 17754 - DNA, 25 bp, S. cerevisiae
aagatcgaaggtgtcgctactccac

SEQ ID NO: 17755 - DNA, 25 bp, S. cerevisiae
aagattgaaggtgttgccactccac

SEQ ID NO: 17756 - DNA, 25 bp, S. cerevisiae
aagattatatggtcttcctcacccc

SEQ ID NO: 17757 - DNA, 25 bp, S. cerevisiae
aagattcattggatggtccccacag

SEQ ID NO: 17758 - DNA, 25 bp, S. cerevisiae
aagttttcagttctggcgcatttgc

SEQ ID NO: 17759 - DNA, 25 bp, S. cerevisiae
aagattatccagacacatgcgccgt

SEQ ID NO: 17760 - DNA, 25 bp, S. cerevisiae
aagatgctattatcgctgctccagt

SEQ ID NO: 17761 - DNA, 25 bp, S. cerevisiae
aagatgctttccaaatgctggatga

SEQ ID NO: 17762 - DNA, 25 bp, S. cerevisiae
aagatgcaccacacgatgcgttgaa

SEQ ID NO: 17763 - DNA, 25 bp, S. cerevisiae
aagataccactgaagacggctgaag

SEQ ID NO: 17764 - DNA, 25 bp, S. cerevisiae
aagataccttgccatgtcgttctag

SEQ ID NO: 17765 - DNA, 25 bp, S. cerevisiae
aagattggctacctgtcgtttgatc

SEQ ID NO: 17766 - DNA, 25 bp, S. cerevisiae
aagtctagagccatgtcgatttcaa

SEQ ID NO: 17767 - DNA, 25 bp, S. cerevisiae
aagtctagagccatgtcgatttcaa

SEQ ID NO: 17768 - DNA, 25 bp, S. cerevisiae
aagttcgctgcctatattacgtgaa

SEQ ID NO: 17769 - DNA, 25 bp, S. cerevisiae
aagattcgatcctgtgtacgtccaa

SEQ ID NO: 17770 - DNA, 25 bp, S. cerevisiae
aatctactggtatggctaacatcac

SEQ ID NO: 17771 - DNA, 25 bp, S. cerevisiae
aagatgattggtcctcgtggtctgc

SEQ ID NO: 17772 - DNA, 25 bp, S. cerevisiae
aagatcttggtgttcgttcattgca

SEQ ID NO: 17773 - DNA, 25 bp, S. cerevisiae
aagatcctgtgttggtgttgcttcc

SEQ ID NO: 17774 - DNA, 25 bp, S. cerevisiae
aagattggtggttctcttgccagaa

SEQ ID NO: 17775 - DNA, 25 bp, S. cerevisiae
aagatgctacgtcgcactggctgta

SEQ ID NO: 17776 - DNA, 25 bp, S. cerevisiae
aagatgctatggctgttgctcgtaa

SEQ ID NO: 17777 - DNA, 25 bp, S. cerevisiae
aagatgccacgcctgtttcaaaata

SEQ ID NO: 17778 - DNA, 25 bp, S. cerevisiae
aagatgcaacctcttctgaccagat

SEQ ID NO: 17779 - DNA, 25 bp, S. cerevisiae
aagatccttatgacgcactagggaa

SEQ ID NO: 17780 - DNA, 25 bp, S. cerevisiae
aagtaccagtaacttggcttcgcct

SEQ ID NO: 17781 - DNA, 25 bp, S. cerevisiae
aagtactcagtaagtgccggtccct

SEQ ID NO: 17782 - DNA, 25 bp, S. cerevisiae
aagttccaacttgtgggtgcagcct

SEQ ID NO: 17783 - DNA, 25 bp, S. cerevisiae
aagattagccttctggatgcccact

SEQ ID NO: 17784 - DNA, 25 bp, S. cerevisiae
aagatatcgtccaacgggcctggtg

SEQ ID NO: 17785 - DNA, 25 bp, S. cerevisiae
aagatcatcgtctcaatggccaagg

SEQ ID NO: 17786 - DNA, 25 bp, S. cerevisiae
aagtttgttacagtgcgacgatggc

SEQ ID NO: 17787 - DNA, 25 bp, S. cerevisiae
aagtctttgcatgtactcgtaacca

SEQ ID NO: 17788 - DNA, 25 bp, S. cerevisiae
aagtcaaggttttgcctggaaccag

SEQ ID NO: 17789 - DNA, 25 bp, S. cerevisiae
aagtctaacttgttactggccaccg

SEQ ID NO: 17790 - DNA, 25 bp, S. cerevisiae
aatccttaacttctactatccaaca

SEQ ID NO: 17791 - DNA, 25 bp, S. cerevisiae
aagtatttacttgctgaacccaaca

SEQ ID NO: 17792 - DNA, 25 bp, S. cerevisiae
aagatagttacagtggcgcccaagg

SEQ ID NO: 17793 - DNA, 25 bp, S. cerevisiae
aagatccttcacaggctgacgctat

SEQ ID NO: 17794 - DNA, 25 bp, S. cerevisiae
aagatctcttcgactgatgcaaaca

SEQ ID NO: 17795 - DNA, 25 bp, S. cerevisiae
aagatctcttggtctctttgacatt

SEQ ID NO: 17796 - DNA, 25 bp, S. cerevisiae
aagattccatatttcaatgcgccaa

SEQ ID NO: 17797 - DNA, 25 bp, S. cerevisiae
aagatccgctattacgtctgcacag

SEQ ID NO: 17798 - DNA, 25 bp, S. cerevisiae
aagatcatctgcgattactgtcccg

SEQ ID NO: 17799 - DNA, 25 bp, S. cerevisiae
aagatcgctgctttggctggtcaac

SEQ ID NO: 17800 - DNA, 25 bp, S. cerevisiae
aagatcgcaccattgagctactgag

SEQ ID NO: 17801 - DNA, 25 bp, S. cerevisiae
aagatgccagcgatgactttaccac

SEQ ID NO: 17802 - DNA, 25 bp, S. cerevisiae
aagatgccatcgagtcagcttctcc

SEQ ID NO: 17803 - DNA, 25 bp, S. cerevisiae
aagaggctctcctatcgcttttgaa

SEQ ID NO: 17804 - DNA, 25 bp, S. cerevisiae
aagttagcagtgtcaagttcgttga

SEQ ID NO: 17805 - DNA, 25 bp, S. cerevisiae
aagtttgacccatacgatttatcta

SEQ ID NO: 17806 - DNA, 25 bp, S. cerevisiae
aagattttgtgcacccttcaataga

SEQ ID NO: 17807 - DNA, 25 bp, S. cerevisiae
aagattttgccattgcccaaagccg

SEQ ID NO: 17808 - DNA, 25 bp, S. cerevisiae
aagattgtgaccttccgcataatgg

SEQ ID NO: 17809 - DNA, 25 bp, S. cerevisiae
aagttgatacatccctagccgaaga

SEQ ID NO: 17810 - DNA, 25 bp, S. cerevisiae
aagataccacactttcatgttccca

SEQ ID NO: 17811 - DNA, 25 bp, S. cerevisiae
aagttcgccaacaagattattccca

SEQ ID NO: 17812 - DNA, 25 bp, S. cerevisiae
aagatctccattgcggctggtgcat

SEQ ID NO: 17813 - DNA, 25 bp, S. cerevisiae
aagatcagaccgttgcagtgtcaag

SEQ ID NO: 17814 - DNA, 25 bp, S. cerevisiae
aagatgagcccgtgcaatacaaggt

SEQ ID NO: 17815 - DNA, 25 bp, S. cerevisiae
aagtaccctaagatcactgatgctg

SEQ ID NO: 17816 - DNA, 25 bp, S. cerevisiae
aagtgaccaatcagcacgcacggct

SEQ ID NO: 17817 - DNA, 25 bp, S. cerevisiae
aaggaccaattagcccaagatattt

SEQ ID NO: 17818 - DNA, 25 bp, S. cerevisiae
aagatattgaggttcccgaggagct

SEQ ID NO: 17819 - DNA, 25 bp, S. cerevisiae
aagtctgtggatctaccgaaggcga

SEQ ID NO: 17820 - DNA, 25 bp, S. cerevisiae
aatccgggttaagcgcagatggcga

SEQ ID NO: 17821 - DNA, 25 bp, S. cerevisiae
aaggcaggaggtatcgtcttacaaa

SEQ ID NO: 17822 - DNA, 25 bp, S. cerevisiae
aagatccgagtttctttcctcaata

SEQ ID NO: 17823 - DNA, 25 bp, S. cerevisiae
aagatccttctaaatttgcccaatt

SEQ ID NO: 17824 - DNA, 25 bp, S. cerevisiae
aatgactttcgacaatgtgcccttc

SEQ ID NO: 17825 - DNA, 25 bp, S. cerevisiae
aagtgcactatctttccttgggatg

SEQ ID NO: 17826 - DNA, 25 bp, S. cerevisiae
aagatacctggagtctcgtcgagac

SEQ ID NO: 17827 - DNA, 25 bp, S. cerevisiae
aagggacttaagatccaggaccatt

SEQ ID NO: 17828 - DNA, 25 bp, S. cerevisiae
aagatagtcagtttgtccttcaaga

SEQ ID NO: 17829 - DNA, 25 bp, S. cerevisiae
aagatcataagttccccattcgaga

SEQ ID NO: 17830 - DNA, 25 bp, S. cerevisiae
aagataacgtttgcagcttcctgtc

SEQ ID NO: 17831 - DNA, 25 bp, S. cerevisiae
aagttgagtgctgctatcggtcata

SEQ ID NO: 17832 - DNA, 25 bp, S. cerevisiae
aagatccaagcattcaacacgttat

SEQ ID NO: 17833 - DNA, 25 bp, S. cerevisiae
aagatcgaaagccaacctgcaattt

SEQ ID NO: 17834 - DNA, 25 bp, S. cerevisiae
aagttatttggatcttgcaggcaga

SEQ ID NO: 17835 - DNA, 25 bp, S. cerevisiae
aagttattcttttcagggacgctga

SEQ ID NO: 17836 - DNA, 25 bp, S. cerevisiae
aagatctttttaccggagcgtatca

SEQ ID NO: 17837 - DNA, 25 bp, S. cerevisiae
aagttttcactcctcaggacggtag

SEQ ID NO: 17838 - DNA, 25 bp, S. cerevisiae
aagtttgttgttcgcatctactggc

SEQ ID NO: 17839 - DNA, 25 bp, S. cerevisiae
aagtttctcgatagcgttcataagc

SEQ ID NO: 17840 - DNA, 25 bp, S. cerevisiae
aagatacttctctcatgctgatgaa

SEQ ID NO: 17841 - DNA, 25 bp, S. cerevisiae
caagaaattcgccaaattacacatg

SEQ ID NO: 17842 - DNA, 25 bp, S. cerevisiae
aagatatacctgctgtgttcaccga

SEQ ID NO: 17843 - DNA, 25 bp, S. cerevisiae
aagattccgttgttaggacctacat

SEQ ID NO: 17844 - DNA, 25 bp, S. cerevisiae
caagagtgcccgttaggaaaggtag

SEQ ID NO: 17845 - DNA, 25 bp, S. cerevisiae
aagggcccagttttgcttgaagtgg

SEQ ID NO: 17846 - DNA, 25 bp, S. cerevisiae
aagtggctgctagaacgattgaaac

SEQ ID NO: 17847 - DNA, 25 bp, S. cerevisiae
aagtgccccacatatcggttgatga

SEQ ID NO: 17848 - DNA, 25 bp, S. cerevisiae
aagtcaccacactctgtgatggagg

SEQ ID NO: 17849 - DNA, 25 bp, S. cerevisiae
aagatctccacacacgttattgcag

SEQ ID NO: 17850 - DNA, 25 bp, S. cerevisiae
aagtctgccaatccacttggttttg

SEQ ID NO: 17851 - DNA, 25 bp, S. cerevisiae
aagtttgaatcccttggcatctggt

SEQ ID NO: 17852 - DNA, 25 bp, S. cerevisiae
aagatttatctccacttcgaagtaa

SEQ ID NO: 17853 - DNA, 25 bp, S. cerevisiae
aagatcttatcccaagctccaagtg

SEQ ID NO: 17854 - DNA, 25 bp, S. cerevisiae
aagatcattatccaagtcgccttga

SEQ ID NO: 17855 - DNA, 25 bp, S. cerevisiae
aagatctttcacatctagctccaac

SEQ ID NO: 17856 - DNA, 25 bp, S. cerevisiae
aagattttgactactctgtcacgcc

SEQ ID NO: 17857 - DNA, 25 bp, S. cerevisiae
aagattcgtcatcacctatcatcag

SEQ ID NO: 17858 - DNA, 25 bp, S. cerevisiae
aagatttcgctccagcctttgatgt

SEQ ID NO: 17859 - DNA, 25 bp, S. cerevisiae
aagatcttcccaccatcatggtaga

SEQ ID NO: 17860 - DNA, 25 bp, S. cerevisiae
aagtcattccaatcgcagctgttac

SEQ ID NO: 17861 - DNA, 25 bp, S. cerevisiae
aagattgtacaagttcattctgaac

SEQ ID NO: 17862 - DNA, 25 bp, S. cerevisiae
aagattcttgcaacttcctttcagc

SEQ ID NO: 17863 - DNA, 25 bp, S. cerevisiae
aagtttctcggagcgttcttcagac

SEQ ID NO: 17864 - DNA, 25 bp, S. cerevisiae
aagatttccgtgctgagttcattca

SEQ ID NO: 17865 - DNA, 25 bp, S. cerevisiae
aagttcctcccatttaccaagatgt

SEQ ID NO: 17866 - DNA, 25 bp, S. cerevisiae
aagttccccacgttagctaatcaat

SEQ ID NO: 17867 - DNA, 25 bp, S. cerevisiae
aagttacacaacaccatggccatgt

SEQ ID NO: 17868 - DNA, 25 bp, S. cerevisiae
aagttaatgggcacaagcgcgctaa

SEQ ID NO: 17869 - DNA, 25 bp, S. cerevisiae
aagttgttatccacatacgcgctat

SEQ ID NO: 17870 - DNA, 25 bp, S. cerevisiae
aagattccccagatatgcctgaaaa

SEQ ID NO: 17871 - DNA, 25 bp, S. cerevisiae
aagtatgctctttcagtatcaccca

SEQ ID NO: 17872 - DNA, 25 bp, S. cerevisiae
aagtcccttagagttatcgcatcaa

SEQ ID NO: 17873 - DNA, 25 bp, S. cerevisiae
aagatttcactctagaggcctcggt

SEQ ID NO: 17874 - DNA, 25 bp, S. cerevisiae
aagattgaccttgacttccacagac

SEQ ID NO: 17875 - DNA, 25 bp, S. cerevisiae
aagattacctttatcaccaacacca

SEQ ID NO: 17876 - DNA, 25 bp, S. cerevisiae
aagttgtccgttatcccaatcagaa

SEQ ID NO: 17877 - DNA, 25 bp, S. cerevisiae
aagtttcgcaataaaggccccagat

SEQ ID NO: 17878 - DNA, 25 bp, S. cerevisiae
aagtcctcgacaaaatggccctaca

SEQ ID NO: 17879 - DNA, 25 bp, S. cerevisiae
aagtgctgctgaccaaaaggcctta

SEQ ID NO: 17880 - DNA, 25 bp, S. cerevisiae
aagtagtaccagttcgcaacttcgc

SEQ ID NO: 17881 - DNA, 25 bp, S. cerevisiae
aagatttatccagcattcgaccaga

SEQ ID NO: 17882 - DNA, 25 bp, S. cerevisiae
aagattttccccttggatcgagagg

SEQ ID NO: 17883 - DNA, 25 bp, S. cerevisiae
aagtttcccctcgtggtgcaggatg

SEQ ID NO: 17884 - DNA, 25 bp, S. cerevisiae
aagatttcacccattgagctcgacg

SEQ ID NO: 17885 - DNA, 25 bp, S. cerevisiae
aagattacacttttagcgagcaggg

SEQ ID NO: 17886 - DNA, 25 bp, S. cerevisiae
aagtacgatttagtctgcgaagagc

SEQ ID NO: 17887 - DNA, 25 bp, S. cerevisiae
aagatacagttttctccgatggaca

SEQ ID NO: 17888 - DNA, 25 bp, S. cerevisiae
aagtcaagcaatccaacatcgttca

SEQ ID NO: 17889 - DNA, 25 bp, S. cerevisiae
aagtactggtacagccacatcaagt

SEQ ID NO: 17890 - DNA, 25 bp, S. cerevisiae
aagtcagcggctacaccaaggcaaa

SEQ ID NO: 17891 - DNA, 25 bp, S. cerevisiae
aagttctgagcctgcaaatggcccg

SEQ ID NO: 17892 - DNA, 25 bp, S. cerevisiae
aagtcctggaagctactggcttgca

SEQ ID NO: 17893 - DNA, 25 bp, S. cerevisiae
aagtctaagaaccataccgctcaca

SEQ ID NO: 17894 - DNA, 25 bp, S. cerevisiae
aagtgctaagttccattccagatcc

SEQ ID NO: 17895 - DNA, 25 bp, S. cerevisiae
aagtcacaattgctaggcggtgcca

SEQ ID NO: 17896 - DNA, 25 bp, S. cerevisiae
aatatgaatactcttgccggtggca

SEQ ID NO: 17897 - DNA, 25 bp, S. cerevisiae
aagttccctggattaccgtgcgata

SEQ ID NO: 17898 - DNA, 25 bp, S. cerevisiae
aagtcttgggtgttccaggtgctat

SEQ ID NO: 17899 - DNA, 25 bp, S. cerevisiae
aagtacagagatcaccatcccctat

SEQ ID NO: 17900 - DNA, 25 bp, S. cerevisiae
aagtaattgatagtctcctgcccat

SEQ ID NO: 17901 - DNA, 25 bp, S. cerevisiae
aagttcaagcaagtcaagcagcact

SEQ ID NO: 17902 - DNA, 25 bp, S. cerevisiae
aagtactcgaataccaggcagccaa

SEQ ID NO: 17903 - DNA, 25 bp, S. cerevisiae
aaggtcctaatgtcttgaagccaga

SEQ ID NO: 17904 - DNA, 25 bp, S. cerevisiae
aagttggcagattatgcgcttccca

SEQ ID NO: 17905 - DNA, 25 bp, S. cerevisiae
aagttgtgcaatctggcttgggtaa

SEQ ID NO: 17906 - DNA, 25 bp, S. cerevisiae
aagatattatcgacggttcccaatt

SEQ ID NO: 17907 - DNA, 25 bp, S. cerevisiae
aagattatttcttctggtcctcgtg

SEQ ID NO: 17908 - DNA, 25 bp, S. cerevisiae
aagttagtttcactggtgcccgagg

SEQ ID NO: 17909 - DNA, 25 bp, S. cerevisiae
aagtcagagtcttccttagcttcga

SEQ ID NO: 17910 - DNA, 25 bp, S. cerevisiae
aagtcggtactgtcgattcctggaa

SEQ ID NO: 17911 - DNA, 25 bp, S. cerevisiae
aagttggctcctaaattcctgtcaa

SEQ ID NO: 17912 - DNA, 25 bp, S. cerevisiae
aagtatctcccacaaaatctagtaa

SEQ ID NO: 17913 - DNA, 25 bp, S. cerevisiae
aagtttgccgtccaacacattagtg

SEQ ID NO: 17914 - DNA, 25 bp, S. cerevisiae
aagttcttgcccacattgagtaatg

SEQ ID NO: 17915 - DNA, 25 bp, S. cerevisiae
aagtcactgttctctttagctaaag

SEQ ID NO: 17916 - DNA, 25 bp, S. cerevisiae
aagtaatgtcgcttcctggattcaa

SEQ ID NO: 17917 - DNA, 25 bp, S. cerevisiae
aagttgactatgaagccgctggtga

SEQ ID NO: 17918 - DNA, 25 bp, S. cerevisiae
aagttgttccattctggcggcgatt

SEQ ID NO: 17919 - DNA, 25 bp, S. cerevisiae
aagttgctttcaactcgcctcgaag

SEQ ID NO: 17920 - DNA, 25 bp, S. cerevisiae
aagattatcttcagcttctctccaa

SEQ ID NO: 17921 - DNA, 25 bp, S. cerevisiae
aagattcgttctatgtttgctatga

SEQ ID NO: 17922 - DNA, 25 bp, S. cerevisiae
aagttgttgttgacgctatcaccaa

SEQ ID NO: 17923 - DNA, 25 bp, S. cerevisiae
aagttgattgctcactctgtggcca

SEQ ID NO: 17924 - DNA, 25 bp, S. cerevisiae
aagttgtcacagaattgcgctctaa

SEQ ID NO: 17925 - DNA, 25 bp, S. cerevisiae
aagatttctgatccaggcgctgcta

SEQ ID NO: 17926 - DNA, 25 bp, S. cerevisiae
aagtttctggtaatgctgctgctgc

SEQ ID NO: 17927 - DNA, 25 bp, S. cerevisiae
aagtttcgagtatgctgtctccgga

SEQ ID NO: 17928 - DNA, 25 bp, S. cerevisiae
aagtatcttttctcatcagggcgca

SEQ ID NO: 17929 - DNA, 25 bp, S. cerevisiae
aagttgcttatactggcgggtttga

SEQ ID NO: 17930 - DNA, 25 bp, S. cerevisiae
aagattcttgtacgacggtattaga

SEQ ID NO: 17931 - DNA, 25 bp, S. cerevisiae
aagttttcatagcagggtttccagg

SEQ ID NO: 17932 - DNA, 25 bp, S. cerevisiae
aagattaatagatccccttcccata

SEQ ID NO: 17933 - DNA, 25 bp, S. cerevisiae
aagattctaatatcccctacgacag

SEQ ID NO: 17934 - DNA, 25 bp, S. cerevisiae
aagggcttaaatctctttggtgata

SEQ ID NO: 17935 - DNA, 25 bp, S. cerevisiae
caagttgtccaacccatctggtggt

SEQ ID NO: 17936 - DNA, 25 bp, S. cerevisiae
aagtatctcgtacctttgggagtca

SEQ ID NO: 17937 - DNA, 25 bp, S. cerevisiae
aagtcccgtcgctgttattggcgaa

SEQ ID NO: 17938 - DNA, 25 bp, S. cerevisiae
aagtcgacgtttggtctctagggat

SEQ ID NO: 17939 - DNA, 25 bp, S. cerevisiae
aagttagcagctctttcaaggatgt

SEQ ID NO: 17940 - DNA, 25 bp, S. cerevisiae
aagttcaagccactagcactgtttc

SEQ ID NO: 17941 - DNA, 25 bp, S. cerevisiae
aagttatagtcctacatcgccttca

SEQ ID NO: 17942 - DNA, 25 bp, S. cerevisiae
aagttcgctgcttgatttcttcgca

SEQ ID NO: 17943 - DNA, 25 bp, S. cerevisiae
aagttcattcattggtttccgacga

SEQ ID NO: 17944 - DNA, 25 bp, S. cerevisiae
aagtttcatgttgttgcgatccctg

SEQ ID NO: 17945 - DNA, 25 bp, S. cerevisiae
aagtatgcgttttactctccgtact

SEQ ID NO: 17946 - DNA, 25 bp, S. cerevisiae
aagtcccatgtgtttattttgcgag

SEQ ID NO: 17947 - DNA, 25 bp, S. cerevisiae
aagtcccatcggtgaatttcagtca

SEQ ID NO: 17948 - DNA, 25 bp, S. cerevisiae
aagtacgccgcctggagattcatta

SEQ ID NO: 17949 - DNA, 25 bp, S. cerevisiae
aagtttgccgcaccagaggattatc

SEQ ID NO: 17950 - DNA, 25 bp, S. cerevisiae
aagttggtcttcgttgtcagaatca

SEQ ID NO: 17951 - DNA, 25 bp, S. cerevisiae
aagttgcactactgtgtctcctgtg

SEQ ID NO: 17952 - DNA, 25 bp, S. cerevisiae
aagttgaccactgcattgtcatcaa

SEQ ID NO: 17953 - DNA, 25 bp, S. cerevisiae
aagtgaccgctaccacatggacaag

SEQ ID NO: 17954 - DNA, 25 bp, S. cerevisiae
aagtatcacctacacaggatagaaa

SEQ ID NO: 17955 - DNA, 25 bp, S. cerevisiae
aagtacattcttcgaagggagacaa

SEQ ID NO: 17956 - DNA, 25 bp, S. cerevisiae
aagttatcctgtcgaagcacggtaa

SEQ ID NO: 17957 - DNA, 25 bp, S. cerevisiae
aagttcttacccatctgttgacaac

SEQ ID NO: 17958 - DNA, 25 bp, S. cerevisiae
aagtttttgaggctattcgtagcta

SEQ ID NO: 17959 - DNA, 25 bp, S. cerevisiae
aagttctttggtgtttgcctctcaa

SEQ ID NO: 17960 - DNA, 25 bp, S. cerevisiae
aagttctggtgtcggtttgttctca

SEQ ID NO: 17961 - DNA, 25 bp, S. cerevisiae
aagttaatatcttacctgaggctaa

SEQ ID NO: 17962 - DNA, 25 bp, S. cerevisiae
aagttcaaactcagatgctatggga

SEQ ID NO: 17963 - DNA, 25 bp, S. cerevisiae
aagtgccccagctatggccaaatgg

SEQ ID NO: 17964 - DNA, 25 bp, S. cerevisiae
aagattcctatattggctcaacatg

SEQ ID NO: 17965 - DNA, 25 bp, S. cerevisiae
aagattcctctgtcttccaattggt

SEQ ID NO: 17966 - DNA, 25 bp, S. cerevisiae
aagttcctgttttgccaatggtggc

SEQ ID NO: 17967 - DNA, 25 bp, S. cerevisiae
aagtttttgatttcctgacgctggc

SEQ ID NO: 17968 - DNA, 25 bp, S. cerevisiae
aagttttggtcaacgctacgctatc

SEQ ID NO: 17969 - DNA, 25 bp, S. cerevisiae
aagtcgcggcactatctggtaatga

SEQ ID NO: 17970 - DNA, 25 bp, S. cerevisiae
aagtatagggcccatggctccatct

SEQ ID NO: 17971 - DNA, 25 bp, S. cerevisiae
aagtacggtgaacactccatcgaag

SEQ ID NO: 17972 - DNA, 25 bp, S. cerevisiae
aagtactgggctagaacttctgcaa

SEQ ID NO: 17973 - DNA, 25 bp, S. cerevisiae
aagtacgtcagcttcaagatctcct

SEQ ID NO: 17974 - DNA, 25 bp, S. cerevisiae
aagattggtatcgtcgaaatctctc

SEQ ID NO: 17975 - DNA, 25 bp, S. cerevisiae
aagattggtcatgctctcatatccg

SEQ ID NO: 17976 - DNA, 25 bp, S. cerevisiae
aagttggcctctgatgcaatccagg

SEQ ID NO: 17977 - DNA, 25 bp, S. cerevisiae
aatgcgagttcgagacaccggcggt

SEQ ID NO: 17978 - DNA, 25 bp, S. cerevisiae
aagttcttatgatgacaccgtcagg

SEQ ID NO: 17979 - DNA, 25 bp, S. cerevisiae
aagttactagcatggccacggcaat

SEQ ID NO: 17980 - DNA, 25 bp, S. cerevisiae
aagtttatagcataccctggtgatc

SEQ ID NO: 17981 - DNA, 25 bp, S. cerevisiae
aagtcttaaagcaaccgccatttca

SEQ ID NO: 17982 - DNA, 25 bp, S. cerevisiae
aagttctcacagttcctaaacaaag

SEQ ID NO: 17983 - DNA, 25 bp, S. cerevisiae
aagttgctcaatttgctctcaagga

SEQ ID NO: 17984 - DNA, 25 bp, S. cerevisiae
aagtgtcatctgttgcagtcggtgt

SEQ ID NO: 17985 - DNA, 25 bp, S. cerevisiae
aagtatggcgttctcaggtgttgta

SEQ ID NO: 17986 - DNA, 25 bp, S. cerevisiae
aagtttgctgttcccggtggtctga

SEQ ID NO: 17987 - DNA, 25 bp, S. cerevisiae
aaggtttgtgccgaatagggtccat

SEQ ID NO: 17988 - DNA, 25 bp, S. cerevisiae
aagtcccttctgatccgtacaatta

SEQ ID NO: 17989 - DNA, 25 bp, S. cerevisiae
aagttggttctggatctcatggtga

SEQ ID NO: 17990 - DNA, 25 bp, S. cerevisiae
aagtacatgttaggcctgtcggttc

SEQ ID NO: 17991 - DNA, 25 bp, S. cerevisiae
aagtgccgtgacaagttcctggtta

SEQ ID NO: 17992 - DNA, 25 bp, S. cerevisiae
aagtccgcacaacaacatcgcgttg

SEQ ID NO: 17993 - DNA, 25 bp, S. cerevisiae
aagtatcattgctttgtccagacaa

SEQ ID NO: 17994 - DNA, 25 bp, S. cerevisiae
aaggatggccatttcatacctcggc

SEQ ID NO: 17995 - DNA, 25 bp, S. cerevisiae
aagtcgctacacacgtacattgctg

SEQ ID NO: 17996 - DNA, 25 bp, S. cerevisiae
aagtggctgacaccttgagatccgc

SEQ ID NO: 17997 - DNA, 25 bp, S. cerevisiae
aagtcactaccgtcaaatccatcat

SEQ ID NO: 17998 - DNA, 25 bp, S. cerevisiae
aagtctactacgtcaggtctcatct

SEQ ID NO: 17999 - DNA, 25 bp, S. cerevisiae
aagtctcactacctagtgttccaag

SEQ ID NO: 18000 - DNA, 25 bp, S. cerevisiae
aagtcccattcatctggtttcaagc

SEQ ID NO: 18001 - DNA, 25 bp, S. cerevisiae
aagtccactttcgtcagtttcatca

SEQ ID NO: 18002 - DNA, 25 bp, S. cerevisiae
aagttatttgtcacggtgtgcccga

SEQ ID NO: 18003 - DNA, 25 bp, S. cerevisiae
aagtttattactacctctgctgacg

SEQ ID NO: 18004 - DNA, 25 bp, S. cerevisiae
aagtcttaggactgcctcatatggg

SEQ ID NO: 18005 - DNA, 25 bp, S. cerevisiae
aagtcgtgaagattggctccatgca

SEQ ID NO: 18006 - DNA, 25 bp, S. cerevisiae
aagtcgttgatgacatcgcacacta

SEQ ID NO: 18007 - DNA, 25 bp, S. cerevisiae
aagtacctctcaaagctgaccaaga

SEQ ID NO: 18008 - DNA, 25 bp, S. cerevisiae
aagtttccagcaaagctatccaagg

SEQ ID NO: 18009 - DNA, 25 bp, S. cerevisiae
aagtttcaagcgtcactgcagcaat

SEQ ID NO: 18010 - DNA, 25 bp, S. cerevisiae
aagttctttcctgctgccagataat

SEQ ID NO: 18011 - DNA, 25 bp, S. cerevisiae
aagtagttcctttgcgccagataaa

SEQ ID NO: 18012 - DNA, 25 bp, S. cerevisiae
aagtagatattttggctcacagaga

SEQ ID NO: 18013 - DNA, 25 bp, S. cerevisiae
aagttgctcactttgtcgtgttcat

SEQ ID NO: 18014 - DNA, 25 bp, S. cerevisiae
aagtgtagtcatttccggctattcc

SEQ ID NO: 18015 - DNA, 25 bp, S. cerevisiae
aagtactacatctatggtctccacc

SEQ ID NO: 18016 - DNA, 25 bp, S. cerevisiae
aagtgtcgcagttccagttgatatt

SEQ ID NO: 18017 - DNA, 25 bp, S. cerevisiae
aagtgccgatgcaagtcctgtcatt

SEQ ID NO: 18018 - DNA, 25 bp, S. cerevisiae
aagtgctgcgcatgggtattatgac

SEQ ID NO: 18019 - DNA, 25 bp, S. cerevisiae
aagggcaaggtgctattctaattga

SEQ ID NO: 18020 - DNA, 25 bp, S. cerevisiae
aagtccaatggtctttgctgagaaa

SEQ ID NO: 18021 - DNA, 25 bp, S. cerevisiae
aagtaatccttcatctcatatcaaa

SEQ ID NO: 18022 - DNA, 25 bp, S. cerevisiae
aagttttgtctctatttcggtgaag

SEQ ID NO: 18023 - DNA, 25 bp, S. cerevisiae
aagtacatgactactgtctccggta

SEQ ID NO: 18024 - DNA, 25 bp, S. cerevisiae
aagttcacaattgttgcggtggcaa

SEQ ID NO: 18025 - DNA, 25 bp, S. cerevisiae
aagttagcacttcttgctggcgcta

SEQ ID NO: 18026 - DNA, 25 bp, S. cerevisiae
aagtagatccttttagctctctctt

SEQ ID NO: 18027 - DNA, 25 bp, S. cerevisiae
aagttttcatttctgccatctctgt

SEQ ID NO: 18028 - DNA, 25 bp, S. cerevisiae
aagtttgtcaagaaggccacccatt

SEQ ID NO: 18029 - DNA, 25 bp, S. cerevisiae
aagtttgctattaacgtcgctacag

SEQ ID NO: 18030 - DNA, 25 bp, S. cerevisiae
aagttagctatcaatccttgggaag

SEQ ID NO: 18031 - DNA, 25 bp, S. cerevisiae
aagtattggcactaccttggagcaa

SEQ ID NO: 18032 - DNA, 25 bp, S. cerevisiae
aagtactttgcattctcttggagaa

SEQ ID NO: 18033 - DNA, 25 bp, S. cerevisiae
aagtcagtattattccacgtggcca

SEQ ID NO: 18034 - DNA, 25 bp, S. cerevisiae
aagtcgaattatacggcggcgccat

SEQ ID NO: 18035 - DNA, 25 bp, S. cerevisiae
gaaacgacttttgaggacacttcca

SEQ ID NO: 18036 - DNA, 25 bp, S. cerevisiae
aatcctaccgttgaagtcgcttccg

SEQ ID NO: 18037 - DNA, 25 bp, S. cerevisiae
aatcgctagtcgttcaaaccgcatg

SEQ ID NO: 18038 - DNA, 25 bp, S. cerevisiae
aatggtagatcctctaaccctggga

SEQ ID NO: 18039 - DNA, 25 bp, S. cerevisiae
aagggttccccattgcaaattcaag

SEQ ID NO: 18040 - DNA, 25 bp, S. cerevisiae
aagtgacatgaattacctgctggat

SEQ ID NO: 18041 - DNA, 25 bp, S. cerevisiae
aagtctcagctttatcaaatttcag

SEQ ID NO: 18042 - DNA, 25 bp, S. cerevisiae
aagtccctaaaacgtcttcagccag

SEQ ID NO: 18043 - DNA, 25 bp, S. cerevisiae
aagtatcctaaatggtttcagctaa

SEQ ID NO: 18044 - DNA, 25 bp, S. cerevisiae
aagtaccgaaactagctcttcctat

SEQ ID NO: 18045 - DNA, 25 bp, S. cerevisiae
aagtcccataaacgatccacttctt

SEQ ID NO: 18046 - DNA, 25 bp, S. cerevisiae
aagtagattctcctgatgacccatt

SEQ ID NO: 18047 - DNA, 25 bp, S. cerevisiae
aagtgatcaattctcaaactggtga

SEQ ID NO: 18048 - DNA, 25 bp, S. cerevisiae
aagtcttcagatctgccggtggtaa

SEQ ID NO: 18049 - DNA, 25 bp, S. cerevisiae
aagtctctagccgtcgaggagttaa

SEQ ID NO: 18050 - DNA, 25 bp, S. cerevisiae
aagtctctaccattctgatctattt

SEQ ID NO: 18051 - DNA, 25 bp, S. cerevisiae
aagtttgccgcaataatccagtgga

SEQ ID NO: 18052 - DNA, 25 bp, S. cerevisiae
aagtttgactatatccgcattggaa

SEQ ID NO: 18053 - DNA, 25 bp, S. cerevisiae
aagtcttactttcccagcgtcgaag

SEQ ID NO: 18054 - DNA, 25 bp, S. cerevisiae
aagtattggttactccactgaagaa

SEQ ID NO: 18055 - DNA, 25 bp, S. cerevisiae
aagtttggaggcttcgcctgcaata

SEQ ID NO: 18056 - DNA, 25 bp, S. cerevisiae
aagtcttgagggaccgcaatgctaa

SEQ ID NO: 18057 - DNA, 25 bp, S. cerevisiae
aagtcttcagcgaacggacatccca

SEQ ID NO: 18058 - DNA, 25 bp, S. cerevisiae
aagtcgctcatccaactgaaaccta

SEQ ID NO: 18059 - DNA, 25 bp, S. cerevisiae
aagtagtgcctccaattgtaccgat

SEQ ID NO: 18060 - DNA, 25 bp, S. cerevisiae
aagtctggtcccattttggccacgg

SEQ ID NO: 18061 - DNA, 25 bp, S. cerevisiae
aagtctcacccaagttgccagttat

SEQ ID NO: 18062 - DNA, 25 bp, S. cerevisiae
aagtcacaccacagccatgcagatt

SEQ ID NO: 18063 - DNA, 25 bp, S. cerevisiae
aagtacgccaaccaatgcgtgcatt

SEQ ID NO: 18064 - DNA, 25 bp, S. cerevisiae
aagggccaaatccaagctgatcatt

SEQ ID NO: 18065 - DNA, 25 bp, S. cerevisiae
aagggcccaagcatggttctgtctc

SEQ ID NO: 18066 - DNA, 25 bp, S. cerevisiae
aaggatcccgagctggcaaattcta

SEQ ID NO: 18067 - DNA, 25 bp, S. cerevisiae
aagtagcgccagtgtctgaaatcgt

SEQ ID NO: 18068 - DNA, 25 bp, S. cerevisiae
aagggccatataccggctgagtcac

SEQ ID NO: 18069 - DNA, 25 bp, S. cerevisiae
aaggtccattgactcagccgatgac

SEQ ID NO: 18070 - DNA, 25 bp, S. cerevisiae
aagtacatcaaatcccgccgaaaga

SEQ ID NO: 18071 - DNA, 25 bp, S. cerevisiae
caaaggaccttctctcggtacgaat

SEQ ID NO: 18072 - DNA, 25 bp, S. cerevisiae
aagggagacgtctctcatcgattcg

SEQ ID NO: 18073 - DNA, 25 bp, S. cerevisiae
aagggcaagttctccacagacgatg

SEQ ID NO: 18074 - DNA, 25 bp, S. cerevisiae
aagggccaatttccagaagtctacg

SEQ ID NO: 18075 - DNA, 25 bp, S. cerevisiae
aagtttcggaatacactcgtgcttc

SEQ ID NO: 18076 - DNA, 25 bp, S. cerevisiae
aagtccggcatcgatatcttcgttt

SEQ ID NO: 18077 - DNA, 25 bp, S. cerevisiae
aagtcatggctgagttgtatagaac

SEQ ID NO: 18078 - DNA, 25 bp, S. cerevisiae
tcgttgaagctgcaccaaaggtctt

SEQ ID NO: 18079 - DNA, 25 bp, S. cerevisiae
cgttgggtccatggataagtcctta

SEQ ID NO: 18080 - DNA, 25 bp, S. cerevisiae
aagtatcctaagcttcctcaaacga

SEQ ID NO: 18081 - DNA, 25 bp, S. cerevisiae
aagtattctcaagatctcctgcaac

SEQ ID NO: 18082 - DNA, 25 bp, S. cerevisiae
aagtagtacttctaccagctcagaa

SEQ ID NO: 18083 - DNA, 25 bp, S. cerevisiae
aagtctgcgattgaatggagcgaac

SEQ ID NO: 18084 - DNA, 25 bp, S. cerevisiae
aagtgtggttcaaagcgaggttcta

SEQ ID NO: 18085 - DNA, 25 bp, S. cerevisiae
aagtgtagttatccggagatcccaa

SEQ ID NO: 18086 - DNA, 25 bp, S. cerevisiae
aagtttgttatcgacagcaaccaag

SEQ ID NO: 18087 - DNA, 25 bp, S. cerevisiae
aagtattttgcagcaggcccaacag

SEQ ID NO: 18088 - DNA, 25 bp, S. cerevisiae
aaggatttcaaccaagccaagcacg

SEQ ID NO: 18089 - DNA, 25 bp, S. cerevisiae
gaagttttcaagctcggaaccgttg

SEQ ID NO: 18090 - DNA, 25 bp, S. cerevisiae
aagtattatccacgcttgggacctt

SEQ ID NO: 18091 - DNA, 25 bp, S. cerevisiae
aatgtttaccacgtctgtgatccca

SEQ ID NO: 18092 - DNA, 25 bp, S. cerevisiae
aagtttgggacagttgcttcgccga

SEQ ID NO: 18093 - DNA, 25 bp, S. cerevisiae
aagtttctggcggtgttcatggcgc

SEQ ID NO: 18094 - DNA, 25 bp, S. cerevisiae
aagtttctgcctcttggatattcaa

SEQ ID NO: 18095 - DNA, 25 bp, S. cerevisiae
aagtctcttcctcttgagcaagaaa

SEQ ID NO: 18096 - DNA, 25 bp, S. cerevisiae
aagtccctcttggtatcgcaatgga

SEQ ID NO: 18097 - DNA, 25 bp, S. cerevisiae
aagtagatgctaccccagaagaatc

SEQ ID NO: 18098 - DNA, 25 bp, S. cerevisiae
aagtgcaagcgatcataccaatatt

SEQ ID NO: 18099 - DNA, 25 bp, S. cerevisiae
aagtcacgcagatttttatattgga

SEQ ID NO: 18100 - DNA, 25 bp, S. cerevisiae
aagtcatcgacttcttcttatccga

SEQ ID NO: 18101 - DNA, 25 bp, S. cerevisiae
aagtatgtccagcagtttccatcag

SEQ ID NO: 18102 - DNA, 25 bp, S. cerevisiae
aagtgcttttggatcgtccggtgaa

SEQ ID NO: 18103 - DNA, 25 bp, S. cerevisiae
aagggattcggcatgcccaagggta

SEQ ID NO: 18104 - DNA, 25 bp, S. cerevisiae
aagggttttattcaagagtgcgaga

SEQ ID NO: 18105 - DNA, 25 bp, S. cerevisiae
aagggcccgttacaatcattcttga

SEQ ID NO: 18106 - DNA, 25 bp, S. cerevisiae
aagggcaccctagcggtaagttgat

SEQ ID NO: 18107 - DNA, 25 bp, S. cerevisiae
aagtcacacgcaaaggccctgaagt

SEQ ID NO: 18108 - DNA, 25 bp, S. cerevisiae
aagtgctcagaaaagttcttgaagc

SEQ ID NO: 18109 - DNA, 25 bp, S. cerevisiae
aagtcacaatttacagtccttcgga

SEQ ID NO: 18110 - DNA, 25 bp, S. cerevisiae
aagtactttttcatccacattggcc

SEQ ID NO: 18111 - DNA, 25 bp, S. cerevisiae
aagtctgctgtcaaagttccactgg

SEQ ID NO: 18112 - DNA, 25 bp, S. cerevisiae
aagtctttcacatgttgctactgcc

SEQ ID NO: 18113 - DNA, 25 bp, S. cerevisiae
aagtttgagctctactcttacgcct

SEQ ID NO: 18114 - DNA, 25 bp, S. cerevisiae
aagtcattcgaccttcattttcgag

SEQ ID NO: 18115 - DNA, 25 bp, S. cerevisiae
aagtctgtcggagtttttctcggca

SEQ ID NO: 18116 - DNA, 25 bp, S. cerevisiae
aagtctaccggtatttgcatctgcc

SEQ ID NO: 18117 - DNA, 25 bp, S. cerevisiae
aagtctcgacaacttcattcttacc

SEQ ID NO: 18118 - DNA, 25 bp, S. cerevisiae
aagtgctgggagaactattcttcca

SEQ ID NO: 18119 - DNA, 25 bp, S. cerevisiae
aagtttgttcgccatttacaccagc

SEQ ID NO: 18120 - DNA, 25 bp, S. cerevisiae
aagtttgtctcagagttcatctccc

SEQ ID NO: 18121 - DNA, 25 bp, S. cerevisiae
aagtctggtgaagatcctacctctc

SEQ ID NO: 18122 - DNA, 25 bp, S. cerevisiae
aagtgattcaaactcccacaccttg

SEQ ID NO: 18123 - DNA, 25 bp, S. cerevisiae
aagtattactactcaccatcctgat

SEQ ID NO: 18124 - DNA, 25 bp, S. cerevisiae
aagtagttcaaatcaccagcgtgct

SEQ ID NO: 18125 - DNA, 25 bp, S. cerevisiae
aagtatgtaggtggcttctccgatg

SEQ ID NO: 18126 - DNA, 25 bp, S. cerevisiae
aagtttggctgtgttactcgtgcat

SEQ ID NO: 18127 - DNA, 25 bp, S. cerevisiae
aagtattctttgtattcctcgtcat

SEQ ID NO: 18128 - DNA, 25 bp, S. cerevisiae
aagtccatttctcgtgccaagtaca

SEQ ID NO: 18129 - DNA, 25 bp, S. cerevisiae
aagtctacttcctcatagtttcaga

SEQ ID NO: 18130 - DNA, 25 bp, S. cerevisiae
aagtcgctgatttaactggctctaa

SEQ ID NO: 18131 - DNA, 25 bp, S. cerevisiae
aagtcgtctcaagagtggcttagca

SEQ ID NO: 18132 - DNA, 25 bp, S. cerevisiae
aagtaagatcctcagcttcatcgac

SEQ ID NO: 18133 - DNA, 25 bp, S. cerevisiae
aagtatactcgctactgttgacgaa

SEQ ID NO: 18134 - DNA, 25 bp, S. cerevisiae
aagtgagccatctagacaacccgaa

SEQ ID NO: 18135 - DNA, 25 bp, S. cerevisiae
aagtagcgtaaagcctattttgaag

SEQ ID NO: 18136 - DNA, 25 bp, S. cerevisiae
aagtcagccgaaaccctatttcaga

SEQ ID NO: 18137 - DNA, 25 bp, S. cerevisiae
aagtaatgccattgaccgtttgagg

SEQ ID NO: 18138 - DNA, 25 bp, S. cerevisiae
aagtcatacccattggattcagagc

SEQ ID NO: 18139 - DNA, 25 bp, S. cerevisiae
aagtctcacccatttggtcacgctt

SEQ ID NO: 18140 - DNA, 25 bp, S. cerevisiae
aagtacatctcccacaatctcagtg

SEQ ID NO: 18141 - DNA, 25 bp, S. cerevisiae
aagtaaccagcacgtcatctgcagt

SEQ ID NO: 18142 - DNA, 25 bp, S. cerevisiae
aagtaacgctgattctgctccatta

SEQ ID NO: 18143 - DNA, 25 bp, S. cerevisiae
aagtcacaggcaagcaatgtccaat

SEQ ID NO: 18144 - DNA, 25 bp, S. cerevisiae
aagtacgacgctgatgtgctcgata

SEQ ID NO: 18145 - DNA, 25 bp, S. cerevisiae
aagtgacgtagctcatccatacaag

SEQ ID NO: 18146 - DNA, 25 bp, S. cerevisiae
aagtacatgtagctagcgcgcaccg

SEQ ID NO: 18147 - DNA, 25 bp, S. cerevisiae
aagtacgttgcaggagcacgcccat

SEQ ID NO: 18148 - DNA, 25 bp, S. cerevisiae
aatgcaactgcagagctgaacctcc

SEQ ID NO: 18149 - DNA, 25 bp, S. cerevisiae
aatgcagccagaaagttacctcccg

SEQ ID NO: 18150 - DNA, 25 bp, S. cerevisiae
aagtctgagagcaagtttcccaccg

SEQ ID NO: 18151 - DNA, 25 bp, S. cerevisiae
aagtgtcagcaatgtttccaccaga

SEQ ID NO: 18152 - DNA, 25 bp, S. cerevisiae
aagtctcgccatgttatcactgtat

SEQ ID NO: 18153 - DNA, 25 bp, S. cerevisiae
aaggctctggaggatgttactggac

SEQ ID NO: 18154 - DNA, 25 bp, S. cerevisiae
aatgtttgcgggatgcttgcgtacg

SEQ ID NO: 18155 - DNA, 25 bp, S. cerevisiae
aagtccttagctaatgtcggcacag

SEQ ID NO: 18156 - DNA, 25 bp, S. cerevisiae
aagtgatgggaggttcgccccagac

SEQ ID NO: 18157 - DNA, 25 bp, S. cerevisiae
aagggcgccattatcatcgacgaga

SEQ ID NO: 18158 - DNA, 25 bp, S. cerevisiae
aaggcgccgttttgtaacgctgaga

SEQ ID NO: 18159 - DNA, 25 bp, S. cerevisiae
aaggtgccgtgccagtaaacgctga

SEQ ID NO: 18160 - DNA, 25 bp, S. cerevisiae
aaggtggtgctgacgttaagcccaa

SEQ ID NO: 18161 - DNA, 25 bp, S. cerevisiae
aagggagtcgttggctaacaagaca

SEQ ID NO: 18162 - DNA, 25 bp, S. cerevisiae
aagtgggactttccttatcggcagc

SEQ ID NO: 18163 - DNA, 25 bp, S. cerevisiae
aagtggcgcaactaggttctttggc

SEQ ID NO: 18164 - DNA, 25 bp, S. cerevisiae
caagggcgaagctggagtaccgaac

SEQ ID NO: 18165 - DNA, 25 bp, S. cerevisiae
caagagggacgatctggtggccaaa

SEQ ID NO: 18166 - DNA, 25 bp, S. cerevisiae
aagggatgtcgttgtttccctgtat

SEQ ID NO: 18167 - DNA, 25 bp, S. cerevisiae
aaggtgagtcgctagggtccattga

SEQ ID NO: 18168 - DNA, 25 bp, S. cerevisiae
caacgggttggacgaaatgcattac

SEQ ID NO: 18169 - DNA, 25 bp, S. cerevisiae
aatcgggtttgctgctaaattcaca

SEQ ID NO: 18170 - DNA, 25 bp, S. cerevisiae
aatgcggacgttgagtacggtacaa

SEQ ID NO: 18171 - DNA, 25 bp, S. cerevisiae
aagtcttggctaaagtcatcggcaa

SEQ ID NO: 18172 - DNA, 25 bp, S. cerevisiae
aagtcgatttgccaatacctgcgca

SEQ ID NO: 18173 - DNA, 25 bp, S. cerevisiae
aagtgcgttgaaccagagccctgcg

SEQ ID NO: 18174 - DNA, 25 bp, S. cerevisiae
aatgacggcggctacgacaaggcac

SEQ ID NO: 18175 - DNA, 25 bp, S. cerevisiae
aatggccgcgtatccaaatctgatc

SEQ ID NO: 18176 - DNA, 25 bp, S. cerevisiae
aagtcgtcgttgtgatgatatgcta

SEQ ID NO: 18177 - DNA, 25 bp, S. cerevisiae
aagtcctcgtctttgaagcatgtca

SEQ ID NO: 18178 - DNA, 25 bp, S. cerevisiae
aagggttgcattctcaaaacggtat

SEQ ID NO: 18179 - DNA, 25 bp, S. cerevisiae
aaggaatccattaacgaagacgcgt

SEQ ID NO: 18180 - DNA, 25 bp, S. cerevisiae
aagggaccattcaaccaataaacat

SEQ ID NO: 18181 - DNA, 25 bp, S. cerevisiae
aagtgtactgcctgcatccattact

SEQ ID NO: 18182 - DNA, 25 bp, S. cerevisiae
aagtgtatccgctgacggtcaacga

SEQ ID NO: 18183 - DNA, 25 bp, S. cerevisiae
aaggtaagtctctcggtgtgcaaac

SEQ ID NO: 18184 - DNA, 25 bp, S. cerevisiae
aaggtggtgtcatcaccgtcccaag

SEQ ID NO: 18185 - DNA, 25 bp, S. cerevisiae
aagggcttgagacataagttgtcca

SEQ ID NO: 18186 - DNA, 25 bp, S. cerevisiae
aaggtttgagacataagttatccaa

SEQ ID NO: 18187 - DNA, 25 bp, S. cerevisiae
aaggttttacgttcattatcaatca

SEQ ID NO: 18188 - DNA, 25 bp, S. cerevisiae
aaggtatggccgcattcgttggaaa

SEQ ID NO: 18189 - DNA, 25 bp, S. cerevisiae
caatggaaacctcacttttggaaat

SEQ ID NO: 18190 - DNA, 25 bp, S. cerevisiae
aagggcactgctagctcagccggaa

SEQ ID NO: 18191 - DNA, 25 bp, S. cerevisiae
aagtgccacttttcacacggacgaa

SEQ ID NO: 18192 - DNA, 25 bp, S. cerevisiae
aagtgagacacttgtcacaccaaag

SEQ ID NO: 18193 - DNA, 25 bp, S. cerevisiae
aagtcacctgcggagtgcatcgaaa

SEQ ID NO: 18194 - DNA, 25 bp, S. cerevisiae
aagtccgctcaggagcttgctaaat

SEQ ID NO: 18195 - DNA, 25 bp, S. cerevisiae
aagtctgagctttctgttggatata

SEQ ID NO: 18196 - DNA, 25 bp, S. cerevisiae
aagtcttctgttggtgttatcatca

SEQ ID NO: 18197 - DNA, 25 bp, S. cerevisiae
aagtgctccattcatttggccggtt

SEQ ID NO: 18198 - DNA, 25 bp, S. cerevisiae
aagtcatccattttttcgcggtgtt

SEQ ID NO: 18199 - DNA, 25 bp, S. cerevisiae
aaggtgccatttgtttgcggtgcca

SEQ ID NO: 18200 - DNA, 25 bp, S. cerevisiae
aagtgacgacggtgtggccacagaa

SEQ ID NO: 18201 - DNA, 25 bp, S. cerevisiae
aagggcccgctctaaggtgccaatg

SEQ ID NO: 18202 - DNA, 25 bp, S. cerevisiae
aagggctcccattgaagtcctggct

SEQ ID NO: 18203 - DNA, 25 bp, S. cerevisiae
aagggcattccatgggacctggcat

SEQ ID NO: 18204 - DNA, 25 bp, S. cerevisiae
aagggcgtcgactctagcagcggca

SEQ ID NO: 18205 - DNA, 25 bp, S. cerevisiae
aagggcttctcctctactagaaaga

SEQ ID NO: 18206 - DNA, 25 bp, S. cerevisiae
aagggcattgtcgtcttcaaaaaag

SEQ ID NO: 18207 - DNA, 25 bp, S. cerevisiae
aagggacttcttttgacatacagta

SEQ ID NO: 18208 - DNA, 25 bp, S. cerevisiae
aagtgcagttactgtgtccacaagt

SEQ ID NO: 18209 - DNA, 25 bp, S. cerevisiae
aagtgcgttaatttgatctctctac

SEQ ID NO: 18210 - DNA, 25 bp, S. cerevisiae
aagtcattttgcttggacaccagca

SEQ ID NO: 18211 - DNA, 25 bp, S. cerevisiae
aaggctactttggaggtttactgct

SEQ ID NO: 18212 - DNA, 25 bp, S. cerevisiae
aaggtaccatcgaggctttcacgaa

SEQ ID NO: 18213 - DNA, 25 bp, S. cerevisiae
aaggttccacacaggagtccaagca

SEQ ID NO: 18214 - DNA, 25 bp, S. cerevisiae
aaggtcttttgagcctttgtcggca

SEQ ID NO: 18215 - DNA, 25 bp, S. cerevisiae
aagtcgctaattggctcacggtcta

SEQ ID NO: 18216 - DNA, 25 bp, S. cerevisiae
aagtctgctaaatctatcgttccat

SEQ ID NO: 18217 - DNA, 25 bp, S. cerevisiae
aagtgtcgacttttcgcaccatttc

SEQ ID NO: 18218 - DNA, 25 bp, S. cerevisiae
aagtccgattgttcctcttcaggag

SEQ ID NO: 18219 - DNA, 25 bp, S. cerevisiae
aagtcgtttttcctttcatctgatg

SEQ ID NO: 18220 - DNA, 25 bp, S. cerevisiae
aagtcgtttcaattcctattctggg

SEQ ID NO: 18221 - DNA, 25 bp, S. cerevisiae
aagggcggtggctttcatcctgaat

SEQ ID NO: 18222 - DNA, 25 bp, S. cerevisiae
aagggcgttcaaattcacactctaa

SEQ ID NO: 18223 - DNA, 25 bp, S. cerevisiae
aagggagattcgaccaacacttcct

SEQ ID NO: 18224 - DNA, 25 bp, S. cerevisiae
aagtgtgtggtccttacaacgtgct

SEQ ID NO: 18225 - DNA, 25 bp, S. cerevisiae
aaggttcactttgaccaagctggta

SEQ ID NO: 18226 - DNA, 25 bp, S. cerevisiae
aaggtgaagccaaatccgccgaact

SEQ ID NO: 18227 - DNA, 25 bp, S. cerevisiae
aaggaaccaggcgagacgtttatat

SEQ ID NO: 18228 - DNA, 25 bp, S. cerevisiae
aatggcccgagttaacgtacattgc

SEQ ID NO: 18229 - DNA, 25 bp, S. cerevisiae
aaggacggattctcacagttcatgc

SEQ ID NO: 18230 - DNA, 25 bp, S. cerevisiae
aagtgacgtactcgcaaagttctcc

SEQ ID NO: 18231 - DNA, 25 bp, S. cerevisiae
aagtgagcgctactatcaatggtat

SEQ ID NO: 18232 - DNA, 25 bp, S. cerevisiae
aagtgatcatgttttctcaaaaggt

SEQ ID NO: 18233 - DNA, 25 bp, S. cerevisiae
aagtctatgggtgctcctattgggt

SEQ ID NO: 18234 - DNA, 25 bp, S. cerevisiae
aagtcgtcaagtccatctctattgt

SEQ ID NO: 18235 - DNA, 25 bp, S. cerevisiae
aagtgcctacagctaagcttggcta

SEQ ID NO: 18236 - DNA, 25 bp, S. cerevisiae
aaggtgtcaacgaagctttcacaga

SEQ ID NO: 18237 - DNA, 25 bp, S. cerevisiae
aagggccaacgttgccagatctcaa

SEQ ID NO: 18238 - DNA, 25 bp, S. cerevisiae
aaggtggtggtgcttgtctatttca

SEQ ID NO: 18239 - DNA, 25 bp, S. cerevisiae
aaggtgcgatactgttcaaatgttc

SEQ ID NO: 18240 - DNA, 25 bp, S. cerevisiae
caaagcatgcgagaggccctgggtt

SEQ ID NO: 18241 - DNA, 25 bp, S. cerevisiae
aaggacgtgctatcccaggtgagta

SEQ ID NO: 18242 - DNA, 25 bp, S. cerevisiae
aagggttattcctcgattgatatcg

SEQ ID NO: 18243 - DNA, 25 bp, S. cerevisiae
aagtggtgcgcttctatactattga

SEQ ID NO: 18244 - DNA, 25 bp, S. cerevisiae
aagtctggtgttggtatctgtgcca

SEQ ID NO: 18245 - DNA, 25 bp, S. cerevisiae
aagtccaagttgaacgatgccgtcg

SEQ ID NO: 18246 - DNA, 25 bp, S. cerevisiae
aagtccaagtaattgtcccgcatct

SEQ ID NO: 18247 - DNA, 25 bp, S. cerevisiae
aagtgacaaatctctaccgcaacag

SEQ ID NO: 18248 - DNA, 25 bp, S. cerevisiae
aagtccaagtgcgaaagctgccaaa

SEQ ID NO: 18249 - DNA, 25 bp, S. cerevisiae
aagtgcgaagcagacggctccaaat

SEQ ID NO: 18250 - DNA, 25 bp, S. cerevisiae
aagtggaactaatatctcccgatat

SEQ ID NO: 18251 - DNA, 25 bp, S. cerevisiae
aaggtagcttccgtattacttgtga

SEQ ID NO: 18252 - DNA, 25 bp, S. cerevisiae
aagggcattcatctgctggttatgg

SEQ ID NO: 18253 - DNA, 25 bp, S. cerevisiae
aagggatccactttgcaatttggta

SEQ ID NO: 18254 - DNA, 25 bp, S. cerevisiae
aagtgattcctctgggaggcgcatt

SEQ ID NO: 18255 - DNA, 25 bp, S. cerevisiae
aagtgatctacgctggatatctaca

SEQ ID NO: 18256 - DNA, 25 bp, S. cerevisiae
aagtgatctcacaggcgtaccacga

SEQ ID NO: 18257 - DNA, 25 bp, S. cerevisiae
aagtgttctcggtcgtggtcacaac

SEQ ID NO: 18258 - DNA, 25 bp, S. cerevisiae
aaggtacttgcgtggtgatgaattc

SEQ ID NO: 18259 - DNA, 25 bp, S. cerevisiae
aatggaatcattaccggtccttgcc

SEQ ID NO: 18260 - DNA, 25 bp, S. cerevisiae
aaggaatttgactgcgctcacgttt

SEQ ID NO: 18261 - DNA, 25 bp, S. cerevisiae
aaggaattggactctgctatggcag

SEQ ID NO: 18262 - DNA, 25 bp, S. cerevisiae
aaggaatctaactctgcctctgggt

SEQ ID NO: 18263 - DNA, 25 bp, S. cerevisiae
aagtgcatatcataccttcctcgga

SEQ ID NO: 18264 - DNA, 25 bp, S. cerevisiae
aagtgcattagaacgttccttgaat

SEQ ID NO: 18265 - DNA, 25 bp, S. cerevisiae
aagtgctgtggctcgtcaccagtat

SEQ ID NO: 18266 - DNA, 25 bp, S. cerevisiae
aagtggagtgctttggcgccagatt

SEQ ID NO: 18267 - DNA, 25 bp, S. cerevisiae
aagtggactggcatacccgttggcg

SEQ ID NO: 18268 - DNA, 25 bp, S. cerevisiae
aagtgggtattatcagcgctggtca

SEQ ID NO: 18269 - DNA, 25 bp, S. cerevisiae
aatgtgggtttagcaacgcaggcgt

SEQ ID NO: 18270 - DNA, 25 bp, S. cerevisiae
aagtcggaagcaactccacaaccag

SEQ ID NO: 18271 - DNA, 25 bp, S. cerevisiae
aagtgggctaatgctgccaaggcat

SEQ ID NO: 18272 - DNA, 25 bp, S. cerevisiae
aagggcagggatccatgttcagata

SEQ ID NO: 18273 - DNA, 25 bp, S. cerevisiae
aagtgggctcatcatctaagtgtaa

SEQ ID NO: 18274 - DNA, 25 bp, S. cerevisiae
aagtgtctgttcaagccggacatcc

SEQ ID NO: 18275 - DNA, 25 bp, S. cerevisiae
aagtgcaaacaggtgtcggagccac

SEQ ID NO: 18276 - DNA, 25 bp, S. cerevisiae
aagtgccgcaaggatgtccattcca

SEQ ID NO: 18277 - DNA, 25 bp, S. cerevisiae
aagtgccgcattggacggcattcct

SEQ ID NO: 18278 - DNA, 25 bp, S. cerevisiae
aagtggatcgcgttatgctgaacaa

SEQ ID NO: 18279 - DNA, 25 bp, S. cerevisiae
aagggtcacaatgcggctttactaa

SEQ ID NO: 18280 - DNA, 25 bp, S. cerevisiae
aagggatttccagatttcttgacaa

SEQ ID NO: 18281 - DNA, 25 bp, S. cerevisiae
aagtggcaccttgatcatgatgaca

SEQ ID NO: 18282 - DNA, 25 bp, S. cerevisiae
aagtggctcctgtgtctgaaattgt

SEQ ID NO: 18283 - DNA, 25 bp, S. cerevisiae
aaggctgatccgttgggacgtaccg

SEQ ID NO: 18284 - DNA, 25 bp, S. cerevisiae
aatgggacccaacagtgccaagccg

SEQ ID NO: 18285 - DNA, 25 bp, S. cerevisiae
aaggaaccacaatagctctcaactg

SEQ ID NO: 18286 - DNA, 25 bp, S. cerevisiae
aagtgctacccaatctgtttcaaag

SEQ ID NO: 18287 - DNA, 25 bp, S. cerevisiae
aagtgtatcacctcgttatcatata

SEQ ID NO: 18288 - DNA, 25 bp, S. cerevisiae
aagtggactccaccggatattgaat

SEQ ID NO: 18289 - DNA, 25 bp, S. cerevisiae
aaggtggtagcaccgccaatgccaa

SEQ ID NO: 18290 - DNA, 25 bp, S. cerevisiae
aaggtgggtgcatctatcaaacaag

SEQ ID NO: 18291 - DNA, 25 bp, S. cerevisiae
aaggccggcgctccaacaagaattg

SEQ ID NO: 18292 - DNA, 25 bp, S. cerevisiae
aaggctctgggttcaataccaattt

SEQ ID NO: 18293 - DNA, 25 bp, S. cerevisiae
aaggctccggctaacaaaattgttg

SEQ ID NO: 18294 - DNA, 25 bp, S. cerevisiae
caagggcggcctaccataatttact

SEQ ID NO: 18295 - DNA, 25 bp, S. cerevisiae
aagggcgtctttctcaatcgtcact

SEQ ID NO: 18296 - DNA, 25 bp, S. cerevisiae
aagggagttcttcctcaattgacaa

SEQ ID NO: 18297 - DNA, 25 bp, S. cerevisiae
aagggtgtcccacaaatcgaagtca

SEQ ID NO: 18298 - DNA, 25 bp, S. cerevisiae
aaggaatccccgtcacaaggcagct

SEQ ID NO: 18299 - DNA, 25 bp, S. cerevisiae
aagtgcgttccgtcaaagaggcctc

SEQ ID NO: 18300 - DNA, 25 bp, S. cerevisiae
aagtgtggcccgacaaagactgctt

SEQ ID NO: 18301 - DNA, 25 bp, S. cerevisiae
aaggatggcagaggtcactatgact

SEQ ID NO: 18302 - DNA, 25 bp, S. cerevisiae
aaggacggactttattgactcagat

SEQ ID NO: 18303 - DNA, 25 bp, S. cerevisiae
aaggacgcaagttcactctaccaat

SEQ ID NO: 18304 - DNA, 25 bp, S. cerevisiae
aagtgtccactgatcaactacctga

SEQ ID NO: 18305 - DNA, 25 bp, S. cerevisiae
aagtgtccttacaactctactctga

SEQ ID NO: 18306 - DNA, 25 bp, S. cerevisiae
aagtgccctaaatattcacgctgat

SEQ ID NO: 18307 - DNA, 25 bp, S. cerevisiae
aagtccacggacaatagccatttga

SEQ ID NO: 18308 - DNA, 25 bp, S. cerevisiae
aagtgtttccattaatcccaccgat

SEQ ID NO: 18309 - DNA, 25 bp, S. cerevisiae
aagtgtttactttaccagaggagca

SEQ ID NO: 18310 - DNA, 25 bp, S. cerevisiae
aaggattatcgcttcaatccggcga

SEQ ID NO: 18311 - DNA, 25 bp, S. cerevisiae
aaggattccctgtcaaatgggtcaa

SEQ ID NO: 18312 - DNA, 25 bp, S. cerevisiae
aagtgcttccctccaagatttttat

SEQ ID NO: 18313 - DNA, 25 bp, S. cerevisiae
aagtcctgagtagcactttccttca

SEQ ID NO: 18314 - DNA, 25 bp, S. cerevisiae
aagggctggcttgcagtttcctgtc

SEQ ID NO: 18315 - DNA, 25 bp, S. cerevisiae
aaggtcatagtttcagggttctgca

SEQ ID NO: 18316 - DNA, 25 bp, S. cerevisiae
aaggttacgcattcaaagtcattac

SEQ ID NO: 18317 - DNA, 25 bp, S. cerevisiae
aaggctaagctgatgaaacaatcta

SEQ ID NO: 18318 - DNA, 25 bp, S. cerevisiae
aagtgctttggttgaatggcattct

SEQ ID NO: 18319 - DNA, 25 bp, S. cerevisiae
aagtgccttctttgatacagctatt

SEQ ID NO: 18320 - DNA, 25 bp, S. cerevisiae
aagtccatttggttgccattgatat

SEQ ID NO: 18321 - DNA, 25 bp, S. cerevisiae
aaggctctgtggctgggcccaaaaa

SEQ ID NO: 18322 - DNA, 25 bp, S. cerevisiae
aagtgtgctacatcatgtcgcgaca

SEQ ID NO: 18323 - DNA, 25 bp, S. cerevisiae
aagtgtcatcattcctggtattgtc

SEQ ID NO: 18324 - DNA, 25 bp, S. cerevisiae
aaggtacttccgcaatgttgcatgc

SEQ ID NO: 18325 - DNA, 25 bp, S. cerevisiae
aaggtgacatattctgcgttggttc

SEQ ID NO: 18326 - DNA, 25 bp, S. cerevisiae
aaggtactggtacatatgccgccat

SEQ ID NO: 18327 - DNA, 25 bp, S. cerevisiae
aaggtactggtgctacttctacttg

SEQ ID NO: 18328 - DNA, 25 bp, S. cerevisiae
aaggtttccgcagccattatatgtt

SEQ ID NO: 18329 - DNA, 25 bp, S. cerevisiae
aagggttacgatgcctctaagtcag

SEQ ID NO: 18330 - DNA, 25 bp, S. cerevisiae
aagtggcaacaaagttcgctcgctc

SEQ ID NO: 18331 - DNA, 25 bp, S. cerevisiae
aaggcgccgctatgattcgtaccaa

SEQ ID NO: 18332 - DNA, 25 bp, S. cerevisiae
aagtggctcctttactcgatatcca

SEQ ID NO: 18333 - DNA, 25 bp, S. cerevisiae
aagtggtcgctaaactttgtgcgca

SEQ ID NO: 18334 - DNA, 25 bp, S. cerevisiae
aatgaggtcagttttcccaataaca

SEQ ID NO: 18335 - DNA, 25 bp, S. cerevisiae
aagtgtatcacttttcaccagtaaa

SEQ ID NO: 18336 - DNA, 25 bp, S. cerevisiae
aagtgaatcgcaaaccaccttcaga

SEQ ID NO: 18337 - DNA, 25 bp, S. cerevisiae
aaggattcgcaaacatcaccgacga

SEQ ID NO: 18338 - DNA, 25 bp, S. cerevisiae
aagtgattccagtcatacctctgca

SEQ ID NO: 18339 - DNA, 25 bp, S. cerevisiae
aagtgcaatcgcaatccaattctcc

SEQ ID NO: 18340 - DNA, 25 bp, S. cerevisiae
aagtgcacagtgactgcgtgttcga

SEQ ID NO: 18341 - DNA, 25 bp, S. cerevisiae
aaggaaggtacaaaacagagccatg

SEQ ID NO: 18342 - DNA, 25 bp, S. cerevisiae
aaggatgaccacgttaaggaccatg

SEQ ID NO: 18343 - DNA, 25 bp, S. cerevisiae
aaggtagctaccaaatcagtctccg

SEQ ID NO: 18344 - DNA, 25 bp, S. cerevisiae
aatggaatgtctattccgccaccag

SEQ ID NO: 18345 - DNA, 25 bp, S. cerevisiae
aaggaagctgctaaggccgccaaga

SEQ ID NO: 18346 - DNA, 25 bp, S. cerevisiae
aagtgttacgtgcacacatcaccaa

SEQ ID NO: 18347 - DNA, 25 bp, S. cerevisiae
aagtgtaagcgcaaccaattcaaga

SEQ ID NO: 18348 - DNA, 25 bp, S. cerevisiae
aagtgttatgctagattgccaccaa

SEQ ID NO: 18349 - DNA, 25 bp, S. cerevisiae
aagtgtttgtgtccatgttgctaga

SEQ ID NO: 18350 - DNA, 25 bp, S. cerevisiae
aagtgccttgaacattgctgctaac

SEQ ID NO: 18351 - DNA, 25 bp, S. cerevisiae
aaggtggtatcattgtcggctctgc

SEQ ID NO: 18352 - DNA, 25 bp, S. cerevisiae
aagggatgttccacaggctctgctt

SEQ ID NO: 18353 - DNA, 25 bp, S. cerevisiae
aagggattctctacgtggtggcaca

SEQ ID NO: 18354 - DNA, 25 bp, S. cerevisiae
aagggttctgtcacttctgtgcaag

SEQ ID NO: 18355 - DNA, 25 bp, S. cerevisiae
aagggtgctcaaacttacgtcaaga

SEQ ID NO: 18356 - DNA, 25 bp, S. cerevisiae
aaggttgcaacatctgatacaggcc

SEQ ID NO: 18357 - DNA, 25 bp, S. cerevisiae
aaggttgactccgattatcgcgcac

SEQ ID NO: 18358 - DNA, 25 bp, S. cerevisiae
aagtgtcagtgtgcgcttatcacgc

SEQ ID NO: 18359 - DNA, 25 bp, S. cerevisiae
aagtgtgctcatcccgattatcaag

SEQ ID NO: 18360 - DNA, 25 bp, S. cerevisiae
aagtgctacaaacgatctgatcaag

SEQ ID NO: 18361 - DNA, 25 bp, S. cerevisiae
aaggtacaactgctattgcatatca

SEQ ID NO: 18362 - DNA, 25 bp, S. cerevisiae
aaggtaacttgccttcgccagaaga

SEQ ID NO: 18363 - DNA, 25 bp, S. cerevisiae
aagtgtgtttctcctattaactata

SEQ ID NO: 18364 - DNA, 25 bp, S. cerevisiae
aagggcttatatcctggctcaacgt

SEQ ID NO: 18365 - DNA, 25 bp, S. cerevisiae
aaggtgctatcgacttggccaaggc

SEQ ID NO: 18366 - DNA, 25 bp, S. cerevisiae
gaacgttggaacacgactactgccc

SEQ ID NO: 18367 - DNA, 25 bp, S. cerevisiae
aaggaccacaaacttcgtcatttgg

SEQ ID NO: 18368 - DNA, 25 bp, S. cerevisiae
aagggttttgacaccttcatgccaa

SEQ ID NO: 18369 - DNA, 25 bp, S. cerevisiae
aaggaaccctaatccttcatcacaa

SEQ ID NO: 18370 - DNA, 25 bp, S. cerevisiae
aaggtactcgtaagcgcctgtcaga

SEQ ID NO: 18371 - DNA, 25 bp, S. cerevisiae
aagtgtttcgatatgtgccgccagc

SEQ ID NO: 18372 - DNA, 25 bp, S. cerevisiae
aagtgtttttgcatggttgcacgca

SEQ ID NO: 18373 - DNA, 25 bp, S. cerevisiae
aaggtcggattgtgttgcttctccc

SEQ ID NO: 18374 - DNA, 25 bp, S. cerevisiae
aagtgttggtgatgagttctcctcc

SEQ ID NO: 18375 - DNA, 25 bp, S. cerevisiae
aagtgttatctgtttctttcgctca

SEQ ID NO: 18376 - DNA, 25 bp, S. cerevisiae
aagggctacaagtttctcctactca

SEQ ID NO: 18377 - DNA, 25 bp, S. cerevisiae
aagggcgaagattttgctccgtgca

SEQ ID NO: 18378 - DNA, 25 bp, S. cerevisiae
aagggtgaagccattgccgttgcca

SEQ ID NO: 18379 - DNA, 25 bp, S. cerevisiae
aagggtctacaaactgttgttgtcg

SEQ ID NO: 18380 - DNA, 25 bp, S. cerevisiae
aaggcccctgctgagtatttgacga

SEQ ID NO: 18381 - DNA, 25 bp, S. cerevisiae
aaggtaccgcatctttcttgatgaa

SEQ ID NO: 18382 - DNA, 25 bp, S. cerevisiae
aaggtttagccgcttctgatgatga

SEQ ID NO: 18383 - DNA, 25 bp, S. cerevisiae
aaggtcggtgtccaagttgctgctc

SEQ ID NO: 18384 - DNA, 25 bp, S. cerevisiae
aaggccatgggagacctagcttcac

SEQ ID NO: 18385 - DNA, 25 bp, S. cerevisiae
aagggctgttgagcaggcacattta

SEQ ID NO: 18386 - DNA, 25 bp, S. cerevisiae
aaggcggttgaatctgcagcagtta

SEQ ID NO: 18387 - DNA, 25 bp, S. cerevisiae
aagtgcaagatttaacccagctgaa

SEQ ID NO: 18388 - DNA, 25 bp, S. cerevisiae
aagtggaagcgattcttcaccctcg

SEQ ID NO: 18389 - DNA, 25 bp, S. cerevisiae
aagtggccataacttcagcaccaaa

SEQ ID NO: 18390 - DNA, 25 bp, S. cerevisiae
aagtgtcgctgaagtcttgccgaaa

SEQ ID NO: 18391 - DNA, 25 bp, S. cerevisiae
aagtgtgcctgttgttggacagtaa

SEQ ID NO: 18392 - DNA, 25 bp, S. cerevisiae
aagggcttgtcgcaaatctctaacg

SEQ ID NO: 18393 - DNA, 25 bp, S. cerevisiae
aagtggctatgtcccaacatttcaa

SEQ ID NO: 18394 - DNA, 25 bp, S. cerevisiae
aagtgtgtgactttggctcggcaca

SEQ ID NO: 18395 - DNA, 25 bp, S. cerevisiae
aagtggttgccaaatgttgtcaaaa

SEQ ID NO: 18396 - DNA, 25 bp, S. cerevisiae
aatgggcgacgcacttttgaaagac

SEQ ID NO: 18397 - DNA, 25 bp, S. cerevisiae
aagggcgagcacaactactacaaaa

SEQ ID NO: 18398 - DNA, 25 bp, S. cerevisiae
aatgagcttgttggcgacggtataa

SEQ ID NO: 18399 - DNA, 25 bp, S. cerevisiae
aatgaaatttgacgccggttctgac

SEQ ID NO: 18400 - DNA, 25 bp, S. cerevisiae
aaggatgtcccacattgtcccgagt

SEQ ID NO: 18401 - DNA, 25 bp, S. cerevisiae
aatgggtatccatcaggctcctttg

SEQ ID NO: 18402 - DNA, 25 bp, S. cerevisiae
aagggtcccaactatcgcaatcatc

SEQ ID NO: 18403 - DNA, 25 bp, S. cerevisiae
aagggtcctgattcacattctttcc

SEQ ID NO: 18404 - DNA, 25 bp, S. cerevisiae
aagggtgccatgtcagatgtatctg

SEQ ID NO: 18405 - DNA, 25 bp, S. cerevisiae
aaggctcaagctccagatgtcatca

SEQ ID NO: 18406 - DNA, 25 bp, S. cerevisiae
aagtgtcacgatacaatcccaaccg

SEQ ID NO: 18407 - DNA, 25 bp, S. cerevisiae
aagggatcttcagattccactgcct

SEQ ID NO: 18408 - DNA, 25 bp, S. cerevisiae
aagggtattgcatactgccactcac

SEQ ID NO: 18409 - DNA, 25 bp, S. cerevisiae
aaggtgaattggtttgctctccaaa

SEQ ID NO: 18410 - DNA, 25 bp, S. cerevisiae
aagggtggcttctttagcggacaag

SEQ ID NO: 18411 - DNA, 25 bp, S. cerevisiae
aaggatgatggtacgtctacagaaa

SEQ ID NO: 18412 - DNA, 25 bp, S. cerevisiae
aaggaaacgcaggtctaagaagatt

SEQ ID NO: 18413 - DNA, 25 bp, S. cerevisiae
aatgaaaacagtgtccccaatcctc

SEQ ID NO: 18414 - DNA, 25 bp, S. cerevisiae
aaggcaaaactatccccaattcatc

SEQ ID NO: 18415 - DNA, 25 bp, S. cerevisiae
aaggcaatcaagcaaccccagtagc

SEQ ID NO: 18416 - DNA, 25 bp, S. cerevisiae
aaggcagttggaaaaccgcaatcag

SEQ ID NO: 18417 - DNA, 25 bp, S. cerevisiae
aagtggagtggatttcgccggatct

SEQ ID NO: 18418 - DNA, 25 bp, S. cerevisiae
aagggcggtatcatcagcaagcata

SEQ ID NO: 18419 - DNA, 25 bp, S. cerevisiae
aaggttcagtatacaatgacccatt

SEQ ID NO: 18420 - DNA, 25 bp, S. cerevisiae
aagggttttgcagctcaagtgttca

SEQ ID NO: 18421 - DNA, 25 bp, S. cerevisiae
aagggaatttccctcaacgccagca

SEQ ID NO: 18422 - DNA, 25 bp, S. cerevisiae
aatgggctaaacacctattggacac

SEQ ID NO: 18423 - DNA, 25 bp, S. cerevisiae
aagtgggatattgtcctgtccaaca

SEQ ID NO: 18424 - DNA, 25 bp, S. cerevisiae
aaggtgccattggtactgtcttcgt

SEQ ID NO: 18425 - DNA, 25 bp, S. cerevisiae
aagggcgctaggacactttttgcat

SEQ ID NO: 18426 - DNA, 25 bp, S. cerevisiae
aaggatcctgccattgttttccaaa

SEQ ID NO: 18427 - DNA, 25 bp, S. cerevisiae
aaggttgaattctctttcccagatg

SEQ ID NO: 18428 - DNA, 25 bp, S. cerevisiae
aaggttatcatcaagtttttacaag

SEQ ID NO: 18429 - DNA, 25 bp, S. cerevisiae
aaggttaataccgttgcttatcaca

SEQ ID NO: 18430 - DNA, 25 bp, S. cerevisiae
aaggtacaaaacagagccatgtcat

SEQ ID NO: 18431 - DNA, 25 bp, S. cerevisiae
aaggaagcactatcaccagtattat

SEQ ID NO: 18432 - DNA, 25 bp, S. cerevisiae
aagtgggctccatgcaaaggatcta

SEQ ID NO: 18433 - DNA, 25 bp, S. cerevisiae
aaggcggcattctcaagtgggctat

SEQ ID NO: 18434 - DNA, 25 bp, S. cerevisiae
gaatcggcctcctcaaagggtttga

SEQ ID NO: 18435 - DNA, 25 bp, S. cerevisiae
aatagccctcctgccacaagagttt

SEQ ID NO: 18436 - DNA, 25 bp, S. cerevisiae
aaggccaccgggacactcaggtcat

SEQ ID NO: 18437 - DNA, 25 bp, S. cerevisiae
aaggccatttggagcacggtgtttt

SEQ ID NO: 18438 - DNA, 25 bp, S. cerevisiae
aaggtattaggatcactcgctttaa

SEQ ID NO: 18439 - DNA, 25 bp, S. cerevisiae
aagggtcgaatgtccactttctcta

SEQ ID NO: 18440 - DNA, 25 bp, S. cerevisiae
aaggttcgtacattggtctgctccg

SEQ ID NO: 18441 - DNA, 25 bp, S. cerevisiae
aagtggcagctgaacagccttctac

SEQ ID NO: 18442 - DNA, 25 bp, S. cerevisiae
aagggctccctagctactggagaat

SEQ ID NO: 18443 - DNA, 25 bp, S. cerevisiae
aagggtacacttctagatgggcgtt

SEQ ID NO: 18444 - DNA, 25 bp, S. cerevisiae
aagggtaatgcctctacttctcgtt

SEQ ID NO: 18445 - DNA, 25 bp, S. cerevisiae
aaggatgctttgaacaagtgtctca

SEQ ID NO: 18446 - DNA, 25 bp, S. cerevisiae
aaggtcatatccaagcgagttcgca

SEQ ID NO: 18447 - DNA, 25 bp, S. cerevisiae
aaggcaaatcttggctgcaaccgca

SEQ ID NO: 18448 - DNA, 25 bp, S. cerevisiae
aatggtaaccggcagcaagagcaac

SEQ ID NO: 18449 - DNA, 25 bp, S. cerevisiae
aaggtaccctggtcgctgcagagac

SEQ ID NO: 18450 - DNA, 25 bp, S. cerevisiae
aagggcttggaattcgttgcatcga

SEQ ID NO: 18451 - DNA, 25 bp, S. cerevisiae
aagtggattgggatcgtatatctaa

SEQ ID NO: 18452 - DNA, 25 bp, S. cerevisiae
aaggcctcgaggatagtagacataa

SEQ ID NO: 18453 - DNA, 25 bp, S. cerevisiae
aaggcacttggtgtcatgtgggcta

SEQ ID NO: 18454 - DNA, 25 bp, S. cerevisiae
aaggactggtctggaatttcgcaat

SEQ ID NO: 18455 - DNA, 25 bp, S. cerevisiae
aagggtggtgctgaagctgcttcca

SEQ ID NO: 18456 - DNA, 25 bp, S. cerevisiae
aaggtcacatcgtttgggtggcctc

SEQ ID NO: 18457 - DNA, 25 bp, S. cerevisiae
aaggaccaccagacactgttctaga

SEQ ID NO: 18458 - DNA, 25 bp, S. cerevisiae
aagtggaagcctttgcgttcaagaa

SEQ ID NO: 18459 - DNA, 25 bp, S. cerevisiae
aaggaagagccatccgcggcaagga

SEQ ID NO: 18460 - DNA, 25 bp, S. cerevisiae
aaggcaccttttgaggctgaagcaa

SEQ ID NO: 18461 - DNA, 25 bp, S. cerevisiae
aaggtccagctccagtgcaggcgat

SEQ ID NO: 18462 - DNA, 25 bp, S. cerevisiae
aaggagttcttatcaggcgatttga

SEQ ID NO: 18463 - DNA, 25 bp, S. cerevisiae
aagggctccctgataaggccttgga

SEQ ID NO: 18464 - DNA, 25 bp, S. cerevisiae
aagggctaccaattacacagtctgt

SEQ ID NO: 18465 - DNA, 25 bp, S. cerevisiae
aagggcgatcgctatttaagtgtca

SEQ ID NO: 18466 - DNA, 25 bp, S. cerevisiae
aaggtgggcgcaattaccattgata

SEQ ID NO: 18467 - DNA, 25 bp, S. cerevisiae
aaggtatcggcctgagcgctgatga

SEQ ID NO: 18468 - DNA, 25 bp, S. cerevisiae
aaggtagcccacgatgtgctggagt

SEQ ID NO: 18469 - DNA, 25 bp, S. cerevisiae
aaggtccatctctatctgacgaggt

SEQ ID NO: 18470 - DNA, 25 bp, S. cerevisiae
aaggccctccacaatcacaggttga

SEQ ID NO: 18471 - DNA, 25 bp, S. cerevisiae
aagggccttcccgatgagagaattt

SEQ ID NO: 18472 - DNA, 25 bp, S. cerevisiae
aagggtcttcgcagaatgcaattct

SEQ ID NO: 18473 - DNA, 25 bp, S. cerevisiae
aagggtcttcccctgtgcaatgctt

SEQ ID NO: 18474 - DNA, 25 bp, S. cerevisiae
aagggttcatgccaatcttcaatgc

SEQ ID NO: 18475 - DNA, 25 bp, S. cerevisiae
aagggtgtcgaagtcgtcttgccag

SEQ ID NO: 18476 - DNA, 25 bp, S. cerevisiae
aaggacggtgttttgactgatgcca

SEQ ID NO: 18477 - DNA, 25 bp, S. cerevisiae
aaggacggatggcactacgcctatt

SEQ ID NO: 18478 - DNA, 25 bp, S. cerevisiae
aaggcactgttgtggcaactacttt

SEQ ID NO: 18479 - DNA, 25 bp, S. cerevisiae
aaggatctttcgcacagactactca

SEQ ID NO: 18480 - DNA, 25 bp, S. cerevisiae
aaggattttactcgcatcactggcc

SEQ ID NO: 18481 - DNA, 25 bp, S. cerevisiae
aagggttctacaattctgacgatga

SEQ ID NO: 18482 - DNA, 25 bp, S. cerevisiae
aagggttctttcattggcgagtcca

SEQ ID NO: 18483 - DNA, 25 bp, S. cerevisiae
aagggtttcttgactgaccgtgaat

SEQ ID NO: 18484 - DNA, 25 bp, S. cerevisiae
aaggtggaacttttgcccaagcaga

SEQ ID NO: 18485 - DNA, 25 bp, S. cerevisiae
aaggtggatccaatttgtctcaagg

SEQ ID NO: 18486 - DNA, 25 bp, S. cerevisiae
aaggtacagcttctagattcaggtg

SEQ ID NO: 18487 - DNA, 25 bp, S. cerevisiae
aaggcttcacttctcacggcaatgt

SEQ ID NO: 18488 - DNA, 25 bp, S. cerevisiae
aaggctgcttacttgaacgacataa

SEQ ID NO: 18489 - DNA, 25 bp, S. cerevisiae
aaggtgtttcttccaaggcaatatc

SEQ ID NO: 18490 - DNA, 25 bp, S. cerevisiae
aaggtatttcctgcaaagacttgaa

SEQ ID NO: 18491 - DNA, 25 bp, S. cerevisiae
aaggattattccatagatagtattg

SEQ ID NO: 18492 - DNA, 25 bp, S. cerevisiae
aaggtttcatcccaggttacggcat

SEQ ID NO: 18493 - DNA, 25 bp, S. cerevisiae
aaggtattctcctaggcgtaccact

SEQ ID NO: 18494 - DNA, 25 bp, S. cerevisiae
aaggtgatgatttacacccgcctgc

SEQ ID NO: 18495 - DNA, 25 bp, S. cerevisiae
aaggtgatttatgggcctcagcggc

SEQ ID NO: 18496 - DNA, 25 bp, S. cerevisiae
aaggtattaagcctgctctagacga

SEQ ID NO: 18497 - DNA, 25 bp, S. cerevisiae
aaggtatcattcactctgacttcgc

SEQ ID NO: 18498 - DNA, 25 bp, S. cerevisiae
aaggcattccatgagtccaactctg

SEQ ID NO: 18499 - DNA, 25 bp, S. cerevisiae
aaggcgtatccttaagatttccaag

SEQ ID NO: 18500 - DNA, 25 bp, S. cerevisiae
aaggtgttatctttgttgtcgattc

SEQ ID NO: 18501 - DNA, 25 bp, S. cerevisiae
aagggttcatctaattcgctcctgg

SEQ ID NO: 18502 - DNA, 25 bp, S. cerevisiae
aaggttacacggtacagtcactgga

SEQ ID NO: 18503 - DNA, 25 bp, S. cerevisiae
aaggagaaacgccacaccgcatggg

SEQ ID NO: 18504 - DNA, 25 bp, S. cerevisiae
aaggaaggacgcacacatccactgc

SEQ ID NO: 18505 - DNA, 25 bp, S. cerevisiae
aagggtaccagcacatatccagtca

SEQ ID NO: 18506 - DNA, 25 bp, S. cerevisiae
aagggaaccattgctttcgatactc

SEQ ID NO: 18507 - DNA, 25 bp, S. cerevisiae
aagggcgcttttggacattcatgaa

SEQ ID NO: 18508 - DNA, 25 bp, S. cerevisiae
aagggcatacccgtgactcttattg

SEQ ID NO: 18509 - DNA, 25 bp, S. cerevisiae
aagggtcccgtatccatggacaaag

SEQ ID NO: 18510 - DNA, 25 bp, S. cerevisiae
aagggatcacacatttccagagaaa

SEQ ID NO: 18511 - DNA, 25 bp, S. cerevisiae
aagggcaagctgatcgcacaatatc

SEQ ID NO: 18512 - DNA, 25 bp, S. cerevisiae
aagggcacggtgacgcagctgtatt

SEQ ID NO: 18513 - DNA, 25 bp, S. cerevisiae
aagggcacgcgctgcaagtgatgat

SEQ ID NO: 18514 - DNA, 25 bp, S. cerevisiae
aagggcagcgattctatagtaattc

SEQ ID NO: 18515 - DNA, 25 bp, S. cerevisiae
aaggtgccgtctgcatcaattttgc

SEQ ID NO: 18516 - DNA, 25 bp, S. cerevisiae
aagggcttgttgtcattgttgctgg

SEQ ID NO: 18517 - DNA, 25 bp, S. cerevisiae
aatgggctgtggcaacttccggtac

SEQ ID NO: 18518 - DNA, 25 bp, S. cerevisiae
aaggcgtccgcgacacctacgatgt

SEQ ID NO: 18519 - DNA, 25 bp, S. cerevisiae
aaggcggaaggcaggctctcgtaaa

SEQ ID NO: 18520 - DNA, 25 bp, S. cerevisiae
aaggcggtaatgcttcatccggtgc

SEQ ID NO: 18521 - DNA, 25 bp, S. cerevisiae
aaggtggtactgttctcattgtcgc

SEQ ID NO: 18522 - DNA, 25 bp, S. cerevisiae
aaggtcggactgttctattgctact

SEQ ID NO: 18523 - DNA, 25 bp, S. cerevisiae
aaggttggtctaactctttggctgg

SEQ ID NO: 18524 - DNA, 25 bp, S. cerevisiae
aaggatcgtatacaccacttggtct

SEQ ID NO: 18525 - DNA, 25 bp, S. cerevisiae
aaggtcgttaaggtctctggtgtct

SEQ ID NO: 18526 - DNA, 25 bp, S. cerevisiae
aaggtcgacgaaggctctgatgttt

SEQ ID NO: 18527 - DNA, 25 bp, S. cerevisiae
aaggatcggagtacctcaagtgtta

SEQ ID NO: 18528 - DNA, 25 bp, S. cerevisiae
aagggtttgagcctactttcagcac

SEQ ID NO: 18529 - DNA, 25 bp, S. cerevisiae
aaggtacggcattcaagatttttca

SEQ ID NO: 18530 - DNA, 25 bp, S. cerevisiae
aaggaaacctctactgacccatctt

SEQ ID NO: 18531 - DNA, 25 bp, S. cerevisiae
aaggaagaaccagctgcaccaactt

SEQ ID NO: 18532 - DNA, 25 bp, S. cerevisiae
aaggtcaaaccgtctcactatactt

SEQ ID NO: 18533 - DNA, 25 bp, S. cerevisiae
aaggattacaccgagtcactaaagg

SEQ ID NO: 18534 - DNA, 25 bp, S. cerevisiae
aaggataagccggagactctcaaga

SEQ ID NO: 18535 - DNA, 25 bp, S. cerevisiae
aaggtgaagctgaccaagccccaga

SEQ ID NO: 18536 - DNA, 25 bp, S. cerevisiae
aaggtcgacttaatatctcccacac

SEQ ID NO: 18537 - DNA, 25 bp, S. cerevisiae
aaggtctactagatactccacaaag

SEQ ID NO: 18538 - DNA, 25 bp, S. cerevisiae
aagggagccattacttccattgcat

SEQ ID NO: 18539 - DNA, 25 bp, S. cerevisiae
aagggtcctggaacatacattgtaa

SEQ ID NO: 18540 - DNA, 25 bp, S. cerevisiae
aaggactccttggacaacactttcg

SEQ ID NO: 18541 - DNA, 25 bp, S. cerevisiae
aaggttcacatcagcaaacatttct

SEQ ID NO: 18542 - DNA, 25 bp, S. cerevisiae
aaggtgagcacagtctaaacatttc

SEQ ID NO: 18543 - DNA, 25 bp, S. cerevisiae
aaggctgagagctttgcaaaactag

SEQ ID NO: 18544 - DNA, 25 bp, S. cerevisiae
aaggtgatactgttggaagctcgaa

SEQ ID NO: 18545 - DNA, 25 bp, S. cerevisiae
aaggttctcatgtattagagccaga

SEQ ID NO: 18546 - DNA, 25 bp, S. cerevisiae
aaggtgatcttatttgcgctgctga

SEQ ID NO: 18547 - DNA, 25 bp, S. cerevisiae
aaggatgatttgtcaggcgccgata

SEQ ID NO: 18548 - DNA, 25 bp, S. cerevisiae
aaggtgatcgcgtagcccaattgat

SEQ ID NO: 18549 - DNA, 25 bp, S. cerevisiae
aaggtactgctgtttctcaagctga

SEQ ID NO: 18550 - DNA, 25 bp, S. cerevisiae
aaggcacagtgtgcgttccaggcca

SEQ ID NO: 18551 - DNA, 25 bp, S. cerevisiae
aaggaatcatgcgagacccctattg

SEQ ID NO: 18552 - DNA, 25 bp, S. cerevisiae
aagggattgctactacctcttctaa

SEQ ID NO: 18553 - DNA, 25 bp, S. cerevisiae
aaggtgattgcttgtactgctccta

SEQ ID NO: 18554 - DNA, 25 bp, S. cerevisiae
aaggagtgtctggatctcagcacct

SEQ ID NO: 18555 - DNA, 25 bp, S. cerevisiae
aaggttgtagtgtcgcaggcctcac

SEQ ID NO: 18556 - DNA, 25 bp, S. cerevisiae
aagggttattcttacacagatgcaa

SEQ ID NO: 18557 - DNA, 25 bp, S. cerevisiae
aaggtctcatttccttggaccactg

SEQ ID NO: 18558 - DNA, 25 bp, S. cerevisiae
aaggtgtccgatggatcttcagaga

SEQ ID NO: 18559 - DNA, 25 bp, S. cerevisiae
aaggtgctacaaatgcatctagaag

SEQ ID NO: 18560 - DNA, 25 bp, S. cerevisiae
aaggtgctactgtcttctatacatg

SEQ ID NO: 18561 - DNA, 25 bp, S. cerevisiae
aaggtcgttgattgctttgtcattg

SEQ ID NO: 18562 - DNA, 25 bp, S. cerevisiae
aaggccattgtcgttcaaggtccag

SEQ ID NO: 18563 - DNA, 25 bp, S. cerevisiae
aaggacatttccactggtgacgcag

SEQ ID NO: 18564 - DNA, 25 bp, S. cerevisiae
aaggacattctcatgggtgaaccag

SEQ ID NO: 18565 - DNA, 25 bp, S. cerevisiae
aatagcaatttcatgggttccggta

SEQ ID NO: 18566 - DNA, 25 bp, S. cerevisiae
aatgtactgattcatccgttctggg

SEQ ID NO: 18567 - DNA, 25 bp, S. cerevisiae
aaggatgtcgttttcaattcagatg

SEQ ID NO: 18568 - DNA, 25 bp, S. cerevisiae
aagggtcgtctaatccagatcaact

SEQ ID NO: 18569 - DNA, 25 bp, S. cerevisiae
aagggtcccagcaacgatgatcaac

SEQ ID NO: 18570 - DNA, 25 bp, S. cerevisiae
aagggttctatgcacgatgtcgtca

SEQ ID NO: 18571 - DNA, 25 bp, S. cerevisiae
aaggttaccaggtcgcattcttcac

SEQ ID NO: 18572 - DNA, 25 bp, S. cerevisiae
aaggttacggatgcgctggctgtac

SEQ ID NO: 18573 - DNA, 25 bp, S. cerevisiae
aaggtttcggtgacgaagctccaat

SEQ ID NO: 18574 - DNA, 25 bp, S. cerevisiae
aagggtgactctccacaaacattat

SEQ ID NO: 18575 - DNA, 25 bp, S. cerevisiae
aaggtacctgctgcgcaaggctaga

SEQ ID NO: 18576 - DNA, 25 bp, S. cerevisiae
aaggtacatccgtgctatggtcaga

SEQ ID NO: 18577 - DNA, 25 bp, S. cerevisiae
aaggatcaactttgtctgtgagact

SEQ ID NO: 18578 - DNA, 25 bp, S. cerevisiae
aaggatctaccttggcccaattgac

SEQ ID NO: 18579 - DNA, 25 bp, S. cerevisiae
aaggatgctttttcgcccaaaatcg

SEQ ID NO: 18580 - DNA, 25 bp, S. cerevisiae
aaggtcacttttgctcgaaacacag

SEQ ID NO: 18581 - DNA, 25 bp, S. cerevisiae
aaggaccttattgcagaaaacgaga

SEQ ID NO: 18582 - DNA, 25 bp, S. cerevisiae
aaggacgccaacaccaagaacagga

SEQ ID NO: 18583 - DNA, 25 bp, S. cerevisiae
aaggaagcccacgaaatagtatcaa

SEQ ID NO: 18584 - DNA, 25 bp, S. cerevisiae
aatggaccccaagaatagcaagagt

SEQ ID NO: 18585 - DNA, 25 bp, S. cerevisiae
aaggccatcccaaaagaccaaagag

SEQ ID NO: 18586 - DNA, 25 bp, S. cerevisiae
aaggccaaccataacgacaaacaag

SEQ ID NO: 18587 - DNA, 25 bp, S. cerevisiae
aaggatgccacttctgcactgaaaa

SEQ ID NO: 18588 - DNA, 25 bp, S. cerevisiae
aaggatatcaagttggctagaagat

SEQ ID NO: 18589 - DNA, 25 bp, S. cerevisiae
aagggtgcagatgtagtcgcaacta

SEQ ID NO: 18590 - DNA, 25 bp, S. cerevisiae
aagggtctcgcgttgatcgacctaa

SEQ ID NO: 18591 - DNA, 25 bp, S. cerevisiae
aaggtgtccctttccacagaatcat

SEQ ID NO: 18592 - DNA, 25 bp, S. cerevisiae
aatgtgggctacatgcatacacagc

SEQ ID NO: 18593 - DNA, 25 bp, S. cerevisiae
aaggcgtggacggatgtcttgccat

SEQ ID NO: 18594 - DNA, 25 bp, S. cerevisiae
aatgggaggttgctcttaacgcgaa

SEQ ID NO: 18595 - DNA, 25 bp, S. cerevisiae
aatgggcgggcaaacatttacgctg

SEQ ID NO: 18596 - DNA, 25 bp, S. cerevisiae
aaggtcactgatgcttcttctttgc

SEQ ID NO: 18597 - DNA, 25 bp, S. cerevisiae
aaggtatcgagtttgctcctgtcgc

SEQ ID NO: 18598 - DNA, 25 bp, S. cerevisiae
aaggtcatcgagagtgccgaacact

SEQ ID NO: 18599 - DNA, 25 bp, S. cerevisiae
aaggttcagagttcttccaaacaag

SEQ ID NO: 18600 - DNA, 25 bp, S. cerevisiae
aaggatggctctgcacttcaagtta

SEQ ID NO: 18601 - DNA, 25 bp, S. cerevisiae
aagggtgctcccattatcagatctc

SEQ ID NO: 18602 - DNA, 25 bp, S. cerevisiae
aaggtggtcccttagacacagctat

SEQ ID NO: 18603 - DNA, 25 bp, S. cerevisiae
aatgggttccatctgagaaacttca

SEQ ID NO: 18604 - DNA, 25 bp, S. cerevisiae
aaggcgttggatctgttaaattcta

SEQ ID NO: 18605 - DNA, 25 bp, S. cerevisiae
aaggactattatacggtcaccgata

SEQ ID NO: 18606 - DNA, 25 bp, S. cerevisiae
aaggactaaacccaattctcgatat

SEQ ID NO: 18607 - DNA, 25 bp, S. cerevisiae
aaggccttcagtgcaggtattgcgt

SEQ ID NO: 18608 - DNA, 25 bp, S. cerevisiae
aaggcgcctcacaaagtggcttcgt

SEQ ID NO: 18609 - DNA, 25 bp, S. cerevisiae
aaggacccatgaaagatcgcgatct

SEQ ID NO: 18610 - DNA, 25 bp, S. cerevisiae
aaggcatcggcatggactctgcgtt

SEQ ID NO: 18611 - DNA, 25 bp, S. cerevisiae
aaggatgcctatgctgtgcgtctag

SEQ ID NO: 18612 - DNA, 25 bp, S. cerevisiae
aaggtcgcatcagcgtcattgatcg

SEQ ID NO: 18613 - DNA, 25 bp, S. cerevisiae
aaggactatattctgccacaccaag

SEQ ID NO: 18614 - DNA, 25 bp, S. cerevisiae
aaggtcaactattctgtcaactcca

SEQ ID NO: 18615 - DNA, 25 bp, S. cerevisiae
aaggtgtttgggacatcgccgctga

SEQ ID NO: 18616 - DNA, 25 bp, S. cerevisiae
aaggtgtttgcggaactgcagcctc

SEQ ID NO: 18617 - DNA, 25 bp, S. cerevisiae
aaggtactgtcttgatctcttgtcc

SEQ ID NO: 18618 - DNA, 25 bp, S. cerevisiae
aaggtcctgtgttatgcttgtcatc

SEQ ID NO: 18619 - DNA, 25 bp, S. cerevisiae
aaggcaataccagtcatggcttggc

SEQ ID NO: 18620 - DNA, 25 bp, S. cerevisiae
aaggactacattgccctgatcaatc

SEQ ID NO: 18621 - DNA, 25 bp, S. cerevisiae
aaggttatcattaccggtgctccag

SEQ ID NO: 18622 - DNA, 25 bp, S. cerevisiae
aaggcattcaaagactgggctccag

SEQ ID NO: 18623 - DNA, 25 bp, S. cerevisiae
aaggctttgctctttttcaacaacg

SEQ ID NO: 18624 - DNA, 25 bp, S. cerevisiae
aaggttggtgacattgtcgacatca

SEQ ID NO: 18625 - DNA, 25 bp, S. cerevisiae
aaggaatgcgttattgatctctcat

SEQ ID NO: 18626 - DNA, 25 bp, S. cerevisiae
aaggactatgtatcgttgctggcag

SEQ ID NO: 18627 - DNA, 25 bp, S. cerevisiae
aaggaggtctactcttcgtcattgc

SEQ ID NO: 18628 - DNA, 25 bp, S. cerevisiae
aaggatatgattttgacgccctcaa

SEQ ID NO: 18629 - DNA, 25 bp, S. cerevisiae
aaggatgattacttgacgcttccaa

SEQ ID NO: 18630 - DNA, 25 bp, S. cerevisiae
aaggtattgctaacccaatcgccac

SEQ ID NO: 18631 - DNA, 25 bp, S. cerevisiae
aaggttatggttcgcaagtcgccca

SEQ ID NO: 18632 - DNA, 25 bp, S. cerevisiae
aaggtatatttttcaactccacgtg

SEQ ID NO: 18633 - DNA, 25 bp, S. cerevisiae
aaggcagaatacttgttccaacgta

SEQ ID NO: 18634 - DNA, 25 bp, S. cerevisiae
aaggtttcttgtttcattgcctggt

SEQ ID NO: 18635 - DNA, 25 bp, S. cerevisiae
aaggcctttggttgttgtgctcgcg

SEQ ID NO: 18636 - DNA, 25 bp, S. cerevisiae
aaggcctttgcgtacgtgggctgaa

SEQ ID NO: 18637 - DNA, 25 bp, S. cerevisiae
aaggttattggatgccgccgttgtc

SEQ ID NO: 18638 - DNA, 25 bp, S. cerevisiae
aaggtttcataatgcccacttctga

SEQ ID NO: 18639 - DNA, 25 bp, S. cerevisiae
aaggtttcttatgttgcctctttga

SEQ ID NO: 18640 - DNA, 25 bp, S. cerevisiae
aaggtgctctcttcagtattgcctc

SEQ ID NO: 18641 - DNA, 25 bp, S. cerevisiae
aaggagctgtcaatcaggttcccgc

SEQ ID NO: 18642 - DNA, 25 bp, S. cerevisiae
aaggttctgagagcgatgctgccac

SEQ ID NO: 18643 - DNA, 25 bp, S. cerevisiae
aaggtatctgcggttcatgtgccat

SEQ ID NO: 18644 - DNA, 25 bp, S. cerevisiae
aaggaactagtcaagcgtgccagaa

SEQ ID NO: 18645 - DNA, 25 bp, S. cerevisiae
aaggtccaattctttgcagtcctca

SEQ ID NO: 18646 - DNA, 25 bp, S. cerevisiae
aaggtcctttgcttatcaggatcca

SEQ ID NO: 18647 - DNA, 25 bp, S. cerevisiae
aaggatcgctcctatttcattgacc

SEQ ID NO: 18648 - DNA, 25 bp, S. cerevisiae
aaggactcctctaagttaggtcaat

SEQ ID NO: 18649 - DNA, 25 bp, S. cerevisiae
aaggcttactgccatactgtctaat

SEQ ID NO: 18650 - DNA, 25 bp, S. cerevisiae
aaggtatcaaacattactgcactga

SEQ ID NO: 18651 - DNA, 25 bp, S. cerevisiae
aaggttccattgctgataaggctga

SEQ ID NO: 18652 - DNA, 25 bp, S. cerevisiae
aaggttcagcttcatgtcgttgtac

SEQ ID NO: 18653 - DNA, 25 bp, S. cerevisiae
aaggcgccttactttgaggagaacg

SEQ ID NO: 18654 - DNA, 25 bp, S. cerevisiae
aatggcgtagacgttctagccgttt

SEQ ID NO: 18655 - DNA, 25 bp, S. cerevisiae
aaggaatccactttacatttggtct

SEQ ID NO: 18656 - DNA, 25 bp, S. cerevisiae
aaggaaacctttactgtcatcgata

SEQ ID NO: 18657 - DNA, 25 bp, S. cerevisiae
aaggcacaaaccattctgtccaggg

SEQ ID NO: 18658 - DNA, 25 bp, S. cerevisiae
aatggactgaaccttattgcccggg

SEQ ID NO: 18659 - DNA, 25 bp, S. cerevisiae
aaggacaatgttaatcctcctccca

SEQ ID NO: 18660 - DNA, 25 bp, S. cerevisiae
aaggcatatcttgaacagttactct

SEQ ID NO: 18661 - DNA, 25 bp, S. cerevisiae
aaggcttttagttcttctactctat

SEQ ID NO: 18662 - DNA, 25 bp, S. cerevisiae
aaggtatttcgatcattcttgccaa

SEQ ID NO: 18663 - DNA, 25 bp, S. cerevisiae
aaggtactaagatgttgcctccaaa

SEQ ID NO: 18664 - DNA, 25 bp, S. cerevisiae
caaggcccaaggtgttgctgtccaa

SEQ ID NO: 18665 - DNA, 25 bp, S. cerevisiae
caaggccaaacgtttgtggctccca

SEQ ID NO: 18666 - DNA, 25 bp, S. cerevisiae
aaggatattcccattttcatcttat

SEQ ID NO: 18667 - DNA, 25 bp, S. cerevisiae
aaggatattcccatcttcgagctct

SEQ ID NO: 18668 - DNA, 25 bp, S. cerevisiae
aaggctttggccatttttgttccag

SEQ ID NO: 18669 - DNA, 25 bp, S. cerevisiae
aaggccttagactattgtcattcaa

SEQ ID NO: 18670 - DNA, 25 bp, S. cerevisiae
aaggccattcgagagtacgttaatc

SEQ ID NO: 18671 - DNA, 25 bp, S. cerevisiae
aaggttttctcacatctcagttcat

SEQ ID NO: 18672 - DNA, 25 bp, S. cerevisiae
aaggctatcattgtcttgtccactt

SEQ ID NO: 18673 - DNA, 25 bp, S. cerevisiae
aaggcccttgtgttggaattagatg

SEQ ID NO: 18674 - DNA, 25 bp, S. cerevisiae
aaggctccgttgtagagactattga

SEQ ID NO: 18675 - DNA, 25 bp, S. cerevisiae
aaggccaagttcgacgctcgttgtg

SEQ ID NO: 18676 - DNA, 25 bp, S. cerevisiae
aaggcgcttttcaaggacgcttgta

SEQ ID NO: 18677 - DNA, 25 bp, S. cerevisiae
aaggcaggtccaaacaacgcttgtc

SEQ ID NO: 18678 - DNA, 25 bp, S. cerevisiae
aatgggctggtatgtgtcacttacg

SEQ ID NO: 18679 - DNA, 25 bp, S. cerevisiae
aatggagtgcggtagttcagatgac

SEQ ID NO: 18680 - DNA, 25 bp, S. cerevisiae
aatgggccggactttcaaaacagcg

SEQ ID NO: 18681 - DNA, 25 bp, S. cerevisiae
aatggcccagaagattttcaacagc

SEQ ID NO: 18682 - DNA, 25 bp, S. cerevisiae
aatggccgcgtaaaggctctcgaac

SEQ ID NO: 18683 - DNA, 25 bp, S. cerevisiae
aaggttttctcctacatcgacagag

SEQ ID NO: 18684 - DNA, 25 bp, S. cerevisiae
aaggatccttattagccattgctca

SEQ ID NO: 18685 - DNA, 25 bp, S. cerevisiae
aaggtatctccatatctagtgcata

SEQ ID NO: 18686 - DNA, 25 bp, S. cerevisiae
aaggtatcctcatggccaagcaata

SEQ ID NO: 18687 - DNA, 25 bp, S. cerevisiae
aaggaagccatagtattctctcaaa

SEQ ID NO: 18688 - DNA, 25 bp, S. cerevisiae
aaggaacctttgaactctcaacaat

SEQ ID NO: 18689 - DNA, 25 bp, S. cerevisiae
aatctagggccatgtcgatttcgac

SEQ ID NO: 18690 - DNA, 25 bp, S. cerevisiae
aatctcaggaggcactagcattggc

SEQ ID NO: 18691 - DNA, 25 bp, S. cerevisiae
aatccagaagcgcagtcaggtttga

SEQ ID NO: 18692 - DNA, 25 bp, S. cerevisiae
taacaaacggcaacgaggagaccaa

SEQ ID NO: 18693 - DNA, 25 bp, S. cerevisiae
aatgcagtactgacaaccgataaca

SEQ ID NO: 18694 - DNA, 25 bp, S. cerevisiae
aatggactcgaagatttgcccttaa

SEQ ID NO: 18695 - DNA, 25 bp, S. cerevisiae
aaggcagtcttagattcgtgggtta

SEQ ID NO: 18696 - DNA, 25 bp, S. cerevisiae
aaggcgtgcttagatcagcgtagtc

SEQ ID NO: 18697 - DNA, 25 bp, S. cerevisiae
aaggcgtctttggaagcttatcatc

SEQ ID NO: 18698 - DNA, 25 bp, S. cerevisiae
aaggaggccggaatgctgctaacat

SEQ ID NO: 18699 - DNA, 25 bp, S. cerevisiae
aaggaaggcgcacagctctacagct

SEQ ID NO: 18700 - DNA, 25 bp, S. cerevisiae
aaggaagtgcaccacacggaggctt

SEQ ID NO: 18701 - DNA, 25 bp, S. cerevisiae
aaggatggtcgttcattatttttga

SEQ ID NO: 18702 - DNA, 25 bp, S. cerevisiae
aaggttcaggtacttctgtgttcga

SEQ ID NO: 18703 - DNA, 25 bp, S. cerevisiae
aaggactctgatgaatttggcgatg

SEQ ID NO: 18704 - DNA, 25 bp, S. cerevisiae
aaggatcatcgttagcatctgcggc

SEQ ID NO: 18705 - DNA, 25 bp, S. cerevisiae
aaggactgctgatcagctcacgtca

SEQ ID NO: 18706 - DNA, 25 bp, S. cerevisiae
aaggaacaaaccgaagctgccaaga

SEQ ID NO: 18707 - DNA, 25 bp, S. cerevisiae
aaggaacaggatacgctagcgccag

SEQ ID NO: 18708 - DNA, 25 bp, S. cerevisiae
aaggaacatggtactgtcccgaatg

SEQ ID NO: 18709 - DNA, 25 bp, S. cerevisiae
aaggctctcctgtggttacaatgat

SEQ ID NO: 18710 - DNA, 25 bp, S. cerevisiae
aaggcccctttttgtattcatcctg

SEQ ID NO: 18711 - DNA, 25 bp, S. cerevisiae
aaggccgagtctactttgggaccat

SEQ ID NO: 18712 - DNA, 25 bp, S. cerevisiae
gtaggaagccccacaagcggttctg

SEQ ID NO: 18713 - DNA, 25 bp, S. cerevisiae
aaggcaagccttacaaacgatgttt

SEQ ID NO: 18714 - DNA, 25 bp, S. cerevisiae
aaggaggtgctctcacggatcagta

SEQ ID NO: 18715 - DNA, 25 bp, S. cerevisiae
aaggagcaagtgtccacggcatcgt

SEQ ID NO: 18716 - DNA, 25 bp, S. cerevisiae
aaggcacaactgtcccagatgttgg

SEQ ID NO: 18717 - DNA, 25 bp, S. cerevisiae
aaggcgtactgtcgagtatacctcg

SEQ ID NO: 18718 - DNA, 25 bp, S. cerevisiae
aaggcttacatctccagaatccaga

SEQ ID NO: 18719 - DNA, 25 bp, S. cerevisiae
aaggctccaattcccagtgatgcgg

SEQ ID NO: 18720 - DNA, 25 bp, S. cerevisiae
aaggcttgaattctacagtggcaga

SEQ ID NO: 18721 - DNA, 25 bp, S. cerevisiae
aaggagttcattttgccggagcaga

SEQ ID NO: 18722 - DNA, 25 bp, S. cerevisiae
aaggatgttcatcttcaggtgagaa

SEQ ID NO: 18723 - DNA, 25 bp, S. cerevisiae
aaggcctggtttagagcaattcaaa

SEQ ID NO: 18724 - DNA, 25 bp, S. cerevisiae
aaggcatctgggtttttattagaca

SEQ ID NO: 18725 - DNA, 25 bp, S. cerevisiae
aaggcacgttgattctttaattgaa

SEQ ID NO: 18726 - DNA, 25 bp, S. cerevisiae
aaggcgcgatttaggttatacctca

SEQ ID NO: 18727 - DNA, 25 bp, S. cerevisiae
aaggccgcaattggctgtttaccag

SEQ ID NO: 18728 - DNA, 25 bp, S. cerevisiae
aaggctccaatcaggcgatttctca

SEQ ID NO: 18729 - DNA, 25 bp, S. cerevisiae
aatctctccaaattctagaaccctc

SEQ ID NO: 18730 - DNA, 25 bp, S. cerevisiae
aatgtccctcaatcaagcgacggtg

SEQ ID NO: 18731 - DNA, 25 bp, S. cerevisiae
aatgaccccaatagacaaccgttat

SEQ ID NO: 18732 - DNA, 25 bp, S. cerevisiae
aatgtacgccaaacggttgacacta

SEQ ID NO: 18733 - DNA, 25 bp, S. cerevisiae
aaggctgcagaactagacgtcttga

SEQ ID NO: 18734 - DNA, 25 bp, S. cerevisiae
aaggacagcaacagcctggcgtgca

SEQ ID NO: 18735 - DNA, 25 bp, S. cerevisiae
aaggaccagcaccagccatcaaggc

SEQ ID NO: 18736 - DNA, 25 bp, S. cerevisiae
aatggaccaggcaacccagaactat

SEQ ID NO: 18737 - DNA, 25 bp, S. cerevisiae
aaggatcctggcaccaagcattttc

SEQ ID NO: 18738 - DNA, 25 bp, S. cerevisiae
aaggcgatgagtcaatcacgattgt

SEQ ID NO: 18739 - DNA, 25 bp, S. cerevisiae
aaggatcaatggtctccagctctaa

SEQ ID NO: 18740 - DNA, 25 bp, S. cerevisiae
aatatgacccgtatactaccacaac

SEQ ID NO: 18741 - DNA, 25 bp, S. cerevisiae
aatggacccggttcgtacgacatat

SEQ ID NO: 18742 - DNA, 25 bp, S. cerevisiae
aatggctccggtactgggtcagcta

SEQ ID NO: 18743 - DNA, 25 bp, S. cerevisiae
aaggcgggttcatatgtgtccaaca

SEQ ID NO: 18744 - DNA, 25 bp, S. cerevisiae
aaggacgtttcaaatgtttcacaga

SEQ ID NO: 18745 - DNA, 25 bp, S. cerevisiae
aaggaacacgttggcgttgctgtca

SEQ ID NO: 18746 - DNA, 25 bp, S. cerevisiae
aaggaaactccttcgttcgatgcgt

SEQ ID NO: 18747 - DNA, 25 bp, S. cerevisiae
aaggcaaactgcaaacgatgtcgaa

SEQ ID NO: 18748 - DNA, 25 bp, S. cerevisiae
aaggacttctcttcaaagccaaatg

SEQ ID NO: 18749 - DNA, 25 bp, S. cerevisiae
aatggagttcttcatggacctaagc

SEQ ID NO: 18750 - DNA, 25 bp, S. cerevisiae
aatgggcccttgagcgacgataatt

SEQ ID NO: 18751 - DNA, 25 bp, S. cerevisiae
aaggcttcctttctatctttgtata

SEQ ID NO: 18752 - DNA, 25 bp, S. cerevisiae
aaggctccatctttgtttggtggta

SEQ ID NO: 18753 - DNA, 25 bp, S. cerevisiae
aaggctacacttttgttgaggttat

SEQ ID NO: 18754 - DNA, 25 bp, S. cerevisiae
aaggccaacgcaattgaccacgttt

SEQ ID NO: 18755 - DNA, 25 bp, S. cerevisiae
aaggccgacagcattgacaatcttg

SEQ ID NO: 18756 - DNA, 25 bp, S. cerevisiae
aatggtgtcactggcaaactctcta

SEQ ID NO: 18757 - DNA, 25 bp, S. cerevisiae
aaggatgtcactattgtcggctctg

SEQ ID NO: 18758 - DNA, 25 bp, S. cerevisiae
aaggagcccaccattggtgcagcat

SEQ ID NO: 18759 - DNA, 25 bp, S. cerevisiae
aaggaggctccgacgatgacgaatt

SEQ ID NO: 18760 - DNA, 25 bp, S. cerevisiae
aaggaggtgccggagctgatcaaaa

SEQ ID NO: 18761 - DNA, 25 bp, S. cerevisiae
aaggaagctcaagccgatgctgctg

SEQ ID NO: 18762 - DNA, 25 bp, S. cerevisiae
aaggacaggccagcccttgatgggc

SEQ ID NO: 18763 - DNA, 25 bp, S. cerevisiae
aaggccaggatcatcctcttgaggc

SEQ ID NO: 18764 - DNA, 25 bp, S. cerevisiae
aaggccgcctagtcctcaagaggaa

SEQ ID NO: 18765 - DNA, 25 bp, S. cerevisiae
aaggcactttcaggcccgagaggat

SEQ ID NO: 18766 - DNA, 25 bp, S. cerevisiae
aaggagctattcgacacccacagag

SEQ ID NO: 18767 - DNA, 25 bp, S. cerevisiae
aaggcagtttccgaattacttgtga

SEQ ID NO: 18768 - DNA, 25 bp, S. cerevisiae
aaggcgttcttccaattacagtctc

SEQ ID NO: 18769 - DNA, 25 bp, S. cerevisiae
aaggcggtatttgctactgtcaata

SEQ ID NO: 18770 - DNA, 25 bp, S. cerevisiae
aaggcatagggagtatcatctagaa

SEQ ID NO: 18771 - DNA, 25 bp, S. cerevisiae
aaggatgatgccgttagccaagaaa

SEQ ID NO: 18772 - DNA, 25 bp, S. cerevisiae
aaggacacgatggtgatccaggaaa

SEQ ID NO: 18773 - DNA, 25 bp, S. cerevisiae
aaggactgcggaactacaagctgaa

SEQ ID NO: 18774 - DNA, 25 bp, S. cerevisiae
caaggactgggctctatcatagggt

SEQ ID NO: 18775 - DNA, 25 bp, S. cerevisiae
aaggacgctgtcactaagaaggctg

SEQ ID NO: 18776 - DNA, 25 bp, S. cerevisiae
aaggacatgttctactcggcaagac

SEQ ID NO: 18777 - DNA, 25 bp, S. cerevisiae
aaggccatcaacaaccagtctacgt

SEQ ID NO: 18778 - DNA, 25 bp, S. cerevisiae
aaggctactccaagcgctgaagaaa

SEQ ID NO: 18779 - DNA, 25 bp, S. cerevisiae
aaggctctgcagcatatctgtttgc

SEQ ID NO: 18780 - DNA, 25 bp, S. cerevisiae
aaggagtctcgtggtgctcatgcga

SEQ ID NO: 18781 - DNA, 25 bp, S. cerevisiae
aaggctggaccttatgggatcctag

SEQ ID NO: 18782 - DNA, 25 bp, S. cerevisiae
aaggcttacacatcttcagctcaag

SEQ ID NO: 18783 - DNA, 25 bp, S. cerevisiae
aaggctgatggaagcgttcgctaaa

SEQ ID NO: 18784 - DNA, 25 bp, S. cerevisiae
aaggcagaacaggtcgatactcaac

SEQ ID NO: 18785 - DNA, 25 bp, S. cerevisiae
aatggatgaaagctcgtactcgcat

SEQ ID NO: 18786 - DNA, 25 bp, S. cerevisiae
aaggcataacagctcacatagaagt

SEQ ID NO: 18787 - DNA, 25 bp, S. cerevisiae
aatgtcactgccatctctaaagtag

SEQ ID NO: 18788 - DNA, 25 bp, S. cerevisiae
aaggcctacaacctgcaagacttag

SEQ ID NO: 18789 - DNA, 25 bp, S. cerevisiae
aaggctgtacgagttaccacgcaag

SEQ ID NO: 18790 - DNA, 25 bp, S. cerevisiae
aaggcaaccactaatgacatcgctg

SEQ ID NO: 18791 - DNA, 25 bp, S. cerevisiae
aaggcaacacagaaaactcgatcgt

SEQ ID NO: 18792 - DNA, 25 bp, S. cerevisiae
aaggcatcactatccctaatgttgt

SEQ ID NO: 18793 - DNA, 25 bp, S. cerevisiae
aatgtatcttttccctaggcttgtt

SEQ ID NO: 18794 - DNA, 25 bp, S. cerevisiae
aatggtcttccattatcccgtttat

SEQ ID NO: 18795 - DNA, 25 bp, S. cerevisiae
aaggacattctcatcattgcacatg

SEQ ID NO: 18796 - DNA, 25 bp, S. cerevisiae
aaggacattgtcttatctgctagat

SEQ ID NO: 18797 - DNA, 25 bp, S. cerevisiae
aatggatttgctcaacctaatagga

SEQ ID NO: 18798 - DNA, 25 bp, S. cerevisiae
aatggatttcatcaagcctgtaata

SEQ ID NO: 18799 - DNA, 25 bp, S. cerevisiae
aaggaattcatgatgggcttcaaga

SEQ ID NO: 18800 - DNA, 25 bp, S. cerevisiae
aaggccaccaagatcttcacaggag

SEQ ID NO: 18801 - DNA, 25 bp, S. cerevisiae
aaggccactcaaggtttctctggtg

SEQ ID NO: 18802 - DNA, 25 bp, S. cerevisiae
aaggccactccgcatctttggagta

SEQ ID NO: 18803 - DNA, 25 bp, S. cerevisiae
aaggcagctcctcttctttggatga

SEQ ID NO: 18804 - DNA, 25 bp, S. cerevisiae
aaggctgctctttggtcgatatcgt

SEQ ID NO: 18805 - DNA, 25 bp, S. cerevisiae
aatggctctatcagggaagttttca

SEQ ID NO: 18806 - DNA, 25 bp, S. cerevisiae
aaggcttttcgagggcagacattca

SEQ ID NO: 18807 - DNA, 25 bp, S. cerevisiae
aaggcagtttcatcttcaggcttgt

SEQ ID NO: 18808 - DNA, 25 bp, S. cerevisiae
aatctcaattacttctttggctcag

SEQ ID NO: 18809 - DNA, 25 bp, S. cerevisiae
aatccaactacaggttctcacaact

SEQ ID NO: 18810 - DNA, 25 bp, S. cerevisiae
aatgcgatcgaattggaactaggac

SEQ ID NO: 18811 - DNA, 25 bp, S. cerevisiae
aatggctcctagtcgtaatggtcct

SEQ ID NO: 18812 - DNA, 25 bp, S. cerevisiae
aaggccctgcagtgaaagcgcatct

SEQ ID NO: 18813 - DNA, 25 bp, S. cerevisiae
aaggcgcaacttcaaagcatcattg

SEQ ID NO: 18814 - DNA, 25 bp, S. cerevisiae
aaggcgattcttccaactctaagag

SEQ ID NO: 18815 - DNA, 25 bp, S. cerevisiae
aaggcgaatcgatcagtccaacaac

SEQ ID NO: 18816 - DNA, 25 bp, S. cerevisiae
aaggccaggcgatgattccacgcaa

SEQ ID NO: 18817 - DNA, 25 bp, S. cerevisiae
aaggacggcgaagtcatcgctaata

SEQ ID NO: 18818 - DNA, 25 bp, S. cerevisiae
aatggctcaggctaacttcagcgac

SEQ ID NO: 18819 - DNA, 25 bp, S. cerevisiae
aaggctgcaagcttgtctttgaaga

SEQ ID NO: 18820 - DNA, 25 bp, S. cerevisiae
aatcgacgccttgcaattgactgac

SEQ ID NO: 18821 - DNA, 25 bp, S. cerevisiae
aatgtacgcaagcttatctgaatac

SEQ ID NO: 18822 - DNA, 25 bp, S. cerevisiae
aaggcatcaacatcaccctaatgac

SEQ ID NO: 18823 - DNA, 25 bp, S. cerevisiae
aatggaatgtacgtcgccttctttc

SEQ ID NO: 18824 - DNA, 25 bp, S. cerevisiae
aatggaagttctggtctctagttca

SEQ ID NO: 18825 - DNA, 25 bp, S. cerevisiae
aaggaaatttcttgctctagagcta

SEQ ID NO: 18826 - DNA, 25 bp, S. cerevisiae
aaggaaactttcattgccgctgcaa

SEQ ID NO: 18827 - DNA, 25 bp, S. cerevisiae
aaggcggcgataaagcttcctctga

SEQ ID NO: 18828 - DNA, 25 bp, S. cerevisiae
aaggcgcataaagacattactgtgt

SEQ ID NO: 18829 - DNA, 25 bp, S. cerevisiae
aaggcatgatgcagatttcccacct

SEQ ID NO: 18830 - DNA, 25 bp, S. cerevisiae
aatggcgaagtttggtccgtgtctt

SEQ ID NO: 18831 - DNA, 25 bp, S. cerevisiae
aatgttgaattgtttcccgtcgccg

SEQ ID NO: 18832 - DNA, 25 bp, S. cerevisiae
aatggcttatcacagttaatcccca

SEQ ID NO: 18833 - DNA, 25 bp, S. cerevisiae
aaggctttccaactctaacagggat

SEQ ID NO: 18834 - DNA, 25 bp, S. cerevisiae
aatggttttaatctatccagggacg

SEQ ID NO: 18835 - DNA, 25 bp, S. cerevisiae
aaggctcttctccattaaactctaa

SEQ ID NO: 18836 - DNA, 25 bp, S. cerevisiae
aatggcgtttccgtaaagacgatca

SEQ ID NO: 18837 - DNA, 25 bp, S. cerevisiae
aatggcttttccctaataacgctgt

SEQ ID NO: 18838 - DNA, 25 bp, S. cerevisiae
aatgaattttttgactaacgagcta

SEQ ID NO: 18839 - DNA, 25 bp, S. cerevisiae
aatgaaggcttggtccctcgaggac

SEQ ID NO: 18840 - DNA, 25 bp, S. cerevisiae
aaggaagttactgctgctctagaaa

SEQ ID NO: 18841 - DNA, 25 bp, S. cerevisiae
aatgtgagcctacttacggacccga

SEQ ID NO: 18842 - DNA, 25 bp, S. cerevisiae
aatgatgagaccatcaccggccatg

SEQ ID NO: 18843 - DNA, 25 bp, S. cerevisiae
aaggcttccttctacacggttgaat

SEQ ID NO: 18844 - DNA, 25 bp, S. cerevisiae
aatgggtgactttccgaagttccag

SEQ ID NO: 18845 - DNA, 25 bp, S. cerevisiae
aatgaagtacctgccgacgtagacg

SEQ ID NO: 18846 - DNA, 25 bp, S. cerevisiae
aatggagtcacagtacgaacagtac

SEQ ID NO: 18847 - DNA, 25 bp, S. cerevisiae
aatgtatgtacagacactccctacc

SEQ ID NO: 18848 - DNA, 25 bp, S. cerevisiae
aaggaattcgaatgctagcgtcaac

SEQ ID NO: 18849 - DNA, 25 bp, S. cerevisiae
aaggcacttctaagagttgcgccaa

SEQ ID NO: 18850 - DNA, 25 bp, S. cerevisiae
aaggcatcggtatgtcttcaaagat

SEQ ID NO: 18851 - DNA, 25 bp, S. cerevisiae
aaggcactggccatgttgaagaaat

SEQ ID NO: 18852 - DNA, 25 bp, S. cerevisiae
aaggcctcctcttctgcagaaaaat

SEQ ID NO: 18853 - DNA, 25 bp, S. cerevisiae
aatggccacgctattgcaaaaaaga

SEQ ID NO: 18854 - DNA, 25 bp, S. cerevisiae
aatcgacgagacctaccgtgaatga

SEQ ID NO: 18855 - DNA, 25 bp, S. cerevisiae
aatggacgagaatacagctgctact

SEQ ID NO: 18856 - DNA, 25 bp, S. cerevisiae
aatgatccagaaaccgagaccgcag

SEQ ID NO: 18857 - DNA, 25 bp, S. cerevisiae
aatggcgaatctggctccgaaacta

SEQ ID NO: 18858 - DNA, 25 bp, S. cerevisiae
aatgacaaacttccactgccaagta

SEQ ID NO: 18859 - DNA, 25 bp, S. cerevisiae
aaggctctgctcaagctgttaacaa

SEQ ID NO: 18860 - DNA, 25 bp, S. cerevisiae
aaggcagacaccttttgcatcaggt

SEQ ID NO: 18861 - DNA, 25 bp, S. cerevisiae
aatgggctgatggaactaccgaaac

SEQ ID NO: 18862 - DNA, 25 bp, S. cerevisiae
aatgggctttctgtaccgagatcct

SEQ ID NO: 18863 - DNA, 25 bp, S. cerevisiae
aatgacgtcttcaccaatggaatct

SEQ ID NO: 18864 - DNA, 25 bp, S. cerevisiae
aaggctgacttgagaccattgcaaa

SEQ ID NO: 18865 - DNA, 25 bp, S. cerevisiae
aaggcagccgctttggtatatccag

SEQ ID NO: 18866 - DNA, 25 bp, S. cerevisiae
aaggcgccgaaatgtattgaatgtc

SEQ ID NO: 18867 - DNA, 25 bp, S. cerevisiae
aaggccatgtggtcattgttatatg

SEQ ID NO: 18868 - DNA, 25 bp, S. cerevisiae
aaggcaatctggtgcatcggtcaat

SEQ ID NO: 18869 - DNA, 25 bp, S. cerevisiae
aaggcagctttactctttgattggc

SEQ ID NO: 18870 - DNA, 25 bp, S. cerevisiae
aatggaccccatattttatttcaga

SEQ ID NO: 18871 - DNA, 25 bp, S. cerevisiae
aatggtcctcgtatttcaagttcta

SEQ ID NO: 18872 - DNA, 25 bp, S. cerevisiae
aatgggttccttcttcacaggtaga

SEQ ID NO: 18873 - DNA, 25 bp, S. cerevisiae
aatggccttgaccactggtaaagaa

SEQ ID NO: 18874 - DNA, 25 bp, S. cerevisiae
aatgtcctaaatgtggcgtacgata

SEQ ID NO: 18875 - DNA, 25 bp, S. cerevisiae
aatggcgtaattgcgctgggacaat

SEQ ID NO: 18876 - DNA, 25 bp, S. cerevisiae
aatgagatctacttttgggttcaga

SEQ ID NO: 18877 - DNA, 25 bp, S. cerevisiae
aaggcagctccaattcttgtgttcg

SEQ ID NO: 18878 - DNA, 25 bp, S. cerevisiae
aaggcatcccacatgcacatgtatg

SEQ ID NO: 18879 - DNA, 25 bp, S. cerevisiae
aaggctgacatcgtatggtgcatca

SEQ ID NO: 18880 - DNA, 25 bp, S. cerevisiae
aaggctattgcactgctgcggagac

SEQ ID NO: 18881 - DNA, 25 bp, S. cerevisiae
aaggctattcacctatcacaatccg

SEQ ID NO: 18882 - DNA, 25 bp, S. cerevisiae
aaggctcttgaaggtgccaacctgg

SEQ ID NO: 18883 - DNA, 25 bp, S. cerevisiae
aaggcctccaagtcgatacactata

SEQ ID NO: 18884 - DNA, 25 bp, S. cerevisiae
aaggctgcctaatttgtcaacatta

SEQ ID NO: 18885 - DNA, 25 bp, S. cerevisiae
caagacgcatccaactgtacactga

SEQ ID NO: 18886 - DNA, 25 bp, S. cerevisiae
aatggccgactgatgtttagctcaa

SEQ ID NO: 18887 - DNA, 25 bp, S. cerevisiae
aatggccagcaaggtgtgtttcctg

SEQ ID NO: 18888 - DNA, 25 bp, S. cerevisiae
aaggcccatagtatcgcttccgata

SEQ ID NO: 18889 - DNA, 25 bp, S. cerevisiae
aatggtatagtcacctggttcgaca

SEQ ID NO: 18890 - DNA, 25 bp, S. cerevisiae
aatggttgagcaagtccggttcttc

SEQ ID NO: 18891 - DNA, 25 bp, S. cerevisiae
aaggcattaatgctggtgaaatcga

SEQ ID NO: 18892 - DNA, 25 bp, S. cerevisiae
aaggccagagattgcttaacaacga

SEQ ID NO: 18893 - DNA, 25 bp, S. cerevisiae
aaggctcggttgttcagccaacgat

SEQ ID NO: 18894 - DNA, 25 bp, S. cerevisiae
aaggccatggttcatcctcaagctt

SEQ ID NO: 18895 - DNA, 25 bp, S. cerevisiae
aatgacctggttaattcacgaatgg

SEQ ID NO: 18896 - DNA, 25 bp, S. cerevisiae
aaggccatagcaaagtcgattccaa

SEQ ID NO: 18897 - DNA, 25 bp, S. cerevisiae
aaggcttatgtgattcgttctcaac

SEQ ID NO: 18898 - DNA, 25 bp, S. cerevisiae
aaggcttctagtgcaatttccacat

SEQ ID NO: 18899 - DNA, 25 bp, S. cerevisiae
aatgagttcttgacctacttcgcca

SEQ ID NO: 18900 - DNA, 25 bp, S. cerevisiae
aaggctttgttcgtgactaccgcta

SEQ ID NO: 18901 - DNA, 25 bp, S. cerevisiae
aaggctactttatctgcttcaggtc

SEQ ID NO: 18902 - DNA, 25 bp, S. cerevisiae
aaggctcttgggtcatctctagaga

SEQ ID NO: 18903 - DNA, 25 bp, S. cerevisiae
aatggctcttcatctatcaccaatg

SEQ ID NO: 18904 - DNA, 25 bp, S. cerevisiae
aaggcctccaccaatgccaatatat

SEQ ID NO: 18905 - DNA, 25 bp, S. cerevisiae
aaggctcatcttttggaagacgcac

SEQ ID NO: 18906 - DNA, 25 bp, S. cerevisiae
aaggcttcgcatgttgattgaccaa

SEQ ID NO: 18907 - DNA, 25 bp, S. cerevisiae
aaggcattcgtggatttctgattag

SEQ ID NO: 18908 - DNA, 25 bp, S. cerevisiae
aaggctcgctgggtatatctgatat

SEQ ID NO: 18909 - DNA, 25 bp, S. cerevisiae
aaggctctgcttttggtggcatcaa

SEQ ID NO: 18910 - DNA, 25 bp, S. cerevisiae
aatggctgccttatttaattttgtc

SEQ ID NO: 18911 - DNA, 25 bp, S. cerevisiae
aaggccatttatttgttctatttgt

SEQ ID NO: 18912 - DNA, 25 bp, S. cerevisiae
aaggctctagtcaaagctgctgtat

SEQ ID NO: 18913 - DNA, 25 bp, S. cerevisiae
aaggctctatccaaagatggtatct

SEQ ID NO: 18914 - DNA, 25 bp, S. cerevisiae
aatggtcatcagtgggctcatgtcc

SEQ ID NO: 18915 - DNA, 25 bp, S. cerevisiae
aaggccactttgattctagcgtcat

SEQ ID NO: 18916 - DNA, 25 bp, S. cerevisiae
aaggcctatgggacgctttgcgtga

SEQ ID NO: 18917 - DNA, 25 bp, S. cerevisiae
aaggccacggatcctgtctttatga

SEQ ID NO: 18918 - DNA, 25 bp, S. cerevisiae
aaggccaatgaatatcccaaggaac

SEQ ID NO: 18919 - DNA, 25 bp, S. cerevisiae
aaggcgacataatacaccatcttaa

SEQ ID NO: 18920 - DNA, 25 bp, S. cerevisiae
aatggcaccaaaccaagttctatgg

SEQ ID NO: 18921 - DNA, 25 bp, S. cerevisiae
aaggctacgccttcatagttttcaa

SEQ ID NO: 18922 - DNA, 25 bp, S. cerevisiae
aatggtatccccttagtcgttgaat

SEQ ID NO: 18923 - DNA, 25 bp, S. cerevisiae
aatggattcagagtcgactcccttg

SEQ ID NO: 18924 - DNA, 25 bp, S. cerevisiae
aaggccattccagttatgacgtcat

SEQ ID NO: 18925 - DNA, 25 bp, S. cerevisiae
aaggctcctaatcctttgagcgtaa

SEQ ID NO: 18926 - DNA, 25 bp, S. cerevisiae
aaggctcttatggtctgctatgcac

SEQ ID NO: 18927 - DNA, 25 bp, S. cerevisiae
aaggcggtattgaatgctgtcataa

SEQ ID NO: 18928 - DNA, 25 bp, S. cerevisiae
aatgagcggagtatcctacgcatta

SEQ ID NO: 18929 - DNA, 25 bp, S. cerevisiae
aatgacggaggtgccaagcctttga

SEQ ID NO: 18930 - DNA, 25 bp, S. cerevisiae
aaggctgtttattccaatgttctat

SEQ ID NO: 18931 - DNA, 25 bp, S. cerevisiae
aatggtgcgtgggacacctgccaga

SEQ ID NO: 18932 - DNA, 25 bp, S. cerevisiae
aatgtgggctgtcgagatccgcaac

SEQ ID NO: 18933 - DNA, 25 bp, S. cerevisiae
aatgctaacggaagccacggcgaac

SEQ ID NO: 18934 - DNA, 25 bp, S. cerevisiae
aatggcgacgaaactcctcggaaca

SEQ ID NO: 18935 - DNA, 25 bp, S. cerevisiae
aatgggagggcaagctctctcaaga

SEQ ID NO: 18936 - DNA, 25 bp, S. cerevisiae
aatggcctggtctcctcataaacga

SEQ ID NO: 18937 - DNA, 25 bp, S. cerevisiae
aaggcctcatcattccctaaatagg

SEQ ID NO: 18938 - DNA, 25 bp, S. cerevisiae
aaggctgcatcttcttccgaagcta

SEQ ID NO: 18939 - DNA, 25 bp, S. cerevisiae
aatggtgctcaaaagcctacttgaa

SEQ ID NO: 18940 - DNA, 25 bp, S. cerevisiae
aatgtggccaaatcctacgctgtga

SEQ ID NO: 18941 - DNA, 25 bp, S. cerevisiae
aatgttggccactcttctaataaat

SEQ ID NO: 18942 - DNA, 25 bp, S. cerevisiae
aatttcgccactgtagatgaagaag

SEQ ID NO: 18943 - DNA, 25 bp, S. cerevisiae
aatgatttgcccagtactatggaag

SEQ ID NO: 18944 - DNA, 25 bp, S. cerevisiae
aatgatcatcgagctggtaactgga

SEQ ID NO: 18945 - DNA, 25 bp, S. cerevisiae
aatgtcatgggcgtagtcgactcca

SEQ ID NO: 18946 - DNA, 25 bp, S. cerevisiae
aatactctaaattcggacttggaag

SEQ ID NO: 18947 - DNA, 25 bp, S. cerevisiae
aatgaccaaagtacgcggtggccta

SEQ ID NO: 18948 - DNA, 25 bp, S. cerevisiae
aatgttcaaggcttaggcgttccat

SEQ ID NO: 18949 - DNA, 25 bp, S. cerevisiae
aatgttacggaaaggccgcctcatt

SEQ ID NO: 18950 - DNA, 25 bp, S. cerevisiae
aaggctgtccaatacttgcacgaaa

SEQ ID NO: 18951 - DNA, 25 bp, S. cerevisiae
aaggctgctcaaaaggctgctaaga

SEQ ID NO: 18952 - DNA, 25 bp, S. cerevisiae
aatggctgacagtgcgggcttaatg

SEQ ID NO: 18953 - DNA, 25 bp, S. cerevisiae
aatggctgcacggaggaattaatag

SEQ ID NO: 18954 - DNA, 25 bp, S. cerevisiae
aatcctgagggagagctcgaatggt

SEQ ID NO: 18955 - DNA, 25 bp, S. cerevisiae
aatccgaagattgacttgaacttga

SEQ ID NO: 18956 - DNA, 25 bp, S. cerevisiae
gaaggacacctctccggatttgtaa

SEQ ID NO: 18957 - DNA, 25 bp, S. cerevisiae
aatgtgtccggatcgcattggtgca

SEQ ID NO: 18958 - DNA, 25 bp, S. cerevisiae
aatgtgtactcgcagactttgaccc

SEQ ID NO: 18959 - DNA, 25 bp, S. cerevisiae
aatgtgagcgcccaagattctgata

SEQ ID NO: 18960 - DNA, 25 bp, S. cerevisiae
aatgcgcagcctgaattcacgctaa

SEQ ID NO: 18961 - DNA, 25 bp, S. cerevisiae
aatggacattgatgccgctctagaa

SEQ ID NO: 18962 - DNA, 25 bp, S. cerevisiae
aaggcgcaacttcgattctactgtg

SEQ ID NO: 18963 - DNA, 25 bp, S. cerevisiae
aaggccaagatttgtctctcggtac

SEQ ID NO: 18964 - DNA, 25 bp, S. cerevisiae
aatggccagcactactttttgaaat

SEQ ID NO: 18965 - DNA, 25 bp, S. cerevisiae
aatggccgccaagtaagatctaatg

SEQ ID NO: 18966 - DNA, 25 bp, S. cerevisiae
aatggcgacgaacaagatgctatct

SEQ ID NO: 18967 - DNA, 25 bp, S. cerevisiae
aatggcgacgcacgctatgcaacta

SEQ ID NO: 18968 - DNA, 25 bp, S. cerevisiae
aaggccgctagaatggacccagatg

SEQ ID NO: 18969 - DNA, 25 bp, S. cerevisiae
aatggaggcgatcctgcgaactttt

SEQ ID NO: 18970 - DNA, 25 bp, S. cerevisiae
aatggcccagaaatctaagcttgag

SEQ ID NO: 18971 - DNA, 25 bp, S. cerevisiae
aatggctggcattggagtctgaaat

SEQ ID NO: 18972 - DNA, 25 bp, S. cerevisiae
aatggtgcagcagtcctgtcagaac

SEQ ID NO: 18973 - DNA, 25 bp, S. cerevisiae
aatggcttgctgacggcacgatgac

SEQ ID NO: 18974 - DNA, 25 bp, S. cerevisiae
aatggctttacgtcactcatgatcg

SEQ ID NO: 18975 - DNA, 25 bp, S. cerevisiae
aaggcgacatgacttttatgacgaa

SEQ ID NO: 18976 - DNA, 25 bp, S. cerevisiae
aaggccgaatttactcatgacgaaa

SEQ ID NO: 18977 - DNA, 25 bp, S. cerevisiae
aaggcgctcttgattcactactgaa

SEQ ID NO: 18978 - DNA, 25 bp, S. cerevisiae
aaggcggtatcattgcatccgttgg

SEQ ID NO: 18979 - DNA, 25 bp, S. cerevisiae
aaggcctagataagttctttgctga

SEQ ID NO: 18980 - DNA, 25 bp, S. cerevisiae
aaggcgcccgtttatgcagatgcta

SEQ ID NO: 18981 - DNA, 25 bp, S. cerevisiae
aaggccgctggtaagttgatgcaaa

SEQ ID NO: 18982 - DNA, 25 bp, S. cerevisiae
aatggctccgtaatcgttgacttgt

SEQ ID NO: 18983 - DNA, 25 bp, S. cerevisiae
aatgaccctttattgatatacctgt

SEQ ID NO: 18984 - DNA, 25 bp, S. cerevisiae
aatgtatcaccatttacctacgtgg

SEQ ID NO: 18985 - DNA, 25 bp, S. cerevisiae
aatgtctgcgcagatttccttcgat

SEQ ID NO: 18986 - DNA, 25 bp, S. cerevisiae
aatggctcaagcagtctcaaaggca

SEQ ID NO: 18987 - DNA, 25 bp, S. cerevisiae
aatggccatgagatcatcggtaaca

SEQ ID NO: 18988 - DNA, 25 bp, S. cerevisiae
aatgtctgccgcatgtgcggtttta

SEQ ID NO: 18989 - DNA, 25 bp, S. cerevisiae
aatgtggccatcataggtgctcatg

SEQ ID NO: 18990 - DNA, 25 bp, S. cerevisiae
aatgatggccatcgctacggtcact

SEQ ID NO: 18991 - DNA, 25 bp, S. cerevisiae
aatcgtcaatcgtaccgacttcaac

SEQ ID NO: 18992 - DNA, 25 bp, S. cerevisiae
aatctttacgatcccaacttgacac

SEQ ID NO: 18993 - DNA, 25 bp, S. cerevisiae
aatgtttacgattccaaatacgacg

SEQ ID NO: 18994 - DNA, 25 bp, S. cerevisiae
aatgatttatcacatgccgaaactg

SEQ ID NO: 18995 - DNA, 25 bp, S. cerevisiae
aatgatccaagaaatcccagattcg

SEQ ID NO: 18996 - DNA, 25 bp, S. cerevisiae
aatgctcacatattggtcgaaattg

SEQ ID NO: 18997 - DNA, 25 bp, S. cerevisiae
aatgaagctactccagaagctgaac

SEQ ID NO: 18998 - DNA, 25 bp, S. cerevisiae
aatgaaaatctagggcgcgcagtcc

SEQ ID NO: 18999 - DNA, 25 bp, S. cerevisiae
aatggcagctccaggtgcggacgac

SEQ ID NO: 19000 - DNA, 25 bp, S. cerevisiae
aatgtggtccatattgcgcaagtta

SEQ ID NO: 19001 - DNA, 25 bp, S. cerevisiae
aatgtggaccatgcaggcgatgaga

SEQ ID NO: 19002 - DNA, 25 bp, S. cerevisiae
aatggcgcagtctcgagcgatcaaa

SEQ ID NO: 19003 - DNA, 25 bp, S. cerevisiae
aaggccaatatgttgacgtcagatc

SEQ ID NO: 19004 - DNA, 25 bp, S. cerevisiae
aaggccatcttgttggaagacatca

SEQ ID NO: 19005 - DNA, 25 bp, S. cerevisiae
caagtcaaaccggagtctgcaagtg

SEQ ID NO: 19006 - DNA, 25 bp, S. cerevisiae
aatgtcaaagccgaagtccctctgt

SEQ ID NO: 19007 - DNA, 25 bp, S. cerevisiae
aatgtgaccccaaagatagcctctg

SEQ ID NO: 19008 - DNA, 25 bp, S. cerevisiae
aatggcgcccagttggattctctga

SEQ ID NO: 19009 - DNA, 25 bp, S. cerevisiae
aatgtcttgactgcctttgtttgta

SEQ ID NO: 19010 - DNA, 25 bp, S. cerevisiae
aatgtttatcgctttcactttcagt

SEQ ID NO: 19011 - DNA, 25 bp, S. cerevisiae
aattgtggacctcatagcggttcct

SEQ ID NO: 19012 - DNA, 25 bp, S. cerevisiae
aatgtttgcgcccttacgtttcact

SEQ ID NO: 19013 - DNA, 25 bp, S. cerevisiae
aatggagtccgactttgtttccgtg

SEQ ID NO: 19014 - DNA, 25 bp, S. cerevisiae
aatgactgtagtacccgcaataata

SEQ ID NO: 19015 - DNA, 25 bp, S. cerevisiae
aatgactgtactacccgcaaccata

SEQ ID NO: 19016 - DNA, 25 bp, S. cerevisiae
aatgcaaagatttcccgtaggcgct

SEQ ID NO: 19017 - DNA, 25 bp, S. cerevisiae
aatggcgaattagacctcagcggct

SEQ ID NO: 19018 - DNA, 25 bp, S. cerevisiae
aatcgcgaacgatacctcaaggagc

SEQ ID NO: 19019 - DNA, 25 bp, S. cerevisiae
aatggtatcggattcaacaagggaa

SEQ ID NO: 19020 - DNA, 25 bp, S. cerevisiae
aatggctacttctacgatcacgatg

SEQ ID NO: 19021 - DNA, 25 bp, S. cerevisiae
aatgggattgtttgccttaggtaca

SEQ ID NO: 19022 - DNA, 25 bp, S. cerevisiae
aatgccgattgtctattatacttac

SEQ ID NO: 19023 - DNA, 25 bp, S. cerevisiae
aatgtacactgtcgctttatccgct

SEQ ID NO: 19024 - DNA, 25 bp, S. cerevisiae
aatgaactttccgattacgcctcag

SEQ ID NO: 19025 - DNA, 25 bp, S. cerevisiae
aataacggcacgtcaaaggctgcaa

SEQ ID NO: 19026 - DNA, 25 bp, S. cerevisiae
aataatccgccgcaaatggtaccaa

SEQ ID NO: 19027 - DNA, 25 bp, S. cerevisiae
aatcccaggtgccaaacaggttgaa

SEQ ID NO: 19028 - DNA, 25 bp, S. cerevisiae
aatgatgacgtaccgcaagaggagt

SEQ ID NO: 19029 - DNA, 25 bp, S. cerevisiae
aatgatgacgctagccatcggctga

SEQ ID NO: 19030 - DNA, 25 bp, S. cerevisiae
gaagaatcgggcacgaccagtttgc

SEQ ID NO: 19031 - DNA, 25 bp, S. cerevisiae
aatggataggccacgcaggaaatct

SEQ ID NO: 19032 - DNA, 25 bp, S. cerevisiae
aatgctggagtcaccgaagaaaccg

SEQ ID NO: 19033 - DNA, 25 bp, S. cerevisiae
aatgggcaatcttccgttaaacacg

SEQ ID NO: 19034 - DNA, 25 bp, S. cerevisiae
aatggcgaactctctcagtcaatag

SEQ ID NO: 19035 - DNA, 25 bp, S. cerevisiae
aatggtcaagactcccgcataagat

SEQ ID NO: 19036 - DNA, 25 bp, S. cerevisiae
aatggttcgcaatctgacacatcag

SEQ ID NO: 19037 - DNA, 25 bp, S. cerevisiae
aatggatttgcaactggacccgttt

SEQ ID NO: 19038 - DNA, 25 bp, S. cerevisiae
aatggccttgcgtctgtctatggaa

SEQ ID NO: 19039 - DNA, 25 bp, S. cerevisiae
aatgcggcaatcgtattcttttgga

SEQ ID NO: 19040 - DNA, 25 bp, S. cerevisiae
aatgatggcaacgatattccggtag

SEQ ID NO: 19041 - DNA, 25 bp, S. cerevisiae
aatgtcattgggttcttccttgcgg

SEQ ID NO: 19042 - DNA, 25 bp, S. cerevisiae
aatgtcgtcgtagctgaaacctcac

SEQ ID NO: 19043 - DNA, 25 bp, S. cerevisiae
aatatttcggcagttgacaatacaa

SEQ ID NO: 19044 - DNA, 25 bp, S. cerevisiae
aatggttcgtgatttgaagcctcaa

SEQ ID NO: 19045 - DNA, 25 bp, S. cerevisiae
aatgggtctcattcctaacgctaag

SEQ ID NO: 19046 - DNA, 25 bp, S. cerevisiae
aatggagactagtgctgaccgggat

SEQ ID NO: 19047 - DNA, 25 bp, S. cerevisiae
aatggtcaccgtcgaagaggccgat

SEQ ID NO: 19048 - DNA, 25 bp, S. cerevisiae
aatggataccagtcgccaatgaccc

SEQ ID NO: 19049 - DNA, 25 bp, S. cerevisiae
aatggtgaccgtagcgatgattcct

SEQ ID NO: 19050 - DNA, 25 bp, S. cerevisiae
aatgattcttccactttcaagttga

SEQ ID NO: 19051 - DNA, 25 bp, S. cerevisiae
aatggtggctacttcggtgttatct

SEQ ID NO: 19052 - DNA, 25 bp, S. cerevisiae
aatgtacctagctccactggtgaag

SEQ ID NO: 19053 - DNA, 25 bp, S. cerevisiae
aatgaacctaaacctgtgactggag

SEQ ID NO: 19054 - DNA, 25 bp, S. cerevisiae
aatggtctgcacaagttcgttaagg

SEQ ID NO: 19055 - DNA, 25 bp, S. cerevisiae
aatggccattctcggtggtatcctt

SEQ ID NO: 19056 - DNA, 25 bp, S. cerevisiae
aatgttttgggaatgggacctgctt

SEQ ID NO: 19057 - DNA, 25 bp, S. cerevisiae
aatgctaaaagagttgccccaccac

SEQ ID NO: 19058 - DNA, 25 bp, S. cerevisiae
aatccaaagacgagagcgccaccag

SEQ ID NO: 19059 - DNA, 25 bp, S. cerevisiae
aatccaatagaaacggcggtctctt

SEQ ID NO: 19060 - DNA, 25 bp, S. cerevisiae
aatgaaggccattgtcccgttacca

SEQ ID NO: 19061 - DNA, 25 bp, S. cerevisiae
aatgggcgcaattctccggtaacta

SEQ ID NO: 19062 - DNA, 25 bp, S. cerevisiae
aatgggtcaaacctgcggtcagttt

SEQ ID NO: 19063 - DNA, 25 bp, S. cerevisiae
aatggaatgatcgtcaccgtgctcg

SEQ ID NO: 19064 - DNA, 25 bp, S. cerevisiae
aatggctatgtcgtcaaattggctg

SEQ ID NO: 19065 - DNA, 25 bp, S. cerevisiae
aatggcaatcccaaccacattagga

SEQ ID NO: 19066 - DNA, 25 bp, S. cerevisiae
aatggaaccaataccgctggccaga

SEQ ID NO: 19067 - DNA, 25 bp, S. cerevisiae
aatgacgcgcaatcacagttagagc

SEQ ID NO: 19068 - DNA, 25 bp, S. cerevisiae
aatgaagcagccaccaacgatgatg

SEQ ID NO: 19069 - DNA, 25 bp, S. cerevisiae
aatggtcctctctatcaaggcatac

SEQ ID NO: 19070 - DNA, 25 bp, S. cerevisiae
aatggatcccaccatctaggagaac

SEQ ID NO: 19071 - DNA, 25 bp, S. cerevisiae
aatggtttcttggagtcttcttgtt

SEQ ID NO: 19072 - DNA, 25 bp, S. cerevisiae
aatggtcacatttaggtcttcctga

SEQ ID NO: 19073 - DNA, 25 bp, S. cerevisiae
aatgttacttaaggtccatggcaga

SEQ ID NO: 19074 - DNA, 25 bp, S. cerevisiae
aatggaatactcaatccttctccga

SEQ ID NO: 19075 - DNA, 25 bp, S. cerevisiae
aatggtgcgctgttacgcgttacaa

SEQ ID NO: 19076 - DNA, 25 bp, S. cerevisiae
aatggcattttttcacatcccactg

SEQ ID NO: 19077 - DNA, 25 bp, S. cerevisiae
aatggcttggttttgagccttcaag

SEQ ID NO: 19078 - DNA, 25 bp, S. cerevisiae
aatggctcgttaattgccctgtcga

SEQ ID NO: 19079 - DNA, 25 bp, S. cerevisiae
aatgaggatgtctttcttgaagcag

SEQ ID NO: 19080 - DNA, 25 bp, S. cerevisiae
aatgtggtgcttggacttgcaatcc

SEQ ID NO: 19081 - DNA, 25 bp, S. cerevisiae
aatggcttgcaattgacatccgtca

SEQ ID NO: 19082 - DNA, 25 bp, S. cerevisiae
aatggctacatattcggcgcatccg

SEQ ID NO: 19083 - DNA, 25 bp, S. cerevisiae
aatggtggtaatggttctcgcgagc

SEQ ID NO: 19084 - DNA, 25 bp, S. cerevisiae
aatgaagtctcctaaataccccagc

SEQ ID NO: 19085 - DNA, 25 bp, S. cerevisiae
aatgaggcttcgtcgactaactccg

SEQ ID NO: 19086 - DNA, 25 bp, S. cerevisiae
aatggtctgattccatcatccacac

SEQ ID NO: 19087 - DNA, 25 bp, S. cerevisiae
aatggtagatatagccgcccatcct

SEQ ID NO: 19088 - DNA, 25 bp, S. cerevisiae
aatggatgcgaaatcacctccgctt

SEQ ID NO: 19089 - DNA, 25 bp, S. cerevisiae
aatggatgtggtaccatctccgggt

SEQ ID NO: 19090 - DNA, 25 bp, S. cerevisiae
aatgtgtgcatctgctctcaagcaa

SEQ ID NO: 19091 - DNA, 25 bp, S. cerevisiae
aatggagtcagcctcgcaactagca

SEQ ID NO: 19092 - DNA, 25 bp, S. cerevisiae
aatgttctatcatgagggcccgtgc

SEQ ID NO: 19093 - DNA, 25 bp, S. cerevisiae
aatgatcttttgtggtccgatccca

SEQ ID NO: 19094 - DNA, 25 bp, S. cerevisiae
aatgatctttttggcgattctaccc

SEQ ID NO: 19095 - DNA, 25 bp, S. cerevisiae
aatgtggactcttctgatttattag

SEQ ID NO: 19096 - DNA, 25 bp, S. cerevisiae
aatgggactgctttgttactccaaa

SEQ ID NO: 19097 - DNA, 25 bp, S. cerevisiae
aatggtagtgatcctgttactgtta

SEQ ID NO: 19098 - DNA, 25 bp, S. cerevisiae
aatggtagcctggtgttattctggt

SEQ ID NO: 19099 - DNA, 25 bp, S. cerevisiae
caatggtaggtcttttttatgtgat

SEQ ID NO: 19100 - DNA, 25 bp, S. cerevisiae
aatggtcaggacttatcgttactta

SEQ ID NO: 19101 - DNA, 25 bp, S. cerevisiae
aatgtttgccagtccaaaggccgaa

SEQ ID NO: 19102 - DNA, 25 bp, S. cerevisiae
aatgtcaggctctccaaataggcga

SEQ ID NO: 19103 - DNA, 25 bp, S. cerevisiae
aatggtgcccatgccaaaagcttat

SEQ ID NO: 19104 - DNA, 25 bp, S. cerevisiae
aatgaagtgtctgcgcaaggtttag

SEQ ID NO: 19105 - DNA, 25 bp, S. cerevisiae
aatggcacatcctaattctgctgca

SEQ ID NO: 19106 - DNA, 25 bp, S. cerevisiae
aatggaattgcgtcttattgaatca

SEQ ID NO: 19107 - DNA, 25 bp, S. cerevisiae
aatggagacccactgtacaactatt

SEQ ID NO: 19108 - DNA, 25 bp, S. cerevisiae
aatgggctcttttctcaaacacaaa

SEQ ID NO: 19109 - DNA, 25 bp, S. cerevisiae
gaatgggcctttgccggtacaaacg

SEQ ID NO: 19110 - DNA, 25 bp, S. cerevisiae
gaatgggccggtgcaggttctaaac

SEQ ID NO: 19111 - DNA, 25 bp, S. cerevisiae
aatggtattgctacgagcctcttgc

SEQ ID NO: 19112 - DNA, 25 bp, S. cerevisiae
aatgaactacggtccttctgtgtat

SEQ ID NO: 19113 - DNA, 25 bp, S. cerevisiae
aatgcggtaaggtcaccctaatcat

SEQ ID NO: 19114 - DNA, 25 bp, S. cerevisiae
aatgcagtccaaggaacgccctaat

SEQ ID NO: 19115 - DNA, 25 bp, S. cerevisiae
aatgattctggagtgacatcccctc

SEQ ID NO: 19116 - DNA, 25 bp, S. cerevisiae
aatgtgcctgtattggagctaccat

SEQ ID NO: 19117 - DNA, 25 bp, S. cerevisiae
aatgtcgctgactatgggttgcaag

SEQ ID NO: 19118 - DNA, 25 bp, S. cerevisiae
aatgacagcaattatggcgttacta

SEQ ID NO: 19119 - DNA, 25 bp, S. cerevisiae
aatcaagactcacaggcttcaataa

SEQ ID NO: 19120 - DNA, 25 bp, S. cerevisiae
aatgatagactgactttccctccat

SEQ ID NO: 19121 - DNA, 25 bp, S. cerevisiae
aatgaatggtgcctcttcacgccag

SEQ ID NO: 19122 - DNA, 25 bp, S. cerevisiae
aatgggcattgcttgtttcgcacag

SEQ ID NO: 19123 - DNA, 25 bp, S. cerevisiae
aatgggcttgattatgtccgcacgc

SEQ ID NO: 19124 - DNA, 25 bp, S. cerevisiae
aatgaacctcagatgtccgataagc

SEQ ID NO: 19125 - DNA, 25 bp, S. cerevisiae
aatgattccgaagtcactcgtgaag

SEQ ID NO: 19126 - DNA, 25 bp, S. cerevisiae
aatgtgatccatccatcaaggcgct

SEQ ID NO: 19127 - DNA, 25 bp, S. cerevisiae
aatgtatgggaagcttccatccaaa

SEQ ID NO: 19128 - DNA, 25 bp, S. cerevisiae
aatgcagttgtttcgcgcttactta

SEQ ID NO: 19129 - DNA, 25 bp, S. cerevisiae
aatgagattgttccgctgcatagtc

SEQ ID NO: 19130 - DNA, 25 bp, S. cerevisiae
aatggttgtgtctctgctggtcctc

SEQ ID NO: 19131 - DNA, 25 bp, S. cerevisiae
aatgggcatggcatttgttatccaa

SEQ ID NO: 19132 - DNA, 25 bp, S. cerevisiae
aatggtgaagttgtctctgtgccag

SEQ ID NO: 19133 - DNA, 25 bp, S. cerevisiae
aatggtgaacctttccatgtgtcgt

SEQ ID NO: 19134 - DNA, 25 bp, S. cerevisiae
aatggtaacatcattccgcagctgc

SEQ ID NO: 19135 - DNA, 25 bp, S. cerevisiae
aatggatcaactcttcatcgcacat

SEQ ID NO: 19136 - DNA, 25 bp, S. cerevisiae
aatggatctcagttcttcatcacca

SEQ ID NO: 19137 - DNA, 25 bp, S. cerevisiae
aatgattctgtacatgtctccaaat

SEQ ID NO: 19138 - DNA, 25 bp, S. cerevisiae
aatgtgcagctagtaacgcctcaaa

SEQ ID NO: 19139 - DNA, 25 bp, S. cerevisiae
aatgtgctgtactgtcagcctcaga

SEQ ID NO: 19140 - DNA, 25 bp, S. cerevisiae
aatgtgatgttgagtccttccttgt

SEQ ID NO: 19141 - DNA, 25 bp, S. cerevisiae
aatgtcgattgcaagtgcctgtaac

SEQ ID NO: 19142 - DNA, 25 bp, S. cerevisiae
aatgatgacggttctgatttggata

SEQ ID NO: 19143 - DNA, 25 bp, S. cerevisiae
aatgacaaggattacgccgccgcag

SEQ ID NO: 19144 - DNA, 25 bp, S. cerevisiae
aatgaagtttactccgcctatgtgg

SEQ ID NO: 19145 - DNA, 25 bp, S. cerevisiae
aatgggattaacttccagctctaat

SEQ ID NO: 19146 - DNA, 25 bp, S. cerevisiae
aatgggattttccaccacatcttta

SEQ ID NO: 19147 - DNA, 25 bp, S. cerevisiae
aatgggttcgctaatgatgctgctc

SEQ ID NO: 19148 - DNA, 25 bp, S. cerevisiae
aatggttcttgtagacgctgctggc

SEQ ID NO: 19149 - DNA, 25 bp, S. cerevisiae
aatggttctttgatgcctgtgagcc

SEQ ID NO: 19150 - DNA, 25 bp, S. cerevisiae
aatgggctatgttcacgctttgacc

SEQ ID NO: 19151 - DNA, 25 bp, S. cerevisiae
aatggtgctgattatgccgtttaca

SEQ ID NO: 19152 - DNA, 25 bp, S. cerevisiae
aatgaactccttgcagaagctgaaa

SEQ ID NO: 19153 - DNA, 25 bp, S. cerevisiae
aatgctacccaagtcacagatctga

SEQ ID NO: 19154 - DNA, 25 bp, S. cerevisiae
aatggtccacagctatcaatctatt

SEQ ID NO: 19155 - DNA, 25 bp, S. cerevisiae
aatggtcacaagcattcgatccacc

SEQ ID NO: 19156 - DNA, 25 bp, S. cerevisiae
aatgtgccagcaaggactgcggtac

SEQ ID NO: 19157 - DNA, 25 bp, S. cerevisiae
aatgctccgatgcaacatgggtaca

SEQ ID NO: 19158 - DNA, 25 bp, S. cerevisiae
aatgttccttcagctagaggccttt

SEQ ID NO: 19159 - DNA, 25 bp, S. cerevisiae
aatgtgtcccgagttattattctaa

SEQ ID NO: 19160 - DNA, 25 bp, S. cerevisiae
aatgatgtccctgtcatcgttgttt

SEQ ID NO: 19161 - DNA, 25 bp, S. cerevisiae
aatggtattcgcagtcgttggtata

SEQ ID NO: 19162 - DNA, 25 bp, S. cerevisiae
aatggtgtgctttccttttatgatt

SEQ ID NO: 19163 - DNA, 25 bp, S. cerevisiae
aatgtcgtgtttgttcttcccacac

SEQ ID NO: 19164 - DNA, 25 bp, S. cerevisiae
aatgtcgtgtttgttcttcccacac

SEQ ID NO: 19165 - DNA, 25 bp, S. cerevisiae
aatgtcttttctggatacgtctttc

SEQ ID NO: 19166 - DNA, 25 bp, S. cerevisiae
aatgtgaaggcctaccatgctccat

SEQ ID NO: 19167 - DNA, 25 bp, S. cerevisiae
aatcgacaggcctgaagttgcaacg

SEQ ID NO: 19168 - DNA, 25 bp, S. cerevisiae
aatggtctggacttgatgagtagca

SEQ ID NO: 19169 - DNA, 25 bp, S. cerevisiae
aatggtgcgcgcattattggcggtt

SEQ ID NO: 19170 - DNA, 25 bp, S. cerevisiae
aatggtaccgctgttggtgctgtat

SEQ ID NO: 19171 - DNA, 25 bp, S. cerevisiae
aatggtgcattccttattcgttgtt

SEQ ID NO: 19172 - DNA, 25 bp, S. cerevisiae
caagttgctcaagctttcgttgaat

SEQ ID NO: 19173 - DNA, 25 bp, S. cerevisiae
aatgtcttcacaggtactttctaga

SEQ ID NO: 19174 - DNA, 25 bp, S. cerevisiae
aatgtcaacaagaaggccctaggcc

SEQ ID NO: 19175 - DNA, 25 bp, S. cerevisiae
aatgatgaacaagaagcctgattta

SEQ ID NO: 19176 - DNA, 25 bp, S. cerevisiae
aatgccgaagctacaccaacagatg

SEQ ID NO: 19177 - DNA, 25 bp, S. cerevisiae
aatctccaatgtacactcagttagg

SEQ ID NO: 19178 - DNA, 25 bp, S. cerevisiae
aatccgagttatcccattcttttgg

SEQ ID NO: 19179 - DNA, 25 bp, S. cerevisiae
aatgcaataccaggcaatatctagt

SEQ ID NO: 19180 - DNA, 25 bp, S. cerevisiae
aatgtctatgagttgattaccgata

SEQ ID NO: 19181 - DNA, 25 bp, S. cerevisiae
aatgtttgacaccttcataccgttc

SEQ ID NO: 19182 - DNA, 25 bp, S. cerevisiae
aatgtgatacgatctctggagcaag

SEQ ID NO: 19183 - DNA, 25 bp, S. cerevisiae
aatgtcttgctggacactagagcta

SEQ ID NO: 19184 - DNA, 25 bp, S. cerevisiae
aatgtcgtcatgacctgctcgggat

SEQ ID NO: 19185 - DNA, 25 bp, S. cerevisiae
aatgtcgttgtcactctagcagcat

SEQ ID NO: 19186 - DNA, 25 bp, S. cerevisiae
aatgaccgtgccgaatatgtacaag

SEQ ID NO: 19187 - DNA, 25 bp, S. cerevisiae
ccccattgtttacagagtgccgttt

SEQ ID NO: 19188 - DNA, 25 bp, S. cerevisiae
cacccatttgatgaagagaatccaa

SEQ ID NO: 19189 - DNA, 25 bp, S. cerevisiae
cacggcctgtacacgaactatgaaa

SEQ ID NO: 19190 - DNA, 25 bp, S. cerevisiae
caagagccgctaacgaattggttaa

SEQ ID NO: 19191 - DNA, 25 bp, S. cerevisiae
aatgaccagctacctaaattttcta

SEQ ID NO: 19192 - DNA, 25 bp, S. cerevisiae
aatacccatacgtggaatgtactga

SEQ ID NO: 19193 - DNA, 25 bp, S. cerevisiae
aatctaccagactcgcgaagtttat

SEQ ID NO: 19194 - DNA, 25 bp, S. cerevisiae
aatgtctataatttcgcgctcaacg

SEQ ID NO: 19195 - DNA, 25 bp, S. cerevisiae
aatgtctgaagatacgctgctacaa

SEQ ID NO: 19196 - DNA, 25 bp, S. cerevisiae
aatgttttatcacccatctatgcct

SEQ ID NO: 19197 - DNA, 25 bp, S. cerevisiae
aatgtcgtcaatggccttttgctca

SEQ ID NO: 19198 - DNA, 25 bp, S. cerevisiae
aatgattgataagcctgttctgcag

SEQ ID NO: 19199 - DNA, 25 bp, S. cerevisiae
aatgtgtcacaaatgggcccagggt

SEQ ID NO: 19200 - DNA, 25 bp, S. cerevisiae
aatgttcaacttcgtgagtacctca

SEQ ID NO: 19201 - DNA, 25 bp, S. cerevisiae
aatgttgctggctggtggtgaccta

SEQ ID NO: 19202 - DNA, 25 bp, S. cerevisiae
aatggtgtgatacttgcgcgtcttc

SEQ ID NO: 19203 - DNA, 25 bp, S. cerevisiae
aattctggaacactgcactagcgag

SEQ ID NO: 19204 - DNA, 25 bp, S. cerevisiae
aatgcatctacctcccgttactttt

SEQ ID NO: 19205 - DNA, 25 bp, S. cerevisiae
aatcttacggccaaacagtttctgt

SEQ ID NO: 19206 - DNA, 25 bp, S. cerevisiae
aatgctatccggcaacataagtacg

SEQ ID NO: 19207 - DNA, 25 bp, S. cerevisiae
aatgtcaacgctaatacggccaccg

SEQ ID NO: 19208 - DNA, 25 bp, S. cerevisiae
aatgtcacccatggacatctggata

SEQ ID NO: 19209 - DNA, 25 bp, S. cerevisiae
aatgatggtcctacgcttgaaaagt

SEQ ID NO: 19210 - DNA, 25 bp, S. cerevisiae
aatgatgtttgccagcacgctacaa

SEQ ID NO: 19211 - DNA, 25 bp, S. cerevisiae
aatgcatgcgttcgctccgcaacaa

SEQ ID NO: 19212 - DNA, 25 bp, S. cerevisiae
aatgcgctagtatcgatggtacata

SEQ ID NO: 19213 - DNA, 25 bp, S. cerevisiae
aatgcctcccatgcaagagggcatg

SEQ ID NO: 19214 - DNA, 25 bp, S. cerevisiae
aatgtgctccgatacaatagcgata

SEQ ID NO: 19215 - DNA, 25 bp, S. cerevisiae
aatgtgtccgctataaatggctgca

SEQ ID NO: 19216 - DNA, 25 bp, S. cerevisiae
aatgttcaccgctaaaattgcctac

SEQ ID NO: 19217 - DNA, 25 bp, S. cerevisiae
aatgtatccgcccaaaatgtttgaa

SEQ ID NO: 19218 - DNA, 25 bp, S. cerevisiae
aatgatgagccaccgattgaagaat

SEQ ID NO: 19219 - DNA, 25 bp, S. cerevisiae
aatgattttaccttcttgcttcctt

SEQ ID NO: 19220 - DNA, 25 bp, S. cerevisiae
aatgttcgggtctattatctggtca

SEQ ID NO: 19221 - DNA, 25 bp, S. cerevisiae
aatgttccaggattgttactcagtc

SEQ ID NO: 19222 - DNA, 25 bp, S. cerevisiae
aatgtctcctgtattattgctccac

SEQ ID NO: 19223 - DNA, 25 bp, S. cerevisiae
aatgtctcctgggtgtcatactcaa

SEQ ID NO: 19224 - DNA, 25 bp, S. cerevisiae
aatgtcaagctggttgcgcctggaa

SEQ ID NO: 19225 - DNA, 25 bp, S. cerevisiae
aatgtccctgcggtgagacgttctt

SEQ ID NO: 19226 - DNA, 25 bp, S. cerevisiae
aatgaaatcatcaccgttcctgaag

SEQ ID NO: 19227 - DNA, 25 bp, S. cerevisiae
aatgccatcgactcagttaccggaa

SEQ ID NO: 19228 - DNA, 25 bp, S. cerevisiae
aatgttgtcatacccatggacctgc

SEQ ID NO: 19229 - DNA, 25 bp, S. cerevisiae
aatgtcctattttttctcttgtaga

SEQ ID NO: 19230 - DNA, 25 bp, S. cerevisiae
aatgtccatcataataacgctgtta

SEQ ID NO: 19231 - DNA, 25 bp, S. cerevisiae
aatgttttgcattatcgcttgctct

SEQ ID NO: 19232 - DNA, 25 bp, S. cerevisiae
aatgtcttttatttggtgcagctgg

SEQ ID NO: 19233 - DNA, 25 bp, S. cerevisiae
aatgttgtccttacaggcggtacat

SEQ ID NO: 19234 - DNA, 25 bp, S. cerevisiae
aatgtggtcatgtcttgcgtgccga

SEQ ID NO: 19235 - DNA, 25 bp, S. cerevisiae
aatgtattctgtgtgcatgctgctc

SEQ ID NO: 19236 - DNA, 25 bp, S. cerevisiae
aatgtgtctcgcgattattctgcag

SEQ ID NO: 19237 - DNA, 25 bp, S. cerevisiae
aatgatccgcctttattgtatccca

SEQ ID NO: 19238 - DNA, 25 bp, S. cerevisiae
aatgccccgaattgtggattcctcg

SEQ ID NO: 19239 - DNA, 25 bp, S. cerevisiae
aatgactccaattttgcagtttcgg

SEQ ID NO: 19240 - DNA, 25 bp, S. cerevisiae
aatgatgctagacccacagcgaaga

SEQ ID NO: 19241 - DNA, 25 bp, S. cerevisiae
aatgatcatcggtttgtgtgcaagc

SEQ ID NO: 19242 - DNA, 25 bp, S. cerevisiae
aatgcatgcactttcttgcggaacg

SEQ ID NO: 19243 - DNA, 25 bp, S. cerevisiae
aatgatcatggctcttggtggccgt

SEQ ID NO: 19244 - DNA, 25 bp, S. cerevisiae
aatcatcgatgctcatgccattggc

SEQ ID NO: 19245 - DNA, 25 bp, S. cerevisiae
aatgctatgtgctcatgccagggca

SEQ ID NO: 19246 - DNA, 25 bp, S. cerevisiae
cactattcgcgggtccggaacagaa

SEQ ID NO: 19247 - DNA, 25 bp, S. cerevisiae
aatgtcatgcgcttggataaccctc

SEQ ID NO: 19248 - DNA, 25 bp, S. cerevisiae
aatgaatgccctcgtagacatcgcg

SEQ ID NO: 19249 - DNA, 25 bp, S. cerevisiae
aatgaagcctgcctagcctatgaac

SEQ ID NO: 19250 - DNA, 25 bp, S. cerevisiae
aatgaagctatgttgcgcgagaata

SEQ ID NO: 19251 - DNA, 25 bp, S. cerevisiae
aatgatctctctcaactggtcaaga

SEQ ID NO: 19252 - DNA, 25 bp, S. cerevisiae
aatgacagcggcacttcgttatatt

SEQ ID NO: 19253 - DNA, 25 bp, S. cerevisiae
aatgtgctcattggttcgatttcga

SEQ ID NO: 19254 - DNA, 25 bp, S. cerevisiae
aatgtttgcttctggcggtgatgac

SEQ ID NO: 19255 - DNA, 25 bp, S. cerevisiae
aatgttatctcttcttctgttggta

SEQ ID NO: 19256 - DNA, 25 bp, S. cerevisiae
aatgttgacgtctcttgggttgata

SEQ ID NO: 19257 - DNA, 25 bp, S. cerevisiae
aatgttgatcctgtgcatttgcctc

SEQ ID NO: 19258 - DNA, 25 bp, S. cerevisiae
aatgttgtcacgaggcttacagcat

SEQ ID NO: 19259 - DNA, 25 bp, S. cerevisiae
aatgattctgatcgtggttcacagt

SEQ ID NO: 19260 - DNA, 25 bp, S. cerevisiae
aatgttttggttgggctatggctcc

SEQ ID NO: 19261 - DNA, 25 bp, S. cerevisiae
aatgtctattgctgttcatctttgc

SEQ ID NO: 19262 - DNA, 25 bp, S. cerevisiae
aatgctgttctctgttttttcttgc

SEQ ID NO: 19263 - DNA, 25 bp, S. cerevisiae
aatgtttctcctgcatctcaaatca

SEQ ID NO: 19264 - DNA, 25 bp, S. cerevisiae
aatgtctgtacaactgggctatctc

SEQ ID NO: 19265 - DNA, 25 bp, S. cerevisiae
aatcctgtaaggttggccactgcag

SEQ ID NO: 19266 - DNA, 25 bp, S. cerevisiae
aatcgctaaaagtgacgccaatgtc

SEQ ID NO: 19267 - DNA, 25 bp, S. cerevisiae
aatccaaaagagtccctgagcattt

SEQ ID NO: 19268 - DNA, 25 bp, S. cerevisiae
aatgtcaaaagttctccaggtgtat

SEQ ID NO: 19269 - DNA, 25 bp, S. cerevisiae
aatgctacaagtcactcccatggta

SEQ ID NO: 19270 - DNA, 25 bp, S. cerevisiae
aatgctggcatgatgcctccccaag

SEQ ID NO: 19271 - DNA, 25 bp, S. cerevisiae
aatgcaagttcttctgatcacaagg

SEQ ID NO: 19272 - DNA, 25 bp, S. cerevisiae
aatgactctttcctgcactactggt

SEQ ID NO: 19273 - DNA, 25 bp, S. cerevisiae
gacccttggtcgatagactttcgga

SEQ ID NO: 19274 - DNA, 25 bp, S. cerevisiae
ggacccattggacaaaaacttacag

SEQ ID NO: 19275 - DNA, 25 bp, S. cerevisiae
gatttaccgccacaaaaacttactg

SEQ ID NO: 19276 - DNA, 25 bp, S. cerevisiae
aatagtgcttctcccaatgttaacc

SEQ ID NO: 19277 - DNA, 25 bp, S. cerevisiae
aatgatgatgtattgccgccgttag

SEQ ID NO: 19278 - DNA, 25 bp, S. cerevisiae
aatgatttggcagcgcgcagtgcat

SEQ ID NO: 19279 - DNA, 25 bp, S. cerevisiae
aatgattggcgcttcatcacagttc

SEQ ID NO: 19280 - DNA, 25 bp, S. cerevisiae
aatgccatttgccatagtagggtct

SEQ ID NO: 19281 - DNA, 25 bp, S. cerevisiae
aatgcggccaatactggtagcaaca

SEQ ID NO: 19282 - DNA, 25 bp, S. cerevisiae
aatgcaggctctaccagcagtggaa

SEQ ID NO: 19283 - DNA, 25 bp, S. cerevisiae
aatgcagcatgttttccaggttaaa

SEQ ID NO: 19284 - DNA, 25 bp, S. cerevisiae
aatgacgatacacttgccaggtccg

SEQ ID NO: 19285 - DNA, 25 bp, S. cerevisiae
aatgacgctgtcgattggcacgttc

SEQ ID NO: 19286 - DNA, 25 bp, S. cerevisiae
aatgctcgccggtttagcgatggca

SEQ ID NO: 19287 - DNA, 25 bp, S. cerevisiae
aatgttgcacgagcatctacctggc

SEQ ID NO: 19288 - DNA, 25 bp, S. cerevisiae
aatgactcatcgtcctctgatacaa

SEQ ID NO: 19289 - DNA, 25 bp, S. cerevisiae
aatgtcttctgttcttgagcaccaa

SEQ ID NO: 19290 - DNA, 25 bp, S. cerevisiae
aatgtttatgtcactgatgccttca

SEQ ID NO: 19291 - DNA, 25 bp, S. cerevisiae
aatgcaacaagaggctttacgtcgg

SEQ ID NO: 19292 - DNA, 25 bp, S. cerevisiae
aatcgacatggagtgctattcagcc

SEQ ID NO: 19293 - DNA, 25 bp, S. cerevisiae
aatgcgagcaactttttgactccta

SEQ ID NO: 19294 - DNA, 25 bp, S. cerevisiae
aatcgatgacccttgtgttggactg

SEQ ID NO: 19295 - DNA, 25 bp, S. cerevisiae
aatgatggctcttcaagtttcgtga

SEQ ID NO: 19296 - DNA, 25 bp, S. cerevisiae
aatgttcgctaaagctttcgagcta

SEQ ID NO: 19297 - DNA, 25 bp, S. cerevisiae
aatgttgcattcatgccccatgttg

SEQ ID NO: 19298 - DNA, 25 bp, S. cerevisiae
aatgattattttctcctgcaatggg

SEQ ID NO: 19299 - DNA, 25 bp, S. cerevisiae
aatgttcatttaactccatcctagt

SEQ ID NO: 19300 - DNA, 25 bp, S. cerevisiae
aatgttatctcattatccgcccata

SEQ ID NO: 19301 - DNA, 25 bp, S. cerevisiae
aatgttcatgcccattatcttccaa

SEQ ID NO: 19302 - DNA, 25 bp, S. cerevisiae
aatgtttttcactttttcagcgata

SEQ ID NO: 19303 - DNA, 25 bp, S. cerevisiae
aatgttttagacttcctgtccgact

SEQ ID NO: 19304 - DNA, 25 bp, S. cerevisiae
aatacgcatttgaaactcgtttcca

SEQ ID NO: 19305 - DNA, 25 bp, S. cerevisiae
aatgttgccaacactgtcagcgacc

SEQ ID NO: 19306 - DNA, 25 bp, S. cerevisiae
aatgcttcaaacaactgccgggtct

SEQ ID NO: 19307 - DNA, 25 bp, S. cerevisiae
aatgaacttatcgtccgctgtggtc

SEQ ID NO: 19308 - DNA, 25 bp, S. cerevisiae
aatgccaatataactaccgtcgaaa

SEQ ID NO: 19309 - DNA, 25 bp, S. cerevisiae
aatcgcggaaaggtacggcacacaa

SEQ ID NO: 19310 - DNA, 25 bp, S. cerevisiae
aatgcgcatcaatccttcatacagc

SEQ ID NO: 19311 - DNA, 25 bp, S. cerevisiae
aatgagctctgctaccaactgaagc

SEQ ID NO: 19312 - DNA, 25 bp, S. cerevisiae
aatgaagcttctccaaacactgacg

SEQ ID NO: 19313 - DNA, 25 bp, S. cerevisiae
aatgatatcctttcaaactcgcagg

SEQ ID NO: 19314 - DNA, 25 bp, S. cerevisiae
aatgctagccaagataactcccgta

SEQ ID NO: 19315 - DNA, 25 bp, S. cerevisiae
aatgcatcctcaagtaacgtcgcca

SEQ ID NO: 19316 - DNA, 25 bp, S. cerevisiae
aatgatggcactatagcacgtccct

SEQ ID NO: 19317 - DNA, 25 bp, S. cerevisiae
aatgaccacgatcaagagctccctt

SEQ ID NO: 19318 - DNA, 25 bp, S. cerevisiae
aatgttctggtgcagagccttgcgt

SEQ ID NO: 19319 - DNA, 25 bp, S. cerevisiae
aatgctattcaggtatttgcggatc

SEQ ID NO: 19320 - DNA, 25 bp, S. cerevisiae
aatgtttcatccacgatgcttcctg

SEQ ID NO: 19321 - DNA, 25 bp, S. cerevisiae
aatgcggacgtaactagccagccta

SEQ ID NO: 19322 - DNA, 25 bp, S. cerevisiae
aatcctgactacaacaccaacttta

SEQ ID NO: 19323 - DNA, 25 bp, S. cerevisiae
aatcgtcgtaataaggccactgttt

SEQ ID NO: 19324 - DNA, 25 bp, S. cerevisiae
aatccttgcccatcagttctttaat

SEQ ID NO: 19325 - DNA, 25 bp, S. cerevisiae
aatgcgcgcatcacaaaaactttca

SEQ ID NO: 19326 - DNA, 25 bp, S. cerevisiae
aatgagcctttaaatgaatctgttc

SEQ ID NO: 19327 - DNA, 25 bp, S. cerevisiae
aatgaacatttacgtgccaccttgc

SEQ ID NO: 19328 - DNA, 25 bp, S. cerevisiae
aatgaatcttttgtgcctcgtatgc

SEQ ID NO: 19329 - DNA, 25 bp, S. cerevisiae
aatgatttatatttcccttgttgga

SEQ ID NO: 19330 - DNA, 25 bp, S. cerevisiae
aatgatgatgagttttcacgcagta

SEQ ID NO: 19331 - DNA, 25 bp, S. cerevisiae
aatctccctaattccaatgcgaagc

SEQ ID NO: 19332 - DNA, 25 bp, S. cerevisiae
aatctcaccaaagggctctggaagt

SEQ ID NO: 19333 - DNA, 25 bp, S. cerevisiae
aatccattgtaagctcttccatacc

SEQ ID NO: 19334 - DNA, 25 bp, S. cerevisiae
aatgacatgtatgacctttcgctcc

SEQ ID NO: 19335 - DNA, 25 bp, S. cerevisiae
aatacttggaacaccacctgaggaa

SEQ ID NO: 19336 - DNA, 25 bp, S. cerevisiae
aatgactttaacacatcggctcaag

SEQ ID NO: 19337 - DNA, 25 bp, S. cerevisiae
aatgaactgttttctccaattggag

SEQ ID NO: 19338 - DNA, 25 bp, S. cerevisiae
aatgatagtgagtcttcccttaatt

SEQ ID NO: 19339 - DNA, 25 bp, S. cerevisiae
aattaggaacctccgcatatgccac

SEQ ID NO: 19340 - DNA, 25 bp, S. cerevisiae
aatgcttcgcaacatccgtattacg

SEQ ID NO: 19341 - DNA, 25 bp, S. cerevisiae
aatgagctattcttgaggatttcta

SEQ ID NO: 19342 - DNA, 25 bp, S. cerevisiae
aatgttgcctccaagtgcggcttca

SEQ ID NO: 19343 - DNA, 25 bp, S. cerevisiae
aatgttgccatcacaggccattcga

SEQ ID NO: 19344 - DNA, 25 bp, S. cerevisiae
aatgttgctggcattggcatctcca

SEQ ID NO: 19345 - DNA, 25 bp, S. cerevisiae
aatgctatcatcgtctctaaaccag

SEQ ID NO: 19346 - DNA, 25 bp, S. cerevisiae
aatgcaatgtcagtcatcttcctcc

SEQ ID NO: 19347 - DNA, 25 bp, S. cerevisiae
aatgctacctcttcgttgtttgaaa

SEQ ID NO: 19348 - DNA, 25 bp, S. cerevisiae
aatgctcggttagctcgtcggaaaa

SEQ ID NO: 19349 - DNA, 25 bp, S. cerevisiae
aatgcttggttgtgactactgtgaa

SEQ ID NO: 19350 - DNA, 25 bp, S. cerevisiae
aatgttgtcttcgttttgatagcta

SEQ ID NO: 19351 - DNA, 25 bp, S. cerevisiae
aattttggaccagacgtagcgaaca

SEQ ID NO: 19352 - DNA, 25 bp, S. cerevisiae
aattcgtttatccaaaatgcggcca

SEQ ID NO: 19353 - DNA, 25 bp, S. cerevisiae
aatcctgccactttcaaaaggcgaa

SEQ ID NO: 19354 - DNA, 25 bp, S. cerevisiae
aatcctgcctactcaaacagcatta

SEQ ID NO: 19355 - DNA, 25 bp, S. cerevisiae
aataacaggccctcatctattttct

SEQ ID NO: 19356 - DNA, 25 bp, S. cerevisiae
aatgcaagaccaaccgtctctgttg

SEQ ID NO: 19357 - DNA, 25 bp, S. cerevisiae
aatgacactcgcacgtttgattctg

SEQ ID NO: 19358 - DNA, 25 bp, S. cerevisiae
aatgagcccaattatcttgaactag

SEQ ID NO: 19359 - DNA, 25 bp, S. cerevisiae
aatgcagacctatttcttatacaag

SEQ ID NO: 19360 - DNA, 25 bp, S. cerevisiae
aatgcatttgctgggttgccaccaa

SEQ ID NO: 19361 - DNA, 25 bp, S. cerevisiae
aatgacgttcgatatgccaccagaa

SEQ ID NO: 19362 - DNA, 25 bp, S. cerevisiae
aatgaggttcagtgtcccaatgaga

SEQ ID NO: 19363 - DNA, 25 bp, S. cerevisiae
aatgacgttagtatcttcatcgaag

SEQ ID NO: 19364 - DNA, 25 bp, S. cerevisiae
aatgatgggttcctcgattaccacg

SEQ ID NO: 19365 - DNA, 25 bp, S. cerevisiae
aatctggcaataaccgttgcggtac

SEQ ID NO: 19366 - DNA, 25 bp, S. cerevisiae
aatccgccagcaaaggtacaagtag

SEQ ID NO: 19367 - DNA, 25 bp, S. cerevisiae
aatcctgctagcatgaagggcaagc

SEQ ID NO: 19368 - DNA, 25 bp, S. cerevisiae
aatgcatgtttggtgccgtagtcta

SEQ ID NO: 19369 - DNA, 25 bp, S. cerevisiae
aatgagattcgagcctctgttctac

SEQ ID NO: 19370 - DNA, 25 bp, S. cerevisiae
aatgcaatccatatcttcttcgcca

SEQ ID NO: 19371 - DNA, 25 bp, S. cerevisiae
aatgctgctatatttggcgctggtt

SEQ ID NO: 19372 - DNA, 25 bp, S. cerevisiae
aatcgatgcatccaaacctgttaag

SEQ ID NO: 19373 - DNA, 25 bp, S. cerevisiae
aatgactatcaagaccttctgcaag

SEQ ID NO: 19374 - DNA, 25 bp, S. cerevisiae
aatcctcaggacgacgattcgcaaa

SEQ ID NO: 19375 - DNA, 25 bp, S. cerevisiae
aatacgcggactatgttccaaaaag

SEQ ID NO: 19376 - DNA, 25 bp, S. cerevisiae
aatgacgtggtctgtgttccaactt

SEQ ID NO: 19377 - DNA, 25 bp, S. cerevisiae
aatgccagtatttcgttaccttgtt

SEQ ID NO: 19378 - DNA, 25 bp, S. cerevisiae
aataattaccttcatcaccgtctta

SEQ ID NO: 19379 - DNA, 25 bp, S. cerevisiae
aatgatccaactgcttcaccaaatg

SEQ ID NO: 19380 - DNA, 25 bp, S. cerevisiae
aatgcatcctaactttcctaacggc

SEQ ID NO: 19381 - DNA, 25 bp, S. cerevisiae
aatgctccataatgtccctcatgac

SEQ ID NO: 19382 - DNA, 25 bp, S. cerevisiae
aatgctacatcaatttcctcttctt

SEQ ID NO: 19383 - DNA, 25 bp, S. cerevisiae
aatccaatggccgttcgtagtgagt

SEQ ID NO: 19384 - DNA, 25 bp, S. cerevisiae
aatgctgacagtatgagcttcaagt

SEQ ID NO: 19385 - DNA, 25 bp, S. cerevisiae
aatgatcctatcgttgatgctagct

SEQ ID NO: 19386 - DNA, 25 bp, S. cerevisiae
aatgatcctcttgattgttgcgaaa

SEQ ID NO: 19387 - DNA, 25 bp, S. cerevisiae
aatgacgacactaattttgcgctaa

SEQ ID NO: 19388 - DNA, 25 bp, S. cerevisiae
aatgctttcactgattttgcgtcaa

SEQ ID NO: 19389 - DNA, 25 bp, S. cerevisiae
aatgacttaatcgattctggcgaaa

SEQ ID NO: 19390 - DNA, 25 bp, S. cerevisiae
aatccgataacgtctatttgaaatt

SEQ ID NO: 19391 - DNA, 25 bp, S. cerevisiae
aatccgtcgacgttttgatgccaaa

SEQ ID NO: 19392 - DNA, 25 bp, S. cerevisiae
aatccctccaagcacggtcataaat

SEQ ID NO: 19393 - DNA, 25 bp, S. cerevisiae
aatgcttttggaggtggatgcgcta

SEQ ID NO: 19394 - DNA, 25 bp, S. cerevisiae
aatgcgcccgtgaaggacatgccta

SEQ ID NO: 19395 - DNA, 25 bp, S. cerevisiae
aatgcggccatggtagaacttctat

SEQ ID NO: 19396 - DNA, 25 bp, S. cerevisiae
aatgcccaagcagatgtacttaaac

SEQ ID NO: 19397 - DNA, 25 bp, S. cerevisiae
aatccattcagctcttcaccaaata

SEQ ID NO: 19398 - DNA, 25 bp, S. cerevisiae
aatgctcccgctacaatacgagaat

SEQ ID NO: 19399 - DNA, 25 bp, S. cerevisiae
aatgctacccgaattgagcgaacat

SEQ ID NO: 19400 - DNA, 25 bp, S. cerevisiae
aatgcaatcactctaaggcgcctat

SEQ ID NO: 19401 - DNA, 25 bp, S. cerevisiae
aatgctaccatttataggccgtttg

SEQ ID NO: 19402 - DNA, 25 bp, S. cerevisiae
aatccttggagaatttgcatttaca

SEQ ID NO: 19403 - DNA, 25 bp, S. cerevisiae
aatccacccagtattgctgttccaa

SEQ ID NO: 19404 - DNA, 25 bp, S. cerevisiae
aatgatgtctcaacctcttttaagg

SEQ ID NO: 19405 - DNA, 25 bp, S. cerevisiae
aatgcacgacattgatccttctgac

SEQ ID NO: 19406 - DNA, 25 bp, S. cerevisiae
aatgaccaattgactgaactacagg

SEQ ID NO: 19407 - DNA, 25 bp, S. cerevisiae
aatgacgcgtattcgaacttagtgg

SEQ ID NO: 19408 - DNA, 25 bp, S. cerevisiae
aatcccattgccaaatgaggccggc

SEQ ID NO: 19409 - DNA, 25 bp, S. cerevisiae
aatgagctttccaaggcaggcggac

SEQ ID NO: 19410 - DNA, 25 bp, S. cerevisiae
aatagactggccaacgacgggacgt

SEQ ID NO: 19411 - DNA, 25 bp, S. cerevisiae
aataacggtgatggcgacgacgacg

SEQ ID NO: 19412 - DNA, 25 bp, S. cerevisiae
aatacggtggtgacgacgattacta

SEQ ID NO: 19413 - DNA, 25 bp, S. cerevisiae
caatctctgaggctactgacggtat

SEQ ID NO: 19414 - DNA, 25 bp, S. cerevisiae
aatcaaagggtgctgccggaattat

SEQ ID NO: 19415 - DNA, 25 bp, S. cerevisiae
aatccagacggcctagatctactga

SEQ ID NO: 19416 - DNA, 25 bp, S. cerevisiae
aatccaacggtgaatgccatcaagg

SEQ ID NO: 19417 - DNA, 25 bp, S. cerevisiae
aatgccatagcggtgacgcctatat

SEQ ID NO: 19418 - DNA, 25 bp, S. cerevisiae
aatccagcccattgagcgcagttat

SEQ ID NO: 19419 - DNA, 25 bp, S. cerevisiae
aatcgataccatttccacttgtttt

SEQ ID NO: 19420 - DNA, 25 bp, S. cerevisiae
aatccaggatttgaacttcttgcaa

SEQ ID NO: 19421 - DNA, 25 bp, S. cerevisiae
aatgcctgagccaccaagtagtttg

SEQ ID NO: 19422 - DNA, 25 bp, S. cerevisiae
aatcatgctacgcatcgtcattctt

SEQ ID NO: 19423 - DNA, 25 bp, S. cerevisiae
aatctgcaacagtatctcttccgtt

SEQ ID NO: 19424 - DNA, 25 bp, S. cerevisiae
aatctggcaagatcactgacctgga

SEQ ID NO: 19425 - DNA, 25 bp, S. cerevisiae
aatcgtcgacatgactaagcggttc

SEQ ID NO: 19426 - DNA, 25 bp, S. cerevisiae
aattcgatgacaagttgaaggagtt

SEQ ID NO: 19427 - DNA, 25 bp, S. cerevisiae
aatgcactattacgcagctttcggc

SEQ ID NO: 19428 - DNA, 25 bp, S. cerevisiae
aatcagcgtagcttgcactactaga

SEQ ID NO: 19429 - DNA, 25 bp, S. cerevisiae
aatgccgttgcagtactgagcgaag

SEQ ID NO: 19430 - DNA, 25 bp, S. cerevisiae
aatccatgcccaatatttctgaaga

SEQ ID NO: 19431 - DNA, 25 bp, S. cerevisiae
aatcgactactttatatctataacg

SEQ ID NO: 19432 - DNA, 25 bp, S. cerevisiae
aatcctccacagtgcaagttgcgat

SEQ ID NO: 19433 - DNA, 25 bp, S. cerevisiae
aatctccttaaccaatgttgttctg

SEQ ID NO: 19434 - DNA, 25 bp, S. cerevisiae
caaccactggaaccgttgtcggata

SEQ ID NO: 19435 - DNA, 25 bp, S. cerevisiae
aatccgctggaacaatatctcgaaa

SEQ ID NO: 19436 - DNA, 25 bp, S. cerevisiae
aatccacggaggcagtaagtacatg

SEQ ID NO: 19437 - DNA, 25 bp, S. cerevisiae
aatccgcgagtgacgaaagagtatt

SEQ ID NO: 19438 - DNA, 25 bp, S. cerevisiae
aatccccattccaagaaactgcttt

SEQ ID NO: 19439 - DNA, 25 bp, S. cerevisiae
aatcgcttaagcacaatcctgacgg

SEQ ID NO: 19440 - DNA, 25 bp, S. cerevisiae
aatgctttggagaccaagcctgcca

SEQ ID NO: 19441 - DNA, 25 bp, S. cerevisiae
aatgctctgaaacattttctccgta

SEQ ID NO: 19442 - DNA, 25 bp, S. cerevisiae
aatgcttgacaacattatcgccggg

SEQ ID NO: 19443 - DNA, 25 bp, S. cerevisiae
aatcttcagcaagccaattgcctgg

SEQ ID NO: 19444 - DNA, 25 bp, S. cerevisiae
aatcgatgcagctgtaatcaccgtg

SEQ ID NO: 19445 - DNA, 25 bp, S. cerevisiae
aatgctttcttatggcgtttctctt

SEQ ID NO: 19446 - DNA, 25 bp, S. cerevisiae
aatccgggaaatggccatgcaatgc

SEQ ID NO: 19447 - DNA, 25 bp, S. cerevisiae
caatctcggaaaaggcggccaggct

SEQ ID NO: 19448 - DNA, 25 bp, S. cerevisiae
aatctcaggcacaggcggtaacgct

SEQ ID NO: 19449 - DNA, 25 bp, S. cerevisiae
aatttaccaccttcgccagtaagag

SEQ ID NO: 19450 - DNA, 25 bp, S. cerevisiae
aataattccctacctccagtacatg

SEQ ID NO: 19451 - DNA, 25 bp, S. cerevisiae
aatccatgtttcttactggacgccg

SEQ ID NO: 19452 - DNA, 25 bp, S. cerevisiae
aatcctcatctgtcggatgcgagaa

SEQ ID NO: 19453 - DNA, 25 bp, S. cerevisiae
aatgcactcgataaatgccatcaaa

SEQ ID NO: 19454 - DNA, 25 bp, S. cerevisiae
aatgctgtcgctatctcatcaaaac

SEQ ID NO: 19455 - DNA, 25 bp, S. cerevisiae
aatgctccctctgatatcaagcagc

SEQ ID NO: 19456 - DNA, 25 bp, S. cerevisiae
aatcctccatttacaaagtctgcca

SEQ ID NO: 19457 - DNA, 25 bp, S. cerevisiae
aatcttggtgtctataaagtcggat

SEQ ID NO: 19458 - DNA, 25 bp, S. cerevisiae
aattaggctccgtgagagtccaatt

SEQ ID NO: 19459 - DNA, 25 bp, S. cerevisiae
aatgcttctgttgtagacctcggta

SEQ ID NO: 19460 - DNA, 25 bp, S. cerevisiae
aatgccactttcttccacgagggag

SEQ ID NO: 19461 - DNA, 25 bp, S. cerevisiae
aatgcagctatcaacacatccacgg

SEQ ID NO: 19462 - DNA, 25 bp, S. cerevisiae
caatgctggtcttcatatggtcata

SEQ ID NO: 19463 - DNA, 25 bp, S. cerevisiae
aatgccgtagcaagcaatctcgacg

SEQ ID NO: 19464 - DNA, 25 bp, S. cerevisiae
aatctcatccgccacaattttttca

SEQ ID NO: 19465 - DNA, 25 bp, S. cerevisiae
aatgcccttgcaactagaggctttc

SEQ ID NO: 19466 - DNA, 25 bp, S. cerevisiae
aatgctcctcttatattctgctcta

SEQ ID NO: 19467 - DNA, 25 bp, S. cerevisiae
aatgccactatatctcttttcgaaa

SEQ ID NO: 19468 - DNA, 25 bp, S. cerevisiae
aatgcttcttagttgggatcccaag

SEQ ID NO: 19469 - DNA, 25 bp, S. cerevisiae
aatgctttgagagttggtgaccacg

SEQ ID NO: 19470 - DNA, 25 bp, S. cerevisiae
aatccttcttggaatccgtcatcag

SEQ ID NO: 19471 - DNA, 25 bp, S. cerevisiae
aatcccgtccataagcatcgtgaag

SEQ ID NO: 19472 - DNA, 25 bp, S. cerevisiae
aatgcccacgaggatacagttgtac

SEQ ID NO: 19473 - DNA, 25 bp, S. cerevisiae
aatcctcatcatttgatcggctggt

SEQ ID NO: 19474 - DNA, 25 bp, S. cerevisiae
aatgctctattgtttaagtgcggta

SEQ ID NO: 19475 - DNA, 25 bp, S. cerevisiae
aatgctttagtttcagttctgaccc

SEQ ID NO: 19476 - DNA, 25 bp, S. cerevisiae
caatcgaaggtttcagtggctactg

SEQ ID NO: 19477 - DNA, 25 bp, S. cerevisiae
aatgcacagggttctttatctatgg

SEQ ID NO: 19478 - DNA, 25 bp, S. cerevisiae
aatgcttagagtttttactactgga

SEQ ID NO: 19479 - DNA, 25 bp, S. cerevisiae
aatgctgctgagatacttttatgta

SEQ ID NO: 19480 - DNA, 25 bp, S. cerevisiae
aatgcaggccacaactatgtctata

SEQ ID NO: 19481 - DNA, 25 bp, S. cerevisiae
aatgcatcatcttggcgtctgctgg

SEQ ID NO: 19482 - DNA, 25 bp, S. cerevisiae
gaactacgctggctcacgagtcgat

SEQ ID NO: 19483 - DNA, 25 bp, S. cerevisiae
caacatacttggctccgggcgaaaa

SEQ ID NO: 19484 - DNA, 25 bp, S. cerevisiae
caaacacgaggtttcgggccagaga

SEQ ID NO: 19485 - DNA, 25 bp, S. cerevisiae
aataagaccgaatcactttcagaaa

SEQ ID NO: 19486 - DNA, 25 bp, S. cerevisiae
aataacgcgttctcagtacctagta

SEQ ID NO: 19487 - DNA, 25 bp, S. cerevisiae
aataactgggaaccgctacctgatt

SEQ ID NO: 19488 - DNA, 25 bp, S. cerevisiae
aatcattatgagtgcctggaaccca

SEQ ID NO: 19489 - DNA, 25 bp, S. cerevisiae
aatgcattactgtaccttggtccca

SEQ ID NO: 19490 - DNA, 25 bp, S. cerevisiae
aatgcttcctgagtgcttgtggtgt

SEQ ID NO: 19491 - DNA, 25 bp, S. cerevisiae
aatgctggcgcatctcatgccgtta

SEQ ID NO: 19492 - DNA, 25 bp, S. cerevisiae
aatgcggctgcatactcagctggta

SEQ ID NO: 19493 - DNA, 25 bp, S. cerevisiae
aatgcttttataggcgctgcagtgc

SEQ ID NO: 19494 - DNA, 25 bp, S. cerevisiae
aatgctttaatactctccgtgctgt

SEQ ID NO: 19495 - DNA, 25 bp, S. cerevisiae
aatcctcaagaattcggcgggccag

SEQ ID NO: 19496 - DNA, 25 bp, S. cerevisiae
aatcgtccagaaaagcgtaggccac

SEQ ID NO: 19497 - DNA, 25 bp, S. cerevisiae
aatgcgttcgtaatgggctttgcca

SEQ ID NO: 19498 - DNA, 25 bp, S. cerevisiae
aatgctttcgtttggatggttctag

SEQ ID NO: 19499 - DNA, 25 bp, S. cerevisiae
aatgctttcgttgggaggcgctcta

SEQ ID NO: 19500 - DNA, 25 bp, S. cerevisiae
aatgcgattttggtgctagctaaca

SEQ ID NO: 19501 - DNA, 25 bp, S. cerevisiae
caagcacttttgtttaccagaacgg

SEQ ID NO: 19502 - DNA, 25 bp, S. cerevisiae
aatgcacttatgctgtgtacctgca

SEQ ID NO: 19503 - DNA, 25 bp, S. cerevisiae
aatgcatggttactttccactggaa

SEQ ID NO: 19504 - DNA, 25 bp, S. cerevisiae
aatgcgtgtatttttctaatgccaa

SEQ ID NO: 19505 - DNA, 25 bp, S. cerevisiae
aatgcggtctccctattagatctga

SEQ ID NO: 19506 - DNA, 25 bp, S. cerevisiae
aatgcttccagctagtatttgacga

SEQ ID NO: 19507 - DNA, 25 bp, S. cerevisiae
aatgctgttcctaccttcacaaaga

SEQ ID NO: 19508 - DNA, 25 bp, S. cerevisiae
aatgctggtcctacaagtgccacat

SEQ ID NO: 19509 - DNA, 25 bp, S. cerevisiae
aatgctcttcctacacatggtagca

SEQ ID NO: 19510 - DNA, 25 bp, S. cerevisiae
aatctccgcattgacttcgacggat

SEQ ID NO: 19511 - DNA, 25 bp, S. cerevisiae
aatgcgaggttttcttggtcagttt

SEQ ID NO: 19512 - DNA, 25 bp, S. cerevisiae
aatccgttcatactgcatgcatcac

SEQ ID NO: 19513 - DNA, 25 bp, S. cerevisiae
aatccctaatcaccattcaaggtcc

SEQ ID NO: 19514 - DNA, 25 bp, S. cerevisiae
aatcgcctcaattgccattcaatgg

SEQ ID NO: 19515 - DNA, 25 bp, S. cerevisiae
aatctggtaggtgtagccgctggtt

SEQ ID NO: 19516 - DNA, 25 bp, S. cerevisiae
aatcgcacgttgaacttgcaccttc

SEQ ID NO: 19517 - DNA, 25 bp, S. cerevisiae
aatccaggctgtaaattgcactacc

SEQ ID NO: 19518 - DNA, 25 bp, S. cerevisiae
gacttgggcgacaaaataaatccta

SEQ ID NO: 19519 - DNA, 25 bp, S. cerevisiae
aattgggcccaatgctaaactcttt

SEQ ID NO: 19520 - DNA, 25 bp, S. cerevisiae
aatctgatacccttcgaaaactcta

SEQ ID NO: 19521 - DNA, 25 bp, S. cerevisiae
aatcggtgggcatttgtcggaacta

SEQ ID NO: 19522 - DNA, 25 bp, S. cerevisiae
aatcgactgactactaaggaggcat

SEQ ID NO: 19523 - DNA, 25 bp, S. cerevisiae
aatcgatctagctccaaaatggccc

SEQ ID NO: 19524 - DNA, 25 bp, S. cerevisiae
aatcggaaccgccaacaatgacagc

SEQ ID NO: 19525 - DNA, 25 bp, S. cerevisiae
aatcgatgacataccgcaagaagtg

SEQ ID NO: 19526 - DNA, 25 bp, S. cerevisiae
aatgccttgatgactcagaaccaat

SEQ ID NO: 19527 - DNA, 25 bp, S. cerevisiae
aatgctatcaagtatcggcccacat

SEQ ID NO: 19528 - DNA, 25 bp, S. cerevisiae
aatgctattccaatggagccatgga

SEQ ID NO: 19529 - DNA, 25 bp, S. cerevisiae
aatgcgttgtctttgggagaaccgc

SEQ ID NO: 19530 - DNA, 25 bp, S. cerevisiae
aatgcgggttttcgagacaacttgt

SEQ ID NO: 19531 - DNA, 25 bp, S. cerevisiae
gatatcggtgggtcttgaaaacggt

SEQ ID NO: 19532 - DNA, 25 bp, S. cerevisiae
aatcacgataattgttaggtcaggc

SEQ ID NO: 19533 - DNA, 25 bp, S. cerevisiae
aatacgtagtaccaaggctctcctg

SEQ ID NO: 19534 - DNA, 25 bp, S. cerevisiae
aatactggacgttaagggctcttgt

SEQ ID NO: 19535 - DNA, 25 bp, S. cerevisiae
aataatggacttggaatgtttcttt

SEQ ID NO: 19536 - DNA, 25 bp, S. cerevisiae
aataaacgtggaggaggcttcattt

SEQ ID NO: 19537 - DNA, 25 bp, S. cerevisiae
aatccgaaggtatggctgctggttt

SEQ ID NO: 19538 - DNA, 25 bp, S. cerevisiae
aatacaacaggccattttcggattt

SEQ ID NO: 19539 - DNA, 25 bp, S. cerevisiae
aataactcgggcattttcagctata

SEQ ID NO: 19540 - DNA, 25 bp, S. cerevisiae
aatgcccatcgttttgtttgcctat

SEQ ID NO: 19541 - DNA, 25 bp, S. cerevisiae
aatgcttacgcttctttcttgcaaa

SEQ ID NO: 19542 - DNA, 25 bp, S. cerevisiae
aatgcttatcatgtgctttcctata

SEQ ID NO: 19543 - DNA, 25 bp, S. cerevisiae
aatccatggcccattctcactaaat

SEQ ID NO: 19544 - DNA, 25 bp, S. cerevisiae
aatccgctccacaagttttatactc

SEQ ID NO: 19545 - DNA, 25 bp, S. cerevisiae
aatcctgacgtaacttttggccaag

SEQ ID NO: 19546 - DNA, 25 bp, S. cerevisiae
aatgcccactacgaattctttgaac

SEQ ID NO: 19547 - DNA, 25 bp, S. cerevisiae
aatgctccattcatgttgcctattg

SEQ ID NO: 19548 - DNA, 25 bp, S. cerevisiae
aatgctacacttacttgcgtactct

SEQ ID NO: 19549 - DNA, 25 bp, S. cerevisiae
aatcctcactctcggttgttcaagg

SEQ ID NO: 19550 - DNA, 25 bp, S. cerevisiae
aatgcctactgtgggttttcaaata

SEQ ID NO: 19551 - DNA, 25 bp, S. cerevisiae
aatgcgttccctgctattttagaaa

SEQ ID NO: 19552 - DNA, 25 bp, S. cerevisiae
aatgctgttcctataccgttcaaaa

SEQ ID NO: 19553 - DNA, 25 bp, S. cerevisiae
aatcctctcgcacatctggtacaag

SEQ ID NO: 19554 - DNA, 25 bp, S. cerevisiae
aatgcctttcccagaagtagaagta

SEQ ID NO: 19555 - DNA, 25 bp, S. cerevisiae
aatgctcttaccaggccttggaaga

SEQ ID NO: 19556 - DNA, 25 bp, S. cerevisiae
aatccttgaattgttctcgcgaaga

SEQ ID NO: 19557 - DNA, 25 bp, S. cerevisiae
aatcttctacgggttcggcgcaaga

SEQ ID NO: 19558 - DNA, 25 bp, S. cerevisiae
aatcttatcgtgtgttcgtgccaat

SEQ ID NO: 19559 - DNA, 25 bp, S. cerevisiae
aatctttctggtgttggcgtcttta

SEQ ID NO: 19560 - DNA, 25 bp, S. cerevisiae
aatccactgctacaaattcggcgac

SEQ ID NO: 19561 - DNA, 25 bp, S. cerevisiae
aatccgctgctaacaaacttgactg

SEQ ID NO: 19562 - DNA, 25 bp, S. cerevisiae
aataaagctgctgaggcgccaatat

SEQ ID NO: 19563 - DNA, 25 bp, S. cerevisiae
aatcaacagcgtggagggcctggaa

SEQ ID NO: 19564 - DNA, 25 bp, S. cerevisiae
aatctcaaggcttcaatggcgctcg

SEQ ID NO: 19565 - DNA, 25 bp, S. cerevisiae
aatgctctgtacactcttgttgaat

SEQ ID NO: 19566 - DNA, 25 bp, S. cerevisiae
aatcctttgctgctgaggttcttga

SEQ ID NO: 19567 - DNA, 25 bp, S. cerevisiae
aatcagggtcggtatcattcatgcc

SEQ ID NO: 19568 - DNA, 25 bp, S. cerevisiae
aatcgctgggcagaaatccaccaag

SEQ ID NO: 19569 - DNA, 25 bp, S. cerevisiae
aatcgggcaacaaccaagcaccata

SEQ ID NO: 19570 - DNA, 25 bp, S. cerevisiae
aatccaggaactgccagaacgcgaa

SEQ ID NO: 19571 - DNA, 25 bp, S. cerevisiae
aatcctctggatggtatcgctactt

SEQ ID NO: 19572 - DNA, 25 bp, S. cerevisiae
aatgccctgggaattcttctctttt

SEQ ID NO: 19573 - DNA, 25 bp, S. cerevisiae
aatccgcagtggtattagtctttct

SEQ ID NO: 19574 - DNA, 25 bp, S. cerevisiae
aatccgctgatgtggttcttcttga

SEQ ID NO: 19575 - DNA, 25 bp, S. cerevisiae
aatgccggtacatctagtgtatcaa

SEQ ID NO: 19576 - DNA, 25 bp, S. cerevisiae
aatgccacgttttctagcgaacaag

SEQ ID NO: 19577 - DNA, 25 bp, S. cerevisiae
aatccacattcaaaccctcgaaata

SEQ ID NO: 19578 - DNA, 25 bp, S. cerevisiae
aatccactcctgaaccacttaaaga

SEQ ID NO: 19579 - DNA, 25 bp, S. cerevisiae
aatccattcgtcgttccttagaaca

SEQ ID NO: 19580 - DNA, 25 bp, S. cerevisiae
aatccattcgttctcatcatctaac

SEQ ID NO: 19581 - DNA, 25 bp, S. cerevisiae
aatccatgtcccctggctataaagc

SEQ ID NO: 19582 - DNA, 25 bp, S. cerevisiae
caaccaatactcctcgtaattacca

SEQ ID NO: 19583 - DNA, 25 bp, S. cerevisiae
aatcctacaacctgcttactacaag

SEQ ID NO: 19584 - DNA, 25 bp, S. cerevisiae
aatcgacaaatgaagaccttgccaa

SEQ ID NO: 19585 - DNA, 25 bp, S. cerevisiae
aatccaatgaagaagctcccagaaa

SEQ ID NO: 19586 - DNA, 25 bp, S. cerevisiae
aatcgcgcgaagtttccagatctta

SEQ ID NO: 19587 - DNA, 25 bp, S. cerevisiae
aatcttgtccaatgtatagcagtaa

SEQ ID NO: 19588 - DNA, 25 bp, S. cerevisiae
aatctgctcccgtagaaactgtaca

SEQ ID NO: 19589 - DNA, 25 bp, S. cerevisiae
aatccttgcctgtacatatatgtga

SEQ ID NO: 19590 - DNA, 25 bp, S. cerevisiae
aatgcggccgcactgggtattgcca

SEQ ID NO: 19591 - DNA, 25 bp, S. cerevisiae
aatgctgtctggttagtcttcgcta

SEQ ID NO: 19592 - DNA, 25 bp, S. cerevisiae
aatcgattccaatatcgctccacat

SEQ ID NO: 19593 - DNA, 25 bp, S. cerevisiae
aatcgatattccaaacggctccata

SEQ ID NO: 19594 - DNA, 25 bp, S. cerevisiae
aatgcgtttgtaccactttctgttt

SEQ ID NO: 19595 - DNA, 25 bp, S. cerevisiae
aatgcctcttactcattctttgatg

SEQ ID NO: 19596 - DNA, 25 bp, S. cerevisiae
aatcgtttggccatcgtttgcgaaa

SEQ ID NO: 19597 - DNA, 25 bp, S. cerevisiae
aatcgcccgcgaagaagactgcagc

SEQ ID NO: 19598 - DNA, 25 bp, S. cerevisiae
aatcgcaacccaaaacactggagtt

SEQ ID NO: 19599 - DNA, 25 bp, S. cerevisiae
aatcgcccagccaaaatcgtgaatt

SEQ ID NO: 19600 - DNA, 25 bp, S. cerevisiae
aatccggcagcgttgaatttattac

SEQ ID NO: 19601 - DNA, 25 bp, S. cerevisiae
aatcccgccgcatatgatttagcga

SEQ ID NO: 19602 - DNA, 25 bp, S. cerevisiae
aatccggccaatatgatatcctgtg

SEQ ID NO: 19603 - DNA, 25 bp, S. cerevisiae
aatgcgctggccaaagactattctt

SEQ ID NO: 19604 - DNA, 25 bp, S. cerevisiae
aatgccgtattaggctctaacgttg

SEQ ID NO: 19605 - DNA, 25 bp, S. cerevisiae
aatgccgtcaaatccttacgctttg

SEQ ID NO: 19606 - DNA, 25 bp, S. cerevisiae
aatgcccttgagttattgtacctta

SEQ ID NO: 19607 - DNA, 25 bp, S. cerevisiae
aatgcccattgaactttataacgga

SEQ ID NO: 19608 - DNA, 25 bp, S. cerevisiae
aatcgactagcaactttaacacagg

SEQ ID NO: 19609 - DNA, 25 bp, S. cerevisiae
aataaacactatgccgcaaccacgt

SEQ ID NO: 19610 - DNA, 25 bp, S. cerevisiae
aatctgtagtatctgtcgggttgac

SEQ ID NO: 19611 - DNA, 25 bp, S. cerevisiae
aatcggagtcattaacggcaagttc

SEQ ID NO: 19612 - DNA, 25 bp, S. cerevisiae
aatgccacgatttctatcacgctat

SEQ ID NO: 19613 - DNA, 25 bp, S. cerevisiae
aatccaagagctttgatagcgccat

SEQ ID NO: 19614 - DNA, 25 bp, S. cerevisiae
aatccagctggtttgcaaagcaatg

SEQ ID NO: 19615 - DNA, 25 bp, S. cerevisiae
aatcccagcctactgcaaagcagca

SEQ ID NO: 19616 - DNA, 25 bp, S. cerevisiae
aatatcaactctttcgaccaatggg

SEQ ID NO: 19617 - DNA, 25 bp, S. cerevisiae
aatatcgtgcccacgcaaacagggt

SEQ ID NO: 19618 - DNA, 25 bp, S. cerevisiae
aattggtgccagtgctttaggtggt

SEQ ID NO: 19619 - DNA, 25 bp, S. cerevisiae
aattggtcatcgtgtttacaacagt

SEQ ID NO: 19620 - DNA, 25 bp, S. cerevisiae
aatcgggcattcagtatttcagaag

SEQ ID NO: 19621 - DNA, 25 bp, S. cerevisiae
aatcgtgcctcctgttttatcaaac

SEQ ID NO: 19622 - DNA, 25 bp, S. cerevisiae
aatccagtatatttccattgcagtg

SEQ ID NO: 19623 - DNA, 25 bp, S. cerevisiae
aatccagtgcagaatcttccaacgc

SEQ ID NO: 19624 - DNA, 25 bp, S. cerevisiae
aatctttatgcagttcacggtccag

SEQ ID NO: 19625 - DNA, 25 bp, S. cerevisiae
aatcttcatgcctgattgtgggcca

SEQ ID NO: 19626 - DNA, 25 bp, S. cerevisiae
aatcatccagtaaccgtagttgcgt

SEQ ID NO: 19627 - DNA, 25 bp, S. cerevisiae
aataagtgcttattttagcgaattt

SEQ ID NO: 19628 - DNA, 25 bp, S. cerevisiae
aatagttggccagatttcgcgaata

SEQ ID NO: 19629 - DNA, 25 bp, S. cerevisiae
aataggatacctgtgatttgcgaaa

SEQ ID NO: 19630 - DNA, 25 bp, S. cerevisiae
aatcggtcccggaactgcacgaaat

SEQ ID NO: 19631 - DNA, 25 bp, S. cerevisiae
aataagtctcggctaccacagaaga

SEQ ID NO: 19632 - DNA, 25 bp, S. cerevisiae
aataaacacggcttgaacgattgga

SEQ ID NO: 19633 - DNA, 25 bp, S. cerevisiae
aatcgttcaataatggcccaggtgc

SEQ ID NO: 19634 - DNA, 25 bp, S. cerevisiae
aatcgaggctgtattcaaatggctt

SEQ ID NO: 19635 - DNA, 25 bp, S. cerevisiae
aatgccattgcgttagctaagggaa

SEQ ID NO: 19636 - DNA, 25 bp, S. cerevisiae
aatgccacggatttcgattctgttt

SEQ ID NO: 19637 - DNA, 25 bp, S. cerevisiae
aatcttcctgatatccatacttggg

SEQ ID NO: 19638 - DNA, 25 bp, S. cerevisiae
aatctggtgcgtaaactgacctcgg

SEQ ID NO: 19639 - DNA, 25 bp, S. cerevisiae
aatctggtcctttactacagtggaa

SEQ ID NO: 19640 - DNA, 25 bp, S. cerevisiae
aatctagaccctttcatattttgga

SEQ ID NO: 19641 - DNA, 25 bp, S. cerevisiae
aatctcatccaacaatgtgcctgtc

SEQ ID NO: 19642 - DNA, 25 bp, S. cerevisiae
aatacccgaggattgatacttccag

SEQ ID NO: 19643 - DNA, 25 bp, S. cerevisiae
aatctccaggttacttaggtcaagc

SEQ ID NO: 19644 - DNA, 25 bp, S. cerevisiae
aatagtcgcactctacggtgtcaag

SEQ ID NO: 19645 - DNA, 25 bp, S. cerevisiae
aatctgcccacaatattcggttcaa

SEQ ID NO: 19646 - DNA, 25 bp, S. cerevisiae
aatccgccgagaattcaggtaaaca

SEQ ID NO: 19647 - DNA, 25 bp, S. cerevisiae
aatcaccactaaaatcacctaaaca

SEQ ID NO: 19648 - DNA, 25 bp, S. cerevisiae
aatgccacccaaatacatgctctat

SEQ ID NO: 19649 - DNA, 25 bp, S. cerevisiae
aatccactccaaaggatgcggcacg

SEQ ID NO: 19650 - DNA, 25 bp, S. cerevisiae
aatgccgtcgatgggaatcttatct

SEQ ID NO: 19651 - DNA, 25 bp, S. cerevisiae
aatccgaagagcgagacactgtatc

SEQ ID NO: 19652 - DNA, 25 bp, S. cerevisiae
aatcctagaccgtatcatgtgaaca

SEQ ID NO: 19653 - DNA, 25 bp, S. cerevisiae
aatcctaacatcattaatgcgatca

SEQ ID NO: 19654 - DNA, 25 bp, S. cerevisiae
aatcgcaataccaatgtgaggcaac

SEQ ID NO: 19655 - DNA, 25 bp, S. cerevisiae
aatcaatatcccctttaccaatgtg

SEQ ID NO: 19656 - DNA, 25 bp, S. cerevisiae
aatcgttaggtgctcaatcttcatt

SEQ ID NO: 19657 - DNA, 25 bp, S. cerevisiae
aatctgcttacggacatactgttca

SEQ ID NO: 19658 - DNA, 25 bp, S. cerevisiae
aatcgctaccaggacattcattcac

SEQ ID NO: 19659 - DNA, 25 bp, S. cerevisiae
aatcctgcagcaaatcatattccta

SEQ ID NO: 19660 - DNA, 25 bp, S. cerevisiae
aatcctgacaatttttctatgggca

SEQ ID NO: 19661 - DNA, 25 bp, S. cerevisiae
aataataatttccactccaacactc

SEQ ID NO: 19662 - DNA, 25 bp, S. cerevisiae
aatctcagggtcagacacttccaaa

SEQ ID NO: 19663 - DNA, 25 bp, S. cerevisiae
aatccaggcgtcatgataattcatc

SEQ ID NO: 19664 - DNA, 25 bp, S. cerevisiae
aatccaatggacttctactctcatc

SEQ ID NO: 19665 - DNA, 25 bp, S. cerevisiae
aatcgcattcggagcagtagccata

SEQ ID NO: 19666 - DNA, 25 bp, S. cerevisiae
aatacagcgggttctatcggtacaa

SEQ ID NO: 19667 - DNA, 25 bp, S. cerevisiae
aatcggccgggaccatatgaattta

SEQ ID NO: 19668 - DNA, 25 bp, S. cerevisiae
aatctggccgtgtttctagacatac

SEQ ID NO: 19669 - DNA, 25 bp, S. cerevisiae
aatcatctgtcgatactgggttgca

SEQ ID NO: 19670 - DNA, 25 bp, S. cerevisiae
aatccacgcgcagtgtggcaagctt

SEQ ID NO: 19671 - DNA, 25 bp, S. cerevisiae
aatcgtctgctaatggtgcgactcc

SEQ ID NO: 19672 - DNA, 25 bp, S. cerevisiae
aatctgatagtccagagtccaccgc

SEQ ID NO: 19673 - DNA, 25 bp, S. cerevisiae
aatcgtcagtcaagattccggcgct

SEQ ID NO: 19674 - DNA, 25 bp, S. cerevisiae
aatcgatgagctgccattactgtgg

SEQ ID NO: 19675 - DNA, 25 bp, S. cerevisiae
aatccagagcctcagtacgctggta

SEQ ID NO: 19676 - DNA, 25 bp, S. cerevisiae
aatcgatgaagcactacgtcagttg

SEQ ID NO: 19677 - DNA, 25 bp, S. cerevisiae
aatcgctgctaaactgcaggctctt

SEQ ID NO: 19678 - DNA, 25 bp, S. cerevisiae
aatcctgacaaccagcagttcttct

SEQ ID NO: 19679 - DNA, 25 bp, S. cerevisiae
aatctggatgaatgaaaccctttat

SEQ ID NO: 19680 - DNA, 25 bp, S. cerevisiae
aatccaggttttttgaggcgtcatt

SEQ ID NO: 19681 - DNA, 25 bp, S. cerevisiae
aatccacagtcggtttgttggctca

SEQ ID NO: 19682 - DNA, 25 bp, S. cerevisiae
aatcgcgctgtcattatcgttggtg

SEQ ID NO: 19683 - DNA, 25 bp, S. cerevisiae
aatccgttcattatcatccacagca

SEQ ID NO: 19684 - DNA, 25 bp, S. cerevisiae
aatccctcaatctgatgttggtacg

SEQ ID NO: 19685 - DNA, 25 bp, S. cerevisiae
aatccttgcaattgtgggtggtgac

SEQ ID NO: 19686 - DNA, 25 bp, S. cerevisiae
aatcccaaatgacgtttctaagcag

SEQ ID NO: 19687 - DNA, 25 bp, S. cerevisiae
aatccacagattatttcactacaga

SEQ ID NO: 19688 - DNA, 25 bp, S. cerevisiae
aatcccagaggaattgttgcccatc

SEQ ID NO: 19689 - DNA, 25 bp, S. cerevisiae
aatcctcaagatatcaagtccgcat

SEQ ID NO: 19690 - DNA, 25 bp, S. cerevisiae
aatccatcagagttggcggctacaa

SEQ ID NO: 19691 - DNA, 25 bp, S. cerevisiae
aatccggcgataccattgagaattt

SEQ ID NO: 19692 - DNA, 25 bp, S. cerevisiae
aatcaccaagaaccctagcacttat

SEQ ID NO: 19693 - DNA, 25 bp, S. cerevisiae
aatcctgatgatattgcaaaaccct

SEQ ID NO: 19694 - DNA, 25 bp, S. cerevisiae
aatcttgcgttcatgctggaaccct

SEQ ID NO: 19695 - DNA, 25 bp, S. cerevisiae
aatcagtggccaactctgggccggc

SEQ ID NO: 19696 - DNA, 25 bp, S. cerevisiae
aatcttgagacatctgaccccggct

SEQ ID NO: 19697 - DNA, 25 bp, S. cerevisiae
aatcatggaaatgagccccgaggct

SEQ ID NO: 19698 - DNA, 25 bp, S. cerevisiae
aatcttgctatatcaggcgacgggt

SEQ ID NO: 19699 - DNA, 25 bp, S. cerevisiae
aatctatgttcactctggcgtgcta

SEQ ID NO: 19700 - DNA, 25 bp, S. cerevisiae
aatctgtgtcaatctgtgggatcat

SEQ ID NO: 19701 - DNA, 25 bp, S. cerevisiae
aatctttgattgtctgggccatcca

SEQ ID NO: 19702 - DNA, 25 bp, S. cerevisiae
aatcactcgagctcattgacgatcc

SEQ ID NO: 19703 - DNA, 25 bp, S. cerevisiae
aatctaccgatattgctgctatgca

SEQ ID NO: 19704 - DNA, 25 bp, S. cerevisiae
aatctggcggtatcatccatgaata

SEQ ID NO: 19705 - DNA, 25 bp, S. cerevisiae
aatctggcgtggtgcatcgcgacat

SEQ ID NO: 19706 - DNA, 25 bp, S. cerevisiae
aatctgggcgactatgggtctgcaa

SEQ ID NO: 19707 - DNA, 25 bp, S. cerevisiae
aatcgaagaacaacatcctctggaa

SEQ ID NO: 19708 - DNA, 25 bp, S. cerevisiae
aatctacaattttcccctgatggtc

SEQ ID NO: 19709 - DNA, 25 bp, S. cerevisiae
aatcccaggtatcatcagagtcact

SEQ ID NO: 19710 - DNA, 25 bp, S. cerevisiae
aatcggctctttagacttcttcagg

SEQ ID NO: 19711 - DNA, 25 bp, S. cerevisiae
aatcgaatttgtgtggttgtcagca

SEQ ID NO: 19712 - DNA, 25 bp, S. cerevisiae
aatcatttgattctcgttggcgaca

SEQ ID NO: 19713 - DNA, 25 bp, S. cerevisiae
aatcggttccattgccattggcgaa

SEQ ID NO: 19714 - DNA, 25 bp, S. cerevisiae
aatcgtttgacatgccattgggtcc

SEQ ID NO: 19715 - DNA, 25 bp, S. cerevisiae
aatccttcatcaactggctcggtga

SEQ ID NO: 19716 - DNA, 25 bp, S. cerevisiae
aatcgtttgttggtgctcatttgag

SEQ ID NO: 19717 - DNA, 25 bp, S. cerevisiae
aatcctgcgtattccactgttcgtt

SEQ ID NO: 19718 - DNA, 25 bp, S. cerevisiae
aatcccgttgatggcagtattattg

SEQ ID NO: 19719 - DNA, 25 bp, S. cerevisiae
aatctgctattatcaatgttcttgc

SEQ ID NO: 19720 - DNA, 25 bp, S. cerevisiae
aatccgctcttggtatgaacttgtt

SEQ ID NO: 19721 - DNA, 25 bp, S. cerevisiae
aatcctggttctgatctcctaagat

SEQ ID NO: 19722 - DNA, 25 bp, S. cerevisiae
aatcgtcaaattcaatgccctggga

SEQ ID NO: 19723 - DNA, 25 bp, S. cerevisiae
aatcgtcaacaattggttccaggaa

SEQ ID NO: 19724 - DNA, 25 bp, S. cerevisiae
aatcttcgtcaattgtctcatcaca

SEQ ID NO: 19725 - DNA, 25 bp, S. cerevisiae
aatcgttttcttccatttagcatga

SEQ ID NO: 19726 - DNA, 25 bp, S. cerevisiae
aatcttcttgggtcaacttgtggaa

SEQ ID NO: 19727 - DNA, 25 bp, S. cerevisiae
aatcttctcagcatgtggacttgga

SEQ ID NO: 19728 - DNA, 25 bp, S. cerevisiae
aatcattcacgcttgctacgttgta

SEQ ID NO: 19729 - DNA, 25 bp, S. cerevisiae
aatctggatttctacagccgacgct

SEQ ID NO: 19730 - DNA, 25 bp, S. cerevisiae
aatctggtttctaatgcgccgatcg

SEQ ID NO: 19731 - DNA, 25 bp, S. cerevisiae
aatcgggtctgaatttgcgcaactg

SEQ ID NO: 19732 - DNA, 25 bp, S. cerevisiae
aattccgacattatatacaccccta

SEQ ID NO: 19733 - DNA, 25 bp, S. cerevisiae
aatccggatgcttggttatctgaac

SEQ ID NO: 19734 - DNA, 25 bp, S. cerevisiae
aatccgtatgcatatttgtcgcact

SEQ ID NO: 19735 - DNA, 25 bp, S. cerevisiae
aatcctggcgatatactggcaacct

SEQ ID NO: 19736 - DNA, 25 bp, S. cerevisiae
aatcgctctggtacttttgatacac

SEQ ID NO: 19737 - DNA, 25 bp, S. cerevisiae
aatcacacggaacacctctgagtag

SEQ ID NO: 19738 - DNA, 25 bp, S. cerevisiae
aatcatcatctggaaggcgcgtcat

SEQ ID NO: 19739 - DNA, 25 bp, S. cerevisiae
catcgttaccgtcggccaatgtaga

SEQ ID NO: 19740 - DNA, 25 bp, S. cerevisiae
catcgttactggtggtaatggccca

SEQ ID NO: 19741 - DNA, 25 bp, S. cerevisiae
cttggtccgtagagacagggcccaa

SEQ ID NO: 19742 - DNA, 25 bp, S. cerevisiae
cttgggccgcttactggaggtttgc

SEQ ID NO: 19743 - DNA, 25 bp, S. cerevisiae
cccggcgtcgatcaggagtacttaa

SEQ ID NO: 19744 - DNA, 25 bp, S. cerevisiae
cggcgagggcaaacgagattccttt

SEQ ID NO: 19745 - DNA, 25 bp, S. cerevisiae
cggtatcaggatacggtcgtccttt

SEQ ID NO: 19746 - DNA, 25 bp, S. cerevisiae
taagtatacgagagcccgtcctggt

SEQ ID NO: 19747 - DNA, 25 bp, S. cerevisiae
aatatcagcaccatttccgggtttc

SEQ ID NO: 19748 - DNA, 25 bp, S. cerevisiae
aatcattcaccaatattccgggcgt

SEQ ID NO: 19749 - DNA, 25 bp, S. cerevisiae
aatcgccaactaattcccaagcagt

SEQ ID NO: 19750 - DNA, 25 bp, S. cerevisiae
aatcgggcgtactatcagccaagcc

SEQ ID NO: 19751 - DNA, 25 bp, S. cerevisiae
aatcgggcgctttgtcgagatcaga

SEQ ID NO: 19752 - DNA, 25 bp, S. cerevisiae
caagttactattgccggtatacata

SEQ ID NO: 19753 - DNA, 25 bp, S. cerevisiae
aatcttactattctgcggcaacgag

SEQ ID NO: 19754 - DNA, 25 bp, S. cerevisiae
aatcttttgagtctcctgaaccaga

SEQ ID NO: 19755 - DNA, 25 bp, S. cerevisiae
aatcggttggtgtttaggtgcgtca

SEQ ID NO: 19756 - DNA, 25 bp, S. cerevisiae
aatcgtccatcaaattctcacaggc

SEQ ID NO: 19757 - DNA, 25 bp, S. cerevisiae
aatctgttgctaaaccaaaggctga

SEQ ID NO: 19758 - DNA, 25 bp, S. cerevisiae
aatctcactgttaactttacccttg

SEQ ID NO: 19759 - DNA, 25 bp, S. cerevisiae
aatacaggcaactctgggcctacaa

SEQ ID NO: 19760 - DNA, 25 bp, S. cerevisiae
aatctttatcattccgtggtcgtct

SEQ ID NO: 19761 - DNA, 25 bp, S. cerevisiae
aatcacgtgaatgccatcccaagaa

SEQ ID NO: 19762 - DNA, 25 bp, S. cerevisiae
aattcagggatctaatgggtaccac

SEQ ID NO: 19763 - DNA, 25 bp, S. cerevisiae
aatctgaggtcctagaggcagtgac

SEQ ID NO: 19764 - DNA, 25 bp, S. cerevisiae
aatctgatacccaagaggcaaacga

SEQ ID NO: 19765 - DNA, 25 bp, S. cerevisiae
aatctgggttggttgttctacatcc

SEQ ID NO: 19766 - DNA, 25 bp, S. cerevisiae
aatcggtgtccagaggatttgcctc

SEQ ID NO: 19767 - DNA, 25 bp, S. cerevisiae
aatcgggatctcttgaggatatcac

SEQ ID NO: 19768 - DNA, 25 bp, S. cerevisiae
aatcatatcttgtatgcggcccgca

SEQ ID NO: 19769 - DNA, 25 bp, S. cerevisiae
aatcatgctttgaatctggaagacg

SEQ ID NO: 19770 - DNA, 25 bp, S. cerevisiae
aatcgacttcaactcgaagagtaag

SEQ ID NO: 19771 - DNA, 25 bp, S. cerevisiae
aataagtttgtcatggagatagcca

SEQ ID NO: 19772 - DNA, 25 bp, S. cerevisiae
aatacgagattgtcccgaatacgaa

SEQ ID NO: 19773 - DNA, 25 bp, S. cerevisiae
aatcaaggttgacccactttcgcaa

SEQ ID NO: 19774 - DNA, 25 bp, S. cerevisiae
aatcaagggctccaaactgtctctg

SEQ ID NO: 19775 - DNA, 25 bp, S. cerevisiae
aatacaacgatttaggtgccttagc

SEQ ID NO: 19776 - DNA, 25 bp, S. cerevisiae
aatcaattccgttaatcccttactg

SEQ ID NO: 19777 - DNA, 25 bp, S. cerevisiae
aatcatggacttttggtttgccctc

SEQ ID NO: 19778 - DNA, 25 bp, S. cerevisiae
aatcacgtgatatttcttttcactc

SEQ ID NO: 19779 - DNA, 25 bp, S. cerevisiae
aatcgcattatatcgcatctttcaa

SEQ ID NO: 19780 - DNA, 25 bp, S. cerevisiae
aatcgctttgtacctctgtcaatga

SEQ ID NO: 19781 - DNA, 25 bp, S. cerevisiae
aatcgttcgttgacaatggcaatcc

SEQ ID NO: 19782 - DNA, 25 bp, S. cerevisiae
aatcttcctcattgtggctcttagg

SEQ ID NO: 19783 - DNA, 25 bp, S. cerevisiae
aatcttccactaaacctctatggtg

SEQ ID NO: 19784 - DNA, 25 bp, S. cerevisiae
aatctacctttcttccatatcgata

SEQ ID NO: 19785 - DNA, 25 bp, S. cerevisiae
aatcgatgccatttttcttccataa

SEQ ID NO: 19786 - DNA, 25 bp, S. cerevisiae
aatacttccctgatttgcccaaaga

SEQ ID NO: 19787 - DNA, 25 bp, S. cerevisiae
aatcacctttctttattgcgggaat

SEQ ID NO: 19788 - DNA, 25 bp, S. cerevisiae
aatcggttctgtagtaggcgtcgaa

SEQ ID NO: 19789 - DNA, 25 bp, S. cerevisiae
aatcaacgttttaagcgacctcctg

SEQ ID NO: 19790 - DNA, 25 bp, S. cerevisiae
aataacggtgttttcggtgccgctg

SEQ ID NO: 19791 - DNA, 25 bp, S. cerevisiae
aataccggcattcaacgagtacgcg

SEQ ID NO: 19792 - DNA, 25 bp, S. cerevisiae
aatactaccccggtttcagatctat

SEQ ID NO: 19793 - DNA, 25 bp, S. cerevisiae
aatacacccctcagatttacgaatg

SEQ ID NO: 19794 - DNA, 25 bp, S. cerevisiae
aatatcagaattcaaacctacggtg

SEQ ID NO: 19795 - DNA, 25 bp, S. cerevisiae
aattagaaccaatctccgacgaatt

SEQ ID NO: 19796 - DNA, 25 bp, S. cerevisiae
aatctaggaggaatttggccgccat

SEQ ID NO: 19797 - DNA, 25 bp, S. cerevisiae
aatctgggaagtttctccgcctcat

SEQ ID NO: 19798 - DNA, 25 bp, S. cerevisiae
aataggtaagcatgctctcggccct

SEQ ID NO: 19799 - DNA, 25 bp, S. cerevisiae
aatagaggatacaagccctccctct

SEQ ID NO: 19800 - DNA, 25 bp, S. cerevisiae
aatacggaagttggccagttcttag

SEQ ID NO: 19801 - DNA, 25 bp, S. cerevisiae
aatacgctgtacgtgagccagctta

SEQ ID NO: 19802 - DNA, 25 bp, S. cerevisiae
aatcatatctgtccgcatgagggct

SEQ ID NO: 19803 - DNA, 25 bp, S. cerevisiae
aatcatcagcgtactggcaggcggt

SEQ ID NO: 19804 - DNA, 25 bp, S. cerevisiae
aataacagcatcgatggcagccgcg

SEQ ID NO: 19805 - DNA, 25 bp, S. cerevisiae
aatcagctactggaggatgccgtga

SEQ ID NO: 19806 - DNA, 25 bp, S. cerevisiae
aatctctcactgacgtcttttacat

SEQ ID NO: 19807 - DNA, 25 bp, S. cerevisiae
aatctagtcctcacacttctaattg

SEQ ID NO: 19808 - DNA, 25 bp, S. cerevisiae
aatcagctggtgtttcgttgttttc

SEQ ID NO: 19809 - DNA, 25 bp, S. cerevisiae
aatcgtgctttttcggatctttcca

SEQ ID NO: 19810 - DNA, 25 bp, S. cerevisiae
aatcggctgttgtagcggttatacc

SEQ ID NO: 19811 - DNA, 25 bp, S. cerevisiae
aatcatgttgccagtcttcgatgct

SEQ ID NO: 19812 - DNA, 25 bp, S. cerevisiae
aatctgttggtggtctttactgtaa

SEQ ID NO: 19813 - DNA, 25 bp, S. cerevisiae
aatcactgggtgttgctttctatag

SEQ ID NO: 19814 - DNA, 25 bp, S. cerevisiae
aatacggtgtagctggtcaatatcc

SEQ ID NO: 19815 - DNA, 25 bp, S. cerevisiae
aatacgtttcatccgagctagactc

SEQ ID NO: 19816 - DNA, 25 bp, S. cerevisiae
caatgtcgcttttgggactagtccc

SEQ ID NO: 19817 - DNA, 25 bp, S. cerevisiae
caatacagcaggacagaggactcgt

SEQ ID NO: 19818 - DNA, 25 bp, S. cerevisiae
aatctgcctgtgaaggtgtgctcgt

SEQ ID NO: 19819 - DNA, 25 bp, S. cerevisiae
aatcaggctcagtatcgtggccgtt

SEQ ID NO: 19820 - DNA, 25 bp, S. cerevisiae
aatcaacgatggtgctgcagccgtc

SEQ ID NO: 19821 - DNA, 25 bp, S. cerevisiae
aatcattattgacactgaccctaac

SEQ ID NO: 19822 - DNA, 25 bp, S. cerevisiae
aatcatattctgagttccgccgcaa

SEQ ID NO: 19823 - DNA, 25 bp, S. cerevisiae
aatcaattggttttcgctgacccaa

SEQ ID NO: 19824 - DNA, 25 bp, S. cerevisiae
aatctagacttcaaccttttgaggg

SEQ ID NO: 19825 - DNA, 25 bp, S. cerevisiae
aatcttggtattgccctttgtgtag

SEQ ID NO: 19826 - DNA, 25 bp, S. cerevisiae
aatcagttcattgcagtggtatccg

SEQ ID NO: 19827 - DNA, 25 bp, S. cerevisiae
aatcagattacctgtcaatatgcca

SEQ ID NO: 19828 - DNA, 25 bp, S. cerevisiae
aatcgattcagccatcagatgaggt

SEQ ID NO: 19829 - DNA, 25 bp, S. cerevisiae
aatcggttgtgcattgtccccagtg

SEQ ID NO: 19830 - DNA, 25 bp, S. cerevisiae
aatcggtattgtcgaaatctctcca

SEQ ID NO: 19831 - DNA, 25 bp, S. cerevisiae
aatcgtcatacgcttgctctggaga

SEQ ID NO: 19832 - DNA, 25 bp, S. cerevisiae
aatctgtcaaaagacgtggcgtttt

SEQ ID NO: 19833 - DNA, 25 bp, S. cerevisiae
aatctgttaaaggtcacgccgtctt

SEQ ID NO: 19834 - DNA, 25 bp, S. cerevisiae
aatcggtattatttccagatcggga

SEQ ID NO: 19835 - DNA, 25 bp, S. cerevisiae
aatagaatggttcctccagttggga

SEQ ID NO: 19836 - DNA, 25 bp, S. cerevisiae
aatcaagctgctttggactaccatg

SEQ ID NO: 19837 - DNA, 25 bp, S. cerevisiae
aatcagagcctcttcgttaagtggg

SEQ ID NO: 19838 - DNA, 25 bp, S. cerevisiae
aatagaccaccctattccaagggag

SEQ ID NO: 19839 - DNA, 25 bp, S. cerevisiae
aataggccaaccagttcaattcaag

SEQ ID NO: 19840 - DNA, 25 bp, S. cerevisiae
aatatggccctcgtgggtattgtac

SEQ ID NO: 19841 - DNA, 25 bp, S. cerevisiae
ctaacgcccgcttgggtaaatacat

SEQ ID NO: 19842 - DNA, 25 bp, S. cerevisiae
aatactgctggccataattaacgat

SEQ ID NO: 19843 - DNA, 25 bp, S. cerevisiae
aataactccgttctagatgctttga

SEQ ID NO: 19844 - DNA, 25 bp, S. cerevisiae
aataggaccctctctcaacatgtgg

SEQ ID NO: 19845 - DNA, 25 bp, S. cerevisiae
aatatggcctaccacctggaagggt

SEQ ID NO: 19846 - DNA, 25 bp, S. cerevisiae
aatcaagcttccgtcactggacagt

SEQ ID NO: 19847 - DNA, 25 bp, S. cerevisiae
aatcaacctctcatcacattacaaa

SEQ ID NO: 19848 - DNA, 25 bp, S. cerevisiae
aatataccacgatgccagaaagagt

SEQ ID NO: 19849 - DNA, 25 bp, S. cerevisiae
aataatcaccgaggccgctaagact

SEQ ID NO: 19850 - DNA, 25 bp, S. cerevisiae
aatcttacctgattccttgaacctg

SEQ ID NO: 19851 - DNA, 25 bp, S. cerevisiae
aatcaaagcctcatgttggcgatga

SEQ ID NO: 19852 - DNA, 25 bp, S. cerevisiae
aatcagcctacccagttttataacg

SEQ ID NO: 19853 - DNA, 25 bp, S. cerevisiae
aatcttgaatggtatcgccaagcaa

SEQ ID NO: 19854 - DNA, 25 bp, S. cerevisiae
aatctatgttttgcctcagagtagc

SEQ ID NO: 19855 - DNA, 25 bp, S. cerevisiae
aatagcggtcaagcttccaatcaag

SEQ ID NO: 19856 - DNA, 25 bp, S. cerevisiae
aatcatacggagaattaccctttag

SEQ ID NO: 19857 - DNA, 25 bp, S. cerevisiae
aatcaacctagagctcgaccatatt

SEQ ID NO: 19858 - DNA, 25 bp, S. cerevisiae
aatcatcaccaatcactccaagtat

SEQ ID NO: 19859 - DNA, 25 bp, S. cerevisiae
aatcagaccgaatttccagcagttg

SEQ ID NO: 19860 - DNA, 25 bp, S. cerevisiae
aatcacccgttttcacaaggatgcg

SEQ ID NO: 19861 - DNA, 25 bp, S. cerevisiae
aatcacctagcttttgcaaacgtcc

SEQ ID NO: 19862 - DNA, 25 bp, S. cerevisiae
aatctttctcataatcaacccactg

SEQ ID NO: 19863 - DNA, 25 bp, S. cerevisiae
aatcttccatctaacgttccattat

SEQ ID NO: 19864 - DNA, 25 bp, S. cerevisiae
aatctttgttggtcacttgttgcgg

SEQ ID NO: 19865 - DNA, 25 bp, S. cerevisiae
aatctatcatttctccactttcgca

SEQ ID NO: 19866 - DNA, 25 bp, S. cerevisiae
aatcttgttgatttggccggttccg

SEQ ID NO: 19867 - DNA, 25 bp, S. cerevisiae
aatatggtgtgctggtgccggtacc

SEQ ID NO: 19868 - DNA, 25 bp, S. cerevisiae
aatagcactgtgttgaggcccgttc

SEQ ID NO: 19869 - DNA, 25 bp, S. cerevisiae
aatagacgctcattctcccgtagta

SEQ ID NO: 19870 - DNA, 25 bp, S. cerevisiae
aatagacctgatacaccgagtgggc

SEQ ID NO: 19871 - DNA, 25 bp, S. cerevisiae
aatatgacacatgcccgtttagaac

SEQ ID NO: 19872 - DNA, 25 bp, S. cerevisiae
aatagcaacatcacctgtccatgaa

SEQ ID NO: 19873 - DNA, 25 bp, S. cerevisiae
aatcagagtctcacttgtccataaa

SEQ ID NO: 19874 - DNA, 25 bp, S. cerevisiae
aatactatcaaccacaaccgatgta

SEQ ID NO: 19875 - DNA, 25 bp, S. cerevisiae
aataactcgtctgatcaccatttgc

SEQ ID NO: 19876 - DNA, 25 bp, S. cerevisiae
aatcaaacgattctgcaactggctg

SEQ ID NO: 19877 - DNA, 25 bp, S. cerevisiae
cttgcaaggagctacggaacggtct

SEQ ID NO: 19878 - DNA, 25 bp, S. cerevisiae
catcgactgatgctacggtaaggtt

SEQ ID NO: 19879 - DNA, 25 bp, S. cerevisiae
gtaccaaggcatggctgggtcattg

SEQ ID NO: 19880 - DNA, 25 bp, S. cerevisiae
aatctggttctaaagttctcgtgag

SEQ ID NO: 19881 - DNA, 25 bp, S. cerevisiae
aatctcacctctgattctactactt

SEQ ID NO: 19882 - DNA, 25 bp, S. cerevisiae
aatacacctgccaagactacatatc

SEQ ID NO: 19883 - DNA, 25 bp, S. cerevisiae
aataatctaagttacctgatacaag

SEQ ID NO: 19884 - DNA, 25 bp, S. cerevisiae
aatacacatatacttaccctaccac

SEQ ID NO: 19885 - DNA, 25 bp, S. cerevisiae
aataaactatggatcccacgctctc

SEQ ID NO: 19886 - DNA, 25 bp, S. cerevisiae
aatagaaatatcacccaggcaggat

SEQ ID NO: 19887 - DNA, 25 bp, S. cerevisiae
aataaaacccagcagcttatcaaga

SEQ ID NO: 19888 - DNA, 25 bp, S. cerevisiae
aatcaaacctctgctaagatctcaa

SEQ ID NO: 19889 - DNA, 25 bp, S. cerevisiae
cattgagaaactattgggaccgaac

SEQ ID NO: 19890 - DNA, 25 bp, S. cerevisiae
aatagtattcttatagggcacggac

SEQ ID NO: 19891 - DNA, 25 bp, S. cerevisiae
aatagttgatctttttcccacgaag

SEQ ID NO: 19892 - DNA, 25 bp, S. cerevisiae
aataatgggctctttgtcaaacgaa

SEQ ID NO: 19893 - DNA, 25 bp, S. cerevisiae
aatcaactctggtacattcgtcaaa

SEQ ID NO: 19894 - DNA, 25 bp, S. cerevisiae
aatctatgcgattcttttcgttgat

SEQ ID NO: 19895 - DNA, 25 bp, S. cerevisiae
aatacaaatttactcgatgcgcaga

SEQ ID NO: 19896 - DNA, 25 bp, S. cerevisiae
aataacagatctccgctgaacgctg

SEQ ID NO: 19897 - DNA, 25 bp, S. cerevisiae
aataatcaacatccgcgatctcgtt

SEQ ID NO: 19898 - DNA, 25 bp, S. cerevisiae
aataatagcaattctggttcagcag

SEQ ID NO: 19899 - DNA, 25 bp, S. cerevisiae
aatataccagagatgcagccgttac

SEQ ID NO: 19900 - DNA, 25 bp, S. cerevisiae
aatacaccaggtggcgtcgctatac

SEQ ID NO: 19901 - DNA, 25 bp, S. cerevisiae
gaattcccggaagccgcaggcaaaa

SEQ ID NO: 19902 - DNA, 25 bp, S. cerevisiae
aatcaagttggaattcagtcgaaaa

SEQ ID NO: 19903 - DNA, 25 bp, S. cerevisiae
aatctgcgtcgcctagatcattaaa

SEQ ID NO: 19904 - DNA, 25 bp, S. cerevisiae
aatcatcttcgggatcctcatcaaa

SEQ ID NO: 19905 - DNA, 25 bp, S. cerevisiae
aataatgcatcgtcagagctatcaa

SEQ ID NO: 19906 - DNA, 25 bp, S. cerevisiae
aataatcattatcccgcacaacaac

SEQ ID NO: 19907 - DNA, 25 bp, S. cerevisiae
aatcaatcactattcacccaaacga

SEQ ID NO: 19908 - DNA, 25 bp, S. cerevisiae
aatcaccactttatggtcgcagcga

SEQ ID NO: 19909 - DNA, 25 bp, S. cerevisiae
aatacagcatgccaggtggttcctt

SEQ ID NO: 19910 - DNA, 25 bp, S. cerevisiae
aatcatctggaagagggatctgcct

SEQ ID NO: 19911 - DNA, 25 bp, S. cerevisiae
aatcatacaatagggaggctctact

SEQ ID NO: 19912 - DNA, 25 bp, S. cerevisiae
aatctctaggaggtgccgattccag

SEQ ID NO: 19913 - DNA, 25 bp, S. cerevisiae
aatacggtgcccgactgagagccaa

SEQ ID NO: 19914 - DNA, 25 bp, S. cerevisiae
aatacggagtaccattgcttgataa

SEQ ID NO: 19915 - DNA, 25 bp, S. cerevisiae
aatacgttgagttcgtcgccgacag

SEQ ID NO: 19916 - DNA, 25 bp, S. cerevisiae
aatactttgtgggtatggccgctac

SEQ ID NO: 19917 - DNA, 25 bp, S. cerevisiae
aatagttttgaattggcaccctcca

SEQ ID NO: 19918 - DNA, 25 bp, S. cerevisiae
aataaacttgaaatggtcgccacca

SEQ ID NO: 19919 - DNA, 25 bp, S. cerevisiae
caaaaatttggtgtggccttcactt

SEQ ID NO: 19920 - DNA, 25 bp, S. cerevisiae
aatcactactgaagagttctcgctg

SEQ ID NO: 19921 - DNA, 25 bp, S. cerevisiae
aatcatcaacagacgacatctctcc

SEQ ID NO: 19922 - DNA, 25 bp, S. cerevisiae
aatactaagtcgtatcactctgcga

SEQ ID NO: 19923 - DNA, 25 bp, S. cerevisiae
aatctctaggattagctgcccagga

SEQ ID NO: 19924 - DNA, 25 bp, S. cerevisiae
aatcatcaccgtcacagcagacaga

SEQ ID NO: 19925 - DNA, 25 bp, S. cerevisiae
caattcaacctggaagcgaccaata

SEQ ID NO: 19926 - DNA, 25 bp, S. cerevisiae
aataccaccaacaacgacagcaata

SEQ ID NO: 19927 - DNA, 25 bp, S. cerevisiae
aatacttgtacctaagagccgttgg

SEQ ID NO: 19928 - DNA, 25 bp, S. cerevisiae
caatcaggtatatcacgacgccggg

SEQ ID NO: 19929 - DNA, 25 bp, S. cerevisiae
aatcagttttatcagttgcccacac

SEQ ID NO: 19930 - DNA, 25 bp, S. cerevisiae
aatcagactttgacgaggatgacaa

SEQ ID NO: 19931 - DNA, 25 bp, S. cerevisiae
aatagcctctcagatgggtgatgac

SEQ ID NO: 19932 - DNA, 25 bp, S. cerevisiae
aatagctccatagtaggcactgcat

SEQ ID NO: 19933 - DNA, 25 bp, S. cerevisiae
aatcatgtatcgacatccggtccat

SEQ ID NO: 19934 - DNA, 25 bp, S. cerevisiae
aatattgtgcgcgatcgggtatgca

SEQ ID NO: 19935 - DNA, 25 bp, S. cerevisiae
aataacgatttccagcagcagcagc

SEQ ID NO: 19936 - DNA, 25 bp, S. cerevisiae
aatactccatttcaacagcagccag

SEQ ID NO: 19937 - DNA, 25 bp, S. cerevisiae
aataacgatgttctcaacccagcat

SEQ ID NO: 19938 - DNA, 25 bp, S. cerevisiae
aatacgcgaactcagcaaatccaag

SEQ ID NO: 19939 - DNA, 25 bp, S. cerevisiae
aatcacagcgactcaatcgacatag

SEQ ID NO: 19940 - DNA, 25 bp, S. cerevisiae
aatagccatgaacgacttgatagag

SEQ ID NO: 19941 - DNA, 25 bp, S. cerevisiae
aatcagatgctggtcatggcgtaaa

SEQ ID NO: 19942 - DNA, 25 bp, S. cerevisiae
aatcaggccgttacctatggcttag

SEQ ID NO: 19943 - DNA, 25 bp, S. cerevisiae
aatagtgcgctgagtccaaaattga

SEQ ID NO: 19944 - DNA, 25 bp, S. cerevisiae
aatagtccttttcaaagcctgcacc

SEQ ID NO: 19945 - DNA, 25 bp, S. cerevisiae
aataactctatctacggaatccgcc

SEQ ID NO: 19946 - DNA, 25 bp, S. cerevisiae
aatcacggttctttgtgtcgtccct

SEQ ID NO: 19947 - DNA, 25 bp, S. cerevisiae
aatcatattggtattcactctgtag

SEQ ID NO: 19948 - DNA, 25 bp, S. cerevisiae
aatcattgttctattcactgtgcat

SEQ ID NO: 19949 - DNA, 25 bp, S. cerevisiae
aatcttatgttttcccagtgcgttc

SEQ ID NO: 19950 - DNA, 25 bp, S. cerevisiae
aatcacatttgttcagctcgctaga

SEQ ID NO: 19951 - DNA, 25 bp, S. cerevisiae
aatctttgccctgcacatcttgaga

SEQ ID NO: 19952 - DNA, 25 bp, S. cerevisiae
aatcttggccatcgctactgttgaa

SEQ ID NO: 19953 - DNA, 25 bp, S. cerevisiae
aatcatgttattctggccaatctgg

SEQ ID NO: 19954 - DNA, 25 bp, S. cerevisiae
aatcagtgcgcaaatattctctcgg

SEQ ID NO: 19955 - DNA, 25 bp, S. cerevisiae
aatcatctcagcatcattcttcatc

SEQ ID NO: 19956 - DNA, 25 bp, S. cerevisiae
aatcattcagcacctgatggttgtg

SEQ ID NO: 19957 - DNA, 25 bp, S. cerevisiae
aatcattggaccgtggtgctgcaaa

SEQ ID NO: 19958 - DNA, 25 bp, S. cerevisiae
aatcatgtccacgtttgctggcaaa

SEQ ID NO: 19959 - DNA, 25 bp, S. cerevisiae
aatcatgttccctttcgtgatcatt

SEQ ID NO: 19960 - DNA, 25 bp, S. cerevisiae
aatactttctcaccagcaagctagt

SEQ ID NO: 19961 - DNA, 25 bp, S. cerevisiae
aatcacctaccagcagtatcttcaa

SEQ ID NO: 19962 - DNA, 25 bp, S. cerevisiae
aatcaaccaacagcatcttccgaaa

SEQ ID NO: 19963 - DNA, 25 bp, S. cerevisiae
aataacattcactatcctctgacgc

SEQ ID NO: 19964 - DNA, 25 bp, S. cerevisiae
aataatgacctgtatacccgaccac

SEQ ID NO: 19965 - DNA, 25 bp, S. cerevisiae
aatcacaatttgacccttccagagg

SEQ ID NO: 19966 - DNA, 25 bp, S. cerevisiae
aataaatgagcccaacttcgacgtc

SEQ ID NO: 19967 - DNA, 25 bp, S. cerevisiae
aatagacaaccactatttcctcggc

SEQ ID NO: 19968 - DNA, 25 bp, S. cerevisiae
aatacaaacagctcattcacgccat

SEQ ID NO: 19969 - DNA, 25 bp, S. cerevisiae
aataacactccgttgcatgtacctt

SEQ ID NO: 19970 - DNA, 25 bp, S. cerevisiae
aataacgtccgttctctcgaatcta

SEQ ID NO: 19971 - DNA, 25 bp, S. cerevisiae
aataacttcggttctgttgccacta

SEQ ID NO: 19972 - DNA, 25 bp, S. cerevisiae
aataatctttgctttcgggtacgag

SEQ ID NO: 19973 - DNA, 25 bp, S. cerevisiae
aataatctgctttgtgctcggctac

SEQ ID NO: 19974 - DNA, 25 bp, S. cerevisiae
aatcattgcctatctctgagattga

SEQ ID NO: 19975 - DNA, 25 bp, S. cerevisiae
aatcattgcctatctggagacacat

SEQ ID NO: 19976 - DNA, 25 bp, S. cerevisiae
aatcatttgctttcagccacagggt

SEQ ID NO: 19977 - DNA, 25 bp, S. cerevisiae
aatcagttcattaacctcgcaggtt

SEQ ID NO: 19978 - DNA, 25 bp, S. cerevisiae
aatttgcctaattttgccgtgttgg

SEQ ID NO: 19979 - DNA, 25 bp, S. cerevisiae
aatttgagagcatattttgggccgg

SEQ ID NO: 19980 - DNA, 25 bp, S. cerevisiae
tcttttaggttttcttgtggcctcg

SEQ ID NO: 19981 - DNA, 25 bp, S. cerevisiae
cacttgtggtcgtgtagttggtcta

SEQ ID NO: 19982 - DNA, 25 bp, S. cerevisiae
ccggttacagttcagttggtccata

SEQ ID NO: 19983 - DNA, 25 bp, S. cerevisiae
cttggttagttctggtgcggacgct

SEQ ID NO: 19984 - DNA, 25 bp, S. cerevisiae
ccttgtttcaatgaggtaccctgag

SEQ ID NO: 19985 - DNA, 25 bp, S. cerevisiae
aatactaccatatctagattcgatg

SEQ ID NO: 19986 - DNA, 25 bp, S. cerevisiae
aatactacgatgagccagatggcga

SEQ ID NO: 19987 - DNA, 25 bp, S. cerevisiae
aatagctatcgatcttcggacgaga

SEQ ID NO: 19988 - DNA, 25 bp, S. cerevisiae
aatagccgacaacttcctaaggaag

SEQ ID NO: 19989 - DNA, 25 bp, S. cerevisiae
aatcaccgaagtattgccaagagca

SEQ ID NO: 19990 - DNA, 25 bp, S. cerevisiae
aatactgaagagctcggtgttgcaa

SEQ ID NO: 19991 - DNA, 25 bp, S. cerevisiae
caagtctacaagttgggtttggcca

SEQ ID NO: 19992 - DNA, 25 bp, S. cerevisiae
caagttatccaactggcggttttca

SEQ ID NO: 19993 - DNA, 25 bp, S. cerevisiae
aatttaaacgtcttcctcttggcag

SEQ ID NO: 19994 - DNA, 25 bp, S. cerevisiae
aattattgcctctggtggacggtgc

SEQ ID NO: 19995 - DNA, 25 bp, S. cerevisiae
gagtttcccacgatattcgttgcca

SEQ ID NO: 19996 - DNA, 25 bp, S. cerevisiae
aatacgtcccagaagtctctgcttt

SEQ ID NO: 19997 - DNA, 25 bp, S. cerevisiae
aatataattacgtgcccagtttcgg

SEQ ID NO: 19998 - DNA, 25 bp, S. cerevisiae
aataaggtaacgactagcgccgatt

SEQ ID NO: 19999 - DNA, 25 bp, S. cerevisiae
aatagaatgctatcgtcgggccgta

SEQ ID NO: 20000 - DNA, 25 bp, S. cerevisiae
aataaatccaatccacagggccctt

SEQ ID NO: 20001 - DNA, 25 bp, S. cerevisiae
aatacaacagaacacgggcctccag

SEQ ID NO: 20002 - DNA, 25 bp, S. cerevisiae
aataagaagtatcagctgggctcct

SEQ ID NO: 20003 - DNA, 25 bp, S. cerevisiae
aatacagttccgtatgctggtgccg

SEQ ID NO: 20004 - DNA, 25 bp, S. cerevisiae
aatcaaattctcaagaggggctcga

SEQ ID NO: 20005 - DNA, 25 bp, S. cerevisiae
aatcaagactctacgatggagcccc

SEQ ID NO: 20006 - DNA, 25 bp, S. cerevisiae
aatcaagactcaactgcgcaatggt

SEQ ID NO: 20007 - DNA, 25 bp, S. cerevisiae
aatcagcaatccacgcgaagggcat

SEQ ID NO: 20008 - DNA, 25 bp, S. cerevisiae
aatcaattcagcaacgccaacgcga

SEQ ID NO: 20009 - DNA, 25 bp, S. cerevisiae
aataatgactcaactccaaccaggc

SEQ ID NO: 20010 - DNA, 25 bp, S. cerevisiae
aatacttctgatgctggttctaggt

SEQ ID NO: 20011 - DNA, 25 bp, S. cerevisiae
aatacccgacgaaccgcaattgaga

SEQ ID NO: 20012 - DNA, 25 bp, S. cerevisiae
aataccgactcttttaatggcagtg

SEQ ID NO: 20013 - DNA, 25 bp, S. cerevisiae
aatagaccctctgtttttgatgaaa

SEQ ID NO: 20014 - DNA, 25 bp, S. cerevisiae
aatatggacacctctttttcgccaa

SEQ ID NO: 20015 - DNA, 25 bp, S. cerevisiae
aatatggtaccttcacatgttccgc

SEQ ID NO: 20016 - DNA, 25 bp, S. cerevisiae
aatcaagttcgcgtcgagtgtcaag

SEQ ID NO: 20017 - DNA, 25 bp, S. cerevisiae
aataatgtggtttcccctggagtct

SEQ ID NO: 20018 - DNA, 25 bp, S. cerevisiae
aatacactggcaattctacaaaaag

SEQ ID NO: 20019 - DNA, 25 bp, S. cerevisiae
aatatgccggcaactcaagcacatc

SEQ ID NO: 20020 - DNA, 25 bp, S. cerevisiae
aataggcttcatttgcaaccaggcg

SEQ ID NO: 20021 - DNA, 25 bp, S. cerevisiae
aataagtcattttccagtgctcagg

SEQ ID NO: 20022 - DNA, 25 bp, S. cerevisiae
aatcaagccattcatcaaagtcgtc

SEQ ID NO: 20023 - DNA, 25 bp, S. cerevisiae
aatcagactctcaaaattccctttc

SEQ ID NO: 20024 - DNA, 25 bp, S. cerevisiae
aataattccaatgttaccctcgcct

SEQ ID NO: 20025 - DNA, 25 bp, S. cerevisiae
aatacatttcagattccaccactca

SEQ ID NO: 20026 - DNA, 25 bp, S. cerevisiae
aatagattcttcagccgcccaagtg

SEQ ID NO: 20027 - DNA, 25 bp, S. cerevisiae
aatagtgtcttcagtggcattgcgg

SEQ ID NO: 20028 - DNA, 25 bp, S. cerevisiae
aatagtttcccttacagaagatcgt

SEQ ID NO: 20029 - DNA, 25 bp, S. cerevisiae
aatagcttctccgtgatatcgaaca

SEQ ID NO: 20030 - DNA, 25 bp, S. cerevisiae
aatacttgctgacataatgctaaca

SEQ ID NO: 20031 - DNA, 25 bp, S. cerevisiae
aataatggcaccacagttctccgat

SEQ ID NO: 20032 - DNA, 25 bp, S. cerevisiae
aatactgcgccaagacggtctacga

SEQ ID NO: 20033 - DNA, 25 bp, S. cerevisiae
aataccgtcttcaccatgtgggatg

SEQ ID NO: 20034 - DNA, 25 bp, S. cerevisiae
aataccgttcaaatgccaatgtgga

SEQ ID NO: 20035 - DNA, 25 bp, S. cerevisiae
aattctgccgttatcgaagcttccg

SEQ ID NO: 20036 - DNA, 25 bp, S. cerevisiae
aatactgtgccggtctcaagttgta

SEQ ID NO: 20037 - DNA, 25 bp, S. cerevisiae
aatcacgtgttgcagttttggaaaa

SEQ ID NO: 20038 - DNA, 25 bp, S. cerevisiae
aatatggtatttcttgctgggtaaa

SEQ ID NO: 20039 - DNA, 25 bp, S. cerevisiae
aatactgtattgtctgcattatcgg

SEQ ID NO: 20040 - DNA, 25 bp, S. cerevisiae
aatcaccgatgcctgtgctttgaag

SEQ ID NO: 20041 - DNA, 25 bp, S. cerevisiae
aatcaccgtgctatctttggagtcc

SEQ ID NO: 20042 - DNA, 25 bp, S. cerevisiae
aatatgcccgttttattgggtccat

SEQ ID NO: 20043 - DNA, 25 bp, S. cerevisiae
aatacctcgttctaaagttctgcag

SEQ ID NO: 20044 - DNA, 25 bp, S. cerevisiae
aataccttgttttcacagtccccag

SEQ ID NO: 20045 - DNA, 25 bp, S. cerevisiae
aatacttttttgataatggcggtgt

SEQ ID NO: 20046 - DNA, 25 bp, S. cerevisiae
aatacattcctttggttatgcgtgg

SEQ ID NO: 20047 - DNA, 25 bp, S. cerevisiae
aatacttccctaatttatcggagag

SEQ ID NO: 20048 - DNA, 25 bp, S. cerevisiae
aatacgtcctcgatcttcgaagacc

SEQ ID NO: 20049 - DNA, 25 bp, S. cerevisiae
aatacgataccgattctgccgatga

SEQ ID NO: 20050 - DNA, 25 bp, S. cerevisiae
aatcacggcaccatttccttgtcaa

SEQ ID NO: 20051 - DNA, 25 bp, S. cerevisiae
aataaagcctgcattaccgttccac

SEQ ID NO: 20052 - DNA, 25 bp, S. cerevisiae
aataaaactgccatcaccacattgc

SEQ ID NO: 20053 - DNA, 25 bp, S. cerevisiae
aataactattactcgccacttgcat

SEQ ID NO: 20054 - DNA, 25 bp, S. cerevisiae
aatcaactgaatttacctccttatg

SEQ ID NO: 20055 - DNA, 25 bp, S. cerevisiae
aatacaagtgctctgactgttccaa

SEQ ID NO: 20056 - DNA, 25 bp, S. cerevisiae
aatcaacttgcttggactatcagaa

SEQ ID NO: 20057 - DNA, 25 bp, S. cerevisiae
aatactcactgaactctggagcaaa

SEQ ID NO: 20058 - DNA, 25 bp, S. cerevisiae
aatactcctgtatttgcgaccacat

SEQ ID NO: 20059 - DNA, 25 bp, S. cerevisiae
aatacaccttctactgctactattg

SEQ ID NO: 20060 - DNA, 25 bp, S. cerevisiae
aataccattgtcacgtgttttcaag

SEQ ID NO: 20061 - DNA, 25 bp, S. cerevisiae
aatacctttcagagctggtctcaag

SEQ ID NO: 20062 - DNA, 25 bp, S. cerevisiae
gaaacgcttccgtgtagttctagga

SEQ ID NO: 20063 - DNA, 25 bp, S. cerevisiae
aatattccaggatcaggtcttccgt

SEQ ID NO: 20064 - DNA, 25 bp, S. cerevisiae
aatacttggacatatcttctttgaa

SEQ ID NO: 20065 - DNA, 25 bp, S. cerevisiae
aatactttacgacctgatttctcca

SEQ ID NO: 20066 - DNA, 25 bp, S. cerevisiae
aatactgtgggctggttcgtagcat

SEQ ID NO: 20067 - DNA, 25 bp, S. cerevisiae
aatacgggatgctggtttgggccac

SEQ ID NO: 20068 - DNA, 25 bp, S. cerevisiae
aatatcgctggacttgggttcggac

SEQ ID NO: 20069 - DNA, 25 bp, S. cerevisiae
aataatggtattgcctctaccgccg

SEQ ID NO: 20070 - DNA, 25 bp, S. cerevisiae
aataatgttgttctgtctaccgcca

SEQ ID NO: 20071 - DNA, 25 bp, S. cerevisiae
aatagaacttctgttccggtcactg

SEQ ID NO: 20072 - DNA, 25 bp, S. cerevisiae
aatcaagaggtctcgcctttgttac

SEQ ID NO: 20073 - DNA, 25 bp, S. cerevisiae
caaagtcagttccacccatttatta

SEQ ID NO: 20074 - DNA, 25 bp, S. cerevisiae
aatagattcttcaactctcttgcgc

SEQ ID NO: 20075 - DNA, 25 bp, S. cerevisiae
aataatcctcacagttttgccgaac

SEQ ID NO: 20076 - DNA, 25 bp, S. cerevisiae
aataccatcccatatataccttacg

SEQ ID NO: 20077 - DNA, 25 bp, S. cerevisiae
caaaccactacacaaaccttgcaaa

SEQ ID NO: 20078 - DNA, 25 bp, S. cerevisiae
caatagccctaaaaaatcgtcgcct

SEQ ID NO: 20079 - DNA, 25 bp, S. cerevisiae
aataccctcttcaaaatcgcttgta

SEQ ID NO: 20080 - DNA, 25 bp, S. cerevisiae
aataacacgcctctggatgcaaatg

SEQ ID NO: 20081 - DNA, 25 bp, S. cerevisiae
aatacaagagctattgcgtgctata

SEQ ID NO: 20082 - DNA, 25 bp, S. cerevisiae
aatactatcttaaccccatagcgtc

SEQ ID NO: 20083 - DNA, 25 bp, S. cerevisiae
aatagcacaagtacgctccctagag

SEQ ID NO: 20084 - DNA, 25 bp, S. cerevisiae
aatagtgcaagctctgctacctcta

SEQ ID NO: 20085 - DNA, 25 bp, S. cerevisiae
aatagtgaagcatccagcgcattta

SEQ ID NO: 20086 - DNA, 25 bp, S. cerevisiae
aataggttattcaattctcccagga

SEQ ID NO: 20087 - DNA, 25 bp, S. cerevisiae
aatacgatatattttgttcccaatg

SEQ ID NO: 20088 - DNA, 25 bp, S. cerevisiae
aatactcattactggattcaacaac

SEQ ID NO: 20089 - DNA, 25 bp, S. cerevisiae
aatacgtccacgaagtcaactcaaa

SEQ ID NO: 20090 - DNA, 25 bp, S. cerevisiae
aatacgccgtctaatatcaactcag

SEQ ID NO: 20091 - DNA, 25 bp, S. cerevisiae
aatacaatttcccatctcgatcatt

SEQ ID NO: 20092 - DNA, 25 bp, S. cerevisiae
aatagcgattggtcagtcccacctg

SEQ ID NO: 20093 - DNA, 25 bp, S. cerevisiae
aatatcgttggcgatttgcccctgg

SEQ ID NO: 20094 - DNA, 25 bp, S. cerevisiae
aatactttggagaccatgaccgatg

SEQ ID NO: 20095 - DNA, 25 bp, S. cerevisiae
aatactatttgctactattcagcga

SEQ ID NO: 20096 - DNA, 25 bp, S. cerevisiae
aattcacaataagctcttgggcaaa

SEQ ID NO: 20097 - DNA, 25 bp, S. cerevisiae
aataggcaattccaccttaggcaaa

SEQ ID NO: 20098 - DNA, 25 bp, S. cerevisiae
aatacgacgttatcttggacaagga

SEQ ID NO: 20099 - DNA, 25 bp, S. cerevisiae
aatactcccgaatatcttgacaagg

SEQ ID NO: 20100 - DNA, 25 bp, S. cerevisiae
aattagccctaggtgttcaagatac

SEQ ID NO: 20101 - DNA, 25 bp, S. cerevisiae
aattcaagccttcgactctaacatg

SEQ ID NO: 20102 - DNA, 25 bp, S. cerevisiae
aatagagcgagcgattcccattcat

SEQ ID NO: 20103 - DNA, 25 bp, S. cerevisiae
aatacatctggcgacatctccaata

SEQ ID NO: 20104 - DNA, 25 bp, S. cerevisiae
aatactagggcacctccaaacgcag

SEQ ID NO: 20105 - DNA, 25 bp, S. cerevisiae
aattaaggagtccatccagcaacaa

SEQ ID NO: 20106 - DNA, 25 bp, S. cerevisiae
aatatgtttcccactattatcagga

SEQ ID NO: 20107 - DNA, 25 bp, S. cerevisiae
aatagtttcgcctttcatgaacagt

SEQ ID NO: 20108 - DNA, 25 bp, S. cerevisiae
aatagcgcttcgacatttacaccag

SEQ ID NO: 20109 - DNA, 25 bp, S. cerevisiae
aattacgacgccattgacggtttgt

SEQ ID NO: 20110 - DNA, 25 bp, S. cerevisiae
aataccgccgccaatgagatcagtg

SEQ ID NO: 20111 - DNA, 25 bp, S. cerevisiae
aataccccagtacgaagattcttct

SEQ ID NO: 20112 - DNA, 25 bp, S. cerevisiae
aatacgccgagcacacaaatttagt

SEQ ID NO: 20113 - DNA, 25 bp, S. cerevisiae
aataccctgacaccacaaatgactg

SEQ ID NO: 20114 - DNA, 25 bp, S. cerevisiae
aatacaacgagctcacaatccagtc

SEQ ID NO: 20115 - DNA, 25 bp, S. cerevisiae
aatattccattttcaaaccagcaag

SEQ ID NO: 20116 - DNA, 25 bp, S. cerevisiae
aatttctcacttccttacctgaatt

SEQ ID NO: 20117 - DNA, 25 bp, S. cerevisiae
aatattccctgcaaactacgttaga

SEQ ID NO: 20118 - DNA, 25 bp, S. cerevisiae
aatacctcctgtaacttcgtctatt

SEQ ID NO: 20119 - DNA, 25 bp, S. cerevisiae
cagaagattcgttaacgttaccttg

SEQ ID NO: 20120 - DNA, 25 bp, S. cerevisiae
caaggattcgcgttctttggacccg

SEQ ID NO: 20121 - DNA, 25 bp, S. cerevisiae
gaagaaccggttatcttgacctcgg

SEQ ID NO: 20122 - DNA, 25 bp, S. cerevisiae
aatacttttcattcttccgtacacg

SEQ ID NO: 20123 - DNA, 25 bp, S. cerevisiae
gaatactcgggattttcctttccag

SEQ ID NO: 20124 - DNA, 25 bp, S. cerevisiae
aatagccagggtcgttgcccctgaa

SEQ ID NO: 20125 - DNA, 25 bp, S. cerevisiae
aatagcaccgcatttgttccaacta

SEQ ID NO: 20126 - DNA, 25 bp, S. cerevisiae
aatagtgccgcatcatcttatcaac

SEQ ID NO: 20127 - DNA, 25 bp, S. cerevisiae
aataccttgcattcagattacgaga

SEQ ID NO: 20128 - DNA, 25 bp, S. cerevisiae
aatacgggatgtcagttgcgccagt

SEQ ID NO: 20129 - DNA, 25 bp, S. cerevisiae
aatacggacttttcagttcctgata

SEQ ID NO: 20130 - DNA, 25 bp, S. cerevisiae
aattctaatcttctacctcagctaa

SEQ ID NO: 20131 - DNA, 25 bp, S. cerevisiae
aatatcgaacttcaactcacggaaa

SEQ ID NO: 20132 - DNA, 25 bp, S. cerevisiae
aatactttcttccatactactgctc

SEQ ID NO: 20133 - DNA, 25 bp, S. cerevisiae
aatacatcttcctttacatctttcc

SEQ ID NO: 20134 - DNA, 25 bp, S. cerevisiae
aatacatcatcgaccttaacttctc

SEQ ID NO: 20135 - DNA, 25 bp, S. cerevisiae
aatacatgactgcactaactctggt

SEQ ID NO: 20136 - DNA, 25 bp, S. cerevisiae
cactgacgatgataccgactctggt

SEQ ID NO: 20137 - DNA, 25 bp, S. cerevisiae
aatacttcttattccgagggtgagc

SEQ ID NO: 20138 - DNA, 25 bp, S. cerevisiae
aatactttcggctttggttctaatg

SEQ ID NO: 20139 - DNA, 25 bp, S. cerevisiae
aatactttctgcacctgtcactgct

SEQ ID NO: 20140 - DNA, 25 bp, S. cerevisiae
aatatccgatcagtccagtacagct

SEQ ID NO: 20141 - DNA, 25 bp, S. cerevisiae
aatacctatcaaacaatcctgccgt

SEQ ID NO: 20142 - DNA, 25 bp, S. cerevisiae
aatacagtattatggccctgccgat

SEQ ID NO: 20143 - DNA, 25 bp, S. cerevisiae
aatatgcagaaatctctccttcctt

SEQ ID NO: 20144 - DNA, 25 bp, S. cerevisiae
aatacaaatcaactttctcctccat

SEQ ID NO: 20145 - DNA, 25 bp, S. cerevisiae
aatacagtgtcatctttccctattc

SEQ ID NO: 20146 - DNA, 25 bp, S. cerevisiae
aatagcaatgtatcccatcacctat

SEQ ID NO: 20147 - DNA, 25 bp, S. cerevisiae
aatacaactctttgatctgccttcc

SEQ ID NO: 20148 - DNA, 25 bp, S. cerevisiae
aatacggctgtttgtccgatattgc

SEQ ID NO: 20149 - DNA, 25 bp, S. cerevisiae
aatacgagcttattttcgacgctga

SEQ ID NO: 20150 - DNA, 25 bp, S. cerevisiae
aatactactctttccaagtcgctca

SEQ ID NO: 20151 - DNA, 25 bp, S. cerevisiae
aatactactctttccaagctgctca

SEQ ID NO: 20152 - DNA, 25 bp, S. cerevisiae
aatacggctagaattcacgctcaaa

SEQ ID NO: 20153 - DNA, 25 bp, S. cerevisiae
aatacaggcaattttctccacatat

SEQ ID NO: 20154 - DNA, 25 bp, S. cerevisiae
aatagccgcagattttgctccaaga

SEQ ID NO: 20155 - DNA, 25 bp, S. cerevisiae
aatagcctcaatatttgcctggaca

SEQ ID NO: 20156 - DNA, 25 bp, S. cerevisiae
aatagtgtacagataggcgcggaaa

SEQ ID NO: 20157 - DNA, 25 bp, S. cerevisiae
aatagtgctaccgtcggctctgtaa

SEQ ID NO: 20158 - DNA, 25 bp, S. cerevisiae
aatagtgcatcagcagtcgcttgcg

SEQ ID NO: 20159 - DNA, 25 bp, S. cerevisiae
aatactgtcatggactcgctgggac

SEQ ID NO: 20160 - DNA, 25 bp, S. cerevisiae
aatactgctgctgttccatctgaag

SEQ ID NO: 20161 - DNA, 25 bp, S. cerevisiae
aatacatcgctgctggttctctaga

SEQ ID NO: 20162 - DNA, 25 bp, S. cerevisiae
aatacattgctggtgctcgtccatg

SEQ ID NO: 20163 - DNA, 25 bp, S. cerevisiae
aatatcttggagctcttgcatgctg

SEQ ID NO: 20164 - DNA, 25 bp, S. cerevisiae
aatatcgtggatagtagcgctgctg

SEQ ID NO: 20165 - DNA, 25 bp, S. cerevisiae
aatatcgatgatgttgactctatca

SEQ ID NO: 20166 - DNA, 25 bp, S. cerevisiae
aatatcgacgcggatgcatcttatc

SEQ ID NO: 20167 - DNA, 25 bp, S. cerevisiae
aatagctctagcgatgaatcatcta

SEQ ID NO: 20168 - DNA, 25 bp, S. cerevisiae
aatatgatctccttgacgatgcaaa

SEQ ID NO: 20169 - DNA, 25 bp, S. cerevisiae
aatatgcttctcttgtcgacacaga

SEQ ID NO: 20170 - DNA, 25 bp, S. cerevisiae
aatagtcatgcttaattccacaggt

SEQ ID NO: 20171 - DNA, 25 bp, S. cerevisiae
aatatccatcataacttgcgtcaga

SEQ ID NO: 20172 - DNA, 25 bp, S. cerevisiae
aatatcaccaattctgccgttgaag

SEQ ID NO: 20173 - DNA, 25 bp, S. cerevisiae
aatatgcttatttccactttcagat

SEQ ID NO: 20174 - DNA, 25 bp, S. cerevisiae
aatagatgccgctctggatttcaga

SEQ ID NO: 20175 - DNA, 25 bp, S. cerevisiae
aatatccacacttgggttccgtaag

SEQ ID NO: 20176 - DNA, 25 bp, S. cerevisiae
aataccaatatgtccgatccggctt

SEQ ID NO: 20177 - DNA, 25 bp, S. cerevisiae
aataccaatggctctgaaagcgaag

SEQ ID NO: 20178 - DNA, 25 bp, S. cerevisiae
aataccatattcttcctcagaggaa

SEQ ID NO: 20179 - DNA, 25 bp, S. cerevisiae
aataccttcagtaattggcgcacag

SEQ ID NO: 20180 - DNA, 25 bp, S. cerevisiae
aataccttcagtaatggcgccatcc

SEQ ID NO: 20181 - DNA, 25 bp, S. cerevisiae
aatactactttgaggttagcccaag

SEQ ID NO: 20182 - DNA, 25 bp, S. cerevisiae
cagatactttttgtgggaccccaga

SEQ ID NO: 20183 - DNA, 25 bp, S. cerevisiae
aatatctcgttgaaagggcccgctc

SEQ ID NO: 20184 - DNA, 25 bp, S. cerevisiae
taatatcgaaggaagaaggttggcc

SEQ ID NO: 20185 - DNA, 25 bp, S. cerevisiae
aatatcaacgcgcagaatggcttag

SEQ ID NO: 20186 - DNA, 25 bp, S. cerevisiae
aatatggcgtctgcaaatgccctac

SEQ ID NO: 20187 - DNA, 25 bp, S. cerevisiae
aatagtgacctaccgatatcgaatg

SEQ ID NO: 20188 - DNA, 25 bp, S. cerevisiae
aatagagaccaacagcagccgctat

SEQ ID NO: 20189 - DNA, 25 bp, S. cerevisiae
aatagagggccatcaacgccactat

SEQ ID NO: 20190 - DNA, 25 bp, S. cerevisiae
aatatgtgagcccataccaggcctt

SEQ ID NO: 20191 - DNA, 25 bp, S. cerevisiae
aatatggcacaaaagcaaacctgtt

SEQ ID NO: 20192 - DNA, 25 bp, S. cerevisiae
aatatggtcaaagacatagcctctt

SEQ ID NO: 20193 - DNA, 25 bp, S. cerevisiae
aatactactggttactgtgctccgt

SEQ ID NO: 20194 - DNA, 25 bp, S. cerevisiae
aatatcctgctcgatggatggctcc

SEQ ID NO: 20195 - DNA, 25 bp, S. cerevisiae
aataccgcaatgacgatgactccat

SEQ ID NO: 20196 - DNA, 25 bp, S. cerevisiae
aatatgcgccagatgaacccaactc

SEQ ID NO: 20197 - DNA, 25 bp, S. cerevisiae
aattctgcggtataaactccattgt

SEQ ID NO: 20198 - DNA, 25 bp, S. cerevisiae
aattcatgcggattcaaacctacca

SEQ ID NO: 20199 - DNA, 25 bp, S. cerevisiae
aatatcctgggctacatttgaacca

SEQ ID NO: 20200 - DNA, 25 bp, S. cerevisiae
cacttgttgcgggtcagagggcttt

SEQ ID NO: 20201 - DNA, 25 bp, S. cerevisiae
aattttcaaggtgaggagcttcctc

SEQ ID NO: 20202 - DNA, 25 bp, S. cerevisiae
aatattataaaagatgcccgccgta

SEQ ID NO: 20203 - DNA, 25 bp, S. cerevisiae
caatagcttaaaaaagggcgccagt

SEQ ID NO: 20204 - DNA, 25 bp, S. cerevisiae
aatattctatgattccaagggcggt

SEQ ID NO: 20205 - DNA, 25 bp, S. cerevisiae
aatatcgatatttccaatgggcatg

SEQ ID NO: 20206 - DNA, 25 bp, S. cerevisiae
aatactggaaccatctattcactaa

SEQ ID NO: 20207 - DNA, 25 bp, S. cerevisiae
aatttggtgttgcagtcgtcgttac

SEQ ID NO: 20208 - DNA, 25 bp, S. cerevisiae
aatattttttatggtaggcgtgcta

SEQ ID NO: 20209 - DNA, 25 bp, S. cerevisiae
aattttttccagttgcaagcatgtc

SEQ ID NO: 20210 - DNA, 25 bp, S. cerevisiae
aattttgtgccattccccaagttat

SEQ ID NO: 20211 - DNA, 25 bp, S. cerevisiae
aattttggcaactccttgacttcta

SEQ ID NO: 20212 - DNA, 25 bp, S. cerevisiae
aattttgcaagagaccattacggta

SEQ ID NO: 20213 - DNA, 25 bp, S. cerevisiae
aatttggtccgatcattattggtgc

SEQ ID NO: 20214 - DNA, 25 bp, S. cerevisiae
aattagttaatgtctctgagggtga

SEQ ID NO: 20215 - DNA, 25 bp, S. cerevisiae
aatttggcaaggtttcatggcagga

SEQ ID NO: 20216 - DNA, 25 bp, S. cerevisiae
aatttgtttcgtcatattcgccacc

SEQ ID NO: 20217 - DNA, 25 bp, S. cerevisiae
aatatgtacttcctgacttccaaac

SEQ ID NO: 20218 - DNA, 25 bp, S. cerevisiae
aatagtacttccattctcgagctac

SEQ ID NO: 20219 - DNA, 25 bp, S. cerevisiae
aatacctggcatgtgattgtcggaa

SEQ ID NO: 20220 - DNA, 25 bp, S. cerevisiae
aatatagcttctctaatttccgaat

SEQ ID NO: 20221 - DNA, 25 bp, S. cerevisiae
aatttgctaaaccacctcacgataa

SEQ ID NO: 20222 - DNA, 25 bp, S. cerevisiae
aatatttcatccaaccatccggtag

SEQ ID NO: 20223 - DNA, 25 bp, S. cerevisiae
aattaactcagccaaatgccacggt

SEQ ID NO: 20224 - DNA, 25 bp, S. cerevisiae
aatataaggccgtacgctggtcagc

SEQ ID NO: 20225 - DNA, 25 bp, S. cerevisiae
aattaacacctattacgtactcttg

SEQ ID NO: 20226 - DNA, 25 bp, S. cerevisiae
aataccaacctcttgctacaatttc

SEQ ID NO: 20227 - DNA, 25 bp, S. cerevisiae
aatttcgactcgcttaatgccgttg

SEQ ID NO: 20228 - DNA, 25 bp, S. cerevisiae
aatagactttggcttggcatttcaa

SEQ ID NO: 20229 - DNA, 25 bp, S. cerevisiae
aatatgacgttgcttctgcttttat

SEQ ID NO: 20230 - DNA, 25 bp, S. cerevisiae
aatatgccatctaacggactttttg

SEQ ID NO: 20231 - DNA, 25 bp, S. cerevisiae
aatacctcctcagggatcgtatctg

SEQ ID NO: 20232 - DNA, 25 bp, S. cerevisiae
aatttaaaactcctctagcttctag

SEQ ID NO: 20233 - DNA, 25 bp, S. cerevisiae
cacttttcaaaaacacacgccgatt

SEQ ID NO: 20234 - DNA, 25 bp, S. cerevisiae
cacttttcccagagatatcccaaat

SEQ ID NO: 20235 - DNA, 25 bp, S. cerevisiae
aattggtcgaatctaacccagaatt

SEQ ID NO: 20236 - DNA, 25 bp, S. cerevisiae
gaagtggaaggctctaacgccagag

SEQ ID NO: 20237 - DNA, 25 bp, S. cerevisiae
caagtttgagtctcgtggtgccgga

SEQ ID NO: 20238 - DNA, 25 bp, S. cerevisiae
gacagttgggtcttcgtagggccta

SEQ ID NO: 20239 - DNA, 25 bp, S. cerevisiae
aattcttggtctttgaacgtgcctc

SEQ ID NO: 20240 - DNA, 25 bp, S. cerevisiae
aattttggattctgcacgggctcat

SEQ ID NO: 20241 - DNA, 25 bp, S. cerevisiae
aattttggacttgcgggctgtttct

SEQ ID NO: 20242 - DNA, 25 bp, S. cerevisiae
aattttgccattagcgcgggtttgc

SEQ ID NO: 20243 - DNA, 25 bp, S. cerevisiae
aattgctgttactggtggcgaaaat

SEQ ID NO: 20244 - DNA, 25 bp, S. cerevisiae
aattctttaccgctacagcctatag

SEQ ID NO: 20245 - DNA, 25 bp, S. cerevisiae
aatttttcaccaacttcatccttat

SEQ ID NO: 20246 - DNA, 25 bp, S. cerevisiae
aatacgatgcttctgttcattcctc

SEQ ID NO: 20247 - DNA, 25 bp, S. cerevisiae
aatatctgacgaattggaggccgaa

SEQ ID NO: 20248 - DNA, 25 bp, S. cerevisiae
aatatgctaccatttagccccggaa

SEQ ID NO: 20249 - DNA, 25 bp, S. cerevisiae
aatagaaagatatacgctgccgtgg

SEQ ID NO: 20250 - DNA, 25 bp, S. cerevisiae
aatattaactatcacgccgctaggc

SEQ ID NO: 20251 - DNA, 25 bp, S. cerevisiae
aattacacgggtgcggctgattcta

SEQ ID NO: 20252 - DNA, 25 bp, S. cerevisiae
aatttcaagggttccaccatcagta

SEQ ID NO: 20253 - DNA, 25 bp, S. cerevisiae
aatttagcgggtctcattggtttca

SEQ ID NO: 20254 - DNA, 25 bp, S. cerevisiae
aattatggaacttcttttgcccctg

SEQ ID NO: 20255 - DNA, 25 bp, S. cerevisiae
aatacctccagcagattgactcttt

SEQ ID NO: 20256 - DNA, 25 bp, S. cerevisiae
aatagccttaatttcactcagttct

SEQ ID NO: 20257 - DNA, 25 bp, S. cerevisiae
aatttgcacattctagctgggtcat

SEQ ID NO: 20258 - DNA, 25 bp, S. cerevisiae
aatattgcccacagatgggtccgcc

SEQ ID NO: 20259 - DNA, 25 bp, S. cerevisiae
aatttaccgtctacgagactcctga

SEQ ID NO: 20260 - DNA, 25 bp, S. cerevisiae
aattaaccgtacagagaccgcaatg

SEQ ID NO: 20261 - DNA, 25 bp, S. cerevisiae
gtagtaacggactggagacacccga

SEQ ID NO: 20262 - DNA, 25 bp, S. cerevisiae
gtatgattactgcagggaaggaccc

SEQ ID NO: 20263 - DNA, 25 bp, S. cerevisiae
gaaagcatacgacaggaaggacccc

SEQ ID NO: 20264 - DNA, 25 bp, S. cerevisiae
gaccagtacgtcaaggaactacccg

SEQ ID NO: 20265 - DNA, 25 bp, S. cerevisiae
aattcaataattacaacttcaggga

SEQ ID NO: 20266 - DNA, 25 bp, S. cerevisiae
aattaaagcgtattctgcccaggga

SEQ ID NO: 20267 - DNA, 25 bp, S. cerevisiae
aattttacgcttttgcgccaagaga

SEQ ID NO: 20268 - DNA, 25 bp, S. cerevisiae
aattttaccctcattgcaaacgctg

SEQ ID NO: 20269 - DNA, 25 bp, S. cerevisiae
aattttcacactatttcgaccgcct

SEQ ID NO: 20270 - DNA, 25 bp, S. cerevisiae
cagattagtcagatacggtttggct

SEQ ID NO: 20271 - DNA, 25 bp, S. cerevisiae
aattcgactggttcggatgctaagt

SEQ ID NO: 20272 - DNA, 25 bp, S. cerevisiae
aattagttgttgtggtgctcgagga

SEQ ID NO: 20273 - DNA, 25 bp, S. cerevisiae
aatatgtcctttctttgcgtggcaa

SEQ ID NO: 20274 - DNA, 25 bp, S. cerevisiae
aataccgtattgttcttcgtctcaa

SEQ ID NO: 20275 - DNA, 25 bp, S. cerevisiae
aatagcttcatcatttgttaccttg

SEQ ID NO: 20276 - DNA, 25 bp, S. cerevisiae
aatatccccttcgatgcattatgga

SEQ ID NO: 20277 - DNA, 25 bp, S. cerevisiae
aatatcgccatttgccattgtttgc

SEQ ID NO: 20278 - DNA, 25 bp, S. cerevisiae
aatagcactctcattcaatgtccct

SEQ ID NO: 20279 - DNA, 25 bp, S. cerevisiae
aatagcacttcttcaaattccctcg

SEQ ID NO: 20280 - DNA, 25 bp, S. cerevisiae
aattcaaaccatattcaccagcctc

SEQ ID NO: 20281 - DNA, 25 bp, S. cerevisiae
aattaatcactgttggcgcaaacga

SEQ ID NO: 20282 - DNA, 25 bp, S. cerevisiae
aatatgggactacttcgcgcaacag

SEQ ID NO: 20283 - DNA, 25 bp, S. cerevisiae
aattgtggcgtaattgcactagacg

SEQ ID NO: 20284 - DNA, 25 bp, S. cerevisiae
aatatctctggttacatgatggcaa

SEQ ID NO: 20285 - DNA, 25 bp, S. cerevisiae
aatatgctattggaccctgcagcca

SEQ ID NO: 20286 - DNA, 25 bp, S. cerevisiae
aatatgtcatcttacctgatccaaa

SEQ ID NO: 20287 - DNA, 25 bp, S. cerevisiae
aatttgctttcaccatgctctagaa

SEQ ID NO: 20288 - DNA, 25 bp, S. cerevisiae
aatttggctttgtgctataccgaac

SEQ ID NO: 20289 - DNA, 25 bp, S. cerevisiae
aattcgttcggacctaacatctctt

SEQ ID NO: 20290 - DNA, 25 bp, S. cerevisiae
aatttgtcacggaccttgatattaa

SEQ ID NO: 20291 - DNA, 25 bp, S. cerevisiae
aattagcggacctcttgagcggtga

SEQ ID NO: 20292 - DNA, 25 bp, S. cerevisiae
aatatcgcagtagcactctcgcagg

SEQ ID NO: 20293 - DNA, 25 bp, S. cerevisiae
aatagaccctttaattggcatcaac

SEQ ID NO: 20294 - DNA, 25 bp, S. cerevisiae
aatagacagttttcctctggtcacc

SEQ ID NO: 20295 - DNA, 25 bp, S. cerevisiae
aatttgtattgcttccggtttgcgt

SEQ ID NO: 20296 - DNA, 25 bp, S. cerevisiae
aatttggccctttgtcaactaccag

SEQ ID NO: 20297 - DNA, 25 bp, S. cerevisiae
aatttttcttcaatgactgccatag

SEQ ID NO: 20298 - DNA, 25 bp, S. cerevisiae
aatatgcttgtctttatggcccaat

SEQ ID NO: 20299 - DNA, 25 bp, S. cerevisiae
aatattttagtctttgttgcccaat

SEQ ID NO: 20300 - DNA, 25 bp, S. cerevisiae
aattctacggtagtcacccagttca

SEQ ID NO: 20301 - DNA, 25 bp, S. cerevisiae
aatttacgagtacatccgcagtgac

SEQ ID NO: 20302 - DNA, 25 bp, S. cerevisiae
aatttggcatggagtacccctacag

SEQ ID NO: 20303 - DNA, 25 bp, S. cerevisiae
aattgaagccgtcctaacattttgg

SEQ ID NO: 20304 - DNA, 25 bp, S. cerevisiae
aattcggcggctctaaacttatatg

SEQ ID NO: 20305 - DNA, 25 bp, S. cerevisiae
aattagctccaacggttctttcatg

SEQ ID NO: 20306 - DNA, 25 bp, S. cerevisiae
aattactcatctagcggacttcggc

SEQ ID NO: 20307 - DNA, 25 bp, S. cerevisiae
aatttctcccgaggctgttcgaaga

SEQ ID NO: 20308 - DNA, 25 bp, S. cerevisiae
aatttctcctccagtgtttcactat

SEQ ID NO: 20309 - DNA, 25 bp, S. cerevisiae
aattcagccttttgaacctgtcgat

SEQ ID NO: 20310 - DNA, 25 bp, S. cerevisiae
aatatctcgatgaccttttagggca

SEQ ID NO: 20311 - DNA, 25 bp, S. cerevisiae
aattatgctagattgggttccgata

SEQ ID NO: 20312 - DNA, 25 bp, S. cerevisiae
aatatcgctaaatttggactccaag

SEQ ID NO: 20313 - DNA, 25 bp, S. cerevisiae
aattccgaagaacgacctcattagt

SEQ ID NO: 20314 - DNA, 25 bp, S. cerevisiae
aatttcgaatgttcgccctcccaga

SEQ ID NO: 20315 - DNA, 25 bp, S. cerevisiae
aatagatcaagtaatcgccctcctc

SEQ ID NO: 20316 - DNA, 25 bp, S. cerevisiae
aatagaccatcgaaatccctgagcc

SEQ ID NO: 20317 - DNA, 25 bp, S. cerevisiae
aatagagccacaggtttccgacgcc

SEQ ID NO: 20318 - DNA, 25 bp, S. cerevisiae
aattagccaatcatttcgaccgtca

SEQ ID NO: 20319 - DNA, 25 bp, S. cerevisiae
aattatggaatttgcccgtcgtgtt

SEQ ID NO: 20320 - DNA, 25 bp, S. cerevisiae
aatttggctgatgatcccttactgc

SEQ ID NO: 20321 - DNA, 25 bp, S. cerevisiae
aatatatcggatctctgccttacgc

SEQ ID NO: 20322 - DNA, 25 bp, S. cerevisiae
aatttgccatcagcactgtttgggc

SEQ ID NO: 20323 - DNA, 25 bp, S. cerevisiae
aatttccgactcgagattatccgcc

SEQ ID NO: 20324 - DNA, 25 bp, S. cerevisiae
aatttcttgaacctgttgacctcgc

SEQ ID NO: 20325 - DNA, 25 bp, S. cerevisiae
aatatgttaagccaaccgcgctcgc

SEQ ID NO: 20326 - DNA, 25 bp, S. cerevisiae
aatatttcttccaacagacctgctg

SEQ ID NO: 20327 - DNA, 25 bp, S. cerevisiae
aattgaaccgtaaaattgcttccat

SEQ ID NO: 20328 - DNA, 25 bp, S. cerevisiae
aattgacgggtatagcctgtattct

SEQ ID NO: 20329 - DNA, 25 bp, S. cerevisiae
aatatatcacctcgtctagttgtat

SEQ ID NO: 20330 - DNA, 25 bp, S. cerevisiae
aatattaacatctactggtgcttta

SEQ ID NO: 20331 - DNA, 25 bp, S. cerevisiae
aatttcatcagtttccagcaagcag

SEQ ID NO: 20332 - DNA, 25 bp, S. cerevisiae
aattactttcaacgcggaatgctct

SEQ ID NO: 20333 - DNA, 25 bp, S. cerevisiae
aatttattccacctcgaagctgctg

SEQ ID NO: 20334 - DNA, 25 bp, S. cerevisiae
aatattgtgctagccagtgttcgct

SEQ ID NO: 20335 - DNA, 25 bp, S. cerevisiae
aatattctgtgcatggttttccaat

SEQ ID NO: 20336 - DNA, 25 bp, S. cerevisiae
aatatctctgagctggttattcaaa

SEQ ID NO: 20337 - DNA, 25 bp, S. cerevisiae
aattcagaaagccagtcctcgacga

SEQ ID NO: 20338 - DNA, 25 bp, S. cerevisiae
aatatacaacagacattcccgccgt

SEQ ID NO: 20339 - DNA, 25 bp, S. cerevisiae
aatattttccattgctacaccgaca

SEQ ID NO: 20340 - DNA, 25 bp, S. cerevisiae
aattcaactggcctcttttatgaca

SEQ ID NO: 20341 - DNA, 25 bp, S. cerevisiae
aattttccgcaattttgtgcaagca

SEQ ID NO: 20342 - DNA, 25 bp, S. cerevisiae
aatttccccagttttctctacagat

SEQ ID NO: 20343 - DNA, 25 bp, S. cerevisiae
aatttcaaggcctcaaacgtgcacc

SEQ ID NO: 20344 - DNA, 25 bp, S. cerevisiae
aattatgtctggtaccctacgtgtt

SEQ ID NO: 20345 - DNA, 25 bp, S. cerevisiae
aattattctggtgcctttgggctct

SEQ ID NO: 20346 - DNA, 25 bp, S. cerevisiae
aatatttttcattatctgccgccgt

SEQ ID NO: 20347 - DNA, 25 bp, S. cerevisiae
aatattgtttctgtgctgacggcgg

SEQ ID NO: 20348 - DNA, 25 bp, S. cerevisiae
aatttcattctgtcttcgaaagctg

SEQ ID NO: 20349 - DNA, 25 bp, S. cerevisiae
aatattacgcaaccatcaccaattc

SEQ ID NO: 20350 - DNA, 25 bp, S. cerevisiae
aatttcacaccgtcattcacagatg

SEQ ID NO: 20351 - DNA, 25 bp, S. cerevisiae
aatttttcgttaatccaggtagctg

SEQ ID NO: 20352 - DNA, 25 bp, S. cerevisiae
aattaatcctgttactcctgtgcta

SEQ ID NO: 20353 - DNA, 25 bp, S. cerevisiae
aattatcatcgtcacaccctattga

SEQ ID NO: 20354 - DNA, 25 bp, S. cerevisiae
aatttcatcattacaatgcccggtg

SEQ ID NO: 20355 - DNA, 25 bp, S. cerevisiae
aatattctcttttatccgcatggtc

SEQ ID NO: 20356 - DNA, 25 bp, S. cerevisiae
aatattctctttgtggtggcattcc

SEQ ID NO: 20357 - DNA, 25 bp, S. cerevisiae
aatttgccgttcatattgccacttt

SEQ ID NO: 20358 - DNA, 25 bp, S. cerevisiae
aatttgccaaacctgcataccactg

SEQ ID NO: 20359 - DNA, 25 bp, S. cerevisiae
aatttggcatcatctttcactctgt

SEQ ID NO: 20360 - DNA, 25 bp, S. cerevisiae
aatttcgccaacactagatcgtttg

SEQ ID NO: 20361 - DNA, 25 bp, S. cerevisiae
aatttcggcagattcctagatccta

SEQ ID NO: 20362 - DNA, 25 bp, S. cerevisiae
aattaccaatatgccggctcttatg

SEQ ID NO: 20363 - DNA, 25 bp, S. cerevisiae
aattacaaccacaacctatcttagc

SEQ ID NO: 20364 - DNA, 25 bp, S. cerevisiae
aattactattctccaccataggacc

SEQ ID NO: 20365 - DNA, 25 bp, S. cerevisiae
aattaattcgttgcgtccttgctga

SEQ ID NO: 20366 - DNA, 25 bp, S. cerevisiae
aattattccattccaacgttgttgt

SEQ ID NO: 20367 - DNA, 25 bp, S. cerevisiae
aattaccgcaggcaagctttcactg

SEQ ID NO: 20368 - DNA, 25 bp, S. cerevisiae
aattgaccagggttttcttcgctgt

SEQ ID NO: 20369 - DNA, 25 bp, S. cerevisiae
aattttgaggacttcttttccagat

SEQ ID NO: 20370 - DNA, 25 bp, S. cerevisiae
aatatactgggaccgttcagcaacg

SEQ ID NO: 20371 - DNA, 25 bp, S. cerevisiae
aatatagacagccttcttgccaact

SEQ ID NO: 20372 - DNA, 25 bp, S. cerevisiae
aattaacaggttgggcgcaggcagc

SEQ ID NO: 20373 - DNA, 25 bp, S. cerevisiae
aattcgacagagtttactgccgcct

SEQ ID NO: 20374 - DNA, 25 bp, S. cerevisiae
aattcccaaaacaagactgctgctt

SEQ ID NO: 20375 - DNA, 25 bp, S. cerevisiae
aattgccagtaaccaaaggtctctg

SEQ ID NO: 20376 - DNA, 25 bp, S. cerevisiae
aatatgccagattatcccacacttc

SEQ ID NO: 20377 - DNA, 25 bp, S. cerevisiae
aatatgctcaattctgggctactca

SEQ ID NO: 20378 - DNA, 25 bp, S. cerevisiae
aatatcaaatttcccttctctactg

SEQ ID NO: 20379 - DNA, 25 bp, S. cerevisiae
aattttactgtcctgggcagaccta

SEQ ID NO: 20380 - DNA, 25 bp, S. cerevisiae
aatttacctgatggcgtcgaacctc

SEQ ID NO: 20381 - DNA, 25 bp, S. cerevisiae
aattaccacccacttgcgaagatga

SEQ ID NO: 20382 - DNA, 25 bp, S. cerevisiae
aattaccagccctgtgacaattggc

SEQ ID NO: 20383 - DNA, 25 bp, S. cerevisiae
aattatgttgtccacacctttgcag

SEQ ID NO: 20384 - DNA, 25 bp, S. cerevisiae
aattatgtctgaatcaccatcccca

SEQ ID NO: 20385 - DNA, 25 bp, S. cerevisiae
aatattgccacattttcatcagaga

SEQ ID NO: 20386 - DNA, 25 bp, S. cerevisiae
aatatttacagctttgcatacgcca

SEQ ID NO: 20387 - DNA, 25 bp, S. cerevisiae
aatatttagcattcttcgagtccaa

SEQ ID NO: 20388 - DNA, 25 bp, S. cerevisiae
aatattccacattgttcgacccatg

SEQ ID NO: 20389 - DNA, 25 bp, S. cerevisiae
aattttggtctctttagcgctaatg

SEQ ID NO: 20390 - DNA, 25 bp, S. cerevisiae
aattattggttgacgcaagcgctaa

SEQ ID NO: 20391 - DNA, 25 bp, S. cerevisiae
aattcttcagccaatagctcgcagc

SEQ ID NO: 20392 - DNA, 25 bp, S. cerevisiae
aatattggcctctatgctatctaaa

SEQ ID NO: 20393 - DNA, 25 bp, S. cerevisiae
aatattagcgccttggttgcataca

SEQ ID NO: 20394 - DNA, 25 bp, S. cerevisiae
aatatctgagtgtcttttgtgctac

SEQ ID NO: 20395 - DNA, 25 bp, S. cerevisiae
aatatcttggacttcatgcgccagc

SEQ ID NO: 20396 - DNA, 25 bp, S. cerevisiae
aattcaaggcattttgttccggaag

SEQ ID NO: 20397 - DNA, 25 bp, S. cerevisiae
aattcaatgcggtttgggccgttca

SEQ ID NO: 20398 - DNA, 25 bp, S. cerevisiae
aatattgactggtgcctgtgcaggt

SEQ ID NO: 20399 - DNA, 25 bp, S. cerevisiae
caatattgacgacttgccggacttc

SEQ ID NO: 20400 - DNA, 25 bp, S. cerevisiae
aattattgcattcgcgcccaatttg

SEQ ID NO: 20401 - DNA, 25 bp, S. cerevisiae
aattaccagctacgactattccaac

SEQ ID NO: 20402 - DNA, 25 bp, S. cerevisiae
aattaccagtatcggttcccatccg

SEQ ID NO: 20403 - DNA, 25 bp, S. cerevisiae
aattcgaagctagggcagccagcct

SEQ ID NO: 20404 - DNA, 25 bp, S. cerevisiae
aatatcacatactttgcgcaccagg

SEQ ID NO: 20405 - DNA, 25 bp, S. cerevisiae
aattcagatgactttgccaaccaaa

SEQ ID NO: 20406 - DNA, 25 bp, S. cerevisiae
aattcaggtgctaccttgaacacaa

SEQ ID NO: 20407 - DNA, 25 bp, S. cerevisiae
aattatgtgaggacgctgaggcaaa

SEQ ID NO: 20408 - DNA, 25 bp, S. cerevisiae
aatataatgctatctctgggaatac

SEQ ID NO: 20409 - DNA, 25 bp, S. cerevisiae
aattaatgtcgaccagtatgactag

SEQ ID NO: 20410 - DNA, 25 bp, S. cerevisiae
aatatttgggccgatttctcacacc

SEQ ID NO: 20411 - DNA, 25 bp, S. cerevisiae
aattatcctcaattcatgtgtccga

SEQ ID NO: 20412 - DNA, 25 bp, S. cerevisiae
aattatcccgcagtgaggtgctctt

SEQ ID NO: 20413 - DNA, 25 bp, S. cerevisiae
aatattacgccccagtgttcttgat

SEQ ID NO: 20414 - DNA, 25 bp, S. cerevisiae
aattatataccccatgtcctcggat

SEQ ID NO: 20415 - DNA, 25 bp, S. cerevisiae
aatattatctcctcgataccagcgt

SEQ ID NO: 20416 - DNA, 25 bp, S. cerevisiae
aatttgaaccaatcccactgggcgt

SEQ ID NO: 20417 - DNA, 25 bp, S. cerevisiae
aatttccacaatatcatcttcccat

SEQ ID NO: 20418 - DNA, 25 bp, S. cerevisiae
aattttgctcaacgtctgcatagac

SEQ ID NO: 20419 - DNA, 25 bp, S. cerevisiae
aattgctggacctaacggagagcca

SEQ ID NO: 20420 - DNA, 25 bp, S. cerevisiae
aattctggacgttacattgctgcgc

SEQ ID NO: 20421 - DNA, 25 bp, S. cerevisiae
aatttctactacgacatccatggac

SEQ ID NO: 20422 - DNA, 25 bp, S. cerevisiae
aattacttccaccagcagaggcaga

SEQ ID NO: 20423 - DNA, 25 bp, S. cerevisiae
aattacgagtcacagcagcgcctga

SEQ ID NO: 20424 - DNA, 25 bp, S. cerevisiae
aatttcgcacaacagcacggtatgt

SEQ ID NO: 20425 - DNA, 25 bp, S. cerevisiae
aattacgcagaacttcacggtgtat

SEQ ID NO: 20426 - DNA, 25 bp, S. cerevisiae
aatattcttggctcatctgtttccg

SEQ ID NO: 20427 - DNA, 25 bp, S. cerevisiae
aatattttgagcacttctctctccg

SEQ ID NO: 20428 - DNA, 25 bp, S. cerevisiae
aattttcggatccatggctgcattc

SEQ ID NO: 20429 - DNA, 25 bp, S. cerevisiae
aatttcgcggattcggcagattatg

SEQ ID NO: 20430 - DNA, 25 bp, S. cerevisiae
aatttatactatccccacatttcgc

SEQ ID NO: 20431 - DNA, 25 bp, S. cerevisiae
aattctatttgggtaagcgtatcgc

SEQ ID NO: 20432 - DNA, 25 bp, S. cerevisiae
aattattttcaggaggcggcaacca

SEQ ID NO: 20433 - DNA, 25 bp, S. cerevisiae
aattttcttcgactgggagctacca

SEQ ID NO: 20434 - DNA, 25 bp, S. cerevisiae
aatttactttttctatggccatcac

SEQ ID NO: 20435 - DNA, 25 bp, S. cerevisiae
aatttgagttgagcggtattccacc

SEQ ID NO: 20436 - DNA, 25 bp, S. cerevisiae
aattaagttctgacgttacgcaagc

SEQ ID NO: 20437 - DNA, 25 bp, S. cerevisiae
aatttggttctatgtcctgctcaag

SEQ ID NO: 20438 - DNA, 25 bp, S. cerevisiae
aatttagtacacagcttcccggtag

SEQ ID NO: 20439 - DNA, 25 bp, S. cerevisiae
aattgcgggaactcatttacgatac

SEQ ID NO: 20440 - DNA, 25 bp, S. cerevisiae
aattggtggtattatcaggtcggat

SEQ ID NO: 20441 - DNA, 25 bp, S. cerevisiae
gaattcagggcaagtctcggtcgaa

SEQ ID NO: 20442 - DNA, 25 bp, S. cerevisiae
aattagcgagggaatctggccagaa

SEQ ID NO: 20443 - DNA, 25 bp, S. cerevisiae
aatattgcggctggtagtactacaa

SEQ ID NO: 20444 - DNA, 25 bp, S. cerevisiae
aatttcctagtttactatcctatga

SEQ ID NO: 20445 - DNA, 25 bp, S. cerevisiae
aattccgaaggaatactccgcagta

SEQ ID NO: 20446 - DNA, 25 bp, S. cerevisiae
aatttcgaaggtagcagccctcagc

SEQ ID NO: 20447 - DNA, 25 bp, S. cerevisiae
aatttcgaattgttgcctgagccac

SEQ ID NO: 20448 - DNA, 25 bp, S. cerevisiae
aatttaaatctgttcagcgcggcaa

SEQ ID NO: 20449 - DNA, 25 bp, S. cerevisiae
aattatagtttcgaagcctgccttg

SEQ ID NO: 20450 - DNA, 25 bp, S. cerevisiae
aatttactattagaccgcacctcct

SEQ ID NO: 20451 - DNA, 25 bp, S. cerevisiae
aatttccgtattgaccgaacctcat

SEQ ID NO: 20452 - DNA, 25 bp, S. cerevisiae
aattccctatttgattctgaaactc

SEQ ID NO: 20453 - DNA, 25 bp, S. cerevisiae
aattcgcgatatgctggattgtgta

SEQ ID NO: 20454 - DNA, 25 bp, S. cerevisiae
aatttaggcctgttgtgctcattaa

SEQ ID NO: 20455 - DNA, 25 bp, S. cerevisiae
aatttattccgcgtttgcttcattt

SEQ ID NO: 20456 - DNA, 25 bp, S. cerevisiae
aatttgatttctggtattgcctgca

SEQ ID NO: 20457 - DNA, 25 bp, S. cerevisiae
gaatttacgtctgctcggacagtac

SEQ ID NO: 20458 - DNA, 25 bp, S. cerevisiae
aatttgccttctccggtgaagctaa

SEQ ID NO: 20459 - DNA, 25 bp, S. cerevisiae
aatttgccctgattgctggatacgg

SEQ ID NO: 20460 - DNA, 25 bp, S. cerevisiae
aatttcctctggttactacattact

SEQ ID NO: 20461 - DNA, 25 bp, S. cerevisiae
aattatttctcgtttgctactgtac

SEQ ID NO: 20462 - DNA, 25 bp, S. cerevisiae
aatttctttgcagctcatggttgat

SEQ ID NO: 20463 - DNA, 25 bp, S. cerevisiae
tacatttcggtagactttctttaag

SEQ ID NO: 20464 - DNA, 25 bp, S. cerevisiae
aatttgggtgagctcgtatctttat

SEQ ID NO: 20465 - DNA, 25 bp, S. cerevisiae
aatttgttggccatggtgtctttga

SEQ ID NO: 20466 - DNA, 25 bp, S. cerevisiae
aattttctgtgcctcagatgcgcaa

SEQ ID NO: 20467 - DNA, 25 bp, S. cerevisiae
aattttccatgctcagcagcagcag

SEQ ID NO: 20468 - DNA, 25 bp, S. cerevisiae
aattttccacaacgcatgatgccac

SEQ ID NO: 20469 - DNA, 25 bp, S. cerevisiae
aatttgagcaccgtatcaacccaaa

SEQ ID NO: 20470 - DNA, 25 bp, S. cerevisiae
aatttatgcatcgtgttttccccaa

SEQ ID NO: 20471 - DNA, 25 bp, S. cerevisiae
aattactgtatgttcggtcgttctt

SEQ ID NO: 20472 - DNA, 25 bp, S. cerevisiae
aattattaacccaatgtagcgcatg

SEQ ID NO: 20473 - DNA, 25 bp, S. cerevisiae
aatttgttccattgattctcgccca

SEQ ID NO: 20474 - DNA, 25 bp, S. cerevisiae
aattctcttgtctctaccgcgatga

SEQ ID NO: 20475 - DNA, 25 bp, S. cerevisiae
aatttctcttatcctaccgtgtgaa

SEQ ID NO: 20476 - DNA, 25 bp, S. cerevisiae
aattattttaccgattcagcagtta

SEQ ID NO: 20477 - DNA, 25 bp, S. cerevisiae
aattttgtgatgagccttccgttgg

SEQ ID NO: 20478 - DNA, 25 bp, S. cerevisiae
aatttaatgtcatccttgccgacgg

SEQ ID NO: 20479 - DNA, 25 bp, S. cerevisiae
aatttcagggcatgtctatcccacg

SEQ ID NO: 20480 - DNA, 25 bp, S. cerevisiae
aatttcagcgatctgcttatgccaa

SEQ ID NO: 20481 - DNA, 25 bp, S. cerevisiae
aattgatcgggctttcagtggaaga

SEQ ID NO: 20482 - DNA, 25 bp, S. cerevisiae
aattcagcgggttatctttaagagc

SEQ ID NO: 20483 - DNA, 25 bp, S. cerevisiae
aatttcgattgggacctttgctctt

SEQ ID NO: 20484 - DNA, 25 bp, S. cerevisiae
aatttctctctttctttgctgtctt

SEQ ID NO: 20485 - DNA, 25 bp, S. cerevisiae
aatttccaaatacctttcgctatag

SEQ ID NO: 20486 - DNA, 25 bp, S. cerevisiae
caaacggcaaattatcttccctata

SEQ ID NO: 20487 - DNA, 25 bp, S. cerevisiae
aattatcatcacattcgcattcacg

SEQ ID NO: 20488 - DNA, 25 bp, S. cerevisiae
aatttatctcagcatccttcatcag

SEQ ID NO: 20489 - DNA, 25 bp, S. cerevisiae
aatttctgctgggtacttgtcacca

SEQ ID NO: 20490 - DNA, 25 bp, S. cerevisiae
aatttctgtctggtgtcttgccaaa

SEQ ID NO: 20491 - DNA, 25 bp, S. cerevisiae
aatttttactctttatgcggctcca

SEQ ID NO: 20492 - DNA, 25 bp, S. cerevisiae
aattaattactgcagttgccccacc

SEQ ID NO: 20493 - DNA, 25 bp, S. cerevisiae
aattctggtacgcaggtggcccacg

SEQ ID NO: 20494 - DNA, 25 bp, S. cerevisiae
aatttcttgtcttcaggattatcag

SEQ ID NO: 20495 - DNA, 25 bp, S. cerevisiae
aattttttgctcatacctacaagga

SEQ ID NO: 20496 - DNA, 25 bp, S. cerevisiae
aatttcctccaatcttgtaccaatg

SEQ ID NO: 20497 - DNA, 25 bp, S. cerevisiae
aatttctcccgatttagagaccaag

SEQ ID NO: 20498 - DNA, 25 bp, S. cerevisiae
aattgtccacctgttgaaaccaaga

SEQ ID NO: 20499 - DNA, 25 bp, S. cerevisiae
aattgaccactacacaaacccaaga

SEQ ID NO: 20500 - DNA, 25 bp, S. cerevisiae
aattaccccatttacagatcgccaa

SEQ ID NO: 20501 - DNA, 25 bp, S. cerevisiae
aattacccttgccttcagtggcgaa

SEQ ID NO: 20502 - DNA, 25 bp, S. cerevisiae
aattgcacgttcactgccattgacg

SEQ ID NO: 20503 - DNA, 25 bp, S. cerevisiae
aattcttgttcgtcgcaataggcgc

SEQ ID NO: 20504 - DNA, 25 bp, S. cerevisiae
aattcaatgttctcaggacgtgctg

SEQ ID NO: 20505 - DNA, 25 bp, S. cerevisiae
caattggacgtaccggacaacctga

SEQ ID NO: 20506 - DNA, 25 bp, S. cerevisiae
aatttctgattactgctcgcgaacg

SEQ ID NO: 20507 - DNA, 25 bp, S. cerevisiae
aatttagtgcattcttgggacctga

SEQ ID NO: 20508 - DNA, 25 bp, S. cerevisiae
aattcatcgcctatgatgggcccaa

SEQ ID NO: 20509 - DNA, 25 bp, S. cerevisiae
aattttcattgcagcactgaccaag

SEQ ID NO: 20510 - DNA, 25 bp, S. cerevisiae
aatttttatgccaatctgaccacgc

SEQ ID NO: 20511 - DNA, 25 bp, S. cerevisiae
aatttcatgcttgatatcctccacg

SEQ ID NO: 20512 - DNA, 25 bp, S. cerevisiae
aattctggcttggaccgatcgaaga

SEQ ID NO: 20513 - DNA, 25 bp, S. cerevisiae
aattcatcggtgttgctgattacgt

SEQ ID NO: 20514 - DNA, 25 bp, S. cerevisiae
aatttcgtcttatgatctctcccaa

SEQ ID NO: 20515 - DNA, 25 bp, S. cerevisiae
aattcgatgccgtcttggtatttaa

SEQ ID NO: 20516 - DNA, 25 bp, S. cerevisiae
cagcttcctacgctaagtacttgat

SEQ ID NO: 20517 - DNA, 25 bp, S. cerevisiae
aattcagtacggacaagcttcttga

SEQ ID NO: 20518 - DNA, 25 bp, S. cerevisiae
aattcttgatcgttacacttcctat

SEQ ID NO: 20519 - DNA, 25 bp, S. cerevisiae
aattttgcacgtcaagtatcgctta

SEQ ID NO: 20520 - DNA, 25 bp, S. cerevisiae
aattctccgcctgattatgggttta

SEQ ID NO: 20521 - DNA, 25 bp, S. cerevisiae
aattcaccgctagttcatgaggtca

SEQ ID NO: 20522 - DNA, 25 bp, S. cerevisiae
aattatgggcattcttctgagcgta

SEQ ID NO: 20523 - DNA, 25 bp, S. cerevisiae
aattatgtttgtactccggctacgg

SEQ ID NO: 20524 - DNA, 25 bp, S. cerevisiae
aattttgtttatttccactaccatg

SEQ ID NO: 20525 - DNA, 25 bp, S. cerevisiae
aattcggtgtgattttccactccgt

SEQ ID NO: 20526 - DNA, 25 bp, S. cerevisiae
aattcggattgtgttccacttgctt

SEQ ID NO: 20527 - DNA, 25 bp, S. cerevisiae
aattttccttgttgctattatcggt

SEQ ID NO: 20528 - DNA, 25 bp, S. cerevisiae
aattttatactgttcttccatcggt

SEQ ID NO: 20529 - DNA, 25 bp, S. cerevisiae
aatttatcttctctatcatcctcta

SEQ ID NO: 20530 - DNA, 25 bp, S. cerevisiae
aatttttgagtgcttatcggtcgga

SEQ ID NO: 20531 - DNA, 25 bp, S. cerevisiae
aattgttgttgccaagtccggtgaa

SEQ ID NO: 20532 - DNA, 25 bp, S. cerevisiae
aattgctggtttgattgccggtatc

SEQ ID NO: 20533 - DNA, 25 bp, S. cerevisiae
aattaggtactccattcggtgtcac

SEQ ID NO: 20534 - DNA, 25 bp, S. cerevisiae
caatctcagtggacttttcaagtta

SEQ ID NO: 20535 - DNA, 25 bp, S. cerevisiae
caatacgggcgcttcaaaatttcaa

SEQ ID NO: 20536 - DNA, 25 bp, S. cerevisiae
aattctgggcgcagcaaagcgttca

SEQ ID NO: 20537 - DNA, 25 bp, S. cerevisiae
aattgggcgcgcactacgtttagaa

SEQ ID NO: 20538 - DNA, 25 bp, S. cerevisiae
aattcgctaacgctgttttgtccgg

SEQ ID NO: 20539 - DNA, 25 bp, S. cerevisiae
aattactactcgatgcctcttgaat

SEQ ID NO: 20540 - DNA, 25 bp, S. cerevisiae
aattaggtcattatgcttcttgcat

SEQ ID NO: 20541 - DNA, 25 bp, S. cerevisiae
aattaactctacatggtcgccttta

SEQ ID NO: 20542 - DNA, 25 bp, S. cerevisiae
aattaacactacaatgcctcccatg

SEQ ID NO: 20543 - DNA, 25 bp, S. cerevisiae
aattcaccttaattgccattcctgg

SEQ ID NO: 20544 - DNA, 25 bp, S. cerevisiae
aatttttgatacctatgtgccggca

SEQ ID NO: 20545 - DNA, 25 bp, S. cerevisiae
cagatttttacaacgttccagtgga

SEQ ID NO: 20546 - DNA, 25 bp, S. cerevisiae
aattgttacaggtcgtacgggtcat

SEQ ID NO: 20547 - DNA, 25 bp, S. cerevisiae
aattgactaaaatcgggcttctgcc

SEQ ID NO: 20548 - DNA, 25 bp, S. cerevisiae
aattggctaaacatgccgtctccga

SEQ ID NO: 20549 - DNA, 25 bp, S. cerevisiae
aattcctacgaggtgcggacttcaa

SEQ ID NO: 20550 - DNA, 25 bp, S. cerevisiae
aattccattgcatagagctgcgtcg

SEQ ID NO: 20551 - DNA, 25 bp, S. cerevisiae
aattcaatgtcgtcatgacctgctc

SEQ ID NO: 20552 - DNA, 25 bp, S. cerevisiae
aattgatccaatctttgccaccaac

SEQ ID NO: 20553 - DNA, 25 bp, S. cerevisiae
aattatgccctttttatcaccaccg

SEQ ID NO: 20554 - DNA, 25 bp, S. cerevisiae
caattagcctgtttgttgtacaagc

SEQ ID NO: 20555 - DNA, 25 bp, S. cerevisiae
aattgagtgagatacccggaatggt

SEQ ID NO: 20556 - DNA, 25 bp, S. cerevisiae
aattgagctcaaaaccacggtttct

SEQ ID NO: 20557 - DNA, 25 bp, S. cerevisiae
aattcgcccaaagcgtggtttcgcg

SEQ ID NO: 20558 - DNA, 25 bp, S. cerevisiae
aattccggcaaatccagttacgacg

SEQ ID NO: 20559 - DNA, 25 bp, S. cerevisiae
aattgggctgaatacgctatggaaa

SEQ ID NO: 20560 - DNA, 25 bp, S. cerevisiae
aattgggttacctcattgtagatga

SEQ ID NO: 20561 - DNA, 25 bp, S. cerevisiae
aattaggctgttccggatgtttgag

SEQ ID NO: 20562 - DNA, 25 bp, S. cerevisiae
aattagtgtactccggtgtcttcac

SEQ ID NO: 20563 - DNA, 25 bp, S. cerevisiae
aattattggatttcggtgcctccag

SEQ ID NO: 20564 - DNA, 25 bp, S. cerevisiae
aattttcagatttcgagagctctat

SEQ ID NO: 20565 - DNA, 25 bp, S. cerevisiae
cacaagatcgccactacgggtgagt

SEQ ID NO: 20566 - DNA, 25 bp, S. cerevisiae
aattgactgcctacaacgggatgac

SEQ ID NO: 20567 - DNA, 25 bp, S. cerevisiae
aattgccaccacgacaagtattcct

SEQ ID NO: 20568 - DNA, 25 bp, S. cerevisiae
aattccagacggagacaattcccct

SEQ ID NO: 20569 - DNA, 25 bp, S. cerevisiae
caattgcagctgttgcgggaaacaa

SEQ ID NO: 20570 - DNA, 25 bp, S. cerevisiae
aattcgctgcttggagcaagttcca

SEQ ID NO: 20571 - DNA, 25 bp, S. cerevisiae
aattcaaggtgtcaggtgcggcaac

SEQ ID NO: 20572 - DNA, 25 bp, S. cerevisiae
aattcatcagggtcagtggtgcgga

SEQ ID NO: 20573 - DNA, 25 bp, S. cerevisiae
aattgcccttatttccagagaccat

SEQ ID NO: 20574 - DNA, 25 bp, S. cerevisiae
aattttctcaattcatcaacgatga

SEQ ID NO: 20575 - DNA, 25 bp, S. cerevisiae
aattatctttatccagaactgatgc

SEQ ID NO: 20576 - DNA, 25 bp, S. cerevisiae
aattagcttgctagggtcgcatgat

SEQ ID NO: 20577 - DNA, 25 bp, S. cerevisiae
aattcaccaatacttgtttcaagaa

SEQ ID NO: 20578 - DNA, 25 bp, S. cerevisiae
aattcaccaatacttgtttcaagaa

SEQ ID NO: 20579 - DNA, 25 bp, S. cerevisiae
aattgccgcaagttcttttaatcca

SEQ ID NO: 20580 - DNA, 25 bp, S. cerevisiae
aattcttgcggtctcatttgtatcc

SEQ ID NO: 20581 - DNA, 25 bp, S. cerevisiae
aattttctggtgttcttgatggaca

SEQ ID NO: 20582 - DNA, 25 bp, S. cerevisiae
aattttcggctcatacaacgccttc

SEQ ID NO: 20583 - DNA, 25 bp, S. cerevisiae
aattcttgggtttacgacagcatca

SEQ ID NO: 20584 - DNA, 25 bp, S. cerevisiae
aattctttcaaaatatcgacgccaa

SEQ ID NO: 20585 - DNA, 25 bp, S. cerevisiae
aattcactattatcagacgacgaca

SEQ ID NO: 20586 - DNA, 25 bp, S. cerevisiae
aattccaatttagtcccatccttgg

SEQ ID NO: 20587 - DNA, 25 bp, S. cerevisiae
caattggttggtgtatcggctttat

SEQ ID NO: 20588 - DNA, 25 bp, S. cerevisiae
gaattggccggtggtaacgcttctt

SEQ ID NO: 20589 - DNA, 25 bp, S. cerevisiae
ccaccagccaccattgaaactttta

SEQ ID NO: 20590 - DNA, 25 bp, S. cerevisiae
gccggtaaggccaacaagcaatttg

SEQ ID NO: 20591 - DNA, 25 bp, S. cerevisiae
gccaagtccaggctactgctgaagt

SEQ ID NO: 20592 - DNA, 25 bp, S. cerevisiae
ctcattagtagagacacccggtaag

SEQ ID NO: 20593 - DNA, 25 bp, S. cerevisiae
aattagtaagctgcacaccgatgtg

SEQ ID NO: 20594 - DNA, 25 bp, S. cerevisiae
aattgccggcggtattgctggagca

SEQ ID NO: 20595 - DNA, 25 bp, S. cerevisiae
aattctttgcgggattgttaggtca

SEQ ID NO: 20596 - DNA, 25 bp, S. cerevisiae
aattgggacggttctgctgtaggct

SEQ ID NO: 20597 - DNA, 25 bp, S. cerevisiae
aattggcggtagagccctcaaaatt

SEQ ID NO: 20598 - DNA, 25 bp, S. cerevisiae
aattccggtagcaatgccgccacta

SEQ ID NO: 20599 - DNA, 25 bp, S. cerevisiae
aattctcaggattgtgtgcctctac

SEQ ID NO: 20600 - DNA, 25 bp, S. cerevisiae
aattgtatggtcttttccgcctgcc

SEQ ID NO: 20601 - DNA, 25 bp, S. cerevisiae
gaatttaacggacacgctctatggt

SEQ ID NO: 20602 - DNA, 25 bp, S. cerevisiae
aattgttcaacagagccgctatatt

SEQ ID NO: 20603 - DNA, 25 bp, S. cerevisiae
aattgtgtccactaaggcgacgccc

SEQ ID NO: 20604 - DNA, 25 bp, S. cerevisiae
aattgcgctctatgaagttgaccca

SEQ ID NO: 20605 - DNA, 25 bp, S. cerevisiae
aattcgcgttaaaggctgacagtca

SEQ ID NO: 20606 - DNA, 25 bp, S. cerevisiae
aattctccgcagacattgaagcact

SEQ ID NO: 20607 - DNA, 25 bp, S. cerevisiae
aattgcgaacgattggaagacttac

SEQ ID NO: 20608 - DNA, 25 bp, S. cerevisiae
caatggtcagaaaatggcaaacttt

SEQ ID NO: 20609 - DNA, 25 bp, S. cerevisiae
caactgtcagtgacaaccaaaccac

SEQ ID NO: 20610 - DNA, 25 bp, S. cerevisiae
aattgccaaggcacgaagacctcga

SEQ ID NO: 20611 - DNA, 25 bp, S. cerevisiae
aattgccgctaatcgagaacctaat

SEQ ID NO: 20612 - DNA, 25 bp, S. cerevisiae
aattcctcattatcggagcactcta

SEQ ID NO: 20613 - DNA, 25 bp, S. cerevisiae
aattccatgattatctacattttaa

SEQ ID NO: 20614 - DNA, 25 bp, S. cerevisiae
aattattcgcgatttctctcaagca

SEQ ID NO: 20615 - DNA, 25 bp, S. cerevisiae
aattcaatcccacttcatctaaact

SEQ ID NO: 20616 - DNA, 25 bp, S. cerevisiae
caatgtacttcgttgtcggtttcgg

SEQ ID NO: 20617 - DNA, 25 bp, S. cerevisiae
aattattcttatatgggctatccaa

SEQ ID NO: 20618 - DNA, 25 bp, S. cerevisiae
aattgttcgatttcacagcggacgg

SEQ ID NO: 20619 - DNA, 25 bp, S. cerevisiae
aattacgagtgtctcactggtcgcg

SEQ ID NO: 20620 - DNA, 25 bp, S. cerevisiae
aattatctagttacaccggtgctgc

SEQ ID NO: 20621 - DNA, 25 bp, S. cerevisiae
aattattttgattccttcggctgcg

SEQ ID NO: 20622 - DNA, 25 bp, S. cerevisiae
aattattgtgggtcttttcattcag

SEQ ID NO: 20623 - DNA, 25 bp, S. cerevisiae
caataaatgcgtgactggctatagt

SEQ ID NO: 20624 - DNA, 25 bp, S. cerevisiae
caataagacagtttcatgggcagat

SEQ ID NO: 20625 - DNA, 25 bp, S. cerevisiae
caatggaacgactatgtggaagatc

SEQ ID NO: 20626 - DNA, 25 bp, S. cerevisiae
caatgggaagagtcgctgcaacagt

SEQ ID NO: 20627 - DNA, 25 bp, S. cerevisiae
caaatggcaaactctaactgatctt

SEQ ID NO: 20628 - DNA, 25 bp, S. cerevisiae
aattggacaccatctaattacattg

SEQ ID NO: 20629 - DNA, 25 bp, S. cerevisiae
aattgcccatccagcttattcaaag

SEQ ID NO: 20630 - DNA, 25 bp, S. cerevisiae
aattccttgactcaaaaatatggta

SEQ ID NO: 20631 - DNA, 25 bp, S. cerevisiae
aattccttactctccaaaatccatt

SEQ ID NO: 20632 - DNA, 25 bp, S. cerevisiae
aattcactctttctttcatttccat

SEQ ID NO: 20633 - DNA, 25 bp, S. cerevisiae
aattctggagatcaacggcggcctg

SEQ ID NO: 20634 - DNA, 25 bp, S. cerevisiae
aattctaaatccacgtctgcagttg

SEQ ID NO: 20635 - DNA, 25 bp, S. cerevisiae
gccattcgaaatgcaagggccatgt

SEQ ID NO: 20636 - DNA, 25 bp, S. cerevisiae
aattcgaccatccaagtgactcagt

SEQ ID NO: 20637 - DNA, 25 bp, S. cerevisiae
aattagcgccactaaggacttggta

SEQ ID NO: 20638 - DNA, 25 bp, S. cerevisiae
caatacattcaacctcatcaacaac

SEQ ID NO: 20639 - DNA, 25 bp, S. cerevisiae
caaagcactatatcccgactactat

SEQ ID NO: 20640 - DNA, 25 bp, S. cerevisiae
aattccagcgaatgacgtctgccat

SEQ ID NO: 20641 - DNA, 25 bp, S. cerevisiae
aattccaggaacgacggtgccaatg

SEQ ID NO: 20642 - DNA, 25 bp, S. cerevisiae
aattacaaacaccagcaggaggcaa

SEQ ID NO: 20643 - DNA, 25 bp, S. cerevisiae
aattctaatccatacaccactgcat

SEQ ID NO: 20644 - DNA, 25 bp, S. cerevisiae
aattcgaacccacaagatctgcatg

SEQ ID NO: 20645 - DNA, 25 bp, S. cerevisiae
aattgtggaactatcctgccatcgg

SEQ ID NO: 20646 - DNA, 25 bp, S. cerevisiae
aattgtggcagggatgtgtccgcaa

SEQ ID NO: 20647 - DNA, 25 bp, S. cerevisiae
aattacagcgcggtgtggccgcaag

SEQ ID NO: 20648 - DNA, 25 bp, S. cerevisiae
aattatgatgccaacggctcctcgt

SEQ ID NO: 20649 - DNA, 25 bp, S. cerevisiae
aattatgatcgattgttcccacggc

SEQ ID NO: 20650 - DNA, 25 bp, S. cerevisiae
aattcttgctagtacactgcacggt

SEQ ID NO: 20651 - DNA, 25 bp, S. cerevisiae
aattcattcaagagctcagccgtcc

SEQ ID NO: 20652 - DNA, 25 bp, S. cerevisiae
aattcgacaagatgccaagctgtat

SEQ ID NO: 20653 - DNA, 25 bp, S. cerevisiae
aattatgcaccacatctaagcgatg

SEQ ID NO: 20654 - DNA, 25 bp, S. cerevisiae
aattctataagctgcatcccacagg

SEQ ID NO: 20655 - DNA, 25 bp, S. cerevisiae
aattcatttggttgcatcactctat

SEQ ID NO: 20656 - DNA, 25 bp, S. cerevisiae
aattacctggtattcctcatctact

SEQ ID NO: 20657 - DNA, 25 bp, S. cerevisiae
aattagccggtttcatcatcttgac

SEQ ID NO: 20658 - DNA, 25 bp, S. cerevisiae
aattacccattgttctctggcaacg

SEQ ID NO: 20659 - DNA, 25 bp, S. cerevisiae
aattgaccagtttggctgtggcgac

SEQ ID NO: 20660 - DNA, 25 bp, S. cerevisiae
aattgctcaagaactggctgtggct

SEQ ID NO: 20661 - DNA, 25 bp, S. cerevisiae
aattcaactcaattgggcttccaaa

SEQ ID NO: 20662 - DNA, 25 bp, S. cerevisiae
aattcgaccatttgctgttactaag

SEQ ID NO: 20663 - DNA, 25 bp, S. cerevisiae
aattcagagcccacaggtcagcaaa

SEQ ID NO: 20664 - DNA, 25 bp, S. cerevisiae
aattgcaagccagtgccgaattcac

SEQ ID NO: 20665 - DNA, 25 bp, S. cerevisiae
aattgacgccaagatgagtgatata

SEQ ID NO: 20666 - DNA, 25 bp, S. cerevisiae
aattcaaccgcagatagttcatcag

SEQ ID NO: 20667 - DNA, 25 bp, S. cerevisiae
aattcccatctagaccttatcgaac

SEQ ID NO: 20668 - DNA, 25 bp, S. cerevisiae
aattcctgaggacactttaccattg

SEQ ID NO: 20669 - DNA, 25 bp, S. cerevisiae
aattgccatgcaagaccactcaaac

SEQ ID NO: 20670 - DNA, 25 bp, S. cerevisiae
aattctagttggctcatgcgttggt

SEQ ID NO: 20671 - DNA, 25 bp, S. cerevisiae
aattaagttgcccatcatgcgataa

SEQ ID NO: 20672 - DNA, 25 bp, S. cerevisiae
aattacatttcccatcagttacaag

SEQ ID NO: 20673 - DNA, 25 bp, S. cerevisiae
gagattacttccactttcgtaccga

SEQ ID NO: 20674 - DNA, 25 bp, S. cerevisiae
aattcagcttccactattgcagagt

SEQ ID NO: 20675 - DNA, 25 bp, S. cerevisiae
aattactccatcattcattgcagaa

SEQ ID NO: 20676 - DNA, 25 bp, S. cerevisiae
aattacatcccttattggctgaact

SEQ ID NO: 20677 - DNA, 25 bp, S. cerevisiae
aattgattcaccatttgggcgaccc

SEQ ID NO: 20678 - DNA, 25 bp, S. cerevisiae
aattgctaaccacttcggtgctgac

SEQ ID NO: 20679 - DNA, 25 bp, S. cerevisiae
aattcttgaccaatgtattctctag

SEQ ID NO: 20680 - DNA, 25 bp, S. cerevisiae
aattcatattctggtgcgattccga

SEQ ID NO: 20681 - DNA, 25 bp, S. cerevisiae
aattgctagccaaaactccctgggt

SEQ ID NO: 20682 - DNA, 25 bp, S. cerevisiae
aattactacaaagctcctggatgag

SEQ ID NO: 20683 - DNA, 25 bp, S. cerevisiae
aattacgtgcgatgagctcttgcaa

SEQ ID NO: 20684 - DNA, 25 bp, S. cerevisiae
caatatcttgtagaatcaggaaact

SEQ ID NO: 20685 - DNA, 25 bp, S. cerevisiae
aattgcatcttcaccaagtcgaaag

SEQ ID NO: 20686 - DNA, 25 bp, S. cerevisiae
aattctgcaagctccaattttgaag

SEQ ID NO: 20687 - DNA, 25 bp, S. cerevisiae
aattgctagagctcatcagttagtg

SEQ ID NO: 20688 - DNA, 25 bp, S. cerevisiae
aattactatcaacagcctcagcaac

SEQ ID NO: 20689 - DNA, 25 bp, S. cerevisiae
aattacttatacgtctcccaatcat

SEQ ID NO: 20690 - DNA, 25 bp, S. cerevisiae
aattacacaataccttacctctcag

SEQ ID NO: 20691 - DNA, 25 bp, S. cerevisiae
aattaatgacccctcttgttctgag

SEQ ID NO: 20692 - DNA, 25 bp, S. cerevisiae
aattcatccttctagacccttattt

SEQ ID NO: 20693 - DNA, 25 bp, S. cerevisiae
aattcattcatttacctccatctac

SEQ ID NO: 20694 - DNA, 25 bp, S. cerevisiae
aattccccgttagtgaactgaacag

SEQ ID NO: 20695 - DNA, 25 bp, S. cerevisiae
aattggttgcttctggtacttctcc

SEQ ID NO: 20696 - DNA, 25 bp, S. cerevisiae
aattgcgttctcttgtactactttg

SEQ ID NO: 20697 - DNA, 25 bp, S. cerevisiae
aattgccatgtttttgcttactaat

SEQ ID NO: 20698 - DNA, 25 bp, S. cerevisiae
aattcgcatttcttcagtctagcca

SEQ ID NO: 20699 - DNA, 25 bp, S. cerevisiae
aattcgataatcttttcactgcccc

SEQ ID NO: 20700 - DNA, 25 bp, S. cerevisiae
aattggtggatctaagtcctccccg

SEQ ID NO: 20701 - DNA, 25 bp, S. cerevisiae
aattcttcaacctaccattgtcgag

SEQ ID NO: 20702 - DNA, 25 bp, S. cerevisiae
aattgtcagaggctacatcaccgga

SEQ ID NO: 20703 - DNA, 25 bp, S. cerevisiae
aattcgtacacgttttctccatctt

SEQ ID NO: 20704 - DNA, 25 bp, S. cerevisiae
aattcgataacgttcagctcgcctc

SEQ ID NO: 20705 - DNA, 25 bp, S. cerevisiae
aattgatagaaggtgcccgcgccac

SEQ ID NO: 20706 - DNA, 25 bp, S. cerevisiae
aattgggccatctatctcccgatga

SEQ ID NO: 20707 - DNA, 25 bp, S. cerevisiae
aattgcagcgacaacattttggcga

SEQ ID NO: 20708 - DNA, 25 bp, S. cerevisiae
aattgggacgacttgcatctgggca

SEQ ID NO: 20709 - DNA, 25 bp, S. cerevisiae
aattgttgcccatggtgcttgccag

SEQ ID NO: 20710 - DNA, 25 bp, S. cerevisiae
aattgttgcgtctagtgttacttga

SEQ ID NO: 20711 - DNA, 25 bp, S. cerevisiae
aattacacttgccatttgctttttg

SEQ ID NO: 20712 - DNA, 25 bp, S. cerevisiae
aattccctatcgcttgctaattgga

SEQ ID NO: 20713 - DNA, 25 bp, S. cerevisiae
aattcatccttctcttctacattga

SEQ ID NO: 20714 - DNA, 25 bp, S. cerevisiae
aattcacatccttcactatatacgt

SEQ ID NO: 20715 - DNA, 25 bp, S. cerevisiae
aattcgagccctctataagcaggag

SEQ ID NO: 20716 - DNA, 25 bp, S. cerevisiae
aattcgaggcgcagctcaaagcgga

SEQ ID NO: 20717 - DNA, 25 bp, S. cerevisiae
aattcgaagccgtatctaacgcaga

SEQ ID NO: 20718 - DNA, 25 bp, S. cerevisiae
aattcgataggcctacgtatgtgaa

SEQ ID NO: 20719 - DNA, 25 bp, S. cerevisiae
aattctatacgcaccactagtacca

SEQ ID NO: 20720 - DNA, 25 bp, S. cerevisiae
aattctttccacattccagtgccaa

SEQ ID NO: 20721 - DNA, 25 bp, S. cerevisiae
aattctgttcattctgttccctcca

SEQ ID NO: 20722 - DNA, 25 bp, S. cerevisiae
caattctggccgtggaagtgacaca

SEQ ID NO: 20723 - DNA, 25 bp, S. cerevisiae
aattggcctcgctcgaactctggag

SEQ ID NO: 20724 - DNA, 25 bp, S. cerevisiae
aattgttctcgctgttacttgtggc

SEQ ID NO: 20725 - DNA, 25 bp, S. cerevisiae
aattcatttccccttagtttcatat

SEQ ID NO: 20726 - DNA, 25 bp, S. cerevisiae
aattcagttctgacgcacaagattt

SEQ ID NO: 20727 - DNA, 25 bp, S. cerevisiae
aattccgctgcgtttgatgagtttg

SEQ ID NO: 20728 - DNA, 25 bp, S. cerevisiae
aattgccctctggtatcgacgttaa

SEQ ID NO: 20729 - DNA, 25 bp, S. cerevisiae
aattctaacggccacataagcgctc

SEQ ID NO: 20730 - DNA, 25 bp, S. cerevisiae
aattcatgaagccagccgattcgcg

SEQ ID NO: 20731 - DNA, 25 bp, S. cerevisiae
aattcaactatgtagccgtcggtga

SEQ ID NO: 20732 - DNA, 25 bp, S. cerevisiae
aattcactttgaaccgtcgctgtac

SEQ ID NO: 20733 - DNA, 25 bp, S. cerevisiae
aattcagttattacgcgggcgattc

SEQ ID NO: 20734 - DNA, 25 bp, S. cerevisiae
aattgcaatcttcttccttgtgtgc

SEQ ID NO: 20735 - DNA, 25 bp, S. cerevisiae
aattggactccaagttgctgtgctg

SEQ ID NO: 20736 - DNA, 25 bp, S. cerevisiae
aattcgcgctattgtattacatgtg

SEQ ID NO: 20737 - DNA, 25 bp, S. cerevisiae
aattcggtattgatcttcgctgtat

SEQ ID NO: 20738 - DNA, 25 bp, S. cerevisiae
aattctatctacattgctatcacat

SEQ ID NO: 20739 - DNA, 25 bp, S. cerevisiae
aattcatctgcaacagcgcttttga

SEQ ID NO: 20740 - DNA, 25 bp, S. cerevisiae
aattgtgatggcacgagctcactta

SEQ ID NO: 20741 - DNA, 25 bp, S. cerevisiae
aattggtggacgcagaagctctatt

SEQ ID NO: 20742 - DNA, 25 bp, S. cerevisiae
aattcttactattgcacatcgtttg

SEQ ID NO: 20743 - DNA, 25 bp, S. cerevisiae
aattgttcaattggcctatttttca

SEQ ID NO: 20744 - DNA, 25 bp, S. cerevisiae
aattccatgattatctacattttaa

SEQ ID NO: 20745 - DNA, 25 bp, S. cerevisiae
aattccttctgttccagcgatggtg

SEQ ID NO: 20746 - DNA, 25 bp, S. cerevisiae
aattcctcctattcctgctaatgat

SEQ ID NO: 20747 - DNA, 25 bp, S. cerevisiae
aattgctagaattcacaccaccatc

SEQ ID NO: 20748 - DNA, 25 bp, S. cerevisiae
aattctaaatcgtccccactttcat

SEQ ID NO: 20749 - DNA, 25 bp, S. cerevisiae
aattcttgtcttgaggcatttcgac

SEQ ID NO: 20750 - DNA, 25 bp, S. cerevisiae
aattcatttattccacctcttcgca

SEQ ID NO: 20751 - DNA, 25 bp, S. cerevisiae
aattcagttgctacgtcagttctca

SEQ ID NO: 20752 - DNA, 25 bp, S. cerevisiae
aattctgagtcttttcatggttctc

SEQ ID NO: 20753 - DNA, 25 bp, S. cerevisiae
aattcgattggatcctggtttcaag

SEQ ID NO: 20754 - DNA, 25 bp, S. cerevisiae
caatctgtcaatgctccggaaggtt

SEQ ID NO: 20755 - DNA, 25 bp, S. cerevisiae
aattggctcaggttttcagggtgtc

SEQ ID NO: 20756 - DNA, 25 bp, S. cerevisiae
aattggtgcaggcttccggatttag

SEQ ID NO: 20757 - DNA, 25 bp, S. cerevisiae
aattgcaggataggatttcagaact

SEQ ID NO: 20758 - DNA, 25 bp, S. cerevisiae
aattgcatggtagcagtcccaacct

SEQ ID NO: 20759 - DNA, 25 bp, S. cerevisiae
aattgcaggtagtttcaccgcagcc

SEQ ID NO: 20760 - DNA, 25 bp, S. cerevisiae
aattgctagtttacataccgatcca

SEQ ID NO: 20761 - DNA, 25 bp, S. cerevisiae
aattgcggtatccaaacatccacac

SEQ ID NO: 20762 - DNA, 25 bp, S. cerevisiae
aattggtgctaagagaatccactct

SEQ ID NO: 20763 - DNA, 25 bp, S. cerevisiae
aattggagtttgttgcgtctcctgc

SEQ ID NO: 20764 - DNA, 25 bp, S. cerevisiae
aattggaatgtttcctcttccttct

SEQ ID NO: 20765 - DNA, 25 bp, S. cerevisiae
aattgcttaccctttgtacactgag

SEQ ID NO: 20766 - DNA, 25 bp, S. cerevisiae
aattcttcatttgcactggacattc

SEQ ID NO: 20767 - DNA, 25 bp, S. cerevisiae
caattgcatttcttcaactggatga

SEQ ID NO: 20768 - DNA, 25 bp, S. cerevisiae
aattggctactattacttgaaggga

SEQ ID NO: 20769 - DNA, 25 bp, S. cerevisiae
aattctgtcattgatgccatcgtgg

SEQ ID NO: 20770 - DNA, 25 bp, S. cerevisiae
aattgcagaattactcgccgattgt

SEQ ID NO: 20771 - DNA, 25 bp, S. cerevisiae
aattgaagatatcccgaccacgtct

SEQ ID NO: 20772 - DNA, 25 bp, S. cerevisiae
caatgctaaggaccggatgacccgt

SEQ ID NO: 20773 - DNA, 25 bp, S. cerevisiae
caactatcggaaatggatccctcga

SEQ ID NO: 20774 - DNA, 25 bp, S. cerevisiae
cacagttcggacaggtgtttgaatt

SEQ ID NO: 20775 - DNA, 25 bp, S. cerevisiae
caatttcggatgtggttcttccaga

SEQ ID NO: 20776 - DNA, 25 bp, S. cerevisiae
aattgtcgttagtgttcttacgcaa

SEQ ID NO: 20777 - DNA, 25 bp, S. cerevisiae
aattccatccggtgctgtcttaaga

SEQ ID NO: 20778 - DNA, 25 bp, S. cerevisiae
aattcttcctggcagactttacagt

SEQ ID NO: 20779 - DNA, 25 bp, S. cerevisiae
aattctgccgctaaagttttgtgct

SEQ ID NO: 20780 - DNA, 25 bp, S. cerevisiae
aattccatccttcatgattcattgt

SEQ ID NO: 20781 - DNA, 25 bp, S. cerevisiae
aattggcgacttctggtgttgataa

SEQ ID NO: 20782 - DNA, 25 bp, S. cerevisiae
aattctggatgcctttatgccttat

SEQ ID NO: 20783 - DNA, 25 bp, S. cerevisiae
aattgcgcaagtattgcccttggtg

SEQ ID NO: 20784 - DNA, 25 bp, S. cerevisiae
aattgctaacttttccgctatcgta

SEQ ID NO: 20785 - DNA, 25 bp, S. cerevisiae
aattccagacattatggcttcttag

SEQ ID NO: 20786 - DNA, 25 bp, S. cerevisiae
aattcgagacattatatggtccacg

SEQ ID NO: 20787 - DNA, 25 bp, S. cerevisiae
aattgaactgaaactgcccgtcttt

SEQ ID NO: 20788 - DNA, 25 bp, S. cerevisiae
aattgctatgtatactcacctgatt

SEQ ID NO: 20789 - DNA, 25 bp, S. cerevisiae
aattctcttggcgaatcctcaactt

SEQ ID NO: 20790 - DNA, 25 bp, S. cerevisiae
aattgcgcggactttgttttctact

SEQ ID NO: 20791 - DNA, 25 bp, S. cerevisiae
aattgcgtgacatctttctttctga

SEQ ID NO: 20792 - DNA, 25 bp, S. cerevisiae
aattgcaaacatactcttccttcac

SEQ ID NO: 20793 - DNA, 25 bp, S. cerevisiae
caagtcgcttgggatttttcccacg

SEQ ID NO: 20794 - DNA, 25 bp, S. cerevisiae
caattagttgaattatatgttccaa

SEQ ID NO: 20795 - DNA, 25 bp, S. cerevisiae
aattgtttgaattccatttgccaga

SEQ ID NO: 20796 - DNA, 25 bp, S. cerevisiae
aattgtttcaatggcggttgcccac

SEQ ID NO: 20797 - DNA, 25 bp, S. cerevisiae
aattgtttagacttggtgttccagc

SEQ ID NO: 20798 - DNA, 25 bp, S. cerevisiae
aattgctttaatcgctggttacggt

SEQ ID NO: 20799 - DNA, 25 bp, S. cerevisiae
aattgcttctaaagggtgcgccggt

SEQ ID NO: 20800 - DNA, 25 bp, S. cerevisiae
aattgctgtttaagggtgcacccat

SEQ ID NO: 20801 - DNA, 25 bp, S. cerevisiae
aattggtttagttgggacactgcta

SEQ ID NO: 20802 - DNA, 25 bp, S. cerevisiae
aattgcctttgtatgcactccagtg

SEQ ID NO: 20803 - DNA, 25 bp, S. cerevisiae
aattgcacatcgtatcgacactgta

SEQ ID NO: 20804 - DNA, 25 bp, S. cerevisiae
aattgacacctgtcgctattgcagc

SEQ ID NO: 20805 - DNA, 25 bp, S. cerevisiae
aattgaccgatttcctgatcatgca

SEQ ID NO: 20806 - DNA, 25 bp, S. cerevisiae
aattctgcccaaatgaccgtggatg

SEQ ID NO: 20807 - DNA, 25 bp, S. cerevisiae
aattctcccaatagccctggttatg

SEQ ID NO: 20808 - DNA, 25 bp, S. cerevisiae
aattcggtcataatgccatcggttt

SEQ ID NO: 20809 - DNA, 25 bp, S. cerevisiae
aattgcaggtacagcctctgaattt

SEQ ID NO: 20810 - DNA, 25 bp, S. cerevisiae
aattgggagccaccgttatatgatt

SEQ ID NO: 20811 - DNA, 25 bp, S. cerevisiae
caattttgacaagcccttctgggac

SEQ ID NO: 20812 - DNA, 25 bp, S. cerevisiae
caaggctgccggtaacgtcatgatt

SEQ ID NO: 20813 - DNA, 25 bp, S. cerevisiae
aattgctgacaacacaccggattcc

SEQ ID NO: 20814 - DNA, 25 bp, S. cerevisiae
aattgctgaacttaccaccattcca

SEQ ID NO: 20815 - DNA, 25 bp, S. cerevisiae
caatggctgaacttacccaattgtt

SEQ ID NO: 20816 - DNA, 25 bp, S. cerevisiae
cacggatgccattgctgacttgaat

SEQ ID NO: 20817 - DNA, 25 bp, S. cerevisiae
aattgctggccatgatgcggatgat

SEQ ID NO: 20818 - DNA, 25 bp, S. cerevisiae
caaggctcgaatagctgcaggcgat

SEQ ID NO: 20819 - DNA, 25 bp, S. cerevisiae
aattgtcgcatgtgctctgtggtta

SEQ ID NO: 20820 - DNA, 25 bp, S. cerevisiae
caatttcacagcttggttgggccaa

SEQ ID NO: 20821 - DNA, 25 bp, S. cerevisiae
aattgtcccaatcgctctggaggaa

SEQ ID NO: 20822 - DNA, 25 bp, S. cerevisiae
aattgccaacttcgcccaatggaag

SEQ ID NO: 20823 - DNA, 25 bp, S. cerevisiae
aattgccaaaatctcacacatgttt

SEQ ID NO: 20824 - DNA, 25 bp, S. cerevisiae
aattgctatcaaatgctcgaccgtt

SEQ ID NO: 20825 - DNA, 25 bp, S. cerevisiae
aattgccatatctttaagcgattta

SEQ ID NO: 20826 - DNA, 25 bp, S. cerevisiae
aattggccatttgatgcacctctac

SEQ ID NO: 20827 - DNA, 25 bp, S. cerevisiae
aattcctgtgaatagtgccgatggt

SEQ ID NO: 20828 - DNA, 25 bp, S. cerevisiae
aattcggatgccatgctggtggaca

SEQ ID NO: 20829 - DNA, 25 bp, S. cerevisiae
aattggagagccatggtgccgccat

SEQ ID NO: 20830 - DNA, 25 bp, S. cerevisiae
aattggagggcacgttctggcacat

SEQ ID NO: 20831 - DNA, 25 bp, S. cerevisiae
aattgtagcggcaagtctatcctcc

SEQ ID NO: 20832 - DNA, 25 bp, S. cerevisiae
aattgaatgggtcctattcgctcac

SEQ ID NO: 20833 - DNA, 25 bp, S. cerevisiae
caaggttaatggttctccaatcact

SEQ ID NO: 20834 - DNA, 25 bp, S. cerevisiae
caaggttaatggttctccaatcact

SEQ ID NO: 20835 - DNA, 25 bp, S. cerevisiae
caacgacttcattgacactgctact

SEQ ID NO: 20836 - DNA, 25 bp, S. cerevisiae
aattggctgagcttgaacacgactc

SEQ ID NO: 20837 - DNA, 25 bp, S. cerevisiae
caattggctgacttgtaccactcct

SEQ ID NO: 20838 - DNA, 25 bp, S. cerevisiae
aattccttatgtcgttgtttctgaa

SEQ ID NO: 20839 - DNA, 25 bp, S. cerevisiae
caagccaaaggcattgtttcaatct

SEQ ID NO: 20840 - DNA, 25 bp, S. cerevisiae
cttccatagggcttattttccagtt

SEQ ID NO: 20841 - DNA, 25 bp, S. cerevisiae
ccaccatattggatacacccgagtt

SEQ ID NO: 20842 - DNA, 25 bp, S. cerevisiae
caatcttgattaaggccgtcggtaa

SEQ ID NO: 20843 - DNA, 25 bp, S. cerevisiae
aattgctgtcacatctgcattcggt

SEQ ID NO: 20844 - DNA, 25 bp, S. cerevisiae
aattgcagctccagatggtcgctaa

SEQ ID NO: 20845 - DNA, 25 bp, S. cerevisiae
aattgagcgagcatgacctttcgaa

SEQ ID NO: 20846 - DNA, 25 bp, S. cerevisiae
aattggctgggattgtcgttcatat

SEQ ID NO: 20847 - DNA, 25 bp, S. cerevisiae
aattgccaggtgttgctttcttatc

SEQ ID NO: 20848 - DNA, 25 bp, S. cerevisiae
aattgtacgctttattttgtcatcg

SEQ ID NO: 20849 - DNA, 25 bp, S. cerevisiae
caatagtgtcactacgacccctaaa

SEQ ID NO: 20850 - DNA, 25 bp, S. cerevisiae
caattctccaacactgttccatatg

SEQ ID NO: 20851 - DNA, 25 bp, S. cerevisiae
aattgtccagagctatgttcaggtc

SEQ ID NO: 20852 - DNA, 25 bp, S. cerevisiae
aattgccaaggctatctttgacagg

SEQ ID NO: 20853 - DNA, 25 bp, S. cerevisiae
caatgtcccgattgtcaaggtcgtg

SEQ ID NO: 20854 - DNA, 25 bp, S. cerevisiae
aattgatcagccaatatctattgat

SEQ ID NO: 20855 - DNA, 25 bp, S. cerevisiae
aattgtgcccgaatccagtgatcct

SEQ ID NO: 20856 - DNA, 25 bp, S. cerevisiae
caattgaacgctttccttgacacac

SEQ ID NO: 20857 - DNA, 25 bp, S. cerevisiae
caattcatcaagtggcgcggaacta

SEQ ID NO: 20858 - DNA, 25 bp, S. cerevisiae
caatatgttgtaccctcgtgaggat

SEQ ID NO: 20859 - DNA, 25 bp, S. cerevisiae
caattcggtactctcagcagggatt

SEQ ID NO: 20860 - DNA, 25 bp, S. cerevisiae
caaaatgttcctttcggtggcttcg

SEQ ID NO: 20861 - DNA, 25 bp, S. cerevisiae
caacgacaccgattgggagctcgaa

SEQ ID NO: 20862 - DNA, 25 bp, S. cerevisiae
cgacgttcgggatggacctgcagaa

SEQ ID NO: 20863 - DNA, 25 bp, S. cerevisiae
caaggttcgaggaaagagaatgcca

SEQ ID NO: 20864 - DNA, 25 bp, S. cerevisiae
caacgctccggtgaagagacccaga

SEQ ID NO: 20865 - DNA, 25 bp, S. cerevisiae
aattgaccttttgcagggtgccgag

SEQ ID NO: 20866 - DNA, 25 bp, S. cerevisiae
aattggctgtgtttcgtatagtccg

SEQ ID NO: 20867 - DNA, 25 bp, S. cerevisiae
aattgggttgagactttcccgcgct

SEQ ID NO: 20868 - DNA, 25 bp, S. cerevisiae
aattgagtttctattctgtcgccca

SEQ ID NO: 20869 - DNA, 25 bp, S. cerevisiae
aattgaagatttcgctctctgtcca

SEQ ID NO: 20870 - DNA, 25 bp, S. cerevisiae
aattggagtcatatgtcacgagcac

SEQ ID NO: 20871 - DNA, 25 bp, S. cerevisiae
aattgtactcattatgctccgcata

SEQ ID NO: 20872 - DNA, 25 bp, S. cerevisiae
caacgacgaaactgactgtgacatt

SEQ ID NO: 20873 - DNA, 25 bp, S. cerevisiae
caacgtcgaacctcactagattatg

SEQ ID NO: 20874 - DNA, 25 bp, S. cerevisiae
caatttcactattccttttactcct

SEQ ID NO: 20875 - DNA, 25 bp, S. cerevisiae
caattttttcctgggttgcactgca

SEQ ID NO: 20876 - DNA, 25 bp, S. cerevisiae
cacttagcccaatactacatgttcc

SEQ ID NO: 20877 - DNA, 25 bp, S. cerevisiae
caccgagtcgaatccaagttctgag

SEQ ID NO: 20878 - DNA, 25 bp, S. cerevisiae
tcctaagtcgtgcaccaagatcctg

SEQ ID NO: 20879 - DNA, 25 bp, S. cerevisiae
caccgggaattgttggaaacacact

SEQ ID NO: 20880 - DNA, 25 bp, S. cerevisiae
caagggcgatttaaacatggacaag

SEQ ID NO: 20881 - DNA, 25 bp, S. cerevisiae
caattcgcccttgacactggaaaat

SEQ ID NO: 20882 - DNA, 25 bp, S. cerevisiae
caattcccgttatccttgctaaaat

SEQ ID NO: 20883 - DNA, 25 bp, S. cerevisiae
aattgtttcctatcccgctgaacaa

SEQ ID NO: 20884 - DNA, 25 bp, S. cerevisiae
aattgggccctctgttcgcaaacat

SEQ ID NO: 20885 - DNA, 25 bp, S. cerevisiae
aattggagacccttactctgaaaca

SEQ ID NO: 20886 - DNA, 25 bp, S. cerevisiae
aattccatgagtgatgtcccatcgc

SEQ ID NO: 20887 - DNA, 25 bp, S. cerevisiae
aattgccaattgctgtcgcacatgg

SEQ ID NO: 20888 - DNA, 25 bp, S. cerevisiae
aattccagtgatctctcggcagagg

SEQ ID NO: 20889 - DNA, 25 bp, S. cerevisiae
aattgaactctacacgcatatccct

SEQ ID NO: 20890 - DNA, 25 bp, S. cerevisiae
aattgtgtccacgttcatgaaaagc

SEQ ID NO: 20891 - DNA, 25 bp, S. cerevisiae
aattggctggacgtatctatgcata

SEQ ID NO: 20892 - DNA, 25 bp, S. cerevisiae
caatttgctaacttctgtgatgaga

SEQ ID NO: 20893 - DNA, 25 bp, S. cerevisiae
caattgcataaactgtcgtctaggg

SEQ ID NO: 20894 - DNA, 25 bp, S. cerevisiae
aattgcacgatgctggcttctatgc

SEQ ID NO: 20895 - DNA, 25 bp, S. cerevisiae
aattgtgttcttcatttgtgccgtt

SEQ ID NO: 20896 - DNA, 25 bp, S. cerevisiae
aattgtcgacatcctttgcctttat

SEQ ID NO: 20897 - DNA, 25 bp, S. cerevisiae
caattgcactaaacggtgccttctt

SEQ ID NO: 20898 - DNA, 25 bp, S. cerevisiae
caatgggataatgccgtttctgtat

SEQ ID NO: 20899 - DNA, 25 bp, S. cerevisiae
caaaacatggttccgttagtgccga

SEQ ID NO: 20900 - DNA, 25 bp, S. cerevisiae
caatagctgcaacatttgggccgtt

SEQ ID NO: 20901 - DNA, 25 bp, S. cerevisiae
aattgccgcctaatattgtacgtaa

SEQ ID NO: 20902 - DNA, 25 bp, S. cerevisiae
aattgcctacgttattgttgccgaa

SEQ ID NO: 20903 - DNA, 25 bp, S. cerevisiae
aattgcccgcgttgatttattcgac

SEQ ID NO: 20904 - DNA, 25 bp, S. cerevisiae
aattgcctctcgcttttattcagat

SEQ ID NO: 20905 - DNA, 25 bp, S. cerevisiae
aattgctctcattttttcatcgaac

SEQ ID NO: 20906 - DNA, 25 bp, S. cerevisiae
caagtattcgcaatcctcattctaa

SEQ ID NO: 20907 - DNA, 25 bp, S. cerevisiae
aattgctcatcctgtaaggccacat

SEQ ID NO: 20908 - DNA, 25 bp, S. cerevisiae
aattgtgcactcttctgacggccat

SEQ ID NO: 20909 - DNA, 25 bp, S. cerevisiae
caatattgcagttcttaggacctca

SEQ ID NO: 20910 - DNA, 25 bp, S. cerevisiae
caatgactggttctatagacctgga

SEQ ID NO: 20911 - DNA, 25 bp, S. cerevisiae
caaacagattgaaaggagaccagta

SEQ ID NO: 20912 - DNA, 25 bp, S. cerevisiae
caatctggatcttttggagaccgta

SEQ ID NO: 20913 - DNA, 25 bp, S. cerevisiae
aattggatgccctacattgactaaa

SEQ ID NO: 20914 - DNA, 25 bp, S. cerevisiae
aattggtaccattccgagatgaaac

SEQ ID NO: 20915 - DNA, 25 bp, S. cerevisiae
aattggtaagctccgtcatcgaaac

SEQ ID NO: 20916 - DNA, 25 bp, S. cerevisiae
aattgcccaagccaactctagaaat

SEQ ID NO: 20917 - DNA, 25 bp, S. cerevisiae
aattgtcccagccattccaaagaaa

SEQ ID NO: 20918 - DNA, 25 bp, S. cerevisiae
aattgctcaagccaactccagaaac

SEQ ID NO: 20919 - DNA, 25 bp, S. cerevisiae
aattgtcacagcttatcgtagtaac

SEQ ID NO: 20920 - DNA, 25 bp, S. cerevisiae
aattgatgctactccattcagacaa

SEQ ID NO: 20921 - DNA, 25 bp, S. cerevisiae
aattgatcgtcattgccattagagc

SEQ ID NO: 20922 - DNA, 25 bp, S. cerevisiae
aattgtgctcgaactacatctccac

SEQ ID NO: 20923 - DNA, 25 bp, S. cerevisiae
aattgtgtagaattgcagattccct

SEQ ID NO: 20924 - DNA, 25 bp, S. cerevisiae
aattgacctcgtttgattgctctca

SEQ ID NO: 20925 - DNA, 25 bp, S. cerevisiae
caatggcagtttgtcggaccccaaa

SEQ ID NO: 20926 - DNA, 25 bp, S. cerevisiae
caatggcgtagtggacccgaccaaa

SEQ ID NO: 20927 - DNA, 25 bp, S. cerevisiae
caaggttttacctgagacgtgccta

SEQ ID NO: 20928 - DNA, 25 bp, S. cerevisiae
cacctaccgtaatatcgaaggaaga

SEQ ID NO: 20929 - DNA, 25 bp, S. cerevisiae
cacctcctccaatcgtgaaacgtaa

SEQ ID NO: 20930 - DNA, 25 bp, S. cerevisiae
caatcccttcaaacaaaccacgtga

SEQ ID NO: 20931 - DNA, 25 bp, S. cerevisiae
aattgcagcatttcacacagtcctt

SEQ ID NO: 20932 - DNA, 25 bp, S. cerevisiae
aattggctctatcagcattctgctg

SEQ ID NO: 20933 - DNA, 25 bp, S. cerevisiae
aattggctgtggattctaccttgac

SEQ ID NO: 20934 - DNA, 25 bp, S. cerevisiae
aattggctttgcacactacctgaac

SEQ ID NO: 20935 - DNA, 25 bp, S. cerevisiae
aattgacttgtcctatcacctgcaa

SEQ ID NO: 20936 - DNA, 25 bp, S. cerevisiae
aattggcttggcttctgcaccaaat

SEQ ID NO: 20937 - DNA, 25 bp, S. cerevisiae
caatttgccgagtatccaccagatg

SEQ ID NO: 20938 - DNA, 25 bp, S. cerevisiae
caatttgcaattccatgtcctcgtg

SEQ ID NO: 20939 - DNA, 25 bp, S. cerevisiae
caaatctagggccatgtcgatttcg

SEQ ID NO: 20940 - DNA, 25 bp, S. cerevisiae
caactaaagggttcggctcatccgg

SEQ ID NO: 20941 - DNA, 25 bp, S. cerevisiae
caacggtaaggttgcaggcgccgct

SEQ ID NO: 20942 - DNA, 25 bp, S. cerevisiae
caaaggaaaaattgcagggcgatgc

SEQ ID NO: 20943 - DNA, 25 bp, S. cerevisiae
caagcttaacaaaatgagtcggtga

SEQ ID NO: 20944 - DNA, 25 bp, S. cerevisiae
caatgctgaaatcaagtggcccgat

SEQ ID NO: 20945 - DNA, 25 bp, S. cerevisiae
caagaagaattcgagttcccgttat

SEQ ID NO: 20946 - DNA, 25 bp, S. cerevisiae
caacggaattccagccggtggtatt

SEQ ID NO: 20947 - DNA, 25 bp, S. cerevisiae
aattgtgccatccatattgcacggg

SEQ ID NO: 20948 - DNA, 25 bp, S. cerevisiae
aattgtgcctaccactgcaattggg

SEQ ID NO: 20949 - DNA, 25 bp, S. cerevisiae
aattgatagcttcatcgcctggaga

SEQ ID NO: 20950 - DNA, 25 bp, S. cerevisiae
caattgttgcttgctcgagcttgaa

SEQ ID NO: 20951 - DNA, 25 bp, S. cerevisiae
caactccatcttctggtccaaagaa

SEQ ID NO: 20952 - DNA, 25 bp, S. cerevisiae
caaccctcaacaagtagccaagcta

SEQ ID NO: 20953 - DNA, 25 bp, S. cerevisiae
caagccactcagaaggataaatcct

SEQ ID NO: 20954 - DNA, 25 bp, S. cerevisiae
caatctccaagtttaataatgccga

SEQ ID NO: 20955 - DNA, 25 bp, S. cerevisiae
caactcctcctacgttaaacaatct

SEQ ID NO: 20956 - DNA, 25 bp, S. cerevisiae
caatttggctagcaccttgttgaag

SEQ ID NO: 20957 - DNA, 25 bp, S. cerevisiae
caattcggttacgtcatcttgacca

SEQ ID NO: 20958 - DNA, 25 bp, S. cerevisiae
caatttgattttcctttctggccaa

SEQ ID NO: 20959 - DNA, 25 bp, S. cerevisiae
caatcactggtgttagcggcgtgtt

SEQ ID NO: 20960 - DNA, 25 bp, S. cerevisiae
ctatcagtcggtggcgacgttgcat

SEQ ID NO: 20961 - DNA, 25 bp, S. cerevisiae
caatcattcttgacagtgaccaata

SEQ ID NO: 20962 - DNA, 25 bp, S. cerevisiae
caatgcgacttagccacgttccgaa

SEQ ID NO: 20963 - DNA, 25 bp, S. cerevisiae
ctaggtttgacatcggctcccgtac

SEQ ID NO: 20964 - DNA, 25 bp, S. cerevisiae
ctgggtttgtaaggttcgccgccat

SEQ ID NO: 20965 - DNA, 25 bp, S. cerevisiae
cagggctttggaagtacacccgcaa

SEQ ID NO: 20966 - DNA, 25 bp, S. cerevisiae
ccctgctttcggattcaaacgcaag

SEQ ID NO: 20967 - DNA, 25 bp, S. cerevisiae
caagtctaccgtacgtaccaggaga

SEQ ID NO: 20968 - DNA, 25 bp, S. cerevisiae
caatatctacaatcggtaccaggaa

SEQ ID NO: 20969 - DNA, 25 bp, S. cerevisiae
caattcaatgacttttccagcgatg

SEQ ID NO: 20970 - DNA, 25 bp, S. cerevisiae
aattgtgatcgttgcggttcatcgc

SEQ ID NO: 20971 - DNA, 25 bp, S. cerevisiae
caatatgtagctatgttcctcgtaa

SEQ ID NO: 20972 - DNA, 25 bp, S. cerevisiae
caatgtcgagctaactgttggcgga

SEQ ID NO: 20973 - DNA, 25 bp, S. cerevisiae
aattggttagattcatgcggcgtag

SEQ ID NO: 20974 - DNA, 25 bp, S. cerevisiae
aattggtcttgaacatctccgttgg

SEQ ID NO: 20975 - DNA, 25 bp, S. cerevisiae
aattggcgtcgaactttcgtctgag

SEQ ID NO: 20976 - DNA, 25 bp, S. cerevisiae
caattctctgttcgtgatttcgcgt

SEQ ID NO: 20977 - DNA, 25 bp, S. cerevisiae
caatcattgcttttggtaccagaga

SEQ ID NO: 20978 - DNA, 25 bp, S. cerevisiae
caattcgctgctttgttatctaaat

SEQ ID NO: 20979 - DNA, 25 bp, S. cerevisiae
caattcgctgttgttgctgttgaac

SEQ ID NO: 20980 - DNA, 25 bp, S. cerevisiae
caattggtggtgctatgatgtctaa

SEQ ID NO: 20981 - DNA, 25 bp, S. cerevisiae
caaggagatgtgctacatgcggaca

SEQ ID NO: 20982 - DNA, 25 bp, S. cerevisiae
caagtggcgcatctgatgacttcaa

SEQ ID NO: 20983 - DNA, 25 bp, S. cerevisiae
caatgcaggtgctattatccaggaa

SEQ ID NO: 20984 - DNA, 25 bp, S. cerevisiae
caacgggacagcaaccttttgtttg

SEQ ID NO: 20985 - DNA, 25 bp, S. cerevisiae
caactgcgtttttcgaatgtttatc

SEQ ID NO: 20986 - DNA, 25 bp, S. cerevisiae
caattttcccttgaattccattcca

SEQ ID NO: 20987 - DNA, 25 bp, S. cerevisiae
caagatttcccttcaaattcccata

SEQ ID NO: 20988 - DNA, 25 bp, S. cerevisiae
caaaatctccgtaccaatgcatcat

SEQ ID NO: 20989 - DNA, 25 bp, S. cerevisiae
caagttcaccggactcgttatggaa

SEQ ID NO: 20990 - DNA, 25 bp, S. cerevisiae
caagctcaacttgcccacaaatgga

SEQ ID NO: 20991 - DNA, 25 bp, S. cerevisiae
aattggtggttcaagcccagtacac

SEQ ID NO: 20992 - DNA, 25 bp, S. cerevisiae
aattggtcttgttttgctcttcaac

SEQ ID NO: 20993 - DNA, 25 bp, S. cerevisiae
aattggtagtgattctggcgttgca

SEQ ID NO: 20994 - DNA, 25 bp, S. cerevisiae
aattggttcccgtccagatcataaa

SEQ ID NO: 20995 - DNA, 25 bp, S. cerevisiae
aattgttgctacagggcgcgtgtga

SEQ ID NO: 20996 - DNA, 25 bp, S. cerevisiae
aattgtgttgctattcatccgacta

SEQ ID NO: 20997 - DNA, 25 bp, S. cerevisiae
caattacttctctctgaccgtatca

SEQ ID NO: 20998 - DNA, 25 bp, S. cerevisiae
caattggtattttccggattcgagt

SEQ ID NO: 20999 - DNA, 25 bp, S. cerevisiae
caagtggtattttcaacgtagcgtt

SEQ ID NO: 21000 - DNA, 25 bp, S. cerevisiae
caatggcctattctaatggtggttt

SEQ ID NO: 21001 - DNA, 25 bp, S. cerevisiae
caaggtccaccgcaacagggttatc

SEQ ID NO: 21002 - DNA, 25 bp, S. cerevisiae
caatgtggtccagctttggtattca

SEQ ID NO: 21003 - DNA, 25 bp, S. cerevisiae
caatgagatctttatgccagggtaa

SEQ ID NO: 21004 - DNA, 25 bp, S. cerevisiae
caatctggcgtctatgaaggtgaaa

SEQ ID NO: 21005 - DNA, 25 bp, S. cerevisiae
caatctcgcccatgaatgaagctat

SEQ ID NO: 21006 - DNA, 25 bp, S. cerevisiae
caatatcggcaatcacacatcagtt

SEQ ID NO: 21007 - DNA, 25 bp, S. cerevisiae
caatatgaccaataacgcagatgat

SEQ ID NO: 21008 - DNA, 25 bp, S. cerevisiae
caattacgattgttccagctgagga

SEQ ID NO: 21009 - DNA, 25 bp, S. cerevisiae
caaatatcagatttttcactgggcg

SEQ ID NO: 21010 - DNA, 25 bp, S. cerevisiae
aattgtgtacttatggatgcgattc

SEQ ID NO: 21011 - DNA, 25 bp, S. cerevisiae
caagaagacgcaaggcagctttttt

SEQ ID NO: 21012 - DNA, 25 bp, S. cerevisiae
caaggagccgctagtgaatttttta

SEQ ID NO: 21013 - DNA, 25 bp, S. cerevisiae
caagttgcgggtcctactttaacag

SEQ ID NO: 21014 - DNA, 25 bp, S. cerevisiae
caatgcctatggagcctatcctaaa

SEQ ID NO: 21015 - DNA, 25 bp, S. cerevisiae
caatcctttgagagcttgggtgaaa

SEQ ID NO: 21016 - DNA, 25 bp, S. cerevisiae
caagcggttggtctctcgggaaact

SEQ ID NO: 21017 - DNA, 25 bp, S. cerevisiae
caatgggttgtcctttccctggaag

SEQ ID NO: 21018 - DNA, 25 bp, S. cerevisiae
caaaataggccagcggttacccaat

SEQ ID NO: 21019 - DNA, 25 bp, S. cerevisiae
caaggataggccgagtagattcaac

SEQ ID NO: 21020 - DNA, 25 bp, S. cerevisiae
caaggaactgacctaagccctaagt

SEQ ID NO: 21021 - DNA, 25 bp, S. cerevisiae
caatgttttggctctacctattcta

SEQ ID NO: 21022 - DNA, 25 bp, S. cerevisiae
caatgattttcctgctacttttata

SEQ ID NO: 21023 - DNA, 25 bp, S. cerevisiae
caatctcactgttatggcttctgga

SEQ ID NO: 21024 - DNA, 25 bp, S. cerevisiae
caattaacggcgaatctccacttta

SEQ ID NO: 21025 - DNA, 25 bp, S. cerevisiae
caagagattggctcttccagcttaa

SEQ ID NO: 21026 - DNA, 25 bp, S. cerevisiae
caaggacatgggtttcggtgataca

SEQ ID NO: 21027 - DNA, 25 bp, S. cerevisiae
caaggaggagacttttggtccatta

SEQ ID NO: 21028 - DNA, 25 bp, S. cerevisiae
caagggtcaggtagttggctccata

SEQ ID NO: 21029 - DNA, 25 bp, S. cerevisiae
caagttgtacgtttctcacatccaa

SEQ ID NO: 21030 - DNA, 25 bp, S. cerevisiae
caatttgatgtcctagttacccctt

SEQ ID NO: 21031 - DNA, 25 bp, S. cerevisiae
caatggtacctttttatgcctcctt

SEQ ID NO: 21032 - DNA, 25 bp, S. cerevisiae
caagttccctttattctgttgcttt

SEQ ID NO: 21033 - DNA, 25 bp, S. cerevisiae
caatgtttcgctgtacgttgttcta

SEQ ID NO: 21034 - DNA, 25 bp, S. cerevisiae
caattttggtcacccttgtttctga

SEQ ID NO: 21035 - DNA, 25 bp, S. cerevisiae
cagattttatggtgcggccgccttc

SEQ ID NO: 21036 - DNA, 25 bp, S. cerevisiae
caagttgtgatttggaggcctcctt

SEQ ID NO: 21037 - DNA, 25 bp, S. cerevisiae
caatgtttttattctgggtcgctgt

SEQ ID NO: 21038 - DNA, 25 bp, S. cerevisiae
aattggcatgcctctgggtactcaa

SEQ ID NO: 21039 - DNA, 25 bp, S. cerevisiae
aattggccatcttttaggtgcacgt

SEQ ID NO: 21040 - DNA, 25 bp, S. cerevisiae
caactggcactagcgataatctctg

SEQ ID NO: 21041 - DNA, 25 bp, S. cerevisiae
caagctgaggcttttggcattccaa

SEQ ID NO: 21042 - DNA, 25 bp, S. cerevisiae
caatcttcctgctgtttcttcaaat

SEQ ID NO: 21043 - DNA, 25 bp, S. cerevisiae
caagcacgttttcgttggcgtttgt

SEQ ID NO: 21044 - DNA, 25 bp, S. cerevisiae
caagccttcgtcagcattacagttt

SEQ ID NO: 21045 - DNA, 25 bp, S. cerevisiae
caacctgttgctgactactactatc

SEQ ID NO: 21046 - DNA, 25 bp, S. cerevisiae
caaactttgggtgtttctatccaca

SEQ ID NO: 21047 - DNA, 25 bp, S. cerevisiae
caaggctttggatacttggttccca

SEQ ID NO: 21048 - DNA, 25 bp, S. cerevisiae
gaaggccttgaactactcggttgga

SEQ ID NO: 21049 - DNA, 25 bp, S. cerevisiae
cagagtcctaaattttccaagccgg

SEQ ID NO: 21050 - DNA, 25 bp, S. cerevisiae
caagtggctagatctttggcgagac

SEQ ID NO: 21051 - DNA, 25 bp, S. cerevisiae
caagtggcatagttgctttggctaa

SEQ ID NO: 21052 - DNA, 25 bp, S. cerevisiae
caatgggcaaggcactcaggtagtt

SEQ ID NO: 21053 - DNA, 25 bp, S. cerevisiae
caatggcagaagttgacacagtcaa

SEQ ID NO: 21054 - DNA, 25 bp, S. cerevisiae
caaggagccatcagtctttgcatgc

SEQ ID NO: 21055 - DNA, 25 bp, S. cerevisiae
caaagagcgctacggtttcatctgc

SEQ ID NO: 21056 - DNA, 25 bp, S. cerevisiae
caattgatcgtgatgcctggtttca

SEQ ID NO: 21057 - DNA, 25 bp, S. cerevisiae
caattatcatggaagcgcctgttga

SEQ ID NO: 21058 - DNA, 25 bp, S. cerevisiae
caatggtcgatgactctgccgttga

SEQ ID NO: 21059 - DNA, 25 bp, S. cerevisiae
caatattctgaggttctgggacact

SEQ ID NO: 21060 - DNA, 25 bp, S. cerevisiae
caataacattgcgtctgtgggaaca

SEQ ID NO: 21061 - DNA, 25 bp, S. cerevisiae
caatgtacgtttcctctgacagaag

SEQ ID NO: 21062 - DNA, 25 bp, S. cerevisiae
caatgctattttggtgtcgcctgat

SEQ ID NO: 21063 - DNA, 25 bp, S. cerevisiae
aattggcttcattggacaacctgag

SEQ ID NO: 21064 - DNA, 25 bp, S. cerevisiae
aattggcttcagcaagtccgctggg

SEQ ID NO: 21065 - DNA, 25 bp, S. cerevisiae
caaggctttaaatgtttggattcac

SEQ ID NO: 21066 - DNA, 25 bp, S. cerevisiae
caaggcttctaactggagattagtc

SEQ ID NO: 21067 - DNA, 25 bp, S. cerevisiae
caagcctgttgcactgggaatgaaa

SEQ ID NO: 21068 - DNA, 25 bp, S. cerevisiae
caagggtgcgtttgccatgatctac

SEQ ID NO: 21069 - DNA, 25 bp, S. cerevisiae
caagagtgtgcgtgtcgtgtcattc

SEQ ID NO: 21070 - DNA, 25 bp, S. cerevisiae
caagtgggtggtgcttccagtcaaa

SEQ ID NO: 21071 - DNA, 25 bp, S. cerevisiae
caaccgtggtggtttccgtcaatat

SEQ ID NO: 21072 - DNA, 25 bp, S. cerevisiae
caaccttggctgaagtagacgctca

SEQ ID NO: 21073 - DNA, 25 bp, S. cerevisiae
caacttttcgcaagacagctgtctc

SEQ ID NO: 21074 - DNA, 25 bp, S. cerevisiae
caattatcccgcagtgaggtgctct

SEQ ID NO: 21075 - DNA, 25 bp, S. cerevisiae
caatagacccgtgggaggctgccat

SEQ ID NO: 21076 - DNA, 25 bp, S. cerevisiae
caaggctttcagtggtggtgtctac

SEQ ID NO: 21077 - DNA, 25 bp, S. cerevisiae
caagctgccttaatgggtggtgccg

SEQ ID NO: 21078 - DNA, 25 bp, S. cerevisiae
caactcctttatttgctagtgcggg

SEQ ID NO: 21079 - DNA, 25 bp, S. cerevisiae
cagaacctattatttgcgaacggca

SEQ ID NO: 21080 - DNA, 25 bp, S. cerevisiae
caacccttacagactcgaacgtgga

SEQ ID NO: 21081 - DNA, 25 bp, S. cerevisiae
caagctatcacgtccttataaggcg

SEQ ID NO: 21082 - DNA, 25 bp, S. cerevisiae
caaggagtgcattcaaaccagtgtt

SEQ ID NO: 21083 - DNA, 25 bp, S. cerevisiae
caatgacgatgctcaagttagtgat

SEQ ID NO: 21084 - DNA, 25 bp, S. cerevisiae
caatgccctgcatctaagtaatgaa

SEQ ID NO: 21085 - DNA, 25 bp, S. cerevisiae
caaggccgacagagacgaatcatct

SEQ ID NO: 21086 - DNA, 25 bp, S. cerevisiae
caagtggaccaaaatgcagacgcat

SEQ ID NO: 21087 - DNA, 25 bp, S. cerevisiae
caaggtacacgataccgctgtaata

SEQ ID NO: 21088 - DNA, 25 bp, S. cerevisiae
cacggtaacgattttgccttagagt

SEQ ID NO: 21089 - DNA, 25 bp, S. cerevisiae
caaggtaacaatgcaaatcagtagt

SEQ ID NO: 21090 - DNA, 25 bp, S. cerevisiae
caaggctaccaaggcttctcaagaa

SEQ ID NO: 21091 - DNA, 25 bp, S. cerevisiae
caagcgccatgacacctggtgaagt

SEQ ID NO: 21092 - DNA, 25 bp, S. cerevisiae
catagacgctactacctggtacagt

SEQ ID NO: 21093 - DNA, 25 bp, S. cerevisiae
caatgacaccagtaccgcggaagtt

SEQ ID NO: 21094 - DNA, 25 bp, S. cerevisiae
caatgatcatttgcgcagccttgac

SEQ ID NO: 21095 - DNA, 25 bp, S. cerevisiae
caagatcttgaatcgctcatgtgaa

SEQ ID NO: 21096 - DNA, 25 bp, S. cerevisiae
caagctttcctcaatggcgcagaaa

SEQ ID NO: 21097 - DNA, 25 bp, S. cerevisiae
caatgcttctgcctcgtgttcgaga

SEQ ID NO: 21098 - DNA, 25 bp, S. cerevisiae
caatatcatccgacagtgttcgaga

SEQ ID NO: 21099 - DNA, 25 bp, S. cerevisiae
caatatcaccaaagtctgtcagtta

SEQ ID NO: 21100 - DNA, 25 bp, S. cerevisiae
caatgattcccaatgatgttacttc

SEQ ID NO: 21101 - DNA, 25 bp, S. cerevisiae
caatgatccttgtgtgtcgattaca

SEQ ID NO: 21102 - DNA, 25 bp, S. cerevisiae
caaggccttgctacgtggtttaaca

SEQ ID NO: 21103 - DNA, 25 bp, S. cerevisiae
caagtatttcctatgctgcaagtgc

SEQ ID NO: 21104 - DNA, 25 bp, S. cerevisiae
caaggtcactaaagccccgcaaaga

SEQ ID NO: 21105 - DNA, 25 bp, S. cerevisiae
caagaacaagaaaaccacgcggagt

SEQ ID NO: 21106 - DNA, 25 bp, S. cerevisiae
caagaagcaaggttccggcaagggt

SEQ ID NO: 21107 - DNA, 25 bp, S. cerevisiae
caagttggtgagtgccatacctcca

SEQ ID NO: 21108 - DNA, 25 bp, S. cerevisiae
caatgtcgtgtttgttcttcccaca

SEQ ID NO: 21109 - DNA, 25 bp, S. cerevisiae
caatccgtttcagagttaccactac

SEQ ID NO: 21110 - DNA, 25 bp, S. cerevisiae
caataggtttcttagcttcgccaat

SEQ ID NO: 21111 - DNA, 25 bp, S. cerevisiae
caatagtgcattttgtagccccggt

SEQ ID NO: 21112 - DNA, 25 bp, S. cerevisiae
caaggttgtattttcagctgccgat

SEQ ID NO: 21113 - DNA, 25 bp, S. cerevisiae
caatgccttcacaaactacgacggt

SEQ ID NO: 21114 - DNA, 25 bp, S. cerevisiae
caaggttactcaatacaaagctggt

SEQ ID NO: 21115 - DNA, 25 bp, S. cerevisiae
caatgtttctcgcagttgtcactgg

SEQ ID NO: 21116 - DNA, 25 bp, S. cerevisiae
caatcttccattcggttgttttgcg

SEQ ID NO: 21117 - DNA, 25 bp, S. cerevisiae
caatctttgtgttttctctgtgtat

SEQ ID NO: 21118 - DNA, 25 bp, S. cerevisiae
caattacgcttgttttggtaggcta

SEQ ID NO: 21119 - DNA, 25 bp, S. cerevisiae
caaggtggtagctctatttcggcca

SEQ ID NO: 21120 - DNA, 25 bp, S. cerevisiae
caagagggtcttaccttcaaagcca

SEQ ID NO: 21121 - DNA, 25 bp, S. cerevisiae
cggtaacattaagatcgtttacgct

SEQ ID NO: 21122 - DNA, 25 bp, S. cerevisiae
ccggaaattatgtcactggtgttga

SEQ ID NO: 21123 - DNA, 25 bp, S. cerevisiae
cacacgggagactgggcaagacctg

SEQ ID NO: 21124 - DNA, 25 bp, S. cerevisiae
caagtggtgtattatctgcccaaga

SEQ ID NO: 21125 - DNA, 25 bp, S. cerevisiae
cactgcaagttatacccctgaggac

SEQ ID NO: 21126 - DNA, 25 bp, S. cerevisiae
caatcagctgttttaacggtggaac

SEQ ID NO: 21127 - DNA, 25 bp, S. cerevisiae
caatccctggtactacggcatggaa

SEQ ID NO: 21128 - DNA, 25 bp, S. cerevisiae
caagcttgctggtgaacgtagtaac

SEQ ID NO: 21129 - DNA, 25 bp, S. cerevisiae
caatgtgtgtgttttaatgtagaaa

SEQ ID NO: 21130 - DNA, 25 bp, S. cerevisiae
caaaggccatgacggacactgataa

SEQ ID NO: 21131 - DNA, 25 bp, S. cerevisiae
caaagacagcatggcgcgatctaca

SEQ ID NO: 21132 - DNA, 25 bp, S. cerevisiae
caagaacagccagggctcataacgt

SEQ ID NO: 21133 - DNA, 25 bp, S. cerevisiae
caagaaccccggaacaacaatacag

SEQ ID NO: 21134 - DNA, 25 bp, S. cerevisiae
caaaacctttgtacggcagcaacca

SEQ ID NO: 21135 - DNA, 25 bp, S. cerevisiae
caaccactcttgtaaccccaatata

SEQ ID NO: 21136 - DNA, 25 bp, S. cerevisiae
caagttcatttgtctaccttcaaca

SEQ ID NO: 21137 - DNA, 25 bp, S. cerevisiae
caatcgtgtacttcttcttctaaaa

SEQ ID NO: 21138 - DNA, 25 bp, S. cerevisiae
caaaagcaaacctgttaagccaaca

SEQ ID NO: 21139 - DNA, 25 bp, S. cerevisiae
caaccccgttattattgtcaccaag

SEQ ID NO: 21140 - DNA, 25 bp, S. cerevisiae
cacaaccaccttgttagtaacagtg

SEQ ID NO: 21141 - DNA, 25 bp, S. cerevisiae
caacggtgctatagattgtctcaaa

SEQ ID NO: 21142 - DNA, 25 bp, S. cerevisiae
caatcggtgtgtgatcttgctctaa

SEQ ID NO: 21143 - DNA, 25 bp, S. cerevisiae
caatcaagctttgccgatgactgaa

SEQ ID NO: 21144 - DNA, 25 bp, S. cerevisiae
caatgaagccttttcggttgtcggt

SEQ ID NO: 21145 - DNA, 25 bp, S. cerevisiae
cttcaaacaaaccacgtgatggtct

SEQ ID NO: 21146 - DNA, 25 bp, S. cerevisiae
cttcaaagagaagcaaaaggccgat

SEQ ID NO: 21147 - DNA, 25 bp, S. cerevisiae
caatccgtctaggtttggctcttaa

SEQ ID NO: 21148 - DNA, 25 bp, S. cerevisiae
caacgcgtccagcatttttcggaag

SEQ ID NO: 21149 - DNA, 25 bp, S. cerevisiae
caaggcggtatgattttcgatccaa

SEQ ID NO: 21150 - DNA, 25 bp, S. cerevisiae
caagctcgtttattttattatccca

SEQ ID NO: 21151 - DNA, 25 bp, S. cerevisiae
caaggtttcaaggttgtatccgcaa

SEQ ID NO: 21152 - DNA, 25 bp, S. cerevisiae
caaggactctgttgttggcaagcaa

SEQ ID NO: 21153 - DNA, 25 bp, S. cerevisiae
caatactacatgttccaagccgcac

SEQ ID NO: 21154 - DNA, 25 bp, S. cerevisiae
caatggctactcttcaaacactcag

SEQ ID NO: 21155 - DNA, 25 bp, S. cerevisiae
caatactactctttccaagctgctc

SEQ ID NO: 21156 - DNA, 25 bp, S. cerevisiae
caatactacttgtttcaagcagctc

SEQ ID NO: 21157 - DNA, 25 bp, S. cerevisiae
caatgaggcttggttggaagagcta

SEQ ID NO: 21158 - DNA, 25 bp, S. cerevisiae
caatggagtctatggaacagcagct

SEQ ID NO: 21159 - DNA, 25 bp, S. cerevisiae
caaggcttcccaacaggttcatgaa

SEQ ID NO: 21160 - DNA, 25 bp, S. cerevisiae
caatgggccaacacgtttgcataaa

SEQ ID NO: 21161 - DNA, 25 bp, S. cerevisiae
caggtcctaagcgtggtactcaaag

SEQ ID NO: 21162 - DNA, 25 bp, S. cerevisiae
caagcgccaacgtaggtccagaaat

SEQ ID NO: 21163 - DNA, 25 bp, S. cerevisiae
caatgcgtatctagaggctgtgaaa

SEQ ID NO: 21164 - DNA, 25 bp, S. cerevisiae
caagagtactgttgatacatcatca

SEQ ID NO: 21165 - DNA, 25 bp, S. cerevisiae
caatgaatcctgaaagagcttacaa

SEQ ID NO: 21166 - DNA, 25 bp, S. cerevisiae
caaaggctcacaaatggcattccgt

SEQ ID NO: 21167 - DNA, 25 bp, S. cerevisiae
caaggtgccaatcatgtttacagtg

SEQ ID NO: 21168 - DNA, 25 bp, S. cerevisiae
caacgggcttggttttatcagctat

SEQ ID NO: 21169 - DNA, 25 bp, S. cerevisiae
caaggagttctaccgttaatgcaaa

SEQ ID NO: 21170 - DNA, 25 bp, S. cerevisiae
caatgggattcctcgatatgcaaaa

SEQ ID NO: 21171 - DNA, 25 bp, S. cerevisiae
caagagattctccagtcggacagga

SEQ ID NO: 21172 - DNA, 25 bp, S. cerevisiae
caagcgttctgtccgttcaaagttt

SEQ ID NO: 21173 - DNA, 25 bp, S. cerevisiae
caacggtcgtcggtactgaattgtt

SEQ ID NO: 21174 - DNA, 25 bp, S. cerevisiae
caaccgctgcatcgttttcagtaag

SEQ ID NO: 21175 - DNA, 25 bp, S. cerevisiae
caaggtcttctagtaactctagcgt

SEQ ID NO: 21176 - DNA, 25 bp, S. cerevisiae
gcaaggtttatagaccctacggtca

SEQ ID NO: 21177 - DNA, 25 bp, S. cerevisiae
caatgtcttttgtactccctggaaa

SEQ ID NO: 21178 - DNA, 25 bp, S. cerevisiae
caatggatttagatggcccgctata

SEQ ID NO: 21179 - DNA, 25 bp, S. cerevisiae
caatccttcaagatgggccgcatat

SEQ ID NO: 21180 - DNA, 25 bp, S. cerevisiae
caatcctctaatatcggcagcggta

SEQ ID NO: 21181 - DNA, 25 bp, S. cerevisiae
caacgttaagttcccatctggtgat

SEQ ID NO: 21182 - DNA, 25 bp, S. cerevisiae
caacgattatatggagccccgggaa

SEQ ID NO: 21183 - DNA, 25 bp, S. cerevisiae
caacaattttgatgccttctgggat

SEQ ID NO: 21184 - DNA, 25 bp, S. cerevisiae
caacaaggttgctgaacgtggtgaa

SEQ ID NO: 21185 - DNA, 25 bp, S. cerevisiae
catttaatgttgacgaactggacga

SEQ ID NO: 21186 - DNA, 25 bp, S. cerevisiae
caatgttccttgtttgactgctgaa

SEQ ID NO: 21187 - DNA, 25 bp, S. cerevisiae
caagtggccttgtattcgcattggg

SEQ ID NO: 21188 - DNA, 25 bp, S. cerevisiae
caaggccacaaggattcgtttgaat

SEQ ID NO: 21189 - DNA, 25 bp, S. cerevisiae
caagatttgcggattcagactcaga

SEQ ID NO: 21190 - DNA, 25 bp, S. cerevisiae
caagtaggcagaatattgggtgaga

SEQ ID NO: 21191 - DNA, 25 bp, S. cerevisiae
caagtgggacattgattggcggcaa

SEQ ID NO: 21192 - DNA, 25 bp, S. cerevisiae
caagttggctcatgattggtggtcc

SEQ ID NO: 21193 - DNA, 25 bp, S. cerevisiae
caagagtcattgtttccgaagggat

SEQ ID NO: 21194 - DNA, 25 bp, S. cerevisiae
caagactgcactattaactgggaat

SEQ ID NO: 21195 - DNA, 25 bp, S. cerevisiae
caaatcgacctttctacctgggata

SEQ ID NO: 21196 - DNA, 25 bp, S. cerevisiae
caaaaccatttgtcgccgctagaaa

SEQ ID NO: 21197 - DNA, 25 bp, S. cerevisiae
tagcgtcccgttgttccaaatttag

SEQ ID NO: 21198 - DNA, 25 bp, S. cerevisiae
caaccaccttaactagagcaaccga

SEQ ID NO: 21199 - DNA, 25 bp, S. cerevisiae
caacaacactatccgttacaacgct

SEQ ID NO: 21200 - DNA, 25 bp, S. cerevisiae
caacgtcaatgctcctgtgtttagg

SEQ ID NO: 21201 - DNA, 25 bp, S. cerevisiae
caacggacacatacctttcgaaagt

SEQ ID NO: 21202 - DNA, 25 bp, S. cerevisiae
caaggctttctaagcttttgccgaa

SEQ ID NO: 21203 - DNA, 25 bp, S. cerevisiae
caaggcttgcttattcattcgccaa

SEQ ID NO: 21204 - DNA, 25 bp, S. cerevisiae
caagctcaggcggtggtggtttatt

SEQ ID NO: 21205 - DNA, 25 bp, S. cerevisiae
catatcccgttgtgcactttttaga

SEQ ID NO: 21206 - DNA, 25 bp, S. cerevisiae
caacccgaagttgctgatatttcag

SEQ ID NO: 21207 - DNA, 25 bp, S. cerevisiae
caaaccaaactttctaatgcccact

SEQ ID NO: 21208 - DNA, 25 bp, S. cerevisiae
caaaaaatcttcatcgttcgctcac

SEQ ID NO: 21209 - DNA, 25 bp, S. cerevisiae
caaggacgtttcttgcgttccaagt

SEQ ID NO: 21210 - DNA, 25 bp, S. cerevisiae
caaggatcagatgtttcgttcaatg

SEQ ID NO: 21211 - DNA, 25 bp, S. cerevisiae
caaggtctggatttgccgttcagca

SEQ ID NO: 21212 - DNA, 25 bp, S. cerevisiae
caaggcattgtgatctgggactctc

SEQ ID NO: 21213 - DNA, 25 bp, S. cerevisiae
caatgatgtttcctcttacaacgaa

SEQ ID NO: 21214 - DNA, 25 bp, S. cerevisiae
caagattctctctctccaagtaaga

SEQ ID NO: 21215 - DNA, 25 bp, S. cerevisiae
cagactccattattgctatacttat

SEQ ID NO: 21216 - DNA, 25 bp, S. cerevisiae
caactagatcgatgcggtgcttcat

SEQ ID NO: 21217 - DNA, 25 bp, S. cerevisiae
caaagaaggtcggtatcacaggtaa

SEQ ID NO: 21218 - DNA, 25 bp, S. cerevisiae
caggatcacctctggtaacgggaat

SEQ ID NO: 21219 - DNA, 25 bp, S. cerevisiae
caaaccctcatatgtcaacgtggaa

SEQ ID NO: 21220 - DNA, 25 bp, S. cerevisiae
caaaggcttggatctacacgggata

SEQ ID NO: 21221 - DNA, 25 bp, S. cerevisiae
caagtttgggcattttcccgtgata

SEQ ID NO: 21222 - DNA, 25 bp, S. cerevisiae
caagttcgtcgcttgtttcacaaga

SEQ ID NO: 21223 - DNA, 25 bp, S. cerevisiae
caagttctttgttgtttcctaatca

SEQ ID NO: 21224 - DNA, 25 bp, S. cerevisiae
caagattccagccttcacttatgaa

SEQ ID NO: 21225 - DNA, 25 bp, S. cerevisiae
caagtctagagccatgtcgatttca

SEQ ID NO: 21226 - DNA, 25 bp, S. cerevisiae
caagtctagagccatgtcgatttca

SEQ ID NO: 21227 - DNA, 25 bp, S. cerevisiae
caaggccgattgtatgctatggtca

SEQ ID NO: 21228 - DNA, 25 bp, S. cerevisiae
caatgggttcctatctcttcaaaat

SEQ ID NO: 21229 - DNA, 25 bp, S. cerevisiae
caagggtgacttactcgttacgatt

SEQ ID NO: 21230 - DNA, 25 bp, S. cerevisiae
cagatcccgtttacaacgtcgcaaa

SEQ ID NO: 21231 - DNA, 25 bp, S. cerevisiae
cactgcctgagatgttaacttccaa

SEQ ID NO: 21232 - DNA, 25 bp, S. cerevisiae
caaagtttcggtggacttctagtca

SEQ ID NO: 21233 - DNA, 25 bp, S. cerevisiae
caaggagaactgtctttccctcaaa

SEQ ID NO: 21234 - DNA, 25 bp, S. cerevisiae
gaaggaaaccctcagctggttcaat

SEQ ID NO: 21235 - DNA, 25 bp, S. cerevisiae
gcaaaaaaccactctaggcccaatt

SEQ ID NO: 21236 - DNA, 25 bp, S. cerevisiae
caaagaagaccatcccagggctagt

SEQ ID NO: 21237 - DNA, 25 bp, S. cerevisiae
caacagtggtttacgtcagggtcct

SEQ ID NO: 21238 - DNA, 25 bp, S. cerevisiae
caaaggtggtggagcccgtgtccta

SEQ ID NO: 21239 - DNA, 25 bp, S. cerevisiae
caagggttataacgctggctgtaca

SEQ ID NO: 21240 - DNA, 25 bp, S. cerevisiae
caagggcgtatatgtcgggtacaac

SEQ ID NO: 21241 - DNA, 25 bp, S. cerevisiae
caatgggcggtggtatctgcctaaa

SEQ ID NO: 21242 - DNA, 25 bp, S. cerevisiae
caagggctggccttttgccatgaaa

SEQ ID NO: 21243 - DNA, 25 bp, S. cerevisiae
caaggtcttctctactggcaaaata

SEQ ID NO: 21244 - DNA, 25 bp, S. cerevisiae
caaggtttcatattcaggcgataca

SEQ ID NO: 21245 - DNA, 25 bp, S. cerevisiae
caaggatttgaatcgggcccaccta

SEQ ID NO: 21246 - DNA, 25 bp, S. cerevisiae
caaaggttaaaggagctgcccctct

SEQ ID NO: 21247 - DNA, 25 bp, S. cerevisiae
cattcggttactttggctacggctt

SEQ ID NO: 21248 - DNA, 25 bp, S. cerevisiae
caacagttcaactaagagctacttt

SEQ ID NO: 21249 - DNA, 25 bp, S. cerevisiae
caagcagacatctttagtggtgact

SEQ ID NO: 21250 - DNA, 25 bp, S. cerevisiae
caagtgactttatcgctgcagcagc

SEQ ID NO: 21251 - DNA, 25 bp, S. cerevisiae
caaaaggtgtcgcagctagctctat

SEQ ID NO: 21252 - DNA, 25 bp, S. cerevisiae
caaggtggtctgcaacaactcataa

SEQ ID NO: 21253 - DNA, 25 bp, S. cerevisiae
caaggtgttcccaaatggatcatga

SEQ ID NO: 21254 - DNA, 25 bp, S. cerevisiae
cagtgattgtgatggccggtattgc

SEQ ID NO: 21255 - DNA, 25 bp, S. cerevisiae
caagcgttattgacacagtggcatt

SEQ ID NO: 21256 - DNA, 25 bp, S. cerevisiae
caagcgattaccgtgcaagtgcgtt

SEQ ID NO: 21257 - DNA, 25 bp, S. cerevisiae
caagctaattttgggtggcctccga

SEQ ID NO: 21258 - DNA, 25 bp, S. cerevisiae
caagctagttgtcgtagatttctac

SEQ ID NO: 21259 - DNA, 25 bp, S. cerevisiae
caacaagttacactactgtgtttct

SEQ ID NO: 21260 - DNA, 25 bp, S. cerevisiae
caacaagttacactactgtgtttct

SEQ ID NO: 21261 - DNA, 25 bp, S. cerevisiae
caacaagccccaaagtggtatcctt

SEQ ID NO: 21262 - DNA, 25 bp, S. cerevisiae
caagcaacacaagagatctggtcac

SEQ ID NO: 21263 - DNA, 25 bp, S. cerevisiae
caagcaacacaaaagatccggtcat

SEQ ID NO: 21264 - DNA, 25 bp, S. cerevisiae
caagcagacaagaagagatacgaat

SEQ ID NO: 21265 - DNA, 25 bp, S. cerevisiae
caagcaatttgctacccacggatgc

SEQ ID NO: 21266 - DNA, 25 bp, S. cerevisiae
caagaggtgcaccaggtatgcctga

SEQ ID NO: 21267 - DNA, 25 bp, S. cerevisiae
caagagttgatccagtgttacgaag

SEQ ID NO: 21268 - DNA, 25 bp, S. cerevisiae
caagcagtgctatcggatctaggaa

SEQ ID NO: 21269 - DNA, 25 bp, S. cerevisiae
caagcagctgtcttcagaaagagaa

SEQ ID NO: 21270 - DNA, 25 bp, S. cerevisiae
caagcatgcttctgaggtagctgaa

SEQ ID NO: 21271 - DNA, 25 bp, S. cerevisiae
caacagttcagcgatgcgggcgata

SEQ ID NO: 21272 - DNA, 25 bp, S. cerevisiae
caaaccactaccttctgatttgggt

SEQ ID NO: 21273 - DNA, 25 bp, S. cerevisiae
caagggatggccgatttcgaaccaa

SEQ ID NO: 21274 - DNA, 25 bp, S. cerevisiae
caagtgttccatttgattcctgatg

SEQ ID NO: 21275 - DNA, 25 bp, S. cerevisiae
caaggttcagtttgtctccagcaag

SEQ ID NO: 21276 - DNA, 25 bp, S. cerevisiae
caagtttagctttatccacgggtgt

SEQ ID NO: 21277 - DNA, 25 bp, S. cerevisiae
caaagcatctaaagcggttattacc

SEQ ID NO: 21278 - DNA, 25 bp, S. cerevisiae
catatacctgaaaagcttgagttac

SEQ ID NO: 21279 - DNA, 25 bp, S. cerevisiae
caacaaaaatgtctgctcctgctac

SEQ ID NO: 21280 - DNA, 25 bp, S. cerevisiae
gcagaccagcatcagagggaccgta

SEQ ID NO: 21281 - DNA, 25 bp, S. cerevisiae
caaactgatggcatgggactcgtta

SEQ ID NO: 21282 - DNA, 25 bp, S. cerevisiae
caacttgatgagctactgggcggta

SEQ ID NO: 21283 - DNA, 25 bp, S. cerevisiae
caacgatttctatgatgcattttat

SEQ ID NO: 21284 - DNA, 25 bp, S. cerevisiae
caagttcttggacgccttgttgtaa

SEQ ID NO: 21285 - DNA, 25 bp, S. cerevisiae
caagagaccatcaaccttctactaa

SEQ ID NO: 21286 - DNA, 25 bp, S. cerevisiae
caccgaccgtacaatttggcttgaa

SEQ ID NO: 21287 - DNA, 25 bp, S. cerevisiae
caagaatctccccaataacatatcc

SEQ ID NO: 21288 - DNA, 25 bp, S. cerevisiae
cagagggctacgaggtgctacacca

SEQ ID NO: 21289 - DNA, 25 bp, S. cerevisiae
caaggtgcttcgagagcgttatcaa

SEQ ID NO: 21290 - DNA, 25 bp, S. cerevisiae
caaggtcgtacaagaggtgctcaaa

SEQ ID NO: 21291 - DNA, 25 bp, S. cerevisiae
caaggtcaaccatacagtgtcacat

SEQ ID NO: 21292 - DNA, 25 bp, S. cerevisiae
caagttaaactctcgtgattcacat

SEQ ID NO: 21293 - DNA, 25 bp, S. cerevisiae
caagttgttgtttccgccgtcgcct

SEQ ID NO: 21294 - DNA, 25 bp, S. cerevisiae
catgacttgggttccgatttactta

SEQ ID NO: 21295 - DNA, 25 bp, S. cerevisiae
caacttcgacgtccgttcgaatgga

SEQ ID NO: 21296 - DNA, 25 bp, S. cerevisiae
caacctcgggtgaaggtctgtacga

SEQ ID NO: 21297 - DNA, 25 bp, S. cerevisiae
caaactggcgtcaagggatcctggt

SEQ ID NO: 21298 - DNA, 25 bp, S. cerevisiae
caacgttattgtcgctggtaccagt

SEQ ID NO: 21299 - DNA, 25 bp, S. cerevisiae
caccgatcctgccattacaagtaaa

SEQ ID NO: 21300 - DNA, 25 bp, S. cerevisiae
gactcgccgccacaaaattcaagga

SEQ ID NO: 21301 - DNA, 25 bp, S. cerevisiae
gaacggctcatacaaaaccaaagga

SEQ ID NO: 21302 - DNA, 25 bp, S. cerevisiae
caagactaatagctgaccccatcaa

SEQ ID NO: 21303 - DNA, 25 bp, S. cerevisiae
caagaatatatactggcgccacgaa

SEQ ID NO: 21304 - DNA, 25 bp, S. cerevisiae
caagattttactgcctcacgttgac

SEQ ID NO: 21305 - DNA, 25 bp, S. cerevisiae
caagctcttttaatgttccgttcaa

SEQ ID NO: 21306 - DNA, 25 bp, S. cerevisiae
caacgcgttttgagtctttgtacaa

SEQ ID NO: 21307 - DNA, 25 bp, S. cerevisiae
caagggttcttatcgtctttacaga

SEQ ID NO: 21308 - DNA, 25 bp, S. cerevisiae
caagaggtcctagacgtctgggaaa

SEQ ID NO: 21309 - DNA, 25 bp, S. cerevisiae
caagagattccatgatacgtcgctg

SEQ ID NO: 21310 - DNA, 25 bp, S. cerevisiae
caaacttacatcaatacagcccatc

SEQ ID NO: 21311 - DNA, 25 bp, S. cerevisiae
caaaccaactctttcatttcatcag

SEQ ID NO: 21312 - DNA, 25 bp, S. cerevisiae
caagaaaactgctcctgatctcaag

SEQ ID NO: 21313 - DNA, 25 bp, S. cerevisiae
caagatataagtgccctgacagaag

SEQ ID NO: 21314 - DNA, 25 bp, S. cerevisiae
caacgctgcaagaagtcactgtaat

SEQ ID NO: 21315 - DNA, 25 bp, S. cerevisiae
caagatagcagattttagggaccat

SEQ ID NO: 21316 - DNA, 25 bp, S. cerevisiae
cacataacaatttaggcggaggctt

SEQ ID NO: 21317 - DNA, 25 bp, S. cerevisiae
caagatatccgttgatcagccgatc

SEQ ID NO: 21318 - DNA, 25 bp, S. cerevisiae
caagaatctgctttgattgccgata

SEQ ID NO: 21319 - DNA, 25 bp, S. cerevisiae
caagttgcactctatttgctcgaaa

SEQ ID NO: 21320 - DNA, 25 bp, S. cerevisiae
caagctgtggtctcgatgtgtttaa

SEQ ID NO: 21321 - DNA, 25 bp, S. cerevisiae
caagagtggtcgtcgtggtgatcaa

SEQ ID NO: 21322 - DNA, 25 bp, S. cerevisiae
caagtggcttcaatatgggtatcaa

SEQ ID NO: 21323 - DNA, 25 bp, S. cerevisiae
caagaggctccttgagggcattcaa

SEQ ID NO: 21324 - DNA, 25 bp, S. cerevisiae
caagaggtgtctaggtcgatggcta

SEQ ID NO: 21325 - DNA, 25 bp, S. cerevisiae
caagggtttcattgtcgaagacatg

SEQ ID NO: 21326 - DNA, 25 bp, S. cerevisiae
caagggcttacaaacggatgacgat

SEQ ID NO: 21327 - DNA, 25 bp, S. cerevisiae
cagaaggcgttagcggttactacaa

SEQ ID NO: 21328 - DNA, 25 bp, S. cerevisiae
caaagcacgttagcggttttattat

SEQ ID NO: 21329 - DNA, 25 bp, S. cerevisiae
caagaccgtcaagcgtgcttctaag

SEQ ID NO: 21330 - DNA, 25 bp, S. cerevisiae
caagaagattcatcacgtgctttga

SEQ ID NO: 21331 - DNA, 25 bp, S. cerevisiae
caaagatggaagagccgcccttggc

SEQ ID NO: 21332 - DNA, 25 bp, S. cerevisiae
caaattagaatgtccacctccacta

SEQ ID NO: 21333 - DNA, 25 bp, S. cerevisiae
caagttccggttattgaatctgcag

SEQ ID NO: 21334 - DNA, 25 bp, S. cerevisiae
caagttcaaggttagaggctcttct

SEQ ID NO: 21335 - DNA, 25 bp, S. cerevisiae
caagaacgaggttagattccttcgt

SEQ ID NO: 21336 - DNA, 25 bp, S. cerevisiae
caacacccggtgtatttatgttatt

SEQ ID NO: 21337 - DNA, 25 bp, S. cerevisiae
caactggttggtacatcatgcctgt

SEQ ID NO: 21338 - DNA, 25 bp, S. cerevisiae
caacggaatgttacctggcagcaaa

SEQ ID NO: 21339 - DNA, 25 bp, S. cerevisiae
caactagatatcatgtcgaaacaat

SEQ ID NO: 21340 - DNA, 25 bp, S. cerevisiae
caagctgagcaacgatgtagacaca

SEQ ID NO: 21341 - DNA, 25 bp, S. cerevisiae
cacactcctgcacgatatggacgaa

SEQ ID NO: 21342 - DNA, 25 bp, S. cerevisiae
caagccactgcgtctggacctgaga

SEQ ID NO: 21343 - DNA, 25 bp, S. cerevisiae
caagcagcggcgttgtaagctcaga

SEQ ID NO: 21344 - DNA, 25 bp, S. cerevisiae
caagcacgcctggttgtactagaca

SEQ ID NO: 21345 - DNA, 25 bp, S. cerevisiae
caagccagactggacgtgtgcatgg

SEQ ID NO: 21346 - DNA, 25 bp, S. cerevisiae
caagagatggcggagcttctgcatg

SEQ ID NO: 21347 - DNA, 25 bp, S. cerevisiae
caagagtctgctggtgttgctgatt

SEQ ID NO: 21348 - DNA, 25 bp, S. cerevisiae
caacttggtctgtaagaaggctgat

SEQ ID NO: 21349 - DNA, 25 bp, S. cerevisiae
caacgctccattgttaacttcttac

SEQ ID NO: 21350 - DNA, 25 bp, S. cerevisiae
caacgttcctggtatttggacacat

SEQ ID NO: 21351 - DNA, 25 bp, S. cerevisiae
caactccttgcggtttttgaatgat

SEQ ID NO: 21352 - DNA, 25 bp, S. cerevisiae
caagaacgtccctaattggcataga

SEQ ID NO: 21353 - DNA, 25 bp, S. cerevisiae
caagaaggtcgctaagagaactaaa

SEQ ID NO: 21354 - DNA, 25 bp, S. cerevisiae
caagaagttagctaccagaccaaag

SEQ ID NO: 21355 - DNA, 25 bp, S. cerevisiae
caagacactttgtgctcaatgagca

SEQ ID NO: 21356 - DNA, 25 bp, S. cerevisiae
caagaaatctctgggctcactagcg

SEQ ID NO: 21357 - DNA, 25 bp, S. cerevisiae
caagatactgtcgtactacccaagt

SEQ ID NO: 21358 - DNA, 25 bp, S. cerevisiae
caagaaatatttcctaccctgaata

SEQ ID NO: 21359 - DNA, 25 bp, S. cerevisiae
caagaaagccaattgttcccgaaga

SEQ ID NO: 21360 - DNA, 25 bp, S. cerevisiae
caaagggctcctcctccaaaggaag

SEQ ID NO: 21361 - DNA, 25 bp, S. cerevisiae
caaagatatcccacgtatactaggt

SEQ ID NO: 21362 - DNA, 25 bp, S. cerevisiae
caaaaatctgctcccattaacaagg

SEQ ID NO: 21363 - DNA, 25 bp, S. cerevisiae
ctaccaactcattactgaagaaagt

SEQ ID NO: 21364 - DNA, 25 bp, S. cerevisiae
caagactgccaaagcttctcaagaa

SEQ ID NO: 21365 - DNA, 25 bp, S. cerevisiae
caagagctgccgatgtttcgattaa

SEQ ID NO: 21366 - DNA, 25 bp, S. cerevisiae
caagcatttgccatatttcgattca

SEQ ID NO: 21367 - DNA, 25 bp, S. cerevisiae
caaattttcctttggtcaagccact

SEQ ID NO: 21368 - DNA, 25 bp, S. cerevisiae
caagcacctttcactttcggaattt

SEQ ID NO: 21369 - DNA, 25 bp, S. cerevisiae
caaacactttcaattcttcccagtt

SEQ ID NO: 21370 - DNA, 25 bp, S. cerevisiae
caagatcctttgttactgacgacat

SEQ ID NO: 21371 - DNA, 25 bp, S. cerevisiae
caagacgctttgtttatcaccagat

SEQ ID NO: 21372 - DNA, 25 bp, S. cerevisiae
caaagttttgttcccgtactctctg

SEQ ID NO: 21373 - DNA, 25 bp, S. cerevisiae
caaagttatatttcgacgccaccat

SEQ ID NO: 21374 - DNA, 25 bp, S. cerevisiae
caacagttagaaagcgatcctcccc

SEQ ID NO: 21375 - DNA, 25 bp, S. cerevisiae
caagcgattttagtgcgtcttcctc

SEQ ID NO: 21376 - DNA, 25 bp, S. cerevisiae
caacaattgttactctttcccaggt

SEQ ID NO: 21377 - DNA, 25 bp, S. cerevisiae
caagagttttctttccgaggaagct

SEQ ID NO: 21378 - DNA, 25 bp, S. cerevisiae
tataatttttcctccggtacctgcg

SEQ ID NO: 21379 - DNA, 25 bp, S. cerevisiae
caaccattttttgactggaggcatg

SEQ ID NO: 21380 - DNA, 25 bp, S. cerevisiae
caagcaatgctttactttgggtgga

SEQ ID NO: 21381 - DNA, 25 bp, S. cerevisiae
caagcattgtttctactggatattt

SEQ ID NO: 21382 - DNA, 25 bp, S. cerevisiae
caacatttttggcacctggtctgga

SEQ ID NO: 21383 - DNA, 25 bp, S. cerevisiae
caaatttggtcagcctgttcgcgaa

SEQ ID NO: 21384 - DNA, 25 bp, S. cerevisiae
cataactatggtgaaggttccgcaa

SEQ ID NO: 21385 - DNA, 25 bp, S. cerevisiae
caaactgtggtttgctttgacctaa

SEQ ID NO: 21386 - DNA, 25 bp, S. cerevisiae
caaaaggagctttcagttcaaaact

SEQ ID NO: 21387 - DNA, 25 bp, S. cerevisiae
caagaaggacttccagcaccaacgt

SEQ ID NO: 21388 - DNA, 25 bp, S. cerevisiae
caagaaggactattccatcgacagt

SEQ ID NO: 21389 - DNA, 25 bp, S. cerevisiae
cagagaaggcattaacgtcgaagat

SEQ ID NO: 21390 - DNA, 25 bp, S. cerevisiae
caacaaggtagatcgctgctggtat

SEQ ID NO: 21391 - DNA, 25 bp, S. cerevisiae
caccattgttggaggttcgtggaca

SEQ ID NO: 21392 - DNA, 25 bp, S. cerevisiae
cactcggcattgaagggtccggtta

SEQ ID NO: 21393 - DNA, 25 bp, S. cerevisiae
cacacggaggctttggtctagggtt

SEQ ID NO: 21394 - DNA, 25 bp, S. cerevisiae
caagccggagctgatgtgtctagaa

SEQ ID NO: 21395 - DNA, 25 bp, S. cerevisiae
caacggttcaaattcttggtgctga

SEQ ID NO: 21396 - DNA, 25 bp, S. cerevisiae
caaccttggaactacttgggattat

SEQ ID NO: 21397 - DNA, 25 bp, S. cerevisiae
caaacttcgcgatcgtatagagcaa

SEQ ID NO: 21398 - DNA, 25 bp, S. cerevisiae
caacggccgcgcaacaggaggacaa

SEQ ID NO: 21399 - DNA, 25 bp, S. cerevisiae
caacgacaaccttcacgaaacgatc

SEQ ID NO: 21400 - DNA, 25 bp, S. cerevisiae
caacgactacatctccacaattgga

SEQ ID NO: 21401 - DNA, 25 bp, S. cerevisiae
caacggatgcaaccccaaactaaag

SEQ ID NO: 21402 - DNA, 25 bp, S. cerevisiae
caaaagcatctagcccagagggaat

SEQ ID NO: 21403 - DNA, 25 bp, S. cerevisiae
ccaaatcggtgcaccaatggctggt

SEQ ID NO: 21404 - DNA, 25 bp, S. cerevisiae
caaaacaggtctttcaatggcattt

SEQ ID NO: 21405 - DNA, 25 bp, S. cerevisiae
caacgaaccgacctatttgcatagt

SEQ ID NO: 21406 - DNA, 25 bp, S. cerevisiae
caaccatactcgttattcccaagat

SEQ ID NO: 21407 - DNA, 25 bp, S. cerevisiae
caccttcgacgaaatttccaagatc

SEQ ID NO: 21408 - DNA, 25 bp, S. cerevisiae
caccttcgaatacattttgccgtca

SEQ ID NO: 21409 - DNA, 25 bp, S. cerevisiae
catacgttatactattttacaccgt

SEQ ID NO: 21410 - DNA, 25 bp, S. cerevisiae
caacggccaacatttttccaacatg

SEQ ID NO: 21411 - DNA, 25 bp, S. cerevisiae
caaccctcaatccatttaccaataa

SEQ ID NO: 21412 - DNA, 25 bp, S. cerevisiae
caaccagtcgttgttattgatgcta

SEQ ID NO: 21413 - DNA, 25 bp, S. cerevisiae
caaaagtctttcagaatcaagcaaa

SEQ ID NO: 21414 - DNA, 25 bp, S. cerevisiae
caaccagctcgtacaggacatcata

SEQ ID NO: 21415 - DNA, 25 bp, S. cerevisiae
caagcgcatttctatgtcgactata

SEQ ID NO: 21416 - DNA, 25 bp, S. cerevisiae
caagctgatcttgatgttattcgaa

SEQ ID NO: 21417 - DNA, 25 bp, S. cerevisiae
ctttggatttcacacgtcgtacgga

SEQ ID NO: 21418 - DNA, 25 bp, S. cerevisiae
ctttattttcatcacgtaacacggt

SEQ ID NO: 21419 - DNA, 25 bp, S. cerevisiae
tttaacttactcaggacgcccaact

SEQ ID NO: 21420 - DNA, 25 bp, S. cerevisiae
tattaaccgtcgaggaaggccaatt

SEQ ID NO: 21421 - DNA, 25 bp, S. cerevisiae
gcaaaaccctcgagcaatagtccaa

SEQ ID NO: 21422 - DNA, 25 bp, S. cerevisiae
caacaccttcggctttttcttagag

SEQ ID NO: 21423 - DNA, 25 bp, S. cerevisiae
cacttccaaagcgttttcctcttat

SEQ ID NO: 21424 - DNA, 25 bp, S. cerevisiae
cactgggcaaaccattttctcgttt

SEQ ID NO: 21425 - DNA, 25 bp, S. cerevisiae
cacgcggacccgaattttggatatc

SEQ ID NO: 21426 - DNA, 25 bp, S. cerevisiae
caaatccataactcggaattcccaa

SEQ ID NO: 21427 - DNA, 25 bp, S. cerevisiae
caaagttatagctcggaatcctcaa

SEQ ID NO: 21428 - DNA, 25 bp, S. cerevisiae
cacactgaattacttgcggacgaat

SEQ ID NO: 21429 - DNA, 25 bp, S. cerevisiae
caacagctgagttcttggtagacat

SEQ ID NO: 21430 - DNA, 25 bp, S. cerevisiae
caaagcatgtaccttggccgccaag

SEQ ID NO: 21431 - DNA, 25 bp, S. cerevisiae
caacatcgtgctgagtgatgcagta

SEQ ID NO: 21432 - DNA, 25 bp, S. cerevisiae
caacaggtgtggtcaagaggtcatt

SEQ ID NO: 21433 - DNA, 25 bp, S. cerevisiae
caaaggtgtcaatctggtcatcaat

SEQ ID NO: 21434 - DNA, 25 bp, S. cerevisiae
caaaggtcattcactggcaagctac

SEQ ID NO: 21435 - DNA, 25 bp, S. cerevisiae
cagagggtactcatcgcatcaatcg

SEQ ID NO: 21436 - DNA, 25 bp, S. cerevisiae
caaacccactcttcgctaatgatgt

SEQ ID NO: 21437 - DNA, 25 bp, S. cerevisiae
caacggcaacttccagatatgtgat

SEQ ID NO: 21438 - DNA, 25 bp, S. cerevisiae
caacggagacatcgccatggaagat

SEQ ID NO: 21439 - DNA, 25 bp, S. cerevisiae
cacctaatcactcgcctgagattga

SEQ ID NO: 21440 - DNA, 25 bp, S. cerevisiae
cactgctttgcccaacatggttaat

SEQ ID NO: 21441 - DNA, 25 bp, S. cerevisiae
cacatgttccgcagattttgatcaa

SEQ ID NO: 21442 - DNA, 25 bp, S. cerevisiae
caacgtatcgtgtttcttcagacta

SEQ ID NO: 21443 - DNA, 25 bp, S. cerevisiae
cagaagaactggtttgttacgtggt

SEQ ID NO: 21444 - DNA, 25 bp, S. cerevisiae
caaaaacggacttctgctcacaggt

SEQ ID NO: 21445 - DNA, 25 bp, S. cerevisiae
caaaatactctgtcgttatggaggt

SEQ ID NO: 21446 - DNA, 25 bp, S. cerevisiae
caaaccctctatgatgttgtcggat

SEQ ID NO: 21447 - DNA, 25 bp, S. cerevisiae
caacgtgaatcctcttttggctaac

SEQ ID NO: 21448 - DNA, 25 bp, S. cerevisiae
caacgaatactctactttctccgaa

SEQ ID NO: 21449 - DNA, 25 bp, S. cerevisiae
caacgaattgttgtcctctttggaa

SEQ ID NO: 21450 - DNA, 25 bp, S. cerevisiae
caagcgcttggatctttcatgtcaa

SEQ ID NO: 21451 - DNA, 25 bp, S. cerevisiae
caaagtagtttccatgtttccgata

SEQ ID NO: 21452 - DNA, 25 bp, S. cerevisiae
caaacagattgcttccgtagagggt

SEQ ID NO: 21453 - DNA, 25 bp, S. cerevisiae
caacttgattgtgccatctctggat

SEQ ID NO: 21454 - DNA, 25 bp, S. cerevisiae
cacgaaattagatcccaccgttttg

SEQ ID NO: 21455 - DNA, 25 bp, S. cerevisiae
cactgaagttggtatccgacgtata

SEQ ID NO: 21456 - DNA, 25 bp, S. cerevisiae
cactaagttacacttggacaaggac

SEQ ID NO: 21457 - DNA, 25 bp, S. cerevisiae
caagcgtggctgaatctttcacaga

SEQ ID NO: 21458 - DNA, 25 bp, S. cerevisiae
caagcccactgtttttcgcaaatta

SEQ ID NO: 21459 - DNA, 25 bp, S. cerevisiae
caaccactctgatttcaaccttttg

SEQ ID NO: 21460 - DNA, 25 bp, S. cerevisiae
cagaccagttgctttaccttggttt

SEQ ID NO: 21461 - DNA, 25 bp, S. cerevisiae
cacagttttactctttccaacgaat

SEQ ID NO: 21462 - DNA, 25 bp, S. cerevisiae
caaccgcataagcaaggaattcatc

SEQ ID NO: 21463 - DNA, 25 bp, S. cerevisiae
gcaaaccacgatcaaggagtccaag

SEQ ID NO: 21464 - DNA, 25 bp, S. cerevisiae
caaacaccttgccatcattggtcaa

SEQ ID NO: 21465 - DNA, 25 bp, S. cerevisiae
caagccaccctagatgcggatgtta

SEQ ID NO: 21466 - DNA, 25 bp, S. cerevisiae
cacacccacacactctcttacatct

SEQ ID NO: 21467 - DNA, 25 bp, S. cerevisiae
cacctgccaagactacatatctgac

SEQ ID NO: 21468 - DNA, 25 bp, S. cerevisiae
caacctattatctccagtttccaat

SEQ ID NO: 21469 - DNA, 25 bp, S. cerevisiae
caccgtcaatctttctcaatcgtaa

SEQ ID NO: 21470 - DNA, 25 bp, S. cerevisiae
caaacttgcctgctaattcttcaac

SEQ ID NO: 21471 - DNA, 25 bp, S. cerevisiae
caaacgtgcctccaaggctttgatt

SEQ ID NO: 21472 - DNA, 25 bp, S. cerevisiae
caaccagtcacctcattatttttca

SEQ ID NO: 21473 - DNA, 25 bp, S. cerevisiae
caaccagctccctcagaaattttaa

SEQ ID NO: 21474 - DNA, 25 bp, S. cerevisiae
cacaccccttcatacaaattcgatt

SEQ ID NO: 21475 - DNA, 25 bp, S. cerevisiae
caaaagaggctttctggtacagact

SEQ ID NO: 21476 - DNA, 25 bp, S. cerevisiae
caaaattgttgattctcctcaccct

SEQ ID NO: 21477 - DNA, 25 bp, S. cerevisiae
caaagatctgttacgtctccaacgt

SEQ ID NO: 21478 - DNA, 25 bp, S. cerevisiae
cgctttgtctttctacgatgggtac

SEQ ID NO: 21479 - DNA, 25 bp, S. cerevisiae
caaatctatccaaccttacttacag

SEQ ID NO: 21480 - DNA, 25 bp, S. cerevisiae
caacattaatgcctattctccagtc

SEQ ID NO: 21481 - DNA, 25 bp, S. cerevisiae
caaaatcaatcatctcgcatcgcaa

SEQ ID NO: 21482 - DNA, 25 bp, S. cerevisiae
caaatatactacctgctgatgtgca

SEQ ID NO: 21483 - DNA, 25 bp, S. cerevisiae
caaattgcaagctgttggtgactta

SEQ ID NO: 21484 - DNA, 25 bp, S. cerevisiae
caactcactacaaaatcccagcttg

SEQ ID NO: 21485 - DNA, 25 bp, S. cerevisiae
cagaaactgtcaacgaacccgggat

SEQ ID NO: 21486 - DNA, 25 bp, S. cerevisiae
caacaaagacttatattccagggaa

SEQ ID NO: 21487 - DNA, 25 bp, S. cerevisiae
caacaactacgtctataccctgaag

SEQ ID NO: 21488 - DNA, 25 bp, S. cerevisiae
caaaactatcgtcttatcctcatgc

SEQ ID NO: 21489 - DNA, 25 bp, S. cerevisiae
caacaacaatttcatctaccacaac

SEQ ID NO: 21490 - DNA, 25 bp, S. cerevisiae
caaattcaatttcctcttctcaaac

SEQ ID NO: 21491 - DNA, 25 bp, S. cerevisiae
cacaatgtaatctattttttcagga

SEQ ID NO: 21492 - DNA, 25 bp, S. cerevisiae
caaatgtaacttgttttctgaaagg

SEQ ID NO: 21493 - DNA, 25 bp, S. cerevisiae
caaagctaccttattgagtccacaa

SEQ ID NO: 21494 - DNA, 25 bp, S. cerevisiae
caacgcttatatttgcacgatggca

SEQ ID NO: 21495 - DNA, 25 bp, S. cerevisiae
cacaccgtattctgcatcgtgattt

SEQ ID NO: 21496 - DNA, 25 bp, S. cerevisiae
cacatccgtttttgtcgttgaccaa

SEQ ID NO: 21497 - DNA, 25 bp, S. cerevisiae
cacagggttactttcgttgtcgaag

SEQ ID NO: 21498 - DNA, 25 bp, S. cerevisiae
caccgccgaccataataataccaat

SEQ ID NO: 21499 - DNA, 25 bp, S. cerevisiae
cacagcaacagaactagaaactaac

SEQ ID NO: 21500 - DNA, 25 bp, S. cerevisiae
cacagcaactgaactaaaaactaat

SEQ ID NO: 21501 - DNA, 25 bp, S. cerevisiae
cacctcctgttttaaaagctactgg

SEQ ID NO: 21502 - DNA, 25 bp, S. cerevisiae
cacccatcttttagtaaatccctcg

SEQ ID NO: 21503 - DNA, 25 bp, S. cerevisiae
caaataccagattttaccgaccctg

SEQ ID NO: 21504 - DNA, 25 bp, S. cerevisiae
caaaagcaagccagtaccgtcaaaa

SEQ ID NO: 21505 - DNA, 25 bp, S. cerevisiae
taataacgtcccattcaaagctacc

SEQ ID NO: 21506 - DNA, 25 bp, S. cerevisiae
caaactttttcggtgctcttacagc

SEQ ID NO: 21507 - DNA, 25 bp, S. cerevisiae
caacgctttcgggttcgtatcaaat

SEQ ID NO: 21508 - DNA, 25 bp, S. cerevisiae
caaagtcttgggtactcctgataaa

SEQ ID NO: 21509 - DNA, 25 bp, S. cerevisiae
caacgttggtggatgtgcagtccat

SEQ ID NO: 21510 - DNA, 25 bp, S. cerevisiae
caactcttttggtggatgtcactcc

SEQ ID NO: 21511 - DNA, 25 bp, S. cerevisiae
cactatggtttggagatgggtcgac

SEQ ID NO: 21512 - DNA, 25 bp, S. cerevisiae
cacttgttgttctctgtacaccgtt

SEQ ID NO: 21513 - DNA, 25 bp, S. cerevisiae
caaacgtttcatatgctagagcctt

SEQ ID NO: 21514 - DNA, 25 bp, S. cerevisiae
caaaggattacagggccaggcgtat

SEQ ID NO: 21515 - DNA, 25 bp, S. cerevisiae
caaatatgttcacgtggccacctgt

SEQ ID NO: 21516 - DNA, 25 bp, S. cerevisiae
gcacaaaatcgctgtacccattgag

SEQ ID NO: 21517 - DNA, 25 bp, S. cerevisiae
caacagttacatggcacggtagtga

SEQ ID NO: 21518 - DNA, 25 bp, S. cerevisiae
caactgttactcctgccgaaatgaa

SEQ ID NO: 21519 - DNA, 25 bp, S. cerevisiae
caaaccatttggaaattgcccttgg

SEQ ID NO: 21520 - DNA, 25 bp, S. cerevisiae
catggcaatactactactacacctt

SEQ ID NO: 21521 - DNA, 25 bp, S. cerevisiae
caccacacacccacacactctctta

SEQ ID NO: 21522 - DNA, 25 bp, S. cerevisiae
caacacatgttattggctgacccca

SEQ ID NO: 21523 - DNA, 25 bp, S. cerevisiae
cagtcgtgcgtagggctgacaacaa

SEQ ID NO: 21524 - DNA, 25 bp, S. cerevisiae
cagagtgtgctgaacgggaccctac

SEQ ID NO: 21525 - DNA, 25 bp, S. cerevisiae
cagatgtgctgtgactgggttccat

SEQ ID NO: 21526 - DNA, 25 bp, S. cerevisiae
caacaattgcagaactcggagtcga

SEQ ID NO: 21527 - DNA, 25 bp, S. cerevisiae
caaacttgttgaatccatgaacgat

SEQ ID NO: 21528 - DNA, 25 bp, S. cerevisiae
caaactcggtgaatactctatggcg

SEQ ID NO: 21529 - DNA, 25 bp, S. cerevisiae
caaacctggtacttctgttgacgtt

SEQ ID NO: 21530 - DNA, 25 bp, S. cerevisiae
caaactgaagtaccccgatctagat

SEQ ID NO: 21531 - DNA, 25 bp, S. cerevisiae
caaagagaatgaatcgcccgttaaa

SEQ ID NO: 21532 - DNA, 25 bp, S. cerevisiae
caactgcttttcaatatctttataa

SEQ ID NO: 21533 - DNA, 25 bp, S. cerevisiae
caactttgccttcttattcatcgat

SEQ ID NO: 21534 - DNA, 25 bp, S. cerevisiae
caacttctggttgttcactccaaga

SEQ ID NO: 21535 - DNA, 25 bp, S. cerevisiae
cagatctttcggttactcctcaaaa

SEQ ID NO: 21536 - DNA, 25 bp, S. cerevisiae
caacttccgtgctttttggcaacaa

SEQ ID NO: 21537 - DNA, 25 bp, S. cerevisiae
caaatccgccagatgatgttgttaa

SEQ ID NO: 21538 - DNA, 25 bp, S. cerevisiae
cacaccatggagtataagccctata

SEQ ID NO: 21539 - DNA, 25 bp, S. cerevisiae
caaagcatgggattacgaacgtgat

SEQ ID NO: 21540 - DNA, 25 bp, S. cerevisiae
caaacgcacgcatacgaaggctatt

SEQ ID NO: 21541 - DNA, 25 bp, S. cerevisiae
caacggtccatcaagcgtaggctta

SEQ ID NO: 21542 - DNA, 25 bp, S. cerevisiae
cagccgaggccttatttacacttag

SEQ ID NO: 21543 - DNA, 25 bp, S. cerevisiae
caaacaccgatacccgagcttgaag

SEQ ID NO: 21544 - DNA, 25 bp, S. cerevisiae
caaacttcactaccttctttatcta

SEQ ID NO: 21545 - DNA, 25 bp, S. cerevisiae
caaataccctactttactacttcag

SEQ ID NO: 21546 - DNA, 25 bp, S. cerevisiae
caaagcggacgccaaattttctaat

SEQ ID NO: 21547 - DNA, 25 bp, S. cerevisiae
caaacaaaccacgtgatggtctaca

SEQ ID NO: 21548 - DNA, 25 bp, S. cerevisiae
caaacagtaccacgttgggcggact

SEQ ID NO: 21549 - DNA, 25 bp, S. cerevisiae
caactctggttccacgggcagaagt

SEQ ID NO: 21550 - DNA, 25 bp, S. cerevisiae
catcctcgccggtgggttagatata

SEQ ID NO: 21551 - DNA, 25 bp, S. cerevisiae
cactacattcggctgggattcaatt

SEQ ID NO: 21552 - DNA, 25 bp, S. cerevisiae
ccggtccctttgcatttattttcat

SEQ ID NO: 21553 - DNA, 25 bp, S. cerevisiae
caccgcctccttagaatttgtttct

SEQ ID NO: 21554 - DNA, 25 bp, S. cerevisiae
cacagtgccagtgcttgaacttgat

SEQ ID NO: 21555 - DNA, 25 bp, S. cerevisiae
cacacatcctatgcgtcaagcttat

SEQ ID NO: 21556 - DNA, 25 bp, S. cerevisiae
cacaaccgcaacctatatacataca

SEQ ID NO: 21557 - DNA, 25 bp, S. cerevisiae
caaacggtatgccttatccaccata

SEQ ID NO: 21558 - DNA, 25 bp, S. cerevisiae
caaacccatatccttatcttggcta

SEQ ID NO: 21559 - DNA, 25 bp, S. cerevisiae
caaaaccaatcactttccttcagaa

SEQ ID NO: 21560 - DNA, 25 bp, S. cerevisiae
cacgatttaaacgttcccttgaatg

SEQ ID NO: 21561 - DNA, 25 bp, S. cerevisiae
cacccgctaaaatttgcccttatga

SEQ ID NO: 21562 - DNA, 25 bp, S. cerevisiae
caacatgctgttccgatatcttctt

SEQ ID NO: 21563 - DNA, 25 bp, S. cerevisiae
caacagctccgccaagtgcaagaag

SEQ ID NO: 21564 - DNA, 25 bp, S. cerevisiae
ctggacagcactacaaggcggcaaa

SEQ ID NO: 21565 - DNA, 25 bp, S. cerevisiae
caaacacctgatgacgcggaagacg

SEQ ID NO: 21566 - DNA, 25 bp, S. cerevisiae
caaagacactgaatatcctgcgata

SEQ ID NO: 21567 - DNA, 25 bp, S. cerevisiae
caaacatgcctggtatgccgaatat

SEQ ID NO: 21568 - DNA, 25 bp, S. cerevisiae
caacacgagatctttcacgcataca

SEQ ID NO: 21569 - DNA, 25 bp, S. cerevisiae
caaagtagcaatccactcttagagg

SEQ ID NO: 21570 - DNA, 25 bp, S. cerevisiae
caaagctacatttccaacagagagg

SEQ ID NO: 21571 - DNA, 25 bp, S. cerevisiae
caaactttattcctcactgcaatga

SEQ ID NO: 21572 - DNA, 25 bp, S. cerevisiae
caacatttctaacgtcagtgctaat

SEQ ID NO: 21573 - DNA, 25 bp, S. cerevisiae
caaatgttccagttatcgtcaaagc

SEQ ID NO: 21574 - DNA, 25 bp, S. cerevisiae
cagaagcttcggttaattcaaggcg

SEQ ID NO: 21575 - DNA, 25 bp, S. cerevisiae
cagaagcttctaccgaagctccagt

SEQ ID NO: 21576 - DNA, 25 bp, S. cerevisiae
caaaggtttgagacataagttatcc

SEQ ID NO: 21577 - DNA, 25 bp, S. cerevisiae
cagacaacggcccaacggttgaaga

SEQ ID NO: 21578 - DNA, 25 bp, S. cerevisiae
cacaaatgttatgggcacgccgctg

SEQ ID NO: 21579 - DNA, 25 bp, S. cerevisiae
caaacatgccgggtatgccaaacat

SEQ ID NO: 21580 - DNA, 25 bp, S. cerevisiae
caaatctccggctaactcgtatata

SEQ ID NO: 21581 - DNA, 25 bp, S. cerevisiae
cacctttaggttcttatgttgcagt

SEQ ID NO: 21582 - DNA, 25 bp, S. cerevisiae
caccgtcaaggattctatttgtcgg

SEQ ID NO: 21583 - DNA, 25 bp, S. cerevisiae
cacctccaggtgatgcatatttgct

SEQ ID NO: 21584 - DNA, 25 bp, S. cerevisiae
cataccagatcgcttgttgtcgtgc

SEQ ID NO: 21585 - DNA, 25 bp, S. cerevisiae
cacgctcaaacggtgggcactaatg

SEQ ID NO: 21586 - DNA, 25 bp, S. cerevisiae
cactgctgctaaatggaggacactc

SEQ ID NO: 21587 - DNA, 25 bp, S. cerevisiae
cacttgcctattatggacagccagt

SEQ ID NO: 21588 - DNA, 25 bp, S. cerevisiae
cactctgcctgtgttgaaagacgcc

SEQ ID NO: 21589 - DNA, 25 bp, S. cerevisiae
caaacgcttcttctgcaattactgc

SEQ ID NO: 21590 - DNA, 25 bp, S. cerevisiae
caacaaccgcttttgaattcccaag

SEQ ID NO: 21591 - DNA, 25 bp, S. cerevisiae
caaagttcccttagatatccgtaag

SEQ ID NO: 21592 - DNA, 25 bp, S. cerevisiae
caaatgttcctagtggtaccagttt

SEQ ID NO: 21593 - DNA, 25 bp, S. cerevisiae
caaatttcaagatgtgtcgcggttt

SEQ ID NO: 21594 - DNA, 25 bp, S. cerevisiae
caaattgtactatgatgtcgagaaa

SEQ ID NO: 21595 - DNA, 25 bp, S. cerevisiae
caaatctggactttatgacgtgcaa

SEQ ID NO: 21596 - DNA, 25 bp, S. cerevisiae
caaaatgtacttctagctccagcac

SEQ ID NO: 21597 - DNA, 25 bp, S. cerevisiae
caaaagtcacttccaattccacgaa

SEQ ID NO: 21598 - DNA, 25 bp, S. cerevisiae
caaaggtcactttcatttccaagat

SEQ ID NO: 21599 - DNA, 25 bp, S. cerevisiae
caaagcgtcactggtttagatgcaa

SEQ ID NO: 21600 - DNA, 25 bp, S. cerevisiae
cacataagatgttacgtcgtctgta

SEQ ID NO: 21601 - DNA, 25 bp, S. cerevisiae
cacaggtggcttcttggtggaaaat

SEQ ID NO: 21602 - DNA, 25 bp, S. cerevisiae
cacagggtgctcagtctcgaaaaat

SEQ ID NO: 21603 - DNA, 25 bp, S. cerevisiae
caaagagcctctttcttggcgaaat

SEQ ID NO: 21604 - DNA, 25 bp, S. cerevisiae
caaaggctatcggtctattctaagt

SEQ ID NO: 21605 - DNA, 25 bp, S. cerevisiae
caaagcattatcagccgtgttcaag

SEQ ID NO: 21606 - DNA, 25 bp, S. cerevisiae
cacaaggtgctcgtgtttacactga

SEQ ID NO: 21607 - DNA, 25 bp, S. cerevisiae
caaacggtcggaagatctcagcaga

SEQ ID NO: 21608 - DNA, 25 bp, S. cerevisiae
caaaccttatggacagactgcgtga

SEQ ID NO: 21609 - DNA, 25 bp, S. cerevisiae
caaactttcttgacgatgctggtag

SEQ ID NO: 21610 - DNA, 25 bp, S. cerevisiae
caaacggtctatacgcatgatgctg

SEQ ID NO: 21611 - DNA, 25 bp, S. cerevisiae
caaaccaccggctatcagaatgata

SEQ ID NO: 21612 - DNA, 25 bp, S. cerevisiae
caaacgttgcgccatcggaggaaga

SEQ ID NO: 21613 - DNA, 25 bp, S. cerevisiae
caaaacttacttatgtcacatgcaa

SEQ ID NO: 21614 - DNA, 25 bp, S. cerevisiae
caaagctaatgtgtcttctggaaca

SEQ ID NO: 21615 - DNA, 25 bp, S. cerevisiae
cacaattggaggatctttctgaaag

SEQ ID NO: 21616 - DNA, 25 bp, S. cerevisiae
caaaatgtcttgtcttctctgctcg

SEQ ID NO: 21617 - DNA, 25 bp, S. cerevisiae
caaatgattcctcttatatgccgcc

SEQ ID NO: 21618 - DNA, 25 bp, S. cerevisiae
caaagttccgaggatgtcatcacca

SEQ ID NO: 21619 - DNA, 25 bp, S. cerevisiae
caaatttccagaggcttatcccact

SEQ ID NO: 21620 - DNA, 25 bp, S. cerevisiae
caaattctcaaggttcttctctaga

SEQ ID NO: 21621 - DNA, 25 bp, S. cerevisiae
cacagtttggtggttctaccattaa

SEQ ID NO: 21622 - DNA, 25 bp, S. cerevisiae
caccgtatccccaaagttgtacata

SEQ ID NO: 21623 - DNA, 25 bp, S. cerevisiae
cacggttctcaccttggcggtagaa

SEQ ID NO: 21624 - DNA, 25 bp, S. cerevisiae
cactttacatttggtcttgagatta

SEQ ID NO: 21625 - DNA, 25 bp, S. cerevisiae
cagagtttgttggtgggttctcgcc

SEQ ID NO: 21626 - DNA, 25 bp, S. cerevisiae
cagatctttggttagagaaatcgcc

SEQ ID NO: 21627 - DNA, 25 bp, S. cerevisiae
cactgtttgggcctggatgaaatcc

SEQ ID NO: 21628 - DNA, 25 bp, S. cerevisiae
cacgctacgacccagaagatcagat

SEQ ID NO: 21629 - DNA, 25 bp, S. cerevisiae
cacgtacgactctgcattggaatta

SEQ ID NO: 21630 - DNA, 25 bp, S. cerevisiae
cactggacagtaccgctttgaaaca

SEQ ID NO: 21631 - DNA, 25 bp, S. cerevisiae
cactgctgaagtgtctcgttgtcaa

SEQ ID NO: 21632 - DNA, 25 bp, S. cerevisiae
cactcagggtggtggttacgcaagt

SEQ ID NO: 21633 - DNA, 25 bp, S. cerevisiae
cacaggaggtccatggttcacagat

SEQ ID NO: 21634 - DNA, 25 bp, S. cerevisiae
cactgggttcaagggtctcctgata

SEQ ID NO: 21635 - DNA, 25 bp, S. cerevisiae
gcacgggttcggcattcaagtctga

SEQ ID NO: 21636 - DNA, 25 bp, S. cerevisiae
cacagggttgcgatatgtccagtat

SEQ ID NO: 21637 - DNA, 25 bp, S. cerevisiae
cacgtggtggtcaaattccagctga

SEQ ID NO: 21638 - DNA, 25 bp, S. cerevisiae
cagggtgctgaaaaactcggtagtt

SEQ ID NO: 21639 - DNA, 25 bp, S. cerevisiae
caccggctatcaaaccatgggtagg

SEQ ID NO: 21640 - DNA, 25 bp, S. cerevisiae
cactacctatggagcctcgagaaga

SEQ ID NO: 21641 - DNA, 25 bp, S. cerevisiae
cacagaccctggtgcgttgcaaaaa

SEQ ID NO: 21642 - DNA, 25 bp, S. cerevisiae
cagcatcgccgtctaaggtgcaaag

SEQ ID NO: 21643 - DNA, 25 bp, S. cerevisiae
catgtcgacgttgcccgtgataaga

SEQ ID NO: 21644 - DNA, 25 bp, S. cerevisiae
cagtcgaagcaaccccaggaggaat

SEQ ID NO: 21645 - DNA, 25 bp, S. cerevisiae
ctaaaactgaactctgtgggtcaaa

SEQ ID NO: 21646 - DNA, 25 bp, S. cerevisiae
gtagaaccgaccttggtggtgccga

SEQ ID NO: 21647 - DNA, 25 bp, S. cerevisiae
gtaggtaggttgtttcagtccattt

SEQ ID NO: 21648 - DNA, 25 bp, S. cerevisiae
ctagtaagtttgtttgcgggcctga

SEQ ID NO: 21649 - DNA, 25 bp, S. cerevisiae
cccttggttacctcaggtgttgaca

SEQ ID NO: 21650 - DNA, 25 bp, S. cerevisiae
ccccggaaacgattagtggcattga

SEQ ID NO: 21651 - DNA, 25 bp, S. cerevisiae
catccagcatgcaatacagtgacat

SEQ ID NO: 21652 - DNA, 25 bp, S. cerevisiae
caccagcatcatcaccgtagtaatt

SEQ ID NO: 21653 - DNA, 25 bp, S. cerevisiae
cacccttaacacctgacgattttga

SEQ ID NO: 21654 - DNA, 25 bp, S. cerevisiae
cacccttattggttaattgtctcga

SEQ ID NO: 21655 - DNA, 25 bp, S. cerevisiae
cacaccgttgggatttggcttaata

SEQ ID NO: 21656 - DNA, 25 bp, S. cerevisiae
cacagggtctagaaatacggcacaa

SEQ ID NO: 21657 - DNA, 25 bp, S. cerevisiae
cacaatgattcatggccaaccgaaa

SEQ ID NO: 21658 - DNA, 25 bp, S. cerevisiae
caaagactagagcacaactggaata

SEQ ID NO: 21659 - DNA, 25 bp, S. cerevisiae
cactaaaggatgttcagaggcaaat

SEQ ID NO: 21660 - DNA, 25 bp, S. cerevisiae
cactatcaaacctctggcagactaa

SEQ ID NO: 21661 - DNA, 25 bp, S. cerevisiae
cactatgaacatactctggacaagg

SEQ ID NO: 21662 - DNA, 25 bp, S. cerevisiae
cacatggaatcgtgggttctgaccc

SEQ ID NO: 21663 - DNA, 25 bp, S. cerevisiae
cacgtcaacgtgcaggtttacctta

SEQ ID NO: 21664 - DNA, 25 bp, S. cerevisiae
cactagtgaaagtgccctcggcaaa

SEQ ID NO: 21665 - DNA, 25 bp, S. cerevisiae
cacgggacacgttgattttggccaa

SEQ ID NO: 21666 - DNA, 25 bp, S. cerevisiae
cacagggacaacaatgatttggcaa

SEQ ID NO: 21667 - DNA, 25 bp, S. cerevisiae
cacagtgcagacgttttggaggcca

SEQ ID NO: 21668 - DNA, 25 bp, S. cerevisiae
cactgtcgatcgttttggacgtcgt

SEQ ID NO: 21669 - DNA, 25 bp, S. cerevisiae
caaagatctctttcatcgggcaatg

SEQ ID NO: 21670 - DNA, 25 bp, S. cerevisiae
catcagagacttgggcatcggctac

SEQ ID NO: 21671 - DNA, 25 bp, S. cerevisiae
cactggcggtattgcagcaggtgct

SEQ ID NO: 21672 - DNA, 25 bp, S. cerevisiae
cactggcatggttatcggtgacacc

SEQ ID NO: 21673 - DNA, 25 bp, S. cerevisiae
cagatgcagcagatgactccgtaaa

SEQ ID NO: 21674 - DNA, 25 bp, S. cerevisiae
catgatgcgcatgatgatccggaaa

SEQ ID NO: 21675 - DNA, 25 bp, S. cerevisiae
caaagctgtcgattggtgggcattt

SEQ ID NO: 21676 - DNA, 25 bp, S. cerevisiae
taccacttgatgctggagggagtcc

SEQ ID NO: 21677 - DNA, 25 bp, S. cerevisiae
cagcaacttgtgtagtgggcgactc

SEQ ID NO: 21678 - DNA, 25 bp, S. cerevisiae
catcgtcgattttgtggagcggcac

SEQ ID NO: 21679 - DNA, 25 bp, S. cerevisiae
cacacctttggcctagacgctaaaa

SEQ ID NO: 21680 - DNA, 25 bp, S. cerevisiae
cacatccgtctccaaagtcttgaaa

SEQ ID NO: 21681 - DNA, 25 bp, S. cerevisiae
cacactcgtctaccgaatctagata

SEQ ID NO: 21682 - DNA, 25 bp, S. cerevisiae
cacacccgttgaatctcagcagtaa

SEQ ID NO: 21683 - DNA, 25 bp, S. cerevisiae
cagcagcagccatagagttcgagta

SEQ ID NO: 21684 - DNA, 25 bp, S. cerevisiae
caccgccatcgtgatgctggagtga

SEQ ID NO: 21685 - DNA, 25 bp, S. cerevisiae
cacattgataacatcagcggactga

SEQ ID NO: 21686 - DNA, 25 bp, S. cerevisiae
cactttacgaggactgggctgcaga

SEQ ID NO: 21687 - DNA, 25 bp, S. cerevisiae
caaattatgcgatttcggtgtcagt

SEQ ID NO: 21688 - DNA, 25 bp, S. cerevisiae
caaatgttggtgatcgtgtggacta

SEQ ID NO: 21689 - DNA, 25 bp, S. cerevisiae
cagaaacacctttgatgcgcttcgc

SEQ ID NO: 21690 - DNA, 25 bp, S. cerevisiae
caaagacaccttttcctatgacagt

SEQ ID NO: 21691 - DNA, 25 bp, S. cerevisiae
caaatgatcgccattgtcctctaaa

SEQ ID NO: 21692 - DNA, 25 bp, S. cerevisiae
cacagcagggcggttcactttgaaa

SEQ ID NO: 21693 - DNA, 25 bp, S. cerevisiae
cacacatttggatacactctctact

SEQ ID NO: 21694 - DNA, 25 bp, S. cerevisiae
cacaaattggtaacattttcctact

SEQ ID NO: 21695 - DNA, 25 bp, S. cerevisiae
cacccgctggcaacttattactaca

SEQ ID NO: 21696 - DNA, 25 bp, S. cerevisiae
cactgcagatgtagatgtcgtagct

SEQ ID NO: 21697 - DNA, 25 bp, S. cerevisiae
cactggcattaggttgtcattttca

SEQ ID NO: 21698 - DNA, 25 bp, S. cerevisiae
caaatctgtttgtcgtaaatgttac

SEQ ID NO: 21699 - DNA, 25 bp, S. cerevisiae
caaatcctttatcgactactgtctg

SEQ ID NO: 21700 - DNA, 25 bp, S. cerevisiae
caaatggctatttcggctatgctcc

SEQ ID NO: 21701 - DNA, 25 bp, S. cerevisiae
caaatggcagttttcgctatgtcga

SEQ ID NO: 21702 - DNA, 25 bp, S. cerevisiae
caaagcacgcattatctgaggattc

SEQ ID NO: 21703 - DNA, 25 bp, S. cerevisiae
cactttgcctaacgcttactggaga

SEQ ID NO: 21704 - DNA, 25 bp, S. cerevisiae
caccattccttcaagcaaacttcaa

SEQ ID NO: 21705 - DNA, 25 bp, S. cerevisiae
cacacctttacccagtatttcatac

SEQ ID NO: 21706 - DNA, 25 bp, S. cerevisiae
cacggtgttttatcaggcagagcta

SEQ ID NO: 21707 - DNA, 25 bp, S. cerevisiae
cagggtttgattgctcggccagtga

SEQ ID NO: 21708 - DNA, 25 bp, S. cerevisiae
cactgggtggctaaaacctgccgtc

SEQ ID NO: 21709 - DNA, 25 bp, S. cerevisiae
cactgggtggtgttttaggcctgtt

SEQ ID NO: 21710 - DNA, 25 bp, S. cerevisiae
caccgcggcgcaaatgttagaagtt

SEQ ID NO: 21711 - DNA, 25 bp, S. cerevisiae
cacttcaatatatctgtcgcacatg

SEQ ID NO: 21712 - DNA, 25 bp, S. cerevisiae
cacattataattttgcgcccaggcc

SEQ ID NO: 21713 - DNA, 25 bp, S. cerevisiae
cagatttctttcttggtcacttcct

SEQ ID NO: 21714 - DNA, 25 bp, S. cerevisiae
cacaaatttggctggtctctatcgt

SEQ ID NO: 21715 - DNA, 25 bp, S. cerevisiae
caaagattacggctgttctaccacc

SEQ ID NO: 21716 - DNA, 25 bp, S. cerevisiae
cactattaccggctgttctacaaaa

SEQ ID NO: 21717 - DNA, 25 bp, S. cerevisiae
cacttccaaagtgggtgctggtgca

SEQ ID NO: 21718 - DNA, 25 bp, S. cerevisiae
cagttaaaattacgccatgatccaa

SEQ ID NO: 21719 - DNA, 25 bp, S. cerevisiae
cagttacgcagttgatcgggtctaa

SEQ ID NO: 21720 - DNA, 25 bp, S. cerevisiae
cacaaatccgcttactgcacaaagt

SEQ ID NO: 21721 - DNA, 25 bp, S. cerevisiae
cacccatcgccgtttgaaagagaat

SEQ ID NO: 21722 - DNA, 25 bp, S. cerevisiae
cacccattcgcatcattgaagggat

SEQ ID NO: 21723 - DNA, 25 bp, S. cerevisiae
catccagcttcgtccaataacatta

SEQ ID NO: 21724 - DNA, 25 bp, S. cerevisiae
cacagccctgccacagatatagtta

SEQ ID NO: 21725 - DNA, 25 bp, S. cerevisiae
cagccgccagacacacgatagtatg

SEQ ID NO: 21726 - DNA, 25 bp, S. cerevisiae
caccgctaccacaacagatgatgat

SEQ ID NO: 21727 - DNA, 25 bp, S. cerevisiae
catccagtactcaattcgacagctt

SEQ ID NO: 21728 - DNA, 25 bp, S. cerevisiae
cacattctcaactaccgtcattata

SEQ ID NO: 21729 - DNA, 25 bp, S. cerevisiae
cacttcccagctgatgagtctttaa

SEQ ID NO: 21730 - DNA, 25 bp, S. cerevisiae
cacattcacacccagtttctttaat

SEQ ID NO: 21731 - DNA, 25 bp, S. cerevisiae
caccaaccgccgattattctaataa

SEQ ID NO: 21732 - DNA, 25 bp, S. cerevisiae
cactgccccagttttgtaattcgaa

SEQ ID NO: 21733 - DNA, 25 bp, S. cerevisiae
cacaagagtttccagcaggctacga

SEQ ID NO: 21734 - DNA, 25 bp, S. cerevisiae
cacacggttctcaacatcctataga

SEQ ID NO: 21735 - DNA, 25 bp, S. cerevisiae
cacacacccacacactctcttacat

SEQ ID NO: 21736 - DNA, 25 bp, S. cerevisiae
cacacacccacacactctcttacat

SEQ ID NO: 21737 - DNA, 25 bp, S. cerevisiae
cacgcccatcatcaacttatttatt

SEQ ID NO: 21738 - DNA, 25 bp, S. cerevisiae
cacctttatttttctgcgagggtag

SEQ ID NO: 21739 - DNA, 25 bp, S. cerevisiae
cactctttgactgctactcaaaaga

SEQ ID NO: 21740 - DNA, 25 bp, S. cerevisiae
cactcttcgagccaattcttaattg

SEQ ID NO: 21741 - DNA, 25 bp, S. cerevisiae
cactcatccgaaccagttgtcgaag

SEQ ID NO: 21742 - DNA, 25 bp, S. cerevisiae
cactgatagagttgcccttgttggg

SEQ ID NO: 21743 - DNA, 25 bp, S. cerevisiae
cacatcatcaagttcccatttggca

SEQ ID NO: 21744 - DNA, 25 bp, S. cerevisiae
cagcatcatcaaatccgccgtcgga

SEQ ID NO: 21745 - DNA, 25 bp, S. cerevisiae
cacagataggtcagcagcgtatgca

SEQ ID NO: 21746 - DNA, 25 bp, S. cerevisiae
cactgacttggacgcacttgaacta

SEQ ID NO: 21747 - DNA, 25 bp, S. cerevisiae
catccatcttaacacattcaacttc

SEQ ID NO: 21748 - DNA, 25 bp, S. cerevisiae
caggcttttagcttattcaacttca

SEQ ID NO: 21749 - DNA, 25 bp, S. cerevisiae
cagaggctttatttttcgtctttga

SEQ ID NO: 21750 - DNA, 25 bp, S. cerevisiae
cactatcggtagttctgttggcgtt

SEQ ID NO: 21751 - DNA, 25 bp, S. cerevisiae
catacgttcaaaagaccgttggcta

SEQ ID NO: 21752 - DNA, 25 bp, S. cerevisiae
cactcagttctattatttggtcgat

SEQ ID NO: 21753 - DNA, 25 bp, S. cerevisiae
catcaaagtcatcccattggttttc

SEQ ID NO: 21754 - DNA, 25 bp, S. cerevisiae
catcgtcgtctagcgggttttacaa

SEQ ID NO: 21755 - DNA, 25 bp, S. cerevisiae
cacgatgcttctaccaacggtttaa

SEQ ID NO: 21756 - DNA, 25 bp, S. cerevisiae
cacgctgtcattttagaccaagaga

SEQ ID NO: 21757 - DNA, 25 bp, S. cerevisiae
cagaaacgtctgtcacggcagtgat

SEQ ID NO: 21758 - DNA, 25 bp, S. cerevisiae
cacagtacagtgcaccagatggtgt

SEQ ID NO: 21759 - DNA, 25 bp, S. cerevisiae
cacccactgtgatgacaatggatgt

SEQ ID NO: 21760 - DNA, 25 bp, S. cerevisiae
cacacaccacgattttgaggcagta

SEQ ID NO: 21761 - DNA, 25 bp, S. cerevisiae
cacagatacacgtttgagaccagat

SEQ ID NO: 21762 - DNA, 25 bp, S. cerevisiae
cacacatattcttctctaccaatga

SEQ ID NO: 21763 - DNA, 25 bp, S. cerevisiae
cagcattaagctgcccaaatcgtta

SEQ ID NO: 21764 - DNA, 25 bp, S. cerevisiae
cactattcgtaccagaaaggttatc

SEQ ID NO: 21765 - DNA, 25 bp, S. cerevisiae
cggatccagataccaaaagggctat

SEQ ID NO: 21766 - DNA, 25 bp, S. cerevisiae
caggagatcgaacaactaggcccat

SEQ ID NO: 21767 - DNA, 25 bp, S. cerevisiae
cgggatcgtaaatttctggtctcta

SEQ ID NO: 21768 - DNA, 25 bp, S. cerevisiae
cagggattgtagtagaccttttcaa

SEQ ID NO: 21769 - DNA, 25 bp, S. cerevisiae
caccgtttcctatttcatttcgatg

SEQ ID NO: 21770 - DNA, 25 bp, S. cerevisiae
cacactttttggcatttcttcgtag

SEQ ID NO: 21771 - DNA, 25 bp, S. cerevisiae
cacagtttgtgcctggtttttcgta

SEQ ID NO: 21772 - DNA, 25 bp, S. cerevisiae
cacgtgttggtgaaagggccagtcc

SEQ ID NO: 21773 - DNA, 25 bp, S. cerevisiae
cacctttgttgtagagggcgccaca

SEQ ID NO: 21774 - DNA, 25 bp, S. cerevisiae
cacgtggtgtttacagcggtgtcac

SEQ ID NO: 21775 - DNA, 25 bp, S. cerevisiae
cactatgggtatccttgctggtata

SEQ ID NO: 21776 - DNA, 25 bp, S. cerevisiae
cacgatggaataacctcagagctta

SEQ ID NO: 21777 - DNA, 25 bp, S. cerevisiae
caccttgccatacccagattttaga

SEQ ID NO: 21778 - DNA, 25 bp, S. cerevisiae
cacctgttgaatgccgatccttata

SEQ ID NO: 21779 - DNA, 25 bp, S. cerevisiae
cacaattgattgtcggtcccagtaa

SEQ ID NO: 21780 - DNA, 25 bp, S. cerevisiae
cagacattactgaggataccattaa

SEQ ID NO: 21781 - DNA, 25 bp, S. cerevisiae
cagacgtccacctgtagattccaat

SEQ ID NO: 21782 - DNA, 25 bp, S. cerevisiae
cagagttcccaccagatacttttat

SEQ ID NO: 21783 - DNA, 25 bp, S. cerevisiae
cagctattctccctggtgcaaaata

SEQ ID NO: 21784 - DNA, 25 bp, S. cerevisiae
cagcagtttctcgatcttcaggata

SEQ ID NO: 21785 - DNA, 25 bp, S. cerevisiae
cacaaatcctcgctttcagacaaaa

SEQ ID NO: 21786 - DNA, 25 bp, S. cerevisiae
caaattcttcctattcgaccacaat

SEQ ID NO: 21787 - DNA, 25 bp, S. cerevisiae
caaatacgatgtttctttaccacta

SEQ ID NO: 21788 - DNA, 25 bp, S. cerevisiae
caaattttggttgtcgctcctattc

SEQ ID NO: 21789 - DNA, 25 bp, S. cerevisiae
cacaaatatcttctaatgcctcctc

SEQ ID NO: 21790 - DNA, 25 bp, S. cerevisiae
cagctgtaacctatcaaccattcta

SEQ ID NO: 21791 - DNA, 25 bp, S. cerevisiae
cacttcctatgttgtctatgtttaa

SEQ ID NO: 21792 - DNA, 25 bp, S. cerevisiae
cacttttatgacttgtaattcgcta

SEQ ID NO: 21793 - DNA, 25 bp, S. cerevisiae
caaatttggagctgtattacctgta

SEQ ID NO: 21794 - DNA, 25 bp, S. cerevisiae
cagcgataccgatggctttattaca

SEQ ID NO: 21795 - DNA, 25 bp, S. cerevisiae
cacgcagtcgttatgatgatgatta

SEQ ID NO: 21796 - DNA, 25 bp, S. cerevisiae
cagccagctctgattcctaatatta

SEQ ID NO: 21797 - DNA, 25 bp, S. cerevisiae
cagccactggtggtctggatggact

SEQ ID NO: 21798 - DNA, 25 bp, S. cerevisiae
ctggatccaattaccggtgaacgtg

SEQ ID NO: 21799 - DNA, 25 bp, S. cerevisiae
caggtccaaagttctggttttgcaa

SEQ ID NO: 21800 - DNA, 25 bp, S. cerevisiae
cggcgcaaataggtcgaggtttaat

SEQ ID NO: 21801 - DNA, 25 bp, S. cerevisiae
cagggaaactgctcaagccattaat

SEQ ID NO: 21802 - DNA, 25 bp, S. cerevisiae
ccagccaaactctcctggcgaaatt

SEQ ID NO: 21803 - DNA, 25 bp, S. cerevisiae
ctccaccagttccaacggtgaattt

SEQ ID NO: 21804 - DNA, 25 bp, S. cerevisiae
cccaactggtggtaaggcaaagctt

SEQ ID NO: 21805 - DNA, 25 bp, S. cerevisiae
cacctacttgaagatctacaaggtt

SEQ ID NO: 21806 - DNA, 25 bp, S. cerevisiae
cacctttggcagcatttacgtgaaa

SEQ ID NO: 21807 - DNA, 25 bp, S. cerevisiae
caaattctcatcatgttgctcctga

SEQ ID NO: 21808 - DNA, 25 bp, S. cerevisiae
cagcagacgccattattccaattac

SEQ ID NO: 21809 - DNA, 25 bp, S. cerevisiae
cactaccactctatctccatctgac

SEQ ID NO: 21810 - DNA, 25 bp, S. cerevisiae
cacagcaccactgccggatatagaa

SEQ ID NO: 21811 - DNA, 25 bp, S. cerevisiae
cacaccacatgcgtcactgtataaa

SEQ ID NO: 21812 - DNA, 25 bp, S. cerevisiae
cacagctcacatcctaggactggaa

SEQ ID NO: 21813 - DNA, 25 bp, S. cerevisiae
cgatgctgacgccatagaccatgac

SEQ ID NO: 21814 - DNA, 25 bp, S. cerevisiae
cagcgctacccaaacctagttttgt

SEQ ID NO: 21815 - DNA, 25 bp, S. cerevisiae
gtttaccacgtctcaagttactaat

SEQ ID NO: 21816 - DNA, 25 bp, S. cerevisiae
gttttgccaagtcccgagttcatta

SEQ ID NO: 21817 - DNA, 25 bp, S. cerevisiae
ctcttggtaagtctcggtgtcacta

SEQ ID NO: 21818 - DNA, 25 bp, S. cerevisiae
cacttggtccagttttggtttctat

SEQ ID NO: 21819 - DNA, 25 bp, S. cerevisiae
cacggccgtcatagtcatattttct

SEQ ID NO: 21820 - DNA, 25 bp, S. cerevisiae
cacagcgggccattgatcatatcat

SEQ ID NO: 21821 - DNA, 25 bp, S. cerevisiae
ccccgtgactactcagatggtggaa

SEQ ID NO: 21822 - DNA, 25 bp, S. cerevisiae
cactacgttatctccaatggtgcaa

SEQ ID NO: 21823 - DNA, 25 bp, S. cerevisiae
cactgtccctaatgtatcctatatc

SEQ ID NO: 21824 - DNA, 25 bp, S. cerevisiae
cactacactactcggtcaggctctt

SEQ ID NO: 21825 - DNA, 25 bp, S. cerevisiae
cactccgtatttgccagcttattta

SEQ ID NO: 21826 - DNA, 25 bp, S. cerevisiae
cacccaattgctaacgatcctattt

SEQ ID NO: 21827 - DNA, 25 bp, S. cerevisiae
caccaaatcgtcactgtccaataaa

SEQ ID NO: 21828 - DNA, 25 bp, S. cerevisiae
caccaaaagatgattcgccgcaaga

SEQ ID NO: 21829 - DNA, 25 bp, S. cerevisiae
cacaggcaaacatttccccaagtat

SEQ ID NO: 21830 - DNA, 25 bp, S. cerevisiae
cacggaaagaattgcccatggtatt

SEQ ID NO: 21831 - DNA, 25 bp, S. cerevisiae
cacgttaagaagttggctactagac

SEQ ID NO: 21832 - DNA, 25 bp, S. cerevisiae
cagatgatcggagaacggctaccaa

SEQ ID NO: 21833 - DNA, 25 bp, S. cerevisiae
cacatgtctggattgctagctgcgt

SEQ ID NO: 21834 - DNA, 25 bp, S. cerevisiae
cagcatatgcttctgcgatgggcag

SEQ ID NO: 21835 - DNA, 25 bp, S. cerevisiae
cacgatgccttcctattggagttta

SEQ ID NO: 21836 - DNA, 25 bp, S. cerevisiae
cactcactccctatgtggcgaagaa

SEQ ID NO: 21837 - DNA, 25 bp, S. cerevisiae
cactatgctgtttctgagctggaaa

SEQ ID NO: 21838 - DNA, 25 bp, S. cerevisiae
cacagaatctccaacagcatcgaag

SEQ ID NO: 21839 - DNA, 25 bp, S. cerevisiae
cactggtggcgctttagctgtaaga

SEQ ID NO: 21840 - DNA, 25 bp, S. cerevisiae
cagtttcctagacataatccacggg

SEQ ID NO: 21841 - DNA, 25 bp, S. cerevisiae
cagatttcattgctgcctacatcac

SEQ ID NO: 21842 - DNA, 25 bp, S. cerevisiae
caggttcatcggacagttcaggttc

SEQ ID NO: 21843 - DNA, 25 bp, S. cerevisiae
cagacttgcgggagtccttgttgaa

SEQ ID NO: 21844 - DNA, 25 bp, S. cerevisiae
caccgttgtcgtttccaggtatata

SEQ ID NO: 21845 - DNA, 25 bp, S. cerevisiae
cacaggatctttaactcccgttaag

SEQ ID NO: 21846 - DNA, 25 bp, S. cerevisiae
cataatatttcttcccctcgttaag

SEQ ID NO: 21847 - DNA, 25 bp, S. cerevisiae
cagaaagtacaagcccgcctacaaa

SEQ ID NO: 21848 - DNA, 25 bp, S. cerevisiae
cagaaactagtgtacccgttcgaag

SEQ ID NO: 21849 - DNA, 25 bp, S. cerevisiae
cacttatcagatttttcgtcctcac

SEQ ID NO: 21850 - DNA, 25 bp, S. cerevisiae
cattgattcgttatacctggtcgcg

SEQ ID NO: 21851 - DNA, 25 bp, S. cerevisiae
caggcattacaaactaccggtccgg

SEQ ID NO: 21852 - DNA, 25 bp, S. cerevisiae
cattcataaagcactatccggacgt

SEQ ID NO: 21853 - DNA, 25 bp, S. cerevisiae
cactgattcaacactctccgataat

SEQ ID NO: 21854 - DNA, 25 bp, S. cerevisiae
cactgtcgggtgcttgttgaataca

SEQ ID NO: 21855 - DNA, 25 bp, S. cerevisiae
cactgtctccggtttgttactatcg

SEQ ID NO: 21856 - DNA, 25 bp, S. cerevisiae
cactctaacgctgtactttctagga

SEQ ID NO: 21857 - DNA, 25 bp, S. cerevisiae
cactccagcctacttgttattatca

SEQ ID NO: 21858 - DNA, 25 bp, S. cerevisiae
cactcttccttttttatttgcataa

SEQ ID NO: 21859 - DNA, 25 bp, S. cerevisiae
cactctgccactatctttcaaggaa

SEQ ID NO: 21860 - DNA, 25 bp, S. cerevisiae
cacatcagttttacgattcatcgga

SEQ ID NO: 21861 - DNA, 25 bp, S. cerevisiae
cagacagggtgttccatatctcggt

SEQ ID NO: 21862 - DNA, 25 bp, S. cerevisiae
cagaattgggttgctacttgactcc

SEQ ID NO: 21863 - DNA, 25 bp, S. cerevisiae
cacatcttcaaccttgtacttgcag

SEQ ID NO: 21864 - DNA, 25 bp, S. cerevisiae
cactgctttaccattacctgatgaa

SEQ ID NO: 21865 - DNA, 25 bp, S. cerevisiae
cactcttctcaccagattactatgt

SEQ ID NO: 21866 - DNA, 25 bp, S. cerevisiae
cacatctttatccaattcagcgtta

SEQ ID NO: 21867 - DNA, 25 bp, S. cerevisiae
cactcgattatgctattctggctaa

SEQ ID NO: 21868 - DNA, 25 bp, S. cerevisiae
cacgcgacaatgctagatctgttaa

SEQ ID NO: 21869 - DNA, 25 bp, S. cerevisiae
caccgagagatctgttttggagcaa

SEQ ID NO: 21870 - DNA, 25 bp, S. cerevisiae
cagccagtggttcttcattggacca

SEQ ID NO: 21871 - DNA, 25 bp, S. cerevisiae
cactcaatgtcttcggtttctcaaa

SEQ ID NO: 21872 - DNA, 25 bp, S. cerevisiae
cactctgggctacttctatgagcat

SEQ ID NO: 21873 - DNA, 25 bp, S. cerevisiae
cacttgatgcttccttattgagaga

SEQ ID NO: 21874 - DNA, 25 bp, S. cerevisiae
cacttgcgcttgttatttacatgag

SEQ ID NO: 21875 - DNA, 25 bp, S. cerevisiae
cactgtgccttgtccatggttggat

SEQ ID NO: 21876 - DNA, 25 bp, S. cerevisiae
cacgccgattggtcatattaatcat

SEQ ID NO: 21877 - DNA, 25 bp, S. cerevisiae
caccactactaacgcatttatcaca

SEQ ID NO: 21878 - DNA, 25 bp, S. cerevisiae
cacccaagctactgtttcatctgaa

SEQ ID NO: 21879 - DNA, 25 bp, S. cerevisiae
cacctcggttgttaatggactgcta

SEQ ID NO: 21880 - DNA, 25 bp, S. cerevisiae
cactcgcggtgcatttgcatgttaa

SEQ ID NO: 21881 - DNA, 25 bp, S. cerevisiae
cactgctcgtgtgtggtcgattgat

SEQ ID NO: 21882 - DNA, 25 bp, S. cerevisiae
cacttcccgtaccattgtcagaaat

SEQ ID NO: 21883 - DNA, 25 bp, S. cerevisiae
cactgattttgaactctggccatat

SEQ ID NO: 21884 - DNA, 25 bp, S. cerevisiae
cacctatcagtggttctatcgtata

SEQ ID NO: 21885 - DNA, 25 bp, S. cerevisiae
cacgttgtcgttttcatgcctgaaa

SEQ ID NO: 21886 - DNA, 25 bp, S. cerevisiae
cactggtgatctgttgattgacgaa

SEQ ID NO: 21887 - DNA, 25 bp, S. cerevisiae
cactgtgtgattttgggctttgcaa

SEQ ID NO: 21888 - DNA, 25 bp, S. cerevisiae
cagcgttgatgttgatcgttgcatt

SEQ ID NO: 21889 - DNA, 25 bp, S. cerevisiae
cactttgcaagtctctaccgtttaa

SEQ ID NO: 21890 - DNA, 25 bp, S. cerevisiae
caccagtgaaggttttccagtcatt

SEQ ID NO: 21891 - DNA, 25 bp, S. cerevisiae
caccaggttggtatccatttttcat

SEQ ID NO: 21892 - DNA, 25 bp, S. cerevisiae
cagccggacggtaacacttttgata

SEQ ID NO: 21893 - DNA, 25 bp, S. cerevisiae
cactcgtgtccgttaactatctgaa

SEQ ID NO: 21894 - DNA, 25 bp, S. cerevisiae
caccggttatgctatctactttgac

SEQ ID NO: 21895 - DNA, 25 bp, S. cerevisiae
cacttttatgttcatttggacgcaa

SEQ ID NO: 21896 - DNA, 25 bp, S. cerevisiae
cactgtttatttttgctacgcacca

SEQ ID NO: 21897 - DNA, 25 bp, S. cerevisiae
cactcttttttgatgctcatgcgca

SEQ ID NO: 21898 - DNA, 25 bp, S. cerevisiae
cactgtttttgcttcgaattctttc

SEQ ID NO: 21899 - DNA, 25 bp, S. cerevisiae
cacgttgttgaatgctgactatttt

SEQ ID NO: 21900 - DNA, 25 bp, S. cerevisiae
cacgctctggtgaattggccgattt

SEQ ID NO: 21901 - DNA, 25 bp, S. cerevisiae
cagcctgtggtgtcattggtctaac

SEQ ID NO: 21902 - DNA, 25 bp, S. cerevisiae
cagctgatatgccaacatctacttg

SEQ ID NO: 21903 - DNA, 25 bp, S. cerevisiae
cagctctacgatgcgtactttcact

SEQ ID NO: 21904 - DNA, 25 bp, S. cerevisiae
cagcttatggatctaggtttcccta

SEQ ID NO: 21905 - DNA, 25 bp, S. cerevisiae
cagcatgctcatgacattccttttt

SEQ ID NO: 21906 - DNA, 25 bp, S. cerevisiae
cagcgccatgggatagtgttattca

SEQ ID NO: 21907 - DNA, 25 bp, S. cerevisiae
cagcttgttgtcctacttcgtgtga

SEQ ID NO: 21908 - DNA, 25 bp, S. cerevisiae
cagcgacttgaataccttgttagca

SEQ ID NO: 21909 - DNA, 25 bp, S. cerevisiae
cagaacattcagaccctttttcaac

SEQ ID NO: 21910 - DNA, 25 bp, S. cerevisiae
cagaacttggttgcggtgatgaaac

SEQ ID NO: 21911 - DNA, 25 bp, S. cerevisiae
cagcccagattaccctctattataa

SEQ ID NO: 21912 - DNA, 25 bp, S. cerevisiae
cagcgccaactactctttacaaaaa

SEQ ID NO: 21913 - DNA, 25 bp, S. cerevisiae
tcaagtagactacagttccgagaaa

SEQ ID NO: 21914 - DNA, 25 bp, S. cerevisiae
catagatacgtaccgggctctggaa

SEQ ID NO: 21915 - DNA, 25 bp, S. cerevisiae
catttaaggaggcttggctgaccaa

SEQ ID NO: 21916 - DNA, 25 bp, S. cerevisiae
cactaaagttgttagccttgcgttt

SEQ ID NO: 21917 - DNA, 25 bp, S. cerevisiae
cacgcaaaggcatttcacaagggtt

SEQ ID NO: 21918 - DNA, 25 bp, S. cerevisiae
cacgtcatccttgtttaaagctcta

SEQ ID NO: 21919 - DNA, 25 bp, S. cerevisiae
cacgcttccctcaatcttaaaaata

SEQ ID NO: 21920 - DNA, 25 bp, S. cerevisiae
cagacccttaccagctagaacagag

SEQ ID NO: 21921 - DNA, 25 bp, S. cerevisiae
cagcaccactgaaacgtttaacaat

SEQ ID NO: 21922 - DNA, 25 bp, S. cerevisiae
cagctagcctccttcgaaaagacaa

SEQ ID NO: 21923 - DNA, 25 bp, S. cerevisiae
cagcatagcgctgttcgtagggaca

SEQ ID NO: 21924 - DNA, 25 bp, S. cerevisiae
cagggtagtcaacagcagcggcaac

SEQ ID NO: 21925 - DNA, 25 bp, S. cerevisiae
cactgtccactctttgactgctact

SEQ ID NO: 21926 - DNA, 25 bp, S. cerevisiae
cactgatccatttcgtcgcaaacat

SEQ ID NO: 21927 - DNA, 25 bp, S. cerevisiae
cactgtccatgatggtcccattaac

SEQ ID NO: 21928 - DNA, 25 bp, S. cerevisiae
cagcgggtacctttgggctatttat

SEQ ID NO: 21929 - DNA, 25 bp, S. cerevisiae
cactgctgcagttattttcgttgtt

SEQ ID NO: 21930 - DNA, 25 bp, S. cerevisiae
catcccctaattatcagttattccc

SEQ ID NO: 21931 - DNA, 25 bp, S. cerevisiae
cagcccagctggtaattcgtgtata

SEQ ID NO: 21932 - DNA, 25 bp, S. cerevisiae
cagccaactggaggacgtgcataaa

SEQ ID NO: 21933 - DNA, 25 bp, S. cerevisiae
cactggttactcaatggtgatgaca

SEQ ID NO: 21934 - DNA, 25 bp, S. cerevisiae
cagcatatctattggcacatggtat

SEQ ID NO: 21935 - DNA, 25 bp, S. cerevisiae
cagaaacgtgaagggcccagttaga

SEQ ID NO: 21936 - DNA, 25 bp, S. cerevisiae
cagcaatagggttgagcgcggcact

SEQ ID NO: 21937 - DNA, 25 bp, S. cerevisiae
caggacgctggtgggcacactgcaa

SEQ ID NO: 21938 - DNA, 25 bp, S. cerevisiae
caccctgaactgacgaatatacatt

SEQ ID NO: 21939 - DNA, 25 bp, S. cerevisiae
cagagcactggtcgtcatagtatgc

SEQ ID NO: 21940 - DNA, 25 bp, S. cerevisiae
cagactgtgagctagaatggttcca

SEQ ID NO: 21941 - DNA, 25 bp, S. cerevisiae
cagaatacgcatccaagtgttgaca

SEQ ID NO: 21942 - DNA, 25 bp, S. cerevisiae
cagcgtagctgattcgacattggag

SEQ ID NO: 21943 - DNA, 25 bp, S. cerevisiae
cagctggcattggtcatcgttgtga

SEQ ID NO: 21944 - DNA, 25 bp, S. cerevisiae
cagagaaccctttattgttggcaaa

SEQ ID NO: 21945 - DNA, 25 bp, S. cerevisiae
cagaatttccttccagttatctaag

SEQ ID NO: 21946 - DNA, 25 bp, S. cerevisiae
cactgacgttgccactgggtgataa

SEQ ID NO: 21947 - DNA, 25 bp, S. cerevisiae
cactgactgttttctttgcttactc

SEQ ID NO: 21948 - DNA, 25 bp, S. cerevisiae
cacggacatcttactttctttgaga

SEQ ID NO: 21949 - DNA, 25 bp, S. cerevisiae
cactggacatccttttgggtgtgaa

SEQ ID NO: 21950 - DNA, 25 bp, S. cerevisiae
cagctggacttctgagttggtttca

SEQ ID NO: 21951 - DNA, 25 bp, S. cerevisiae
cagccgttgtcattggtgtggttac

SEQ ID NO: 21952 - DNA, 25 bp, S. cerevisiae
caccgattgtcacgttggagattca

SEQ ID NO: 21953 - DNA, 25 bp, S. cerevisiae
cacccatttgtccacatgcattgag

SEQ ID NO: 21954 - DNA, 25 bp, S. cerevisiae
cacgtttagtggctcatctgatggg

SEQ ID NO: 21955 - DNA, 25 bp, S. cerevisiae
cagtgttttggtcgcacaaggtgtc

SEQ ID NO: 21956 - DNA, 25 bp, S. cerevisiae
caggcttgggttcatcgagtacgtc

SEQ ID NO: 21957 - DNA, 25 bp, S. cerevisiae
cagaacgggtctggagatagccaaa

SEQ ID NO: 21958 - DNA, 25 bp, S. cerevisiae
cagcatcaagggtttggtactctat

SEQ ID NO: 21959 - DNA, 25 bp, S. cerevisiae
caccagggtttatcaatgctcgcat

SEQ ID NO: 21960 - DNA, 25 bp, S. cerevisiae
cagccaaggcttacgactacaacat

SEQ ID NO: 21961 - DNA, 25 bp, S. cerevisiae
cagccagagtttgcagagtttcaat

SEQ ID NO: 21962 - DNA, 25 bp, S. cerevisiae
cagcctcattttgcgtaatcgagaa

SEQ ID NO: 21963 - DNA, 25 bp, S. cerevisiae
cagactcttttctctaatcttgaag

SEQ ID NO: 21964 - DNA, 25 bp, S. cerevisiae
cagcctctttaccacgaatcaataa

SEQ ID NO: 21965 - DNA, 25 bp, S. cerevisiae
cagcccatttaccacgagcgtagaa

SEQ ID NO: 21966 - DNA, 25 bp, S. cerevisiae
cgtcaagcactgattcaactccaat

SEQ ID NO: 21967 - DNA, 25 bp, S. cerevisiae
cagccgatgccgcattgttaatgca

SEQ ID NO: 21968 - DNA, 25 bp, S. cerevisiae
cagtgatccggcagctgtcatgaaa

SEQ ID NO: 21969 - DNA, 25 bp, S. cerevisiae
cagctcgaaatttagcctgccattt

SEQ ID NO: 21970 - DNA, 25 bp, S. cerevisiae
cagtcgatttccaagtcccaatgat

SEQ ID NO: 21971 - DNA, 25 bp, S. cerevisiae
cagatgcaattagcggaccacgtta

SEQ ID NO: 21972 - DNA, 25 bp, S. cerevisiae
cagatcatttctggcgggctacgac

SEQ ID NO: 21973 - DNA, 25 bp, S. cerevisiae
cagatttctctgtcctagttaacga

SEQ ID NO: 21974 - DNA, 25 bp, S. cerevisiae
cagattcctatgatcgtttttgcga

SEQ ID NO: 21975 - DNA, 25 bp, S. cerevisiae
cagtacggcttttcagtccttaatt

SEQ ID NO: 21976 - DNA, 25 bp, S. cerevisiae
cacgttgcggctaccatgaactaat

SEQ ID NO: 21977 - DNA, 25 bp, S. cerevisiae
cagctggtgtcatctcattgtacga

SEQ ID NO: 21978 - DNA, 25 bp, S. cerevisiae
cacgcatattcatccactggtcaga

SEQ ID NO: 21979 - DNA, 25 bp, S. cerevisiae
caccagatcgcgtcttcggataaga

SEQ ID NO: 21980 - DNA, 25 bp, S. cerevisiae
caccgcctctgtttcgaatcaagaa

SEQ ID NO: 21981 - DNA, 25 bp, S. cerevisiae
cacctcttcgctttcaagatctaat

SEQ ID NO: 21982 - DNA, 25 bp, S. cerevisiae
cacgctgttgcggaatattgccata

SEQ ID NO: 21983 - DNA, 25 bp, S. cerevisiae
cacggttgatctggatggctgtatc

SEQ ID NO: 21984 - DNA, 25 bp, S. cerevisiae
cagcagaggcgctggttctcattaa

SEQ ID NO: 21985 - DNA, 25 bp, S. cerevisiae
caccgactctgaatattccttactg

SEQ ID NO: 21986 - DNA, 25 bp, S. cerevisiae
catcctaccagtatacttttcgtta

SEQ ID NO: 21987 - DNA, 25 bp, S. cerevisiae
cagcctcaccagaaacacattgtac

SEQ ID NO: 21988 - DNA, 25 bp, S. cerevisiae
cacctcacgctgaaatctcatctaa

SEQ ID NO: 21989 - DNA, 25 bp, S. cerevisiae
gcaccggaagccctcaatgtaagag

SEQ ID NO: 21990 - DNA, 25 bp, S. cerevisiae
caccaagctcctctcatattaatga

SEQ ID NO: 21991 - DNA, 25 bp, S. cerevisiae
cagcgttttgtgttacctatagcca

SEQ ID NO: 21992 - DNA, 25 bp, S. cerevisiae
cccagtttctcacaacgatgacttg

SEQ ID NO: 21993 - DNA, 25 bp, S. cerevisiae
caccattttcgacgcacttgtgagt

SEQ ID NO: 21994 - DNA, 25 bp, S. cerevisiae
tgacctttgtcgtcgttaggacttt

SEQ ID NO: 21995 - DNA, 25 bp, S. cerevisiae
cagatttttgcatcctttgggacta

SEQ ID NO: 21996 - DNA, 25 bp, S. cerevisiae
cagattcaatctgccgctatcggtg

SEQ ID NO: 21997 - DNA, 25 bp, S. cerevisiae
cagactcattgctgaccatttggtt

SEQ ID NO: 21998 - DNA, 25 bp, S. cerevisiae
cagattttgctccacctgtaggata

SEQ ID NO: 21999 - DNA, 25 bp, S. cerevisiae
caggatcgaatgtcttgctaccaat

SEQ ID NO: 22000 - DNA, 25 bp, S. cerevisiae
cagcgacttagacatgtccctttta

SEQ ID NO: 22001 - DNA, 25 bp, S. cerevisiae
cgctacctggtaagtccttggaaag

SEQ ID NO: 22002 - DNA, 25 bp, S. cerevisiae
cctaccgtaatatcgaaggaagaag

SEQ ID NO: 22003 - DNA, 25 bp, S. cerevisiae
cagagattttacaacccacttcttc

SEQ ID NO: 22004 - DNA, 25 bp, S. cerevisiae
catgagcacgtaaacaacccttacc

SEQ ID NO: 22005 - DNA, 25 bp, S. cerevisiae
cagccactacaagctactgtgcagt

SEQ ID NO: 22006 - DNA, 25 bp, S. cerevisiae
cacgcctatgttgtatctggatgct

SEQ ID NO: 22007 - DNA, 25 bp, S. cerevisiae
catcaacttgttgttcggttcctta

SEQ ID NO: 22008 - DNA, 25 bp, S. cerevisiae
cagcttatgatagtgttaccggcaa

SEQ ID NO: 22009 - DNA, 25 bp, S. cerevisiae
cagcagggctacaatcagcagggat

SEQ ID NO: 22010 - DNA, 25 bp, S. cerevisiae
cagcttactgtgttgacgggaattc

SEQ ID NO: 22011 - DNA, 25 bp, S. cerevisiae
cagcttactaacatggtgcaattgg

SEQ ID NO: 22012 - DNA, 25 bp, S. cerevisiae
tcagttacttgacgcgggaatattg

SEQ ID NO: 22013 - DNA, 25 bp, S. cerevisiae
cagccaaactctcctggcgaaattt

SEQ ID NO: 22014 - DNA, 25 bp, S. cerevisiae
catgccatacaggttagcctcaaat

SEQ ID NO: 22015 - DNA, 25 bp, S. cerevisiae
catctccagtgctctatccaaggac

SEQ ID NO: 22016 - DNA, 25 bp, S. cerevisiae
catgcagccggatcttcaaagtgtc

SEQ ID NO: 22017 - DNA, 25 bp, S. cerevisiae
cagccactggtgctaaacgtgctca

SEQ ID NO: 22018 - DNA, 25 bp, S. cerevisiae
cagtcctttgtaaaagtgtgtccaa

SEQ ID NO: 22019 - DNA, 25 bp, S. cerevisiae
caccgcttatttcctatgcttttga

SEQ ID NO: 22020 - DNA, 25 bp, S. cerevisiae
cacgccggtgttattgtgtttgcaa

SEQ ID NO: 22021 - DNA, 25 bp, S. cerevisiae
caccgccgtgttatattgtttaagc

SEQ ID NO: 22022 - DNA, 25 bp, S. cerevisiae
cagacagagagtttgccacaggtaa

SEQ ID NO: 22023 - DNA, 25 bp, S. cerevisiae
caggaggaatgttctgccggttcac

SEQ ID NO: 22024 - DNA, 25 bp, S. cerevisiae
cagggctacaattgcttcaggtggt

SEQ ID NO: 22025 - DNA, 25 bp, S. cerevisiae
cagaggatactataatgagttgagt

SEQ ID NO: 22026 - DNA, 25 bp, S. cerevisiae
cagggatacattgagccgttccaaa

SEQ ID NO: 22027 - DNA, 25 bp, S. cerevisiae
cagcggtaaaccatttgcattcaaa

SEQ ID NO: 22028 - DNA, 25 bp, S. cerevisiae
cagcagctgatgtttcgaattctac

SEQ ID NO: 22029 - DNA, 25 bp, S. cerevisiae
cagcatgcaatacagtgacatatat

SEQ ID NO: 22030 - DNA, 25 bp, S. cerevisiae
cagcagcaacatcacacgcagaatt

SEQ ID NO: 22031 - DNA, 25 bp, S. cerevisiae
caggcaccaatacccaagttctaag

SEQ ID NO: 22032 - DNA, 25 bp, S. cerevisiae
caggacattacagccaaaatccaag

SEQ ID NO: 22033 - DNA, 25 bp, S. cerevisiae
caggactccgcctgcaagaaggcaa

SEQ ID NO: 22034 - DNA, 25 bp, S. cerevisiae
caggatcgcccgtgctatagaggag

SEQ ID NO: 22035 - DNA, 25 bp, S. cerevisiae
cagattgtggctgtcttcattttag

SEQ ID NO: 22036 - DNA, 25 bp, S. cerevisiae
caggtcgccgcgtttgttaacaatt

SEQ ID NO: 22037 - DNA, 25 bp, S. cerevisiae
cagacctcaggtttttagcaccatc

SEQ ID NO: 22038 - DNA, 25 bp, S. cerevisiae
cagaactcagttgtttggctcagga

SEQ ID NO: 22039 - DNA, 25 bp, S. cerevisiae
cagaaatctttgttttcctcctaag

SEQ ID NO: 22040 - DNA, 25 bp, S. cerevisiae
cagcttgaaagctctattcgccttg

SEQ ID NO: 22041 - DNA, 25 bp, S. cerevisiae
cagattaaagccagctatctccaag

SEQ ID NO: 22042 - DNA, 25 bp, S. cerevisiae
cagattaaagccagccatctccagt

SEQ ID NO: 22043 - DNA, 25 bp, S. cerevisiae
cagattaaagccagccatctccagt

SEQ ID NO: 22044 - DNA, 25 bp, S. cerevisiae
cagattaaagccagccatctccagt

SEQ ID NO: 22045 - DNA, 25 bp, S. cerevisiae
cagtctcaggagtgcgatatggtat

SEQ ID NO: 22046 - DNA, 25 bp, S. cerevisiae
cagggcagtggctggatacagtata

SEQ ID NO: 22047 - DNA, 25 bp, S. cerevisiae
caggtatgtggttgcttctcaggac

SEQ ID NO: 22048 - DNA, 25 bp, S. cerevisiae
caggcaaggtatccgttggtgactt

SEQ ID NO: 22049 - DNA, 25 bp, S. cerevisiae
cgagcaaggtgactccgacgaactt

SEQ ID NO: 22050 - DNA, 25 bp, S. cerevisiae
gctgaaatggtctccgggaagcctt

SEQ ID NO: 22051 - DNA, 25 bp, S. cerevisiae
caggatatgggcaccgggataccgt

SEQ ID NO: 22052 - DNA, 25 bp, S. cerevisiae
gagtatatgggtcccgggaaccatt

SEQ ID NO: 22053 - DNA, 25 bp, S. cerevisiae
cagtcgaaactaccggaatacctct

SEQ ID NO: 22054 - DNA, 25 bp, S. cerevisiae
cgccaaaccggaccatttagattct

SEQ ID NO: 22055 - DNA, 25 bp, S. cerevisiae
cagccaaccctaagtattctaactc

SEQ ID NO: 22056 - DNA, 25 bp, S. cerevisiae
cacctattccgcctttatattggtt

SEQ ID NO: 22057 - DNA, 25 bp, S. cerevisiae
cacctttaccatctcatttggcgat

SEQ ID NO: 22058 - DNA, 25 bp, S. cerevisiae
cagccgttggaagactttgagcgat

SEQ ID NO: 22059 - DNA, 25 bp, S. cerevisiae
cagccagctgggtacaattttatct

SEQ ID NO: 22060 - DNA, 25 bp, S. cerevisiae
cagtatgcctccttcaattttatca

SEQ ID NO: 22061 - DNA, 25 bp, S. cerevisiae
cagcgtagtcttgtggcatttgcca

SEQ ID NO: 22062 - DNA, 25 bp, S. cerevisiae
cagaaatcttcgaaggctctctaga

SEQ ID NO: 22063 - DNA, 25 bp, S. cerevisiae
cagatggctcatggaagggtcgtac

SEQ ID NO: 22064 - DNA, 25 bp, S. cerevisiae
cagaggccattgaagtcgctcggaa

SEQ ID NO: 22065 - DNA, 25 bp, S. cerevisiae
cagaggaatagcaatgtatcccatc

SEQ ID NO: 22066 - DNA, 25 bp, S. cerevisiae
cagcaccaatggttcatcatttcat

SEQ ID NO: 22067 - DNA, 25 bp, S. cerevisiae
cagaccatctggttctggtgctaat

SEQ ID NO: 22068 - DNA, 25 bp, S. cerevisiae
catctttctacttacttgaaggtct

SEQ ID NO: 22069 - DNA, 25 bp, S. cerevisiae
ctacaagaagggtgctgcctccaac

SEQ ID NO: 22070 - DNA, 25 bp, S. cerevisiae
ctacgggtcgagtttgcaatggcat

SEQ ID NO: 22071 - DNA, 25 bp, S. cerevisiae
cagccggaacaggtgatttgccaat

SEQ ID NO: 22072 - DNA, 25 bp, S. cerevisiae
cagccgatgacctggatcagttcat

SEQ ID NO: 22073 - DNA, 25 bp, S. cerevisiae
cagaggctgacctaccagagggcta

SEQ ID NO: 22074 - DNA, 25 bp, S. cerevisiae
cagagccttatgtaccggcgaaaag

SEQ ID NO: 22075 - DNA, 25 bp, S. cerevisiae
cagcgtatttttccactgctgaata

SEQ ID NO: 22076 - DNA, 25 bp, S. cerevisiae
cagctaccataatactggcgcttat

SEQ ID NO: 22077 - DNA, 25 bp, S. cerevisiae
catctacaacaataagtgcccctca

SEQ ID NO: 22078 - DNA, 25 bp, S. cerevisiae
catcccaatatatttcgggccattt

SEQ ID NO: 22079 - DNA, 25 bp, S. cerevisiae
cagtataaacaacacctcctcagga

SEQ ID NO: 22080 - DNA, 25 bp, S. cerevisiae
cagccttttatacctcgcttcttaa

SEQ ID NO: 22081 - DNA, 25 bp, S. cerevisiae
caccatttgatgttcctgttcatga

SEQ ID NO: 22082 - DNA, 25 bp, S. cerevisiae
cagccaatatagctccctttgaatt

SEQ ID NO: 22083 - DNA, 25 bp, S. cerevisiae
caccattaacttgcacaaaagattg

SEQ ID NO: 22084 - DNA, 25 bp, S. cerevisiae
cagactgataatgaaccgagacgat

SEQ ID NO: 22085 - DNA, 25 bp, S. cerevisiae
cagattgctggagtattccgtcgat

SEQ ID NO: 22086 - DNA, 25 bp, S. cerevisiae
cagcattatagtggtttcgcagcaa

SEQ ID NO: 22087 - DNA, 25 bp, S. cerevisiae
cagctggacctcgtattcggaattt

SEQ ID NO: 22088 - DNA, 25 bp, S. cerevisiae
cagcatgccgaacctgttggatgaa

SEQ ID NO: 22089 - DNA, 25 bp, S. cerevisiae
cagatacgccatacgctgatggtgt

SEQ ID NO: 22090 - DNA, 25 bp, S. cerevisiae
caggacctcatgaccgatggtacgt

SEQ ID NO: 22091 - DNA, 25 bp, S. cerevisiae
cagcgcttccttcagatggtacaat

SEQ ID NO: 22092 - DNA, 25 bp, S. cerevisiae
cagccttccctgaagatcttatctt

SEQ ID NO: 22093 - DNA, 25 bp, S. cerevisiae
caggagcttcctgaaccaaactttt

SEQ ID NO: 22094 - DNA, 25 bp, S. cerevisiae
cagggaatcctgcacacgaaaatgt

SEQ ID NO: 22095 - DNA, 25 bp, S. cerevisiae
caggcgctaccgcagcaattagata

SEQ ID NO: 22096 - DNA, 25 bp, S. cerevisiae
cagcggttctgcctacaatcaagat

SEQ ID NO: 22097 - DNA, 25 bp, S. cerevisiae
cagtgacatatttgccgatcctaat

SEQ ID NO: 22098 - DNA, 25 bp, S. cerevisiae
cagtttccgtcaatggcgaaccaaa

SEQ ID NO: 22099 - DNA, 25 bp, S. cerevisiae
cagctttccgtgtccaagttggtga

SEQ ID NO: 22100 - DNA, 25 bp, S. cerevisiae
cagctcttctccacaaaaggtcgaa

SEQ ID NO: 22101 - DNA, 25 bp, S. cerevisiae
cagcgcttgttacgcaaatttgacg

SEQ ID NO: 22102 - DNA, 25 bp, S. cerevisiae
cagcgcttttgaaaaatgccctaga

SEQ ID NO: 22103 - DNA, 25 bp, S. cerevisiae
cagcaaatgttggtgattctcgaat

SEQ ID NO: 22104 - DNA, 25 bp, S. cerevisiae
cagaagatgtggatgatgcgtcgac

SEQ ID NO: 22105 - DNA, 25 bp, S. cerevisiae
cagctaatggacatgtcgtctcctc

SEQ ID NO: 22106 - DNA, 25 bp, S. cerevisiae
cagacgtgaacttcatgccatggtt

SEQ ID NO: 22107 - DNA, 25 bp, S. cerevisiae
cagtacgctccctttctattaggaa

SEQ ID NO: 22108 - DNA, 25 bp, S. cerevisiae
caggaggcccagttatctttcaaaa

SEQ ID NO: 22109 - DNA, 25 bp, S. cerevisiae
cagctcgccccgttatcttttttca

SEQ ID NO: 22110 - DNA, 25 bp, S. cerevisiae
cagctcgcccccttttttactattg

SEQ ID NO: 22111 - DNA, 25 bp, S. cerevisiae
cagctcgccccttttatttttgatt

SEQ ID NO: 22112 - DNA, 25 bp, S. cerevisiae
cagcgtgcccatttctttattttat

SEQ ID NO: 22113 - DNA, 25 bp, S. cerevisiae
cagtgccgtggtattagctcgttgt

SEQ ID NO: 22114 - DNA, 25 bp, S. cerevisiae
caggactgttgctgtttgcacgggt

SEQ ID NO: 22115 - DNA, 25 bp, S. cerevisiae
caggacttaaggaaatgtgcggaat

SEQ ID NO: 22116 - DNA, 25 bp, S. cerevisiae
cttacttgcaagctggcggtggtat

SEQ ID NO: 22117 - DNA, 25 bp, S. cerevisiae
ctcattttcgacaggcagtttccag

SEQ ID NO: 22118 - DNA, 25 bp, S. cerevisiae
cagctttagctggaggcgttttgcc

SEQ ID NO: 22119 - DNA, 25 bp, S. cerevisiae
cagctgctgtcaatgcgggtgtgat

SEQ ID NO: 22120 - DNA, 25 bp, S. cerevisiae
cagccgtcatcttggtttccgaaaa

SEQ ID NO: 22121 - DNA, 25 bp, S. cerevisiae
cagccgttcatcagtgttccagaaa

SEQ ID NO: 22122 - DNA, 25 bp, S. cerevisiae
cagacagtgcttttggattcccatt

SEQ ID NO: 22123 - DNA, 25 bp, S. cerevisiae
cagtcggtatcattggttacgccat

SEQ ID NO: 22124 - DNA, 25 bp, S. cerevisiae
cagttggtcgattgtattgccttct

SEQ ID NO: 22125 - DNA, 25 bp, S. cerevisiae
cagcttgagttatcttttgatcgac

SEQ ID NO: 22126 - DNA, 25 bp, S. cerevisiae
caggcggcgaggctttaacttcttt

SEQ ID NO: 22127 - DNA, 25 bp, S. cerevisiae
cagaccgccatggagtgtttacatt

SEQ ID NO: 22128 - DNA, 25 bp, S. cerevisiae
cagcagcccctgcaggagttaatag

SEQ ID NO: 22129 - DNA, 25 bp, S. cerevisiae
cagcgcatctactgaacctgatcaa

SEQ ID NO: 22130 - DNA, 25 bp, S. cerevisiae
cagctccagccgatattatgcagta

SEQ ID NO: 22131 - DNA, 25 bp, S. cerevisiae
cagctccagctccaattactaatgg

SEQ ID NO: 22132 - DNA, 25 bp, S. cerevisiae
catcgacggtttttcattacttttg

SEQ ID NO: 22133 - DNA, 25 bp, S. cerevisiae
cagcgaaggtttattgtgctctttt

SEQ ID NO: 22134 - DNA, 25 bp, S. cerevisiae
cagtgaaggtatttccggctgcttt

SEQ ID NO: 22135 - DNA, 25 bp, S. cerevisiae
cagcgtctctatttccggaacgaaa

SEQ ID NO: 22136 - DNA, 25 bp, S. cerevisiae
caggatcttaaaccctgccaagaaa

SEQ ID NO: 22137 - DNA, 25 bp, S. cerevisiae
cagctcaattttacatggcgacgat

SEQ ID NO: 22138 - DNA, 25 bp, S. cerevisiae
cagacaatatctgccttgccaaaga

SEQ ID NO: 22139 - DNA, 25 bp, S. cerevisiae
cagattgttgcgttttggtctacga

SEQ ID NO: 22140 - DNA, 25 bp, S. cerevisiae
cagctttctagctttggaatctgga

SEQ ID NO: 22141 - DNA, 25 bp, S. cerevisiae
cagctctggatcttttggacttgga

SEQ ID NO: 22142 - DNA, 25 bp, S. cerevisiae
cagctatcgaatctgttgatcccgc

SEQ ID NO: 22143 - DNA, 25 bp, S. cerevisiae
cagcgagagcaacttcttggtcgtc

SEQ ID NO: 22144 - DNA, 25 bp, S. cerevisiae
cagtgctgagcatgggatcggtttc

SEQ ID NO: 22145 - DNA, 25 bp, S. cerevisiae
cagtcgaaagtgtcttggctcattt

SEQ ID NO: 22146 - DNA, 25 bp, S. cerevisiae
catccgcaagtccaatttctggtgg

SEQ ID NO: 22147 - DNA, 25 bp, S. cerevisiae
cagcggcgacaacttttcataactt

SEQ ID NO: 22148 - DNA, 25 bp, S. cerevisiae
caggtgctgttattggtcatgccat

SEQ ID NO: 22149 - DNA, 25 bp, S. cerevisiae
cagtgggtcctattggtactcgcat

SEQ ID NO: 22150 - DNA, 25 bp, S. cerevisiae
cagcgtgttctcaagtcgtttcaat

SEQ ID NO: 22151 - DNA, 25 bp, S. cerevisiae
cagcattctgctgcgtgtagtagat

SEQ ID NO: 22152 - DNA, 25 bp, S. cerevisiae
cagcgtggtgctacagtatttgtta

SEQ ID NO: 22153 - DNA, 25 bp, S. cerevisiae
cagtcaagtgacaatttgtttattc

SEQ ID NO: 22154 - DNA, 25 bp, S. cerevisiae
cagcaatctcggttttgtcgcagaa

SEQ ID NO: 22155 - DNA, 25 bp, S. cerevisiae
caggccagatgacggtgtttattaa

SEQ ID NO: 22156 - DNA, 25 bp, S. cerevisiae
cagaggctccaaaacaatccgttga

SEQ ID NO: 22157 - DNA, 25 bp, S. cerevisiae
cagaacctattatcgctcacgttga

SEQ ID NO: 22158 - DNA, 25 bp, S. cerevisiae
cagaactattttcgccttcaggtga

SEQ ID NO: 22159 - DNA, 25 bp, S. cerevisiae
cagaaacattttggccatcaacggc

SEQ ID NO: 22160 - DNA, 25 bp, S. cerevisiae
cagaaagctttgtcgatatcggtca

SEQ ID NO: 22161 - DNA, 25 bp, S. cerevisiae
cagatgaacctagcgctgtcgtgaa

SEQ ID NO: 22162 - DNA, 25 bp, S. cerevisiae
cagataacagatgacgtcggcgaat

SEQ ID NO: 22163 - DNA, 25 bp, S. cerevisiae
cagtatactgtgaacgttgcccaaa

SEQ ID NO: 22164 - DNA, 25 bp, S. cerevisiae
cagagaatcttgtatcgttgcgcta

SEQ ID NO: 22165 - DNA, 25 bp, S. cerevisiae
cagaattttactttatgcctcaggt

SEQ ID NO: 22166 - DNA, 25 bp, S. cerevisiae
cggataatttggacagctctactgc

SEQ ID NO: 22167 - DNA, 25 bp, S. cerevisiae
cagcatgctgcagtgttttattcaa

SEQ ID NO: 22168 - DNA, 25 bp, S. cerevisiae
cagcaaccactacattatctcaatc

SEQ ID NO: 22169 - DNA, 25 bp, S. cerevisiae
cataaagcccacgattatccacatt

SEQ ID NO: 22170 - DNA, 25 bp, S. cerevisiae
catataaaacccttccaacatattt

SEQ ID NO: 22171 - DNA, 25 bp, S. cerevisiae
catacccagagcagacccaagaaag

SEQ ID NO: 22172 - DNA, 25 bp, S. cerevisiae
ctagcctaactacgtccacaaatga

SEQ ID NO: 22173 - DNA, 25 bp, S. cerevisiae
cagggtccgataaaagatgctaaac

SEQ ID NO: 22174 - DNA, 25 bp, S. cerevisiae
cagggcacactatcgaaaggcaata

SEQ ID NO: 22175 - DNA, 25 bp, S. cerevisiae
catgggcacgcagattcaatcggaa

SEQ ID NO: 22176 - DNA, 25 bp, S. cerevisiae
catgggtccagctttcagattgtac

SEQ ID NO: 22177 - DNA, 25 bp, S. cerevisiae
caggtacctgacgtagatgcatttc

SEQ ID NO: 22178 - DNA, 25 bp, S. cerevisiae
cagggcatatgcttcgtcaacaatt

SEQ ID NO: 22179 - DNA, 25 bp, S. cerevisiae
caggcagcctctacggacgaatata

SEQ ID NO: 22180 - DNA, 25 bp, S. cerevisiae
caggcggctacaagactctcaaaat

SEQ ID NO: 22181 - DNA, 25 bp, S. cerevisiae
caggctggtcgtagaaccattgcaa

SEQ ID NO: 22182 - DNA, 25 bp, S. cerevisiae
cagttcgtcgcgaggctcattaaat

SEQ ID NO: 22183 - DNA, 25 bp, S. cerevisiae
caggtttccgggtttacgcattgag

SEQ ID NO: 22184 - DNA, 25 bp, S. cerevisiae
caggtgtttccgttagagacgttgc

SEQ ID NO: 22185 - DNA, 25 bp, S. cerevisiae
caggcgactcggttaggttatttct

SEQ ID NO: 22186 - DNA, 25 bp, S. cerevisiae
caggtcctctggtaacggtaagtca

SEQ ID NO: 22187 - DNA, 25 bp, S. cerevisiae
cagagactctctattccctaaagta

SEQ ID NO: 22188 - DNA, 25 bp, S. cerevisiae
cagcaccttctgattccgataataa

SEQ ID NO: 22189 - DNA, 25 bp, S. cerevisiae
cagtgctttagcatctggcgacaag

SEQ ID NO: 22190 - DNA, 25 bp, S. cerevisiae
cagatgttttgcacgctgctatagg

SEQ ID NO: 22191 - DNA, 25 bp, S. cerevisiae
cagtaaggcgttcaagcagcaggtt

SEQ ID NO: 22192 - DNA, 25 bp, S. cerevisiae
ctgctactttatccccagcaatgga

SEQ ID NO: 22193 - DNA, 25 bp, S. cerevisiae
catggacatgttggccccacaatta

SEQ ID NO: 22194 - DNA, 25 bp, S. cerevisiae
cagtgcccttgactctcaaagtgaa

SEQ ID NO: 22195 - DNA, 25 bp, S. cerevisiae
cagagtgccggtatcgtgtgtacgt

SEQ ID NO: 22196 - DNA, 25 bp, S. cerevisiae
cagcatgctgtcgtttgtttttgat

SEQ ID NO: 22197 - DNA, 25 bp, S. cerevisiae
cagatttgagacctgaatttgcaga

SEQ ID NO: 22198 - DNA, 25 bp, S. cerevisiae
cagtttggtcttggtctggcatttt

SEQ ID NO: 22199 - DNA, 25 bp, S. cerevisiae
cattttcgttttctactttggtgct

SEQ ID NO: 22200 - DNA, 25 bp, S. cerevisiae
cggtacctcaaaagttcctcagatc

SEQ ID NO: 22201 - DNA, 25 bp, S. cerevisiae
cagaggttgcctataagcccagaag

SEQ ID NO: 22202 - DNA, 25 bp, S. cerevisiae
cagtaacttctggtggcttgtttac

SEQ ID NO: 22203 - DNA, 25 bp, S. cerevisiae
cagaaagttcttcggtttgtccaag

SEQ ID NO: 22204 - DNA, 25 bp, S. cerevisiae
cagacatgcgttcaggattactcca

SEQ ID NO: 22205 - DNA, 25 bp, S. cerevisiae
cagcaatggctttggcgcgcaatga

SEQ ID NO: 22206 - DNA, 25 bp, S. cerevisiae
cagagctatctcaattgggcaatac

SEQ ID NO: 22207 - DNA, 25 bp, S. cerevisiae
cagagctaatcttcggcgcaacaaa

SEQ ID NO: 22208 - DNA, 25 bp, S. cerevisiae
cagagtcctttactgcataacgaag

SEQ ID NO: 22209 - DNA, 25 bp, S. cerevisiae
cagagccctgttactgaggacttat

SEQ ID NO: 22210 - DNA, 25 bp, S. cerevisiae
cagcacgtcgttataacttcttcac

SEQ ID NO: 22211 - DNA, 25 bp, S. cerevisiae
cagcactatcgccatattcatactt

SEQ ID NO: 22212 - DNA, 25 bp, S. cerevisiae
catcccacaggatcctactttattt

SEQ ID NO: 22213 - DNA, 25 bp, S. cerevisiae
caggcacattaatcagtggccatta

SEQ ID NO: 22214 - DNA, 25 bp, S. cerevisiae
cagtgacctacggtggcagtgcatt

SEQ ID NO: 22215 - DNA, 25 bp, S. cerevisiae
cagaatctcctcttcaacaacatga

SEQ ID NO: 22216 - DNA, 25 bp, S. cerevisiae
cagtgacaactcttcaaccacggaa

SEQ ID NO: 22217 - DNA, 25 bp, S. cerevisiae
caggagcaactttcaagggaagcat

SEQ ID NO: 22218 - DNA, 25 bp, S. cerevisiae
caggagtctctgagcaaggccgaat

SEQ ID NO: 22219 - DNA, 25 bp, S. cerevisiae
cagattgatctctttgggtttgaac

SEQ ID NO: 22220 - DNA, 25 bp, S. cerevisiae
cagaggaccgtttgccatttacagc

SEQ ID NO: 22221 - DNA, 25 bp, S. cerevisiae
cagaggagtcgtatgctgcttctaa

SEQ ID NO: 22222 - DNA, 25 bp, S. cerevisiae
cagagaggcattgccgtcattccaa

SEQ ID NO: 22223 - DNA, 25 bp, S. cerevisiae
cagtcagatgtttctcatgcggtaa

SEQ ID NO: 22224 - DNA, 25 bp, S. cerevisiae
catgacttagccgttcgtatggaac

SEQ ID NO: 22225 - DNA, 25 bp, S. cerevisiae
cagaatgtcacatcatatgctcata

SEQ ID NO: 22226 - DNA, 25 bp, S. cerevisiae
cagtatccgctattatcatcattcc

SEQ ID NO: 22227 - DNA, 25 bp, S. cerevisiae
cagtctctctgcattgatctagtca

SEQ ID NO: 22228 - DNA, 25 bp, S. cerevisiae
cagtgcaaagtgtaatatcgcccaa

SEQ ID NO: 22229 - DNA, 25 bp, S. cerevisiae
catggcaagggctgtgatcgtaaca

SEQ ID NO: 22230 - DNA, 25 bp, S. cerevisiae
caggaagcggtgttcatgtgatcaa

SEQ ID NO: 22231 - DNA, 25 bp, S. cerevisiae
cagaggattgatcgcgatactcatc

SEQ ID NO: 22232 - DNA, 25 bp, S. cerevisiae
catgggcttgacagagagtatcgct

SEQ ID NO: 22233 - DNA, 25 bp, S. cerevisiae
cagggcttgtcagtatatggactca

SEQ ID NO: 22234 - DNA, 25 bp, S. cerevisiae
cagggcttgcactttaacttttgaa

SEQ ID NO: 22235 - DNA, 25 bp, S. cerevisiae
cagatgctgttgtcgcagttggttt

SEQ ID NO: 22236 - DNA, 25 bp, S. cerevisiae
cagatcttgctgaaagtgacgtatt

SEQ ID NO: 22237 - DNA, 25 bp, S. cerevisiae
cagagtagcgattgaggcggttaat

SEQ ID NO: 22238 - DNA, 25 bp, S. cerevisiae
cagagcttcctgactcattgaaaaa

SEQ ID NO: 22239 - DNA, 25 bp, S. cerevisiae
cagactaacttgtttgcagctttaa

SEQ ID NO: 22240 - DNA, 25 bp, S. cerevisiae
cagactaactggttggaatgcaatc

SEQ ID NO: 22241 - DNA, 25 bp, S. cerevisiae
cagagccaagcttttcagattcgat

SEQ ID NO: 22242 - DNA, 25 bp, S. cerevisiae
cagaccaatctctccatatactata

SEQ ID NO: 22243 - DNA, 25 bp, S. cerevisiae
catggccgctctgtcaaatttgaat

SEQ ID NO: 22244 - DNA, 25 bp, S. cerevisiae
caggcggttgcccaaatttcagatt

SEQ ID NO: 22245 - DNA, 25 bp, S. cerevisiae
caggaagattggtactactctcata

SEQ ID NO: 22246 - DNA, 25 bp, S. cerevisiae
cagggtttcaccatacacgtatttc

SEQ ID NO: 22247 - DNA, 25 bp, S. cerevisiae
cagggtttcgccatacacatatttt

SEQ ID NO: 22248 - DNA, 25 bp, S. cerevisiae
cagatggtggcttgccttactgtat

SEQ ID NO: 22249 - DNA, 25 bp, S. cerevisiae
cagaggttctgtcattactgttgaa

SEQ ID NO: 22250 - DNA, 25 bp, S. cerevisiae
caggttccttgggtttgttgccatc

SEQ ID NO: 22251 - DNA, 25 bp, S. cerevisiae
cagagattcgttgtttgggtattca

SEQ ID NO: 22252 - DNA, 25 bp, S. cerevisiae
ctttcatttctagagacggtggtct

SEQ ID NO: 22253 - DNA, 25 bp, S. cerevisiae
catcgtttttaccagaagcgtttct

SEQ ID NO: 22254 - DNA, 25 bp, S. cerevisiae
ctcgcttttattcagatggtcctct

SEQ ID NO: 22255 - DNA, 25 bp, S. cerevisiae
cagttgttatttctgtcgaccctaa

SEQ ID NO: 22256 - DNA, 25 bp, S. cerevisiae
caggcgattgccgacattgttcagt

SEQ ID NO: 22257 - DNA, 25 bp, S. cerevisiae
cagtggtgagcccttggtacagtac

SEQ ID NO: 22258 - DNA, 25 bp, S. cerevisiae
cagggtctgccgtatgtggccgtaa

SEQ ID NO: 22259 - DNA, 25 bp, S. cerevisiae
catcgaccgcggtattgacctttta

SEQ ID NO: 22260 - DNA, 25 bp, S. cerevisiae
cataactcgtcacaatactgctggt

SEQ ID NO: 22261 - DNA, 25 bp, S. cerevisiae
cagtacattgtagacgaggcagtga

SEQ ID NO: 22262 - DNA, 25 bp, S. cerevisiae
catgaacactttgagctacgctatt

SEQ ID NO: 22263 - DNA, 25 bp, S. cerevisiae
cagaaatcttttcctacgttgaccg

SEQ ID NO: 22264 - DNA, 25 bp, S. cerevisiae
cttgaaaaccccttttgcgcgcctg

SEQ ID NO: 22265 - DNA, 25 bp, S. cerevisiae
ggtacgactttctttgttgtgggag

SEQ ID NO: 22266 - DNA, 25 bp, S. cerevisiae
cgaatagtatcctgtccgtgcgaga

SEQ ID NO: 22267 - DNA, 25 bp, S. cerevisiae
gcttgaagttaatcccgggccaaat

SEQ ID NO: 22268 - DNA, 25 bp, S. cerevisiae
ctcggaagttgatcccggtcgttat

SEQ ID NO: 22269 - DNA, 25 bp, S. cerevisiae
cagacggagtgttccctaagtcgtt

SEQ ID NO: 22270 - DNA, 25 bp, S. cerevisiae
cagatcattggctcatcacgaaaat

SEQ ID NO: 22271 - DNA, 25 bp, S. cerevisiae
cagtctctcagccaagctcaagaaa

SEQ ID NO: 22272 - DNA, 25 bp, S. cerevisiae
cagttctccgattggcagatgcaga

SEQ ID NO: 22273 - DNA, 25 bp, S. cerevisiae
cagttctgcacaccacgaaggaagt

SEQ ID NO: 22274 - DNA, 25 bp, S. cerevisiae
catcctcaacaaacgaccatcaatt

SEQ ID NO: 22275 - DNA, 25 bp, S. cerevisiae
catcctcaagaattccatccggtta

SEQ ID NO: 22276 - DNA, 25 bp, S. cerevisiae
ctggcaaaggactacctgcggtgca

SEQ ID NO: 22277 - DNA, 25 bp, S. cerevisiae
cttcaaattgatcacgccggtacca

SEQ ID NO: 22278 - DNA, 25 bp, S. cerevisiae
cttagaatctctgacactcggtatg

SEQ ID NO: 22279 - DNA, 25 bp, S. cerevisiae
cagtttcacgttgcattccaccaat

SEQ ID NO: 22280 - DNA, 25 bp, S. cerevisiae
caggtgctattgatttctactacgg

SEQ ID NO: 22281 - DNA, 25 bp, S. cerevisiae
caggtagatttcgtttgcgtttccg

SEQ ID NO: 22282 - DNA, 25 bp, S. cerevisiae
cagagcgatattgcctttccttata

SEQ ID NO: 22283 - DNA, 25 bp, S. cerevisiae
cagtgctctggctacaaaggttttc

SEQ ID NO: 22284 - DNA, 25 bp, S. cerevisiae
caggctctgcaaaaaagggtgctac

SEQ ID NO: 22285 - DNA, 25 bp, S. cerevisiae
cagattctcaaacaagcacggcaga

SEQ ID NO: 22286 - DNA, 25 bp, S. cerevisiae
cagtttccatgagacaggccgcaaa

SEQ ID NO: 22287 - DNA, 25 bp, S. cerevisiae
ctgccagaagaaccggtttactacg

SEQ ID NO: 22288 - DNA, 25 bp, S. cerevisiae
catcctgacaaaggtggttctccat

SEQ ID NO: 22289 - DNA, 25 bp, S. cerevisiae
catgttgaggaacgtatgggctcca

SEQ ID NO: 22290 - DNA, 25 bp, S. cerevisiae
cagtcaatggcgattatggcgttac

SEQ ID NO: 22291 - DNA, 25 bp, S. cerevisiae
caggcctgggagaattgatcgtaaa

SEQ ID NO: 22292 - DNA, 25 bp, S. cerevisiae
caggacggtccttcttcgaaaggtg

SEQ ID NO: 22293 - DNA, 25 bp, S. cerevisiae
caggacggtccttcttcgaaaggtg

SEQ ID NO: 22294 - DNA, 25 bp, S. cerevisiae
caggagggtcctttcttgataatta

SEQ ID NO: 22295 - DNA, 25 bp, S. cerevisiae
cagggaattctccttcaataacata

SEQ ID NO: 22296 - DNA, 25 bp, S. cerevisiae
gcggtacaccagctcctaaaaagaa

SEQ ID NO: 22297 - DNA, 25 bp, S. cerevisiae
cagagttcatcagtgctgtcgctaa

SEQ ID NO: 22298 - DNA, 25 bp, S. cerevisiae
caggtttcaaggaagccgccgctaa

SEQ ID NO: 22299 - DNA, 25 bp, S. cerevisiae
cagtattttgatagtttgcctttga

SEQ ID NO: 22300 - DNA, 25 bp, S. cerevisiae
cagtttctcataacccgtcatttga

SEQ ID NO: 22301 - DNA, 25 bp, S. cerevisiae
cagagggctaaccagtgcattgatt

SEQ ID NO: 22302 - DNA, 25 bp, S. cerevisiae
taggaggcaaaatgtcactattgac

SEQ ID NO: 22303 - DNA, 25 bp, S. cerevisiae
caggatggagacgatttcactttat

SEQ ID NO: 22304 - DNA, 25 bp, S. cerevisiae
cagggaggatgtagcttcttttatt

SEQ ID NO: 22305 - DNA, 25 bp, S. cerevisiae
cagggagaggtcgtcaatttgaact

SEQ ID NO: 22306 - DNA, 25 bp, S. cerevisiae
cagtcttacaccgagcattttgaaa

SEQ ID NO: 22307 - DNA, 25 bp, S. cerevisiae
caggttgcacctgccagtgtaataa

SEQ ID NO: 22308 - DNA, 25 bp, S. cerevisiae
cagtgttgatattcccagcggcaat

SEQ ID NO: 22309 - DNA, 25 bp, S. cerevisiae
cagttatgacattgccccaggaata

SEQ ID NO: 22310 - DNA, 25 bp, S. cerevisiae
cagttcagacaatcctgcaagattt

SEQ ID NO: 22311 - DNA, 25 bp, S. cerevisiae
gcatttccaaaacctgcaaaaccag

SEQ ID NO: 22312 - DNA, 25 bp, S. cerevisiae
ctttgccaaccagcgaaaactcatt

SEQ ID NO: 22313 - DNA, 25 bp, S. cerevisiae
ctttgtacagcccacgaaggacatt

SEQ ID NO: 22314 - DNA, 25 bp, S. cerevisiae
ctgtagtacccgcaataataatagc

SEQ ID NO: 22315 - DNA, 25 bp, S. cerevisiae
ctgtactacccgcaaccataatagc

SEQ ID NO: 22316 - DNA, 25 bp, S. cerevisiae
cttggttgaacacatcatccaagct

SEQ ID NO: 22317 - DNA, 25 bp, S. cerevisiae
cagtgtgatcaagcagcctaccgtt

SEQ ID NO: 22318 - DNA, 25 bp, S. cerevisiae
ctctgtacaaggaaaccccattatt

SEQ ID NO: 22319 - DNA, 25 bp, S. cerevisiae
cagggccagaggaaaccgaatgttt

SEQ ID NO: 22320 - DNA, 25 bp, S. cerevisiae
cagattggtttgacagacttcgcaa

SEQ ID NO: 22321 - DNA, 25 bp, S. cerevisiae
caggaatcgctggtgcttttcgata

SEQ ID NO: 22322 - DNA, 25 bp, S. cerevisiae
cagtgccgcagtgctgctgattaaa

SEQ ID NO: 22323 - DNA, 25 bp, S. cerevisiae
cagtggctgctatctttgctaacat

SEQ ID NO: 22324 - DNA, 25 bp, S. cerevisiae
cagtcgacatgataattgcttgcaa

SEQ ID NO: 22325 - DNA, 25 bp, S. cerevisiae
cagatggcactgattttgctctcaa

SEQ ID NO: 22326 - DNA, 25 bp, S. cerevisiae
catattccagcagccatacttacaa

SEQ ID NO: 22327 - DNA, 25 bp, S. cerevisiae
catattcctcaaccggcagtagaag

SEQ ID NO: 22328 - DNA, 25 bp, S. cerevisiae
cagtatacgctctaccttgggttta

SEQ ID NO: 22329 - DNA, 25 bp, S. cerevisiae
ctgaaagattgcaaccgggctgggt

SEQ ID NO: 22330 - DNA, 25 bp, S. cerevisiae
cagtggcgttttggtcatgggatat

SEQ ID NO: 22331 - DNA, 25 bp, S. cerevisiae
catggcgctgactgtttagaggcta

SEQ ID NO: 22332 - DNA, 25 bp, S. cerevisiae
catggcgtacatcacctggaagcaa

SEQ ID NO: 22333 - DNA, 25 bp, S. cerevisiae
catggtgctttgaaacaggtctact

SEQ ID NO: 22334 - DNA, 25 bp, S. cerevisiae
catctgagaacgttgaaggtccttt

SEQ ID NO: 22335 - DNA, 25 bp, S. cerevisiae
cttacgaccaagagaacactgtgcg

SEQ ID NO: 22336 - DNA, 25 bp, S. cerevisiae
ctttcgccgacacaggagacgacga

SEQ ID NO: 22337 - DNA, 25 bp, S. cerevisiae
ctactaccgaactgtggactggtac

SEQ ID NO: 22338 - DNA, 25 bp, S. cerevisiae
ctacttcaagaaggttgggtggata

SEQ ID NO: 22339 - DNA, 25 bp, S. cerevisiae
catattcaccagaggattccgtgga

SEQ ID NO: 22340 - DNA, 25 bp, S. cerevisiae
catagtatacatccgtacatccgta

SEQ ID NO: 22341 - DNA, 25 bp, S. cerevisiae
catcgattccaacgatagatcgcgt

SEQ ID NO: 22342 - DNA, 25 bp, S. cerevisiae
catttcgcatcagagacagacggtg

SEQ ID NO: 22343 - DNA, 25 bp, S. cerevisiae
catctcgcgtgccagaacagacaag

SEQ ID NO: 22344 - DNA, 25 bp, S. cerevisiae
catcgctggtggtaactatgctgca

SEQ ID NO: 22345 - DNA, 25 bp, S. cerevisiae
catccacgtcgacaattgctcaaag

SEQ ID NO: 22346 - DNA, 25 bp, S. cerevisiae
catccccatttacttttcgaaccag

SEQ ID NO: 22347 - DNA, 25 bp, S. cerevisiae
cagtgctccgaattattgtggtgaa

SEQ ID NO: 22348 - DNA, 25 bp, S. cerevisiae
cagttcatcctttagtgtcgcgaga

SEQ ID NO: 22349 - DNA, 25 bp, S. cerevisiae
cagtctgctgcattgtttgtcgaag

SEQ ID NO: 22350 - DNA, 25 bp, S. cerevisiae
cagatctgctgatttgttgcttgtt

SEQ ID NO: 22351 - DNA, 25 bp, S. cerevisiae
cagtctctgcattggtgttatttca

SEQ ID NO: 22352 - DNA, 25 bp, S. cerevisiae
caggtcttcctgttattgcaatgaa

SEQ ID NO: 22353 - DNA, 25 bp, S. cerevisiae
caggttgacgtcttacagttcttga

SEQ ID NO: 22354 - DNA, 25 bp, S. cerevisiae
cagttttccttccacaagtttacag

SEQ ID NO: 22355 - DNA, 25 bp, S. cerevisiae
cagttttcgttaccgactatccacg

SEQ ID NO: 22356 - DNA, 25 bp, S. cerevisiae
cagtgaatgcccctactacagtaaa

SEQ ID NO: 22357 - DNA, 25 bp, S. cerevisiae
cagtagagtctcattgccatcaaaa

SEQ ID NO: 22358 - DNA, 25 bp, S. cerevisiae
cagttctaactaattctcatgtggt

SEQ ID NO: 22359 - DNA, 25 bp, S. cerevisiae
cagtgcttataaaattgccggtggc

SEQ ID NO: 22360 - DNA, 25 bp, S. cerevisiae
cagtcgttagccatgttaccacaag

SEQ ID NO: 22361 - DNA, 25 bp, S. cerevisiae
cagtatttatttgatcatgggctat

SEQ ID NO: 22362 - DNA, 25 bp, S. cerevisiae
cagtatgttatcatgtacggtgtta

SEQ ID NO: 22363 - DNA, 25 bp, S. cerevisiae
caggtgctgtactttacggtgtcta

SEQ ID NO: 22364 - DNA, 25 bp, S. cerevisiae
caggctgcatttttggaccgtgtta

SEQ ID NO: 22365 - DNA, 25 bp, S. cerevisiae
cagtcagtttctcgtgatgatccac

SEQ ID NO: 22366 - DNA, 25 bp, S. cerevisiae
caggcgagatttgttttgtcagtaa

SEQ ID NO: 22367 - DNA, 25 bp, S. cerevisiae
caggtttgacatctttttgggcgaa

SEQ ID NO: 22368 - DNA, 25 bp, S. cerevisiae
caggcttacctcctatttttggtgg

SEQ ID NO: 22369 - DNA, 25 bp, S. cerevisiae
cagttatcttctttttctaccctga

SEQ ID NO: 22370 - DNA, 25 bp, S. cerevisiae
cagtatatggtttttctttcccgat

SEQ ID NO: 22371 - DNA, 25 bp, S. cerevisiae
cagggctatgctccaaaatttttga

SEQ ID NO: 22372 - DNA, 25 bp, S. cerevisiae
caggactttcctggccatttaatga

SEQ ID NO: 22373 - DNA, 25 bp, S. cerevisiae
cagtcttttccttcgtagctatatg

SEQ ID NO: 22374 - DNA, 25 bp, S. cerevisiae
cagtacgttcccttatatgcattta

SEQ ID NO: 22375 - DNA, 25 bp, S. cerevisiae
cagttcgtttgtcttcatgtcttac

SEQ ID NO: 22376 - DNA, 25 bp, S. cerevisiae
cagtggcgtgtttgatgaatttatc

SEQ ID NO: 22377 - DNA, 25 bp, S. cerevisiae
cagtctgcttggtgtgggcattgcc

SEQ ID NO: 22378 - DNA, 25 bp, S. cerevisiae
catggtttggtttgggccaggctta

SEQ ID NO: 22379 - DNA, 25 bp, S. cerevisiae
caggcaatggtttttgtcgggcttc

SEQ ID NO: 22380 - DNA, 25 bp, S. cerevisiae
cagtgactggtataggctcggcgct

SEQ ID NO: 22381 - DNA, 25 bp, S. cerevisiae
cagtgactgtagtggacctggccaa

SEQ ID NO: 22382 - DNA, 25 bp, S. cerevisiae
cagtacgtcaagctgcagtttagca

SEQ ID NO: 22383 - DNA, 25 bp, S. cerevisiae
cagtatgccagctggtgttttggat

SEQ ID NO: 22384 - DNA, 25 bp, S. cerevisiae
caggtgctcacttgggtagattcgt

SEQ ID NO: 22385 - DNA, 25 bp, S. cerevisiae
gcatccgttgttttggccaaagtcg

SEQ ID NO: 22386 - DNA, 25 bp, S. cerevisiae
cattgaagaggctaccacgactaat

SEQ ID NO: 22387 - DNA, 25 bp, S. cerevisiae
cattgtataggaagccagccccggg

SEQ ID NO: 22388 - DNA, 25 bp, S. cerevisiae
cagtttggtttcaacatctttgcta

SEQ ID NO: 22389 - DNA, 25 bp, S. cerevisiae
caggtgcggcttggttctttgttaa

SEQ ID NO: 22390 - DNA, 25 bp, S. cerevisiae
caggctcagaggattcgtttgttaa

SEQ ID NO: 22391 - DNA, 25 bp, S. cerevisiae
cagtttagctggctcttgtgtactt

SEQ ID NO: 22392 - DNA, 25 bp, S. cerevisiae
catggtggctgacgcaatgcttgac

SEQ ID NO: 22393 - DNA, 25 bp, S. cerevisiae
caggtcgtcagggattctgccaaaa

SEQ ID NO: 22394 - DNA, 25 bp, S. cerevisiae
caggaggtcagcgtatcttgcagaa

SEQ ID NO: 22395 - DNA, 25 bp, S. cerevisiae
caggctattgcccatttcattatca

SEQ ID NO: 22396 - DNA, 25 bp, S. cerevisiae
cagtacttcgtgttggctcataggt

SEQ ID NO: 22397 - DNA, 25 bp, S. cerevisiae
catgcgttgcatactgtaatttctc

SEQ ID NO: 22398 - DNA, 25 bp, S. cerevisiae
caggaatccacatcactctttgagt

SEQ ID NO: 22399 - DNA, 25 bp, S. cerevisiae
catgtacaccatggactctttggga

SEQ ID NO: 22400 - DNA, 25 bp, S. cerevisiae
catcgactttgtcattgccacagta

SEQ ID NO: 22401 - DNA, 25 bp, S. cerevisiae
cagtcgaatcgctgcgtcaggacaa

SEQ ID NO: 22402 - DNA, 25 bp, S. cerevisiae
cagtgtaactgctggtggctggcaa

SEQ ID NO: 22403 - DNA, 25 bp, S. cerevisiae
cagtcttttggtattcatgttgcag

SEQ ID NO: 22404 - DNA, 25 bp, S. cerevisiae
caggtttagttgattcattcgctca

SEQ ID NO: 22405 - DNA, 25 bp, S. cerevisiae
caggctggacagcacttgttgtcaa

SEQ ID NO: 22406 - DNA, 25 bp, S. cerevisiae
cttggcaagctatatacgtcgggtt

SEQ ID NO: 22407 - DNA, 25 bp, S. cerevisiae
cattggcgatgctgacttagtctac

SEQ ID NO: 22408 - DNA, 25 bp, S. cerevisiae
catcgacgagcaacctactttatct

SEQ ID NO: 22409 - DNA, 25 bp, S. cerevisiae
caggcgccaggtttgacttatcata

SEQ ID NO: 22410 - DNA, 25 bp, S. cerevisiae
cggcgtcattgattgtggcgtatat

SEQ ID NO: 22411 - DNA, 25 bp, S. cerevisiae
caggcagtactgaaggacgtcattt

SEQ ID NO: 22412 - DNA, 25 bp, S. cerevisiae
catgggtattggcagcagctacatt

SEQ ID NO: 22413 - DNA, 25 bp, S. cerevisiae
caggtattcgtgttgcgtactcaaa

SEQ ID NO: 22414 - DNA, 25 bp, S. cerevisiae
cagggattgcgtttgatgttgccaa

SEQ ID NO: 22415 - DNA, 25 bp, S. cerevisiae
caggcgttggttcagttcatggcat

SEQ ID NO: 22416 - DNA, 25 bp, S. cerevisiae
catgccgttacttctaatcactgga

SEQ ID NO: 22417 - DNA, 25 bp, S. cerevisiae
catggtgccacgaagctatgcttga

SEQ ID NO: 22418 - DNA, 25 bp, S. cerevisiae
cagtctgatttttgtctctcttggt

SEQ ID NO: 22419 - DNA, 25 bp, S. cerevisiae
catgccagatatgactgttccttct

SEQ ID NO: 22420 - DNA, 25 bp, S. cerevisiae
catggatttctactgtctccttaat

SEQ ID NO: 22421 - DNA, 25 bp, S. cerevisiae
caggcgttcaacgttgtcgaaacat

SEQ ID NO: 22422 - DNA, 25 bp, S. cerevisiae
cagtgtattctaggctatccccaaa

SEQ ID NO: 22423 - DNA, 25 bp, S. cerevisiae
cagtcttacataatttctctccata

SEQ ID NO: 22424 - DNA, 25 bp, S. cerevisiae
catgaccgagcaaggatctccttta

SEQ ID NO: 22425 - DNA, 25 bp, S. cerevisiae
caggtacccatttcggcactaaaat

SEQ ID NO: 22426 - DNA, 25 bp, S. cerevisiae
caggcccatttgtccttggattaag

SEQ ID NO: 22427 - DNA, 25 bp, S. cerevisiae
caggatcctagactgctttggcatc

SEQ ID NO: 22428 - DNA, 25 bp, S. cerevisiae
cagggtagtatgtcaccgacgcaaa

SEQ ID NO: 22429 - DNA, 25 bp, S. cerevisiae
catccagatggctaagttcccttaa

SEQ ID NO: 22430 - DNA, 25 bp, S. cerevisiae
catatcagagaacaccttccctaat

SEQ ID NO: 22431 - DNA, 25 bp, S. cerevisiae
catctggaaaactagctcccactaa

SEQ ID NO: 22432 - DNA, 25 bp, S. cerevisiae
catgctgcgtacctggcattgggaa

SEQ ID NO: 22433 - DNA, 25 bp, S. cerevisiae
ctcgcgaaccgtacaggatgccaaa

SEQ ID NO: 22434 - DNA, 25 bp, S. cerevisiae
catggagccgctatcagaacgattt

SEQ ID NO: 22435 - DNA, 25 bp, S. cerevisiae
catgcctggcatggttacaacaata

SEQ ID NO: 22436 - DNA, 25 bp, S. cerevisiae
catgccatggttctgcaccagatat

SEQ ID NO: 22437 - DNA, 25 bp, S. cerevisiae
catctctctctatgatcagtccatt

SEQ ID NO: 22438 - DNA, 25 bp, S. cerevisiae
caggtcgctttggagctttgttagc

SEQ ID NO: 22439 - DNA, 25 bp, S. cerevisiae
cagtgatcattgtcacatcctgtga

SEQ ID NO: 22440 - DNA, 25 bp, S. cerevisiae
cagtgttcgcttgtcttggtatagt

SEQ ID NO: 22441 - DNA, 25 bp, S. cerevisiae
caggttctttagtcattgcgtctac

SEQ ID NO: 22442 - DNA, 25 bp, S. cerevisiae
caggcgttcgattgagcagtcctta

SEQ ID NO: 22443 - DNA, 25 bp, S. cerevisiae
catgatgtttattggccagctctgg

SEQ ID NO: 22444 - DNA, 25 bp, S. cerevisiae
catggtgttgttgctagtgtgaaga

SEQ ID NO: 22445 - DNA, 25 bp, S. cerevisiae
catgatctaccctagtgcattcaac

SEQ ID NO: 22446 - DNA, 25 bp, S. cerevisiae
catggcgatcattggcagctgtcaa

SEQ ID NO: 22447 - DNA, 25 bp, S. cerevisiae
cgctcagaaacgtctcctcaaggag

SEQ ID NO: 22448 - DNA, 25 bp, S. cerevisiae
cctccagaccattttcctagtaggt

SEQ ID NO: 22449 - DNA, 25 bp, S. cerevisiae
catcccagacttcatgatccaaggt

SEQ ID NO: 22450 - DNA, 25 bp, S. cerevisiae
catggtgagatctccactttggaaa

SEQ ID NO: 22451 - DNA, 25 bp, S. cerevisiae
cagtgtctattgctgcttctgagaa

SEQ ID NO: 22452 - DNA, 25 bp, S. cerevisiae
catggttatggccactgttaaaaag

SEQ ID NO: 22453 - DNA, 25 bp, S. cerevisiae
caggatctgacgtcatggcccaata

SEQ ID NO: 22454 - DNA, 25 bp, S. cerevisiae
catggtaatttacgtcttgccgatt

SEQ ID NO: 22455 - DNA, 25 bp, S. cerevisiae
catcctaacttaagaattccgcctc

SEQ ID NO: 22456 - DNA, 25 bp, S. cerevisiae
catacgttgcttacggttacccatc

SEQ ID NO: 22457 - DNA, 25 bp, S. cerevisiae
gcaacttttttctcttccgaatgga

SEQ ID NO: 22458 - DNA, 25 bp, S. cerevisiae
cttcctttttcatcttccaaatagc

SEQ ID NO: 22459 - DNA, 25 bp, S. cerevisiae
catgtcgctaatttgggttccttaa

SEQ ID NO: 22460 - DNA, 25 bp, S. cerevisiae
cataccttggtaacgttcctataga

SEQ ID NO: 22461 - DNA, 25 bp, S. cerevisiae
catcagcttattcggtacttcaaca

SEQ ID NO: 22462 - DNA, 25 bp, S. cerevisiae
catcctctgaacgtcgtgttttgtt

SEQ ID NO: 22463 - DNA, 25 bp, S. cerevisiae
ctcagatttctgacggccaagttca

SEQ ID NO: 22464 - DNA, 25 bp, S. cerevisiae
catatggatttggtgcgattacgga

SEQ ID NO: 22465 - DNA, 25 bp, S. cerevisiae
catatggcatcacaattggaacggt

SEQ ID NO: 22466 - DNA, 25 bp, S. cerevisiae
catcattgaaggtattaacgctggt

SEQ ID NO: 22467 - DNA, 25 bp, S. cerevisiae
catcaaatatggtaagaactctggt

SEQ ID NO: 22468 - DNA, 25 bp, S. cerevisiae
catcagcagtatggtcaaggttcat

SEQ ID NO: 22469 - DNA, 25 bp, S. cerevisiae
catccgtcagatccaagtacctgta

SEQ ID NO: 22470 - DNA, 25 bp, S. cerevisiae
catccgccgatgaacagtactgtag

SEQ ID NO: 22471 - DNA, 25 bp, S. cerevisiae
catgctgccctcaaagtaactcatt

SEQ ID NO: 22472 - DNA, 25 bp, S. cerevisiae
cttggatgatctgactgcgtggttc

SEQ ID NO: 22473 - DNA, 25 bp, S. cerevisiae
catgtgctgcattcatcgacggtga

SEQ ID NO: 22474 - DNA, 25 bp, S. cerevisiae
catgatcatcatgttaccgtggaac

SEQ ID NO: 22475 - DNA, 25 bp, S. cerevisiae
catccggcccattagcattatgtga

SEQ ID NO: 22476 - DNA, 25 bp, S. cerevisiae
catcgattctcctcaatttggcaaa

SEQ ID NO: 22477 - DNA, 25 bp, S. cerevisiae
catcggtgactgtaatttttgcaaa

SEQ ID NO: 22478 - DNA, 25 bp, S. cerevisiae
catgcggtaaagttgttggtgacaa

SEQ ID NO: 22479 - DNA, 25 bp, S. cerevisiae
caggcctcatattttgccggtgaat

SEQ ID NO: 22480 - DNA, 25 bp, S. cerevisiae
caggcctgatatctcccatggaaat

SEQ ID NO: 22481 - DNA, 25 bp, S. cerevisiae
catgattttgatcctgaccacagaa

SEQ ID NO: 22482 - DNA, 25 bp, S. cerevisiae
catccctgaggatagcggtgcaaat

SEQ ID NO: 22483 - DNA, 25 bp, S. cerevisiae
catgtagacagttcggccattgcgc

SEQ ID NO: 22484 - DNA, 25 bp, S. cerevisiae
cattcggtttagttgcgacggccgt

SEQ ID NO: 22485 - DNA, 25 bp, S. cerevisiae
cttgagacctgttgttagagcccca

SEQ ID NO: 22486 - DNA, 25 bp, S. cerevisiae
catgttcggttgtttagttgtctat

SEQ ID NO: 22487 - DNA, 25 bp, S. cerevisiae
catgcacttgagttgtgggctctgt

SEQ ID NO: 22488 - DNA, 25 bp, S. cerevisiae
catcatgtgttgtggagctgcttta

SEQ ID NO: 22489 - DNA, 25 bp, S. cerevisiae
catcgtgcgggccagaggtactata

SEQ ID NO: 22490 - DNA, 25 bp, S. cerevisiae
cataccgcgggcatggcatagcaaa

SEQ ID NO: 22491 - DNA, 25 bp, S. cerevisiae
catacctccggttctgaaaacatct

SEQ ID NO: 22492 - DNA, 25 bp, S. cerevisiae
cggcaagaccccattcagtgatata

SEQ ID NO: 22493 - DNA, 25 bp, S. cerevisiae
caggagttctcttgcttttgttaaa

SEQ ID NO: 22494 - DNA, 25 bp, S. cerevisiae
caggcatttcctccggatgttttgg

SEQ ID NO: 22495 - DNA, 25 bp, S. cerevisiae
catggtctttgttcccgatatttta

SEQ ID NO: 22496 - DNA, 25 bp, S. cerevisiae
caggtttgtttcattggcgttgtat

SEQ ID NO: 22497 - DNA, 25 bp, S. cerevisiae
caggcttattttccattgtccttaa

SEQ ID NO: 22498 - DNA, 25 bp, S. cerevisiae
caggcgtgtttgaccgtatctttaa

SEQ ID NO: 22499 - DNA, 25 bp, S. cerevisiae
catcgggctggttactacttttgaa

SEQ ID NO: 22500 - DNA, 25 bp, S. cerevisiae
catcggcccgtatatgccatattta

SEQ ID NO: 22501 - DNA, 25 bp, S. cerevisiae
ctttcacacttctagacctattgtc

SEQ ID NO: 22502 - DNA, 25 bp, S. cerevisiae
catttcatttactgggtgaggtctc

SEQ ID NO: 22503 - DNA, 25 bp, S. cerevisiae
ctaactactttggacgtgacctcca

SEQ ID NO: 22504 - DNA, 25 bp, S. cerevisiae
gcgtaaaataccattccttcccaag

SEQ ID NO: 22505 - DNA, 25 bp, S. cerevisiae
cattaggtgttgttccaagcgccaa

SEQ ID NO: 22506 - DNA, 25 bp, S. cerevisiae
catacaattttttaggagtgccgtt

SEQ ID NO: 22507 - DNA, 25 bp, S. cerevisiae
cataacgataacaagggcctgcaca

SEQ ID NO: 22508 - DNA, 25 bp, S. cerevisiae
catagactcaagtggcgagccttca

SEQ ID NO: 22509 - DNA, 25 bp, S. cerevisiae
catcatgatgcgtgccggtaaggct

SEQ ID NO: 22510 - DNA, 25 bp, S. cerevisiae
catcaatgccattccaggtaataat

SEQ ID NO: 22511 - DNA, 25 bp, S. cerevisiae
cattgatagatgtcccacgaacgat

SEQ ID NO: 22512 - DNA, 25 bp, S. cerevisiae
catttcaagaactactgccacgatt

SEQ ID NO: 22513 - DNA, 25 bp, S. cerevisiae
catttcaagaacacggaggagggta

SEQ ID NO: 22514 - DNA, 25 bp, S. cerevisiae
cttcgacattactccacatgagctt

SEQ ID NO: 22515 - DNA, 25 bp, S. cerevisiae
cttggtattcaatcctgatggcttg

SEQ ID NO: 22516 - DNA, 25 bp, S. cerevisiae
cattggtaacgttcttggtgcctct

SEQ ID NO: 22517 - DNA, 25 bp, S. cerevisiae
cttgtcgattcgttattccatgcca

SEQ ID NO: 22518 - DNA, 25 bp, S. cerevisiae
cattgttttcctacgtcgaaccagt

SEQ ID NO: 22519 - DNA, 25 bp, S. cerevisiae
cattatcaagtctgtcggttccaac

SEQ ID NO: 22520 - DNA, 25 bp, S. cerevisiae
catgttaccaagtcgagacgcttaa

SEQ ID NO: 22521 - DNA, 25 bp, S. cerevisiae
catatttctccgtaaagtcagccga

SEQ ID NO: 22522 - DNA, 25 bp, S. cerevisiae
cttttcacaccctgaactgacgaat

SEQ ID NO: 22523 - DNA, 25 bp, S. cerevisiae
ctttatcgaaactgaagtgcgcaat

SEQ ID NO: 22524 - DNA, 25 bp, S. cerevisiae
ctttatcaagagagaacgtgccaaa

SEQ ID NO: 22525 - DNA, 25 bp, S. cerevisiae
ctttatcagaacagtcaggcccaca

SEQ ID NO: 22526 - DNA, 25 bp, S. cerevisiae
ctccgctagaaagttgcgtgtccac

SEQ ID NO: 22527 - DNA, 25 bp, S. cerevisiae
ctctgctagaaagctacgtgtccac

SEQ ID NO: 22528 - DNA, 25 bp, S. cerevisiae
cattccttggatgtatgccgtcgat

SEQ ID NO: 22529 - DNA, 25 bp, S. cerevisiae
caggcagctgctaaattctacgata

SEQ ID NO: 22530 - DNA, 25 bp, S. cerevisiae
caggctatccgttcttcattgaaaa

SEQ ID NO: 22531 - DNA, 25 bp, S. cerevisiae
catggtttcatggtcactggtaagg

SEQ ID NO: 22532 - DNA, 25 bp, S. cerevisiae
catggattatctgctcctggtcaga

SEQ ID NO: 22533 - DNA, 25 bp, S. cerevisiae
catggttatatgctcctagtaggta

SEQ ID NO: 22534 - DNA, 25 bp, S. cerevisiae
caggcgatcaatgccctttagtgat

SEQ ID NO: 22535 - DNA, 25 bp, S. cerevisiae
caggccattggtttcttacgtgatc

SEQ ID NO: 22536 - DNA, 25 bp, S. cerevisiae
cattgagcttagaacccttttgggc

SEQ ID NO: 22537 - DNA, 25 bp, S. cerevisiae
catccagttgaaggccgtttgtcca

SEQ ID NO: 22538 - DNA, 25 bp, S. cerevisiae
cattcagctaaaggccgtttgtcca

SEQ ID NO: 22539 - DNA, 25 bp, S. cerevisiae
ctaaacgatcgtattgcctctgggt

SEQ ID NO: 22540 - DNA, 25 bp, S. cerevisiae
cataataggatctagtactgcctct

SEQ ID NO: 22541 - DNA, 25 bp, S. cerevisiae
cattgtgacggatctttcgtacggt

SEQ ID NO: 22542 - DNA, 25 bp, S. cerevisiae
catacggcttgtaccagtggcgatg

SEQ ID NO: 22543 - DNA, 25 bp, S. cerevisiae
cttcaagtctcttccagatggcagg

SEQ ID NO: 22544 - DNA, 25 bp, S. cerevisiae
cattaagtgttatacgtgaccgtga

SEQ ID NO: 22545 - DNA, 25 bp, S. cerevisiae
ctataagtagtatccgcggctcggt

SEQ ID NO: 22546 - DNA, 25 bp, S. cerevisiae
cttggattaagaccctcggctaagt

SEQ ID NO: 22547 - DNA, 25 bp, S. cerevisiae
catggtatattttctggctcagcta

SEQ ID NO: 22548 - DNA, 25 bp, S. cerevisiae
catctgatattcgtaagctggctac

SEQ ID NO: 22549 - DNA, 25 bp, S. cerevisiae
catctggatctggtgcaagctgtta

SEQ ID NO: 22550 - DNA, 25 bp, S. cerevisiae
ctaagggttctgattccgctattaa

SEQ ID NO: 22551 - DNA, 25 bp, S. cerevisiae
ctcttaacttctctgtcttctatta

SEQ ID NO: 22552 - DNA, 25 bp, S. cerevisiae
catctaatgatgttgctgctgtgtt

SEQ ID NO: 22553 - DNA, 25 bp, S. cerevisiae
catcccaatgcatgttgtcaccaaa

SEQ ID NO: 22554 - DNA, 25 bp, S. cerevisiae
ctaggtccgtcgttaccacatataa

SEQ ID NO: 22555 - DNA, 25 bp, S. cerevisiae
cattccatctcatcgcaaactaaaa

SEQ ID NO: 22556 - DNA, 25 bp, S. cerevisiae
cattagctctcgcaacatcagttac

SEQ ID NO: 22557 - DNA, 25 bp, S. cerevisiae
catgatatctctggaaccgggtgat

SEQ ID NO: 22558 - DNA, 25 bp, S. cerevisiae
catgctgatcaaggattcgcgggtt

SEQ ID NO: 22559 - DNA, 25 bp, S. cerevisiae
catgggctaaatccccgtatttgca

SEQ ID NO: 22560 - DNA, 25 bp, S. cerevisiae
catgacgttacatccaagcggtttt

SEQ ID NO: 22561 - DNA, 25 bp, S. cerevisiae
cattcaggtcaggtaaagggttatt

SEQ ID NO: 22562 - DNA, 25 bp, S. cerevisiae
catgcctggttcaatctacgggtta

SEQ ID NO: 22563 - DNA, 25 bp, S. cerevisiae
cttaggttctatactggttccaggc

SEQ ID NO: 22564 - DNA, 25 bp, S. cerevisiae
cttcaagcttcaaacagggtccagt

SEQ ID NO: 22565 - DNA, 25 bp, S. cerevisiae
catgttatttctaaagttgccggta

SEQ ID NO: 22566 - DNA, 25 bp, S. cerevisiae
catgggtttatttggttcctgattc

SEQ ID NO: 22567 - DNA, 25 bp, S. cerevisiae
catttctcaggtgcagatagctcaa

SEQ ID NO: 22568 - DNA, 25 bp, S. cerevisiae
cattcataatgattcctgtaccaga

SEQ ID NO: 22569 - DNA, 25 bp, S. cerevisiae
catctgtccaccctgagtttaaaac

SEQ ID NO: 22570 - DNA, 25 bp, S. cerevisiae
catacctctcaactccttaggaatt

SEQ ID NO: 22571 - DNA, 25 bp, S. cerevisiae
catggtctcctctatatctcaagaa

SEQ ID NO: 22572 - DNA, 25 bp, S. cerevisiae
cttgctcaggagacgctttagtgaa

SEQ ID NO: 22573 - DNA, 25 bp, S. cerevisiae
catgcatttgggtctgtttttgaac

SEQ ID NO: 22574 - DNA, 25 bp, S. cerevisiae
catccgtttctgcataagtgtctat

SEQ ID NO: 22575 - DNA, 25 bp, S. cerevisiae
catcggaatttcaaccagcaatatt

SEQ ID NO: 22576 - DNA, 25 bp, S. cerevisiae
catcctgagtccctaccaattaata

SEQ ID NO: 22577 - DNA, 25 bp, S. cerevisiae
catcattggtcacaacccagatgaa

SEQ ID NO: 22578 - DNA, 25 bp, S. cerevisiae
catgcattggtactctgattccgga

SEQ ID NO: 22579 - DNA, 25 bp, S. cerevisiae
cattctgcaggatgatggcccgatt

SEQ ID NO: 22580 - DNA, 25 bp, S. cerevisiae
catgtctcagtgatgacgctttgat

SEQ ID NO: 22581 - DNA, 25 bp, S. cerevisiae
catgttcggttgtctggtagtctac

SEQ ID NO: 22582 - DNA, 25 bp, S. cerevisiae
catcccaggtagtgttcagtgcgac

SEQ ID NO: 22583 - DNA, 25 bp, S. cerevisiae
catcccttgggttgtactggcgcaa

SEQ ID NO: 22584 - DNA, 25 bp, S. cerevisiae
catcgtctatatttccagggtctaa

SEQ ID NO: 22585 - DNA, 25 bp, S. cerevisiae
catcggtgcatctagtttacggcta

SEQ ID NO: 22586 - DNA, 25 bp, S. cerevisiae
catgtcgatttcgactgcatgcaac

SEQ ID NO: 22587 - DNA, 25 bp, S. cerevisiae
cttcgagttcaggagatgcccaacc

SEQ ID NO: 22588 - DNA, 25 bp, S. cerevisiae
ctatgggatctgtcgatgatgcttc

SEQ ID NO: 22589 - DNA, 25 bp, S. cerevisiae
catgagtggatttgcgtcgctgttt

SEQ ID NO: 22590 - DNA, 25 bp, S. cerevisiae
catgtgggtgtctatttgcgtttac

SEQ ID NO: 22591 - DNA, 25 bp, S. cerevisiae
cattgaaggtgtctttttctccggt

SEQ ID NO: 22592 - DNA, 25 bp, S. cerevisiae
cattaccgcagtacgttgattttgt

SEQ ID NO: 22593 - DNA, 25 bp, S. cerevisiae
cattctaacgtgtccgtagcactta

SEQ ID NO: 22594 - DNA, 25 bp, S. cerevisiae
catcacttcaccattcttagactaa

SEQ ID NO: 22595 - DNA, 25 bp, S. cerevisiae
catccattccacaactttcatttag

SEQ ID NO: 22596 - DNA, 25 bp, S. cerevisiae
catcatttccgcagagttcttctaa

SEQ ID NO: 22597 - DNA, 25 bp, S. cerevisiae
catgtgcccttggtggttgttataa

SEQ ID NO: 22598 - DNA, 25 bp, S. cerevisiae
catgtccctgtggtaagaaattcaa

SEQ ID NO: 22599 - DNA, 25 bp, S. cerevisiae
catcgataagtggttctgcgttgac

SEQ ID NO: 22600 - DNA, 25 bp, S. cerevisiae
cataattctgatcttgccgtggaca

SEQ ID NO: 22601 - DNA, 25 bp, S. cerevisiae
catcatatttactagcgtgctcgca

SEQ ID NO: 22602 - DNA, 25 bp, S. cerevisiae
catatacagtggtgcgtccgctggc

SEQ ID NO: 22603 - DNA, 25 bp, S. cerevisiae
catcatctccgctatgggtgaagaa

SEQ ID NO: 22604 - DNA, 25 bp, S. cerevisiae
catcgcgttcttatggagaccaaca

SEQ ID NO: 22605 - DNA, 25 bp, S. cerevisiae
catcgccatttttccagcaaacaat

SEQ ID NO: 22606 - DNA, 25 bp, S. cerevisiae
cttcagcatatactaccccaaggat

SEQ ID NO: 22607 - DNA, 25 bp, S. cerevisiae
ctttggctggtttccacaaggttca

SEQ ID NO: 22608 - DNA, 25 bp, S. cerevisiae
catttgttttgtttaccacgtctca

SEQ ID NO: 22609 - DNA, 25 bp, S. cerevisiae
catatgtttcggtatgtctgccggt

SEQ ID NO: 22610 - DNA, 25 bp, S. cerevisiae
catcgtcattggttgtgtggttggt

SEQ ID NO: 22611 - DNA, 25 bp, S. cerevisiae
catctcatccggtttagttgtgtat

SEQ ID NO: 22612 - DNA, 25 bp, S. cerevisiae
cattacttggttttgcttgtggcga

SEQ ID NO: 22613 - DNA, 25 bp, S. cerevisiae
catttttgggtgtatccttggcgct

SEQ ID NO: 22614 - DNA, 25 bp, S. cerevisiae
catttctggccagtgacttcattgg

SEQ ID NO: 22615 - DNA, 25 bp, S. cerevisiae
catcgagtgatggttttgcaattgc

SEQ ID NO: 22616 - DNA, 25 bp, S. cerevisiae
catcatgttggtcatttcggtcgta

SEQ ID NO: 22617 - DNA, 25 bp, S. cerevisiae
catcatgtatggtattccacgctgt

SEQ ID NO: 22618 - DNA, 25 bp, S. cerevisiae
catgcagtaaaaccacgccaattgt

SEQ ID NO: 22619 - DNA, 25 bp, S. cerevisiae
catcactacagatcacacggttggt

SEQ ID NO: 22620 - DNA, 25 bp, S. cerevisiae
cttcttgactactccttttgatgtt

SEQ ID NO: 22621 - DNA, 25 bp, S. cerevisiae
cttattgtctaagcctgaattcagt

SEQ ID NO: 22622 - DNA, 25 bp, S. cerevisiae
catcaccggctttgtttcaactaga

SEQ ID NO: 22623 - DNA, 25 bp, S. cerevisiae
catctacgggttgcgtccatcggac

SEQ ID NO: 22624 - DNA, 25 bp, S. cerevisiae
catctgtcggtcacactttgatcaa

SEQ ID NO: 22625 - DNA, 25 bp, S. cerevisiae
catgcattgcgttattttgctgcta

SEQ ID NO: 22626 - DNA, 25 bp, S. cerevisiae
catcttctttgttttctgtaccact

SEQ ID NO: 22627 - DNA, 25 bp, S. cerevisiae
catgcctttgagtgattttaccgat

SEQ ID NO: 22628 - DNA, 25 bp, S. cerevisiae
cattggccaaaccttcagtatcgtt

SEQ ID NO: 22629 - DNA, 25 bp, S. cerevisiae
cttggctgcaagtgttcggtttggt

SEQ ID NO: 22630 - DNA, 25 bp, S. cerevisiae
cattggccagcattgaggaggactc

SEQ ID NO: 22631 - DNA, 25 bp, S. cerevisiae
cattgcagaagcttacgatctttta

SEQ ID NO: 22632 - DNA, 25 bp, S. cerevisiae
catgcaagcaatcttcgcctttgaa

SEQ ID NO: 22633 - DNA, 25 bp, S. cerevisiae
catcgtgaatgagttgccctttata

SEQ ID NO: 22634 - DNA, 25 bp, S. cerevisiae
catcctgaagatgctgtttcgctat

SEQ ID NO: 22635 - DNA, 25 bp, S. cerevisiae
catagcgctaatgctggtctcagct

SEQ ID NO: 22636 - DNA, 25 bp, S. cerevisiae
catcaggataatttgcgtgcggctt

SEQ ID NO: 22637 - DNA, 25 bp, S. cerevisiae
catgcggatgcattttggctgaaat

SEQ ID NO: 22638 - DNA, 25 bp, S. cerevisiae
catcggtatctcttggatcatctac

SEQ ID NO: 22639 - DNA, 25 bp, S. cerevisiae
catacgttcaattgctgtctcatta

SEQ ID NO: 22640 - DNA, 25 bp, S. cerevisiae
catcctgattcattggtgacgtttg

SEQ ID NO: 22641 - DNA, 25 bp, S. cerevisiae
catgcttccattgatcccgaattaa

SEQ ID NO: 22642 - DNA, 25 bp, S. cerevisiae
catgctttatctccgtcctatagtt

SEQ ID NO: 22643 - DNA, 25 bp, S. cerevisiae
catgccttttcattgcctctaaata

SEQ ID NO: 22644 - DNA, 25 bp, S. cerevisiae
catcgcattttcttggcctgtttga

SEQ ID NO: 22645 - DNA, 25 bp, S. cerevisiae
catagattttgcttcactccattct

SEQ ID NO: 22646 - DNA, 25 bp, S. cerevisiae
catatggttctctccattctttaca

SEQ ID NO: 22647 - DNA, 25 bp, S. cerevisiae
cattatgtgttatcgtgggctcaaa

SEQ ID NO: 22648 - DNA, 25 bp, S. cerevisiae
catctttatttccatctagtgccga

SEQ ID NO: 22649 - DNA, 25 bp, S. cerevisiae
cattttgaattgcactccagcgaga

SEQ ID NO: 22650 - DNA, 25 bp, S. cerevisiae
catctaagaaggaacgcccaggttt

SEQ ID NO: 22651 - DNA, 25 bp, S. cerevisiae
cattgaagttaaaggcgccacgttt

SEQ ID NO: 22652 - DNA, 25 bp, S. cerevisiae
catttacccataaagcccacgatta

SEQ ID NO: 22653 - DNA, 25 bp, S. cerevisiae
catttgaccaaagggcacgtttcga

SEQ ID NO: 22654 - DNA, 25 bp, S. cerevisiae
gcttgccctattgacgtccgtaaag

SEQ ID NO: 22655 - DNA, 25 bp, S. cerevisiae
cattgatcctatcccaagatggcga

SEQ ID NO: 22656 - DNA, 25 bp, S. cerevisiae
catcgctgatgggttttgtgtgtct

SEQ ID NO: 22657 - DNA, 25 bp, S. cerevisiae
cattgaattggaacgccgctcatta

SEQ ID NO: 22658 - DNA, 25 bp, S. cerevisiae
catttggcaccttcatcggaatgat

SEQ ID NO: 22659 - DNA, 25 bp, S. cerevisiae
catccgcctgcgatacgataaatat

SEQ ID NO: 22660 - DNA, 25 bp, S. cerevisiae
catcctcctccttatcaaaagtcta

SEQ ID NO: 22661 - DNA, 25 bp, S. cerevisiae
catactgccccgtaaatacttcaat

SEQ ID NO: 22662 - DNA, 25 bp, S. cerevisiae
cattgctgaccactgttgcacaagt

SEQ ID NO: 22663 - DNA, 25 bp, S. cerevisiae
catagagctgctcttgatccaaaga

SEQ ID NO: 22664 - DNA, 25 bp, S. cerevisiae
catcatggcatcctcatactatcaa

SEQ ID NO: 22665 - DNA, 25 bp, S. cerevisiae
catctgttcctctatcttcaaacga

SEQ ID NO: 22666 - DNA, 25 bp, S. cerevisiae
catctattcagtttcctcgttcaga

SEQ ID NO: 22667 - DNA, 25 bp, S. cerevisiae
cattgctttgtatcctgccggaaat

SEQ ID NO: 22668 - DNA, 25 bp, S. cerevisiae
catacacacgttactttccgattca

SEQ ID NO: 22669 - DNA, 25 bp, S. cerevisiae
catctcaatcttctctttccaatat

SEQ ID NO: 22670 - DNA, 25 bp, S. cerevisiae
catcttcatgggttgctttgccaaa

SEQ ID NO: 22671 - DNA, 25 bp, S. cerevisiae
catcttcattgggtgttggacactc

SEQ ID NO: 22672 - DNA, 25 bp, S. cerevisiae
cattcatcgtgtgggaagaaccgca

SEQ ID NO: 22673 - DNA, 25 bp, S. cerevisiae
catttagatctttgactgtccctga

SEQ ID NO: 22674 - DNA, 25 bp, S. cerevisiae
cttggtattgcaggcgtcattcttg

SEQ ID NO: 22675 - DNA, 25 bp, S. cerevisiae
catacgatcattgcgggtcttgacg

SEQ ID NO: 22676 - DNA, 25 bp, S. cerevisiae
catatctcctaatggtatacctggc

SEQ ID NO: 22677 - DNA, 25 bp, S. cerevisiae
cattgtccatgatcaagttaccggg

SEQ ID NO: 22678 - DNA, 25 bp, S. cerevisiae
catttcctgaacttgtaacaccggt

SEQ ID NO: 22679 - DNA, 25 bp, S. cerevisiae
cttggtcgaccctcaacacaaggct

SEQ ID NO: 22680 - DNA, 25 bp, S. cerevisiae
ctatgggacccatctcaatacgagg

SEQ ID NO: 22681 - DNA, 25 bp, S. cerevisiae
cttgggtcccaccttctaggagagg

SEQ ID NO: 22682 - DNA, 25 bp, S. cerevisiae
catcaagtcgctactattcagttgg

SEQ ID NO: 22683 - DNA, 25 bp, S. cerevisiae
catcgtcatatgctataccttcaag

SEQ ID NO: 22684 - DNA, 25 bp, S. cerevisiae
catagccaatctccatcaatttcaa

SEQ ID NO: 22685 - DNA, 25 bp, S. cerevisiae
catatcagcgaccacacaatctaat

SEQ ID NO: 22686 - DNA, 25 bp, S. cerevisiae
gccacttgtgtgttgagaccagacc

SEQ ID NO: 22687 - DNA, 25 bp, S. cerevisiae
catagaatgatgattgcggccacca

SEQ ID NO: 22688 - DNA, 25 bp, S. cerevisiae
ctcctttattagtggatacgcccga

SEQ ID NO: 22689 - DNA, 25 bp, S. cerevisiae
ctcacattgaattggttgttaccga

SEQ ID NO: 22690 - DNA, 25 bp, S. cerevisiae
catctaatgtttttggttccgtact

SEQ ID NO: 22691 - DNA, 25 bp, S. cerevisiae
catctccatcatatacattttctcc

SEQ ID NO: 22692 - DNA, 25 bp, S. cerevisiae
catatctattttgcctcattctgaa

SEQ ID NO: 22693 - DNA, 25 bp, S. cerevisiae
cattttgtcatactcggttcgtggt

SEQ ID NO: 22694 - DNA, 25 bp, S. cerevisiae
catattttttattcgctgcaccaaa

SEQ ID NO: 22695 - DNA, 25 bp, S. cerevisiae
catcaccttttttctctaccaatag

SEQ ID NO: 22696 - DNA, 25 bp, S. cerevisiae
cattgaacttttgtctaccaatatg

SEQ ID NO: 22697 - DNA, 25 bp, S. cerevisiae
cattgatgatcctcttccgttcaaa

SEQ ID NO: 22698 - DNA, 25 bp, S. cerevisiae
catcgatgattccttacctttgcaa

SEQ ID NO: 22699 - DNA, 25 bp, S. cerevisiae
catcggcgttatgttgtctgcattt

SEQ ID NO: 22700 - DNA, 25 bp, S. cerevisiae
catcggtctttgacagtgcctgatt

SEQ ID NO: 22701 - DNA, 25 bp, S. cerevisiae
cattgagcgtcggagaagcccttat

SEQ ID NO: 22702 - DNA, 25 bp, S. cerevisiae
cttgcatgctctttctaaaccttta

SEQ ID NO: 22703 - DNA, 25 bp, S. cerevisiae
catttgctattttccaacgttgtga

SEQ ID NO: 22704 - DNA, 25 bp, S. cerevisiae
cattgcactctttgttccgtaaggt

SEQ ID NO: 22705 - DNA, 25 bp, S. cerevisiae
cattccatcttctaatgactgtagt

SEQ ID NO: 22706 - DNA, 25 bp, S. cerevisiae
cattgtgatcctcctatgttgtagt

SEQ ID NO: 22707 - DNA, 25 bp, S. cerevisiae
catatccagccgctctttatgagag

SEQ ID NO: 22708 - DNA, 25 bp, S. cerevisiae
ctaccgccgggtttgggatcgcatg

SEQ ID NO: 22709 - DNA, 25 bp, S. cerevisiae
catcgtcacgacatcttgggaaaga

SEQ ID NO: 22710 - DNA, 25 bp, S. cerevisiae
cttccgctatcgcatctagttgatg

SEQ ID NO: 22711 - DNA, 25 bp, S. cerevisiae
ctttcgatgtcgcaccagattggga

SEQ ID NO: 22712 - DNA, 25 bp, S. cerevisiae
catcttccgcatccgaacaatatga

SEQ ID NO: 22713 - DNA, 25 bp, S. cerevisiae
catttccttgtcaactctgtcttat

SEQ ID NO: 22714 - DNA, 25 bp, S. cerevisiae
catttctcgttatgccatggcttta

SEQ ID NO: 22715 - DNA, 25 bp, S. cerevisiae
cattattttgtgcagccatggcgct

SEQ ID NO: 22716 - DNA, 25 bp, S. cerevisiae
cttgagtgtattgagggtccccatt

SEQ ID NO: 22717 - DNA, 25 bp, S. cerevisiae
cttgaagttcttgggaagagccgaa

SEQ ID NO: 22718 - DNA, 25 bp, S. cerevisiae
catttatttgttttgggtgtctgta

SEQ ID NO: 22719 - DNA, 25 bp, S. cerevisiae
catattgtttttctgcctgtttgcc

SEQ ID NO: 22720 - DNA, 25 bp, S. cerevisiae
ctataatttccgtccaatgggcttt

SEQ ID NO: 22721 - DNA, 25 bp, S. cerevisiae
cttttccgccatcaaatctcagagg

SEQ ID NO: 22722 - DNA, 25 bp, S. cerevisiae
cttcactaccgacaaattgagatca

SEQ ID NO: 22723 - DNA, 25 bp, S. cerevisiae
ctaagctaccgcctaattttgatga

SEQ ID NO: 22724 - DNA, 25 bp, S. cerevisiae
ctagcgctacctgataacgttgtta

SEQ ID NO: 22725 - DNA, 25 bp, S. cerevisiae
ctgccgattggcgttgaaaggttta

SEQ ID NO: 22726 - DNA, 25 bp, S. cerevisiae
ctccgttggcgtcacaagactatat

SEQ ID NO: 22727 - DNA, 25 bp, S. cerevisiae
cttcgttaccacacagagatccaat

SEQ ID NO: 22728 - DNA, 25 bp, S. cerevisiae
cattgggtccggatggattgcctat

SEQ ID NO: 22729 - DNA, 25 bp, S. cerevisiae
catacttatctttggccgctggttt

SEQ ID NO: 22730 - DNA, 25 bp, S. cerevisiae
catactctcaaagatccccttagaa

SEQ ID NO: 22731 - DNA, 25 bp, S. cerevisiae
catactttgagctttaggcctataa

SEQ ID NO: 22732 - DNA, 25 bp, S. cerevisiae
catacgttcgttcagactattcaag

SEQ ID NO: 22733 - DNA, 25 bp, S. cerevisiae
cattcgtctacaattgagcctatta

SEQ ID NO: 22734 - DNA, 25 bp, S. cerevisiae
catatttcgcggttctttgattggt

SEQ ID NO: 22735 - DNA, 25 bp, S. cerevisiae
cattttctcgagatctggtagcgtt

SEQ ID NO: 22736 - DNA, 25 bp, S. cerevisiae
catttttgggtttagttgctgcttc

SEQ ID NO: 22737 - DNA, 25 bp, S. cerevisiae
cttggttgggtattcttctgtttct

SEQ ID NO: 22738 - DNA, 25 bp, S. cerevisiae
gtaggttttctatcctttcgttgag

SEQ ID NO: 22739 - DNA, 25 bp, S. cerevisiae
ccgaatccaattgcccgacattaat

SEQ ID NO: 22740 - DNA, 25 bp, S. cerevisiae
cggaacaaactatcacctctatcaa

SEQ ID NO: 22741 - DNA, 25 bp, S. cerevisiae
cattccattagatatgtggtcccta

SEQ ID NO: 22742 - DNA, 25 bp, S. cerevisiae
catatcacattttccacatggaccc

SEQ ID NO: 22743 - DNA, 25 bp, S. cerevisiae
cattggctggttgcaagagagcctt

SEQ ID NO: 22744 - DNA, 25 bp, S. cerevisiae
cattgcggaattgaagcctgatctt

SEQ ID NO: 22745 - DNA, 25 bp, S. cerevisiae
cattgatgagttttgccggtgaagc

SEQ ID NO: 22746 - DNA, 25 bp, S. cerevisiae
cattgggttcatttgctggcaacta

SEQ ID NO: 22747 - DNA, 25 bp, S. cerevisiae
catcttggatcaacaggtgccactt

SEQ ID NO: 22748 - DNA, 25 bp, S. cerevisiae
cttatgctgcaatcaaacctcggtg

SEQ ID NO: 22749 - DNA, 25 bp, S. cerevisiae
cattttgggcgcaacaggcttgtgt

SEQ ID NO: 22750 - DNA, 25 bp, S. cerevisiae
cattgttggacagaatcgttgcttt

SEQ ID NO: 22751 - DNA, 25 bp, S. cerevisiae
cattgtattggataacgccgctgta

SEQ ID NO: 22752 - DNA, 25 bp, S. cerevisiae
cattgagtttaaatatccgcctggg

SEQ ID NO: 22753 - DNA, 25 bp, S. cerevisiae
cttgaatttaattaccaccccagca

SEQ ID NO: 22754 - DNA, 25 bp, S. cerevisiae
cattcaatattcaagaaccccggaa

SEQ ID NO: 22755 - DNA, 25 bp, S. cerevisiae
cattgttcaatcaaaccccgttaca

SEQ ID NO: 22756 - DNA, 25 bp, S. cerevisiae
catttttatcccacgcggtgtgaag

SEQ ID NO: 22757 - DNA, 25 bp, S. cerevisiae
cttggactatatcttctcttattga

SEQ ID NO: 22758 - DNA, 25 bp, S. cerevisiae
catttctctaattactactgttgga

SEQ ID NO: 22759 - DNA, 25 bp, S. cerevisiae
catatatatacccacacactctctc

SEQ ID NO: 22760 - DNA, 25 bp, S. cerevisiae
catatatatacaccacacccacaca

SEQ ID NO: 22761 - DNA, 25 bp, S. cerevisiae
catatatatacaccacacccacaca

SEQ ID NO: 22762 - DNA, 25 bp, S. cerevisiae
cttgtacatcattgccgtcaaaggt

SEQ ID NO: 22763 - DNA, 25 bp, S. cerevisiae
cattgggtgcttgctgactacagga

SEQ ID NO: 22764 - DNA, 25 bp, S. cerevisiae
cttgtcagttgtgaagcctctggat

SEQ ID NO: 22765 - DNA, 25 bp, S. cerevisiae
cttgccgcttgtcagaactctctag

SEQ ID NO: 22766 - DNA, 25 bp, S. cerevisiae
cattgcgttatgatgctttagctga

SEQ ID NO: 22767 - DNA, 25 bp, S. cerevisiae
cataaaaacgctttgatgggcttaa

SEQ ID NO: 22768 - DNA, 25 bp, S. cerevisiae
cttacagaaccatatcttgcctcta

SEQ ID NO: 22769 - DNA, 25 bp, S. cerevisiae
ctgctactgattcgccctttaacta

SEQ ID NO: 22770 - DNA, 25 bp, S. cerevisiae
cttgaccttagccactttaactgaa

SEQ ID NO: 22771 - DNA, 25 bp, S. cerevisiae
cttgctactactttcgatattctcg

SEQ ID NO: 22772 - DNA, 25 bp, S. cerevisiae
catatctcagccgtatttggtctat

SEQ ID NO: 22773 - DNA, 25 bp, S. cerevisiae
cttgcaaaccattgatctgagcttt

SEQ ID NO: 22774 - DNA, 25 bp, S. cerevisiae
cttgcaagaatctgtcgaagcctac

SEQ ID NO: 22775 - DNA, 25 bp, S. cerevisiae
cttgaattgtccctctttgccaaca

SEQ ID NO: 22776 - DNA, 25 bp, S. cerevisiae
cttgaaattcccattgcctcacaga

SEQ ID NO: 22777 - DNA, 25 bp, S. cerevisiae
cattgaacacttgttacgggtcgga

SEQ ID NO: 22778 - DNA, 25 bp, S. cerevisiae
cattcaagccttaattcacggtctg

SEQ ID NO: 22779 - DNA, 25 bp, S. cerevisiae
cttcattggcagaggttacgacgat

SEQ ID NO: 22780 - DNA, 25 bp, S. cerevisiae
cattacctaagttatctccaaccct

SEQ ID NO: 22781 - DNA, 25 bp, S. cerevisiae
cttcaccaagagtcaattccagcac

SEQ ID NO: 22782 - DNA, 25 bp, S. cerevisiae
cattgccacaatggatcagattgag

SEQ ID NO: 22783 - DNA, 25 bp, S. cerevisiae
cattggttctcagtgccatgaagtt

SEQ ID NO: 22784 - DNA, 25 bp, S. cerevisiae
cttggtactggcttcatctgatatt

SEQ ID NO: 22785 - DNA, 25 bp, S. cerevisiae
cattggcccttggtttgatttctta

SEQ ID NO: 22786 - DNA, 25 bp, S. cerevisiae
catactacgcttatctttctcttgt

SEQ ID NO: 22787 - DNA, 25 bp, S. cerevisiae
cattcgctgcatcctttgtagaggt

SEQ ID NO: 22788 - DNA, 25 bp, S. cerevisiae
cattggcgcatcatagggacagaat

SEQ ID NO: 22789 - DNA, 25 bp, S. cerevisiae
cattgccttctaccaggaccgataa

SEQ ID NO: 22790 - DNA, 25 bp, S. cerevisiae
cattctatttagcaggacgactaca

SEQ ID NO: 22791 - DNA, 25 bp, S. cerevisiae
cattcttttagcatacacttcccat

SEQ ID NO: 22792 - DNA, 25 bp, S. cerevisiae
cattaccacaccagctgaattctta

SEQ ID NO: 22793 - DNA, 25 bp, S. cerevisiae
cttctccccatgcattgagcaagta

SEQ ID NO: 22794 - DNA, 25 bp, S. cerevisiae
cattcactacccttcgagcgacata

SEQ ID NO: 22795 - DNA, 25 bp, S. cerevisiae
cattgactaaaattgctgaggaaca

SEQ ID NO: 22796 - DNA, 25 bp, S. cerevisiae
cattgagttcaattcgcgagtacga

SEQ ID NO: 22797 - DNA, 25 bp, S. cerevisiae
cattttcgccaaagcctgtgagatc

SEQ ID NO: 22798 - DNA, 25 bp, S. cerevisiae
cttatgtcccctagactggatcgaa

SEQ ID NO: 22799 - DNA, 25 bp, S. cerevisiae
cattccgtttgcagtggttggttct

SEQ ID NO: 22800 - DNA, 25 bp, S. cerevisiae
cattaggttctgttggcgttgttat

SEQ ID NO: 22801 - DNA, 25 bp, S. cerevisiae
catttgtggcgttagcctgtcctaa

SEQ ID NO: 22802 - DNA, 25 bp, S. cerevisiae
cttacagtgctttaggttccatcaa

SEQ ID NO: 22803 - DNA, 25 bp, S. cerevisiae
cattatgttttgtggcccggctaaa

SEQ ID NO: 22804 - DNA, 25 bp, S. cerevisiae
cattatgttttgtggtccaagctaa

SEQ ID NO: 22805 - DNA, 25 bp, S. cerevisiae
cattatgcttttctggtctcctcgg

SEQ ID NO: 22806 - DNA, 25 bp, S. cerevisiae
cattgatctagcatccttggaggcg

SEQ ID NO: 22807 - DNA, 25 bp, S. cerevisiae
cattatctagaagcttagtcggaac

SEQ ID NO: 22808 - DNA, 25 bp, S. cerevisiae
ctaggcctgaaagatgttcgctcca

SEQ ID NO: 22809 - DNA, 25 bp, S. cerevisiae
tctaccgtcgtacccaaaaccaatg

SEQ ID NO: 22810 - DNA, 25 bp, S. cerevisiae
cattccgtcagttacctttacgaat

SEQ ID NO: 22811 - DNA, 25 bp, S. cerevisiae
ctttagtagcaactcctttttggat

SEQ ID NO: 22812 - DNA, 25 bp, S. cerevisiae
cttgattctaaagcgtctgtcgttg

SEQ ID NO: 22813 - DNA, 25 bp, S. cerevisiae
cttacctcataagtctatctccgat

SEQ ID NO: 22814 - DNA, 25 bp, S. cerevisiae
catttcatctctggttacacttcta

SEQ ID NO: 22815 - DNA, 25 bp, S. cerevisiae
cattgcttggccattaagtcgaaaa

SEQ ID NO: 22816 - DNA, 25 bp, S. cerevisiae
catttttccttttctgttggaggca

SEQ ID NO: 22817 - DNA, 25 bp, S. cerevisiae
catttttccttttctcattgttctc

SEQ ID NO: 22818 - DNA, 25 bp, S. cerevisiae
cattctttggtttgtctttgctatc

SEQ ID NO: 22819 - DNA, 25 bp, S. cerevisiae
cattctggtgtactagcttggtgtt

SEQ ID NO: 22820 - DNA, 25 bp, S. cerevisiae
cattcgaggattttgcttggctgac

SEQ ID NO: 22821 - DNA, 25 bp, S. cerevisiae
cattaaggctctcagtatcgatcta

SEQ ID NO: 22822 - DNA, 25 bp, S. cerevisiae
cttcgagtgggagttagcagtatca

SEQ ID NO: 22823 - DNA, 25 bp, S. cerevisiae
cattcttgcggtgtggctcgtacaa

SEQ ID NO: 22824 - DNA, 25 bp, S. cerevisiae
cttactctccaaagcccgttaaatg

SEQ ID NO: 22825 - DNA, 25 bp, S. cerevisiae
cgccaactttatccgacgttaacag

SEQ ID NO: 22826 - DNA, 25 bp, S. cerevisiae
ctacgggttacagtcatcgttgaaa

SEQ ID NO: 22827 - DNA, 25 bp, S. cerevisiae
cattggcggcttatatcccttaata

SEQ ID NO: 22828 - DNA, 25 bp, S. cerevisiae
catttcaggcttcatcatctacttt

SEQ ID NO: 22829 - DNA, 25 bp, S. cerevisiae
cattcggagatactgcttgcgtttt

SEQ ID NO: 22830 - DNA, 25 bp, S. cerevisiae
ttagaccgcggtattccattacgtc

SEQ ID NO: 22831 - DNA, 25 bp, S. cerevisiae
cattacccacgttcgatttgcgaga

SEQ ID NO: 22832 - DNA, 25 bp, S. cerevisiae
cattacgcccgaaggtttgccagtt

SEQ ID NO: 22833 - DNA, 25 bp, S. cerevisiae
cttattccaagaaggtgttgttgtc

SEQ ID NO: 22834 - DNA, 25 bp, S. cerevisiae
cttattccaagaaggtgttgttgtc

SEQ ID NO: 22835 - DNA, 25 bp, S. cerevisiae
cttgtcacccaagagtattgttcca

SEQ ID NO: 22836 - DNA, 25 bp, S. cerevisiae
catttcccgaatgtgtatgctgctc

SEQ ID NO: 22837 - DNA, 25 bp, S. cerevisiae
cattctttgaggacatctttggatc

SEQ ID NO: 22838 - DNA, 25 bp, S. cerevisiae
catttactatgtgcatcgcgggata

SEQ ID NO: 22839 - DNA, 25 bp, S. cerevisiae
catattgactatgccttggtgaatt

SEQ ID NO: 22840 - DNA, 25 bp, S. cerevisiae
cttcgacttgggactattggacttc

SEQ ID NO: 22841 - DNA, 25 bp, S. cerevisiae
cattttggcgatgactgtgctgaaa

SEQ ID NO: 22842 - DNA, 25 bp, S. cerevisiae
catttcgccggctatatgcattgac

SEQ ID NO: 22843 - DNA, 25 bp, S. cerevisiae
catttactctgtggccatatctttg

SEQ ID NO: 22844 - DNA, 25 bp, S. cerevisiae
catttctcacttggctgatgacggt

SEQ ID NO: 22845 - DNA, 25 bp, S. cerevisiae
ctttctacttacttgaaggtctaca

SEQ ID NO: 22846 - DNA, 25 bp, S. cerevisiae
cggcgcacctattgtaaggagtctt

SEQ ID NO: 22847 - DNA, 25 bp, S. cerevisiae
ctaccactcgtacaagggcttctaa

SEQ ID NO: 22848 - DNA, 25 bp, S. cerevisiae
ctaccaccgcaacaaacgcattttg

SEQ ID NO: 22849 - DNA, 25 bp, S. cerevisiae
cttccttacccactgcattaataaa

SEQ ID NO: 22850 - DNA, 25 bp, S. cerevisiae
cttcgtttcccatcttatataaggg

SEQ ID NO: 22851 - DNA, 25 bp, S. cerevisiae
cattattgctgatcgctgcggttga

SEQ ID NO: 22852 - DNA, 25 bp, S. cerevisiae
cattatgtgtggctgtagtatctac

SEQ ID NO: 22853 - DNA, 25 bp, S. cerevisiae
cattgtggcgctgttcttgttggaa

SEQ ID NO: 22854 - DNA, 25 bp, S. cerevisiae
cattttccctttaggctttgccata

SEQ ID NO: 22855 - DNA, 25 bp, S. cerevisiae
cttactccgctgctgcaggatttaa

SEQ ID NO: 22856 - DNA, 25 bp, S. cerevisiae
cattcaggctgcgttatatgagatt

SEQ ID NO: 22857 - DNA, 25 bp, S. cerevisiae
cattgttggtgattcctctgcagaa

SEQ ID NO: 22858 - DNA, 25 bp, S. cerevisiae
ctgatgtagagctgtgccctggttc

SEQ ID NO: 22859 - DNA, 25 bp, S. cerevisiae
ctatgttaggaagcggtctcccctg

SEQ ID NO: 22860 - DNA, 25 bp, S. cerevisiae
cttggccagggatcgatgtccacaa

SEQ ID NO: 22861 - DNA, 25 bp, S. cerevisiae
cttggactgtggtgatctcctggaa

SEQ ID NO: 22862 - DNA, 25 bp, S. cerevisiae
cattggttagactacctcaattgag

SEQ ID NO: 22863 - DNA, 25 bp, S. cerevisiae
cttcgacgcatactccatacaagga

SEQ ID NO: 22864 - DNA, 25 bp, S. cerevisiae
cttggatcggtcacgcatgaatgcc

SEQ ID NO: 22865 - DNA, 25 bp, S. cerevisiae
cttggaggcgctacttggtgctaca

SEQ ID NO: 22866 - DNA, 25 bp, S. cerevisiae
cttccggatatattgggctctgacc

SEQ ID NO: 22867 - DNA, 25 bp, S. cerevisiae
cattgtcgaatgtagcggtgctcta

SEQ ID NO: 22868 - DNA, 25 bp, S. cerevisiae
cattgtcgcaacaggttccattgga

SEQ ID NO: 22869 - DNA, 25 bp, S. cerevisiae
cttcgcgcaagcaacagtttttctg

SEQ ID NO: 22870 - DNA, 25 bp, S. cerevisiae
ctgcactattaactgggaatttttt

SEQ ID NO: 22871 - DNA, 25 bp, S. cerevisiae
cttgcgttcaagaggtattcatttt

SEQ ID NO: 22872 - DNA, 25 bp, S. cerevisiae
cttctttcagttgggcatctttttt

SEQ ID NO: 22873 - DNA, 25 bp, S. cerevisiae
cattgatgaacttgtggtgctggac

SEQ ID NO: 22874 - DNA, 25 bp, S. cerevisiae
ctatagagcctattggtcggacact

SEQ ID NO: 22875 - DNA, 25 bp, S. cerevisiae
ctattgcagccggtggtcgatatga

SEQ ID NO: 22876 - DNA, 25 bp, S. cerevisiae
cattccgcccattctggagtatatt

SEQ ID NO: 22877 - DNA, 25 bp, S. cerevisiae
cattttcttgcttcgtctattctga

SEQ ID NO: 22878 - DNA, 25 bp, S. cerevisiae
cattgcctatttggtccttggataa

SEQ ID NO: 22879 - DNA, 25 bp, S. cerevisiae
cattgcctcattattcccattgaac

SEQ ID NO: 22880 - DNA, 25 bp, S. cerevisiae
cattgactcttcctgtcggtatgaa

SEQ ID NO: 22881 - DNA, 25 bp, S. cerevisiae
cttgagatttgcgttcggcctaaac

SEQ ID NO: 22882 - DNA, 25 bp, S. cerevisiae
cattgttctttcattttggcagtac

SEQ ID NO: 22883 - DNA, 25 bp, S. cerevisiae
cattgtgatctatttattcccgaag

SEQ ID NO: 22884 - DNA, 25 bp, S. cerevisiae
ctttattcagttcacccaggagatt

SEQ ID NO: 22885 - DNA, 25 bp, S. cerevisiae
ctattttcgtcgacaccgctagaaa

SEQ ID NO: 22886 - DNA, 25 bp, S. cerevisiae
ctttatcttggagcccgcctgtgaa

SEQ ID NO: 22887 - DNA, 25 bp, S. cerevisiae
ctttttctgaaggataacgctgcga

SEQ ID NO: 22888 - DNA, 25 bp, S. cerevisiae
cttctcctatatctttacaccaaat

SEQ ID NO: 22889 - DNA, 25 bp, S. cerevisiae
cttgcatctgcattatctaccttac

SEQ ID NO: 22890 - DNA, 25 bp, S. cerevisiae
ctagctctgctaataacacgaccac

SEQ ID NO: 22891 - DNA, 25 bp, S. cerevisiae
ctactaatgacttaccagacgacgt

SEQ ID NO: 22892 - DNA, 25 bp, S. cerevisiae
ctcgtggtatgtaacctactgcgta

SEQ ID NO: 22893 - DNA, 25 bp, S. cerevisiae
ctttagtcatcggtatcagtgcata

SEQ ID NO: 22894 - DNA, 25 bp, S. cerevisiae
cttctatggtccgatcctgatgata

SEQ ID NO: 22895 - DNA, 25 bp, S. cerevisiae
cattcttggatctttctctggatat

SEQ ID NO: 22896 - DNA, 25 bp, S. cerevisiae
cattcatcactgactttgcgtgtat

SEQ ID NO: 22897 - DNA, 25 bp, S. cerevisiae
cattcccagatctttgcgactttga

SEQ ID NO: 22898 - DNA, 25 bp, S. cerevisiae
cattacacatcgaattgggcactta

SEQ ID NO: 22899 - DNA, 25 bp, S. cerevisiae
cattacgcacatatagaggactcat

SEQ ID NO: 22900 - DNA, 25 bp, S. cerevisiae
cattgagggagcttgtcgacgacat

SEQ ID NO: 22901 - DNA, 25 bp, S. cerevisiae
cattctggtgatgtgtccattccat

SEQ ID NO: 22902 - DNA, 25 bp, S. cerevisiae
cattcggtgattatcgtgacgctgt

SEQ ID NO: 22903 - DNA, 25 bp, S. cerevisiae
cttgcccaagggtcataagcatgaa

SEQ ID NO: 22904 - DNA, 25 bp, S. cerevisiae
ctttcccaaagatatagcgcagaga

SEQ ID NO: 22905 - DNA, 25 bp, S. cerevisiae
ctaggctacaaagccaagcaaggtt

SEQ ID NO: 22906 - DNA, 25 bp, S. cerevisiae
cattgcctctccaagacatcaagaa

SEQ ID NO: 22907 - DNA, 25 bp, S. cerevisiae
cattcccgcagcaattttcgagaga

SEQ ID NO: 22908 - DNA, 25 bp, S. cerevisiae
cattggccatgatgtttttgatgtg

SEQ ID NO: 22909 - DNA, 25 bp, S. cerevisiae
cttgtggtgctgttttttatcatga

SEQ ID NO: 22910 - DNA, 25 bp, S. cerevisiae
cattgctggtgggttttctttgcta

SEQ ID NO: 22911 - DNA, 25 bp, S. cerevisiae
cattgcatttacttggagacccaga

SEQ ID NO: 22912 - DNA, 25 bp, S. cerevisiae
cattgcctatgaggaggcggcctta

SEQ ID NO: 22913 - DNA, 25 bp, S. cerevisiae
cattgtttctattgtgtggctcttg

SEQ ID NO: 22914 - DNA, 25 bp, S. cerevisiae
cattcatggttcttgtgggctggat

SEQ ID NO: 22915 - DNA, 25 bp, S. cerevisiae
cattgctccaggtgctatcgataat

SEQ ID NO: 22916 - DNA, 25 bp, S. cerevisiae
cttgcctcatggtgtttgtaacgct

SEQ ID NO: 22917 - DNA, 25 bp, S. cerevisiae
ctacccggtggcatttcaattgagc

SEQ ID NO: 22918 - DNA, 25 bp, S. cerevisiae
cttcgcctggccaatctttaattaa

SEQ ID NO: 22919 - DNA, 25 bp, S. cerevisiae
cttcagactggcaccgacaaagcaa

SEQ ID NO: 22920 - DNA, 25 bp, S. cerevisiae
ctccaagtgcgcctgccaaaataaa

SEQ ID NO: 22921 - DNA, 25 bp, S. cerevisiae
ctcaaatgagcggttcggaacaaaa

SEQ ID NO: 22922 - DNA, 25 bp, S. cerevisiae
cttctgggacggttcgatacgcaat

SEQ ID NO: 22923 - DNA, 25 bp, S. cerevisiae
ctattgtggaatttgctcctaccca

SEQ ID NO: 22924 - DNA, 25 bp, S. cerevisiae
cttccctgtggttgaccatcagata

SEQ ID NO: 22925 - DNA, 25 bp, S. cerevisiae
ctatctccgggaaacaacaacagta

SEQ ID NO: 22926 - DNA, 25 bp, S. cerevisiae
cttcaagttttcaccttcacaactg

SEQ ID NO: 22927 - DNA, 25 bp, S. cerevisiae
cttcaagttattatgccagccacag

SEQ ID NO: 22928 - DNA, 25 bp, S. cerevisiae
ctttgccaaagatcaagaccgtcag

SEQ ID NO: 22929 - DNA, 25 bp, S. cerevisiae
ctttggaaaagattggtatcgtcga

SEQ ID NO: 22930 - DNA, 25 bp, S. cerevisiae
ctttcgcgaataattggtaatgtca

SEQ ID NO: 22931 - DNA, 25 bp, S. cerevisiae
cttacggttcttgggacgatgtcac

SEQ ID NO: 22932 - DNA, 25 bp, S. cerevisiae
ctttccaagctgctcacccaactga

SEQ ID NO: 22933 - DNA, 25 bp, S. cerevisiae
ctttacaactgcctcattcgtggaa

SEQ ID NO: 22934 - DNA, 25 bp, S. cerevisiae
cttacagcgtcagcctcttgaggaa

SEQ ID NO: 22935 - DNA, 25 bp, S. cerevisiae
cattggcccatcacttcgtaagaag

SEQ ID NO: 22936 - DNA, 25 bp, S. cerevisiae
cattggcttcaaacatcgggcacga

SEQ ID NO: 22937 - DNA, 25 bp, S. cerevisiae
cattgtcttcgttatcggagttgca

SEQ ID NO: 22938 - DNA, 25 bp, S. cerevisiae
ctttcaagcctggtcaacctatcaa

SEQ ID NO: 22939 - DNA, 25 bp, S. cerevisiae
cttctgaacccactccaataacaaa

SEQ ID NO: 22940 - DNA, 25 bp, S. cerevisiae
cctaatacccgttcacagagaaagt

SEQ ID NO: 22941 - DNA, 25 bp, S. cerevisiae
ccaaataccctttccgcaaatgaga

SEQ ID NO: 22942 - DNA, 25 bp, S. cerevisiae
ctaagatccgtgtcccattgaatca

SEQ ID NO: 22943 - DNA, 25 bp, S. cerevisiae
ctaccagtcggtgccatcatgaact

SEQ ID NO: 22944 - DNA, 25 bp, S. cerevisiae
cttggcagtcgactacatcttgaga

SEQ ID NO: 22945 - DNA, 25 bp, S. cerevisiae
cttggagtgctccatgattctcgga

SEQ ID NO: 22946 - DNA, 25 bp, S. cerevisiae
cattgcagggtttttcactggtggc

SEQ ID NO: 22947 - DNA, 25 bp, S. cerevisiae
cttgcgtggtggttaggctttccaa

SEQ ID NO: 22948 - DNA, 25 bp, S. cerevisiae
cattgccttttgtccttggtcgaag

SEQ ID NO: 22949 - DNA, 25 bp, S. cerevisiae
cattccatctttggccgaggtcgaa

SEQ ID NO: 22950 - DNA, 25 bp, S. cerevisiae
ctttactatccggtggtggccaaga

SEQ ID NO: 22951 - DNA, 25 bp, S. cerevisiae
ctttacccgtggcattgggcaagat

SEQ ID NO: 22952 - DNA, 25 bp, S. cerevisiae
gcccttccggtctgttagagctgga

SEQ ID NO: 22953 - DNA, 25 bp, S. cerevisiae
cttttcaatctttcacttcctgaac

SEQ ID NO: 22954 - DNA, 25 bp, S. cerevisiae
cttcacgtcgttatttgcattcttc

SEQ ID NO: 22955 - DNA, 25 bp, S. cerevisiae
gctttcgatactcacggtaacgtta

SEQ ID NO: 22956 - DNA, 25 bp, S. cerevisiae
ctattcttactgaacggttactggt

SEQ ID NO: 22957 - DNA, 25 bp, S. cerevisiae
gtcgtccaactgaacggtagattga

SEQ ID NO: 22958 - DNA, 25 bp, S. cerevisiae
ctcggccaagtcaagcggtatcatt

SEQ ID NO: 22959 - DNA, 25 bp, S. cerevisiae
cttggccaatgtttctagtgctagt

SEQ ID NO: 22960 - DNA, 25 bp, S. cerevisiae
cttatttttcgtatggatgctcctt

SEQ ID NO: 22961 - DNA, 25 bp, S. cerevisiae
ctttatctttccacatggcttctat

SEQ ID NO: 22962 - DNA, 25 bp, S. cerevisiae
cttggcattgtctttgaggttccga

SEQ ID NO: 22963 - DNA, 25 bp, S. cerevisiae
cttgggctccaattgcttatgttgt

SEQ ID NO: 22964 - DNA, 25 bp, S. cerevisiae
ctttgacgcaatctctgatagctgt

SEQ ID NO: 22965 - DNA, 25 bp, S. cerevisiae
ctttgacacaagtttatatatcccc

SEQ ID NO: 22966 - DNA, 25 bp, S. cerevisiae
cttatacccagctttacatgatcct

SEQ ID NO: 22967 - DNA, 25 bp, S. cerevisiae
cttcctctacgccaaaatcattttt

SEQ ID NO: 22968 - DNA, 25 bp, S. cerevisiae
cttcctcacggctcaaacattgtga

SEQ ID NO: 22969 - DNA, 25 bp, S. cerevisiae
ctttgcgtctctgcccgaagaaatt

SEQ ID NO: 22970 - DNA, 25 bp, S. cerevisiae
cattgtgaccctggcaaatttgcaa

SEQ ID NO: 22971 - DNA, 25 bp, S. cerevisiae
cttttccacggatattccaattgtg

SEQ ID NO: 22972 - DNA, 25 bp, S. cerevisiae
ctatttcccgcgatacgtattttgg

SEQ ID NO: 22973 - DNA, 25 bp, S. cerevisiae
cttcctatggcacagggcattttga

SEQ ID NO: 22974 - DNA, 25 bp, S. cerevisiae
cttctacggcattggctggttttga

SEQ ID NO: 22975 - DNA, 25 bp, S. cerevisiae
ctcatcggctggttggcaaacgtta

SEQ ID NO: 22976 - DNA, 25 bp, S. cerevisiae
ctacttaaagcccaagcctcttaat

SEQ ID NO: 22977 - DNA, 25 bp, S. cerevisiae
ctgcagctccaataaagacctctac

SEQ ID NO: 22978 - DNA, 25 bp, S. cerevisiae
ctacctcatggttaagacactttgc

SEQ ID NO: 22979 - DNA, 25 bp, S. cerevisiae
cttccagtgggttgatgacagctat

SEQ ID NO: 22980 - DNA, 25 bp, S. cerevisiae
ctttgaggctggttcagacgctgat

SEQ ID NO: 22981 - DNA, 25 bp, S. cerevisiae
ctagatgcttggactgaatttcgaa

SEQ ID NO: 22982 - DNA, 25 bp, S. cerevisiae
ctacagtttttcttggctcctaaat

SEQ ID NO: 22983 - DNA, 25 bp, S. cerevisiae
ctagaaacttctcactggccataat

SEQ ID NO: 22984 - DNA, 25 bp, S. cerevisiae
cgaaaagttccaaagagcctctatg

SEQ ID NO: 22985 - DNA, 25 bp, S. cerevisiae
ctttccaagtcgctcatccaactga

SEQ ID NO: 22986 - DNA, 25 bp, S. cerevisiae
cttccacaaatccaattaccacagg

SEQ ID NO: 22987 - DNA, 25 bp, S. cerevisiae
ctttgactactgagctgtccttaga

SEQ ID NO: 22988 - DNA, 25 bp, S. cerevisiae
ctttggaacagagcgtccttgcgtt

SEQ ID NO: 22989 - DNA, 25 bp, S. cerevisiae
cttgggacaactaagctcctatgtt

SEQ ID NO: 22990 - DNA, 25 bp, S. cerevisiae
cttggtggtgtctacatcatgcgat

SEQ ID NO: 22991 - DNA, 25 bp, S. cerevisiae
cttgtgtttcataaggtgggccatc

SEQ ID NO: 22992 - DNA, 25 bp, S. cerevisiae
cttttattcattatagtggcggcat

SEQ ID NO: 22993 - DNA, 25 bp, S. cerevisiae
cttgttattatcaaccacgcctttg

SEQ ID NO: 22994 - DNA, 25 bp, S. cerevisiae
ctattactatcacaacccgtttcaa

SEQ ID NO: 22995 - DNA, 25 bp, S. cerevisiae
ctttagtgatcgctgactctggtat

SEQ ID NO: 22996 - DNA, 25 bp, S. cerevisiae
cttatcacccaacatcttcatagga

SEQ ID NO: 22997 - DNA, 25 bp, S. cerevisiae
ctactttttaggagacagcgtcgag

SEQ ID NO: 22998 - DNA, 25 bp, S. cerevisiae
cttcgcctttatcgttaactttcag

SEQ ID NO: 22999 - DNA, 25 bp, S. cerevisiae
cttcacctcttacgacagaactttg

SEQ ID NO: 23000 - DNA, 25 bp, S. cerevisiae
cttgtctcaattggctgcccaaatg

SEQ ID NO: 23001 - DNA, 25 bp, S. cerevisiae
cttgtacattatcgccgtcaaaggc

SEQ ID NO: 23002 - DNA, 25 bp, S. cerevisiae
cttccgctttgccatttaaggagga

SEQ ID NO: 23003 - DNA, 25 bp, S. cerevisiae
cttccctatttcgtacttggcaaga

SEQ ID NO: 23004 - DNA, 25 bp, S. cerevisiae
cttccgtattttacctcttgctata

SEQ ID NO: 23005 - DNA, 25 bp, S. cerevisiae
cttcctcttttcatgatagcgtgtc

SEQ ID NO: 23006 - DNA, 25 bp, S. cerevisiae
cttcgctgcagattcttgtgttaaa

SEQ ID NO: 23007 - DNA, 25 bp, S. cerevisiae
cttcccactggaaactagaccttat

SEQ ID NO: 23008 - DNA, 25 bp, S. cerevisiae
cttaacccctaccatgttacattat

SEQ ID NO: 23009 - DNA, 25 bp, S. cerevisiae
cttccacccatctttttcgataaag

SEQ ID NO: 23010 - DNA, 25 bp, S. cerevisiae
cttcttacttctatccattgcaaac

SEQ ID NO: 23011 - DNA, 25 bp, S. cerevisiae
cttcttacagtcaacgttatccgca

SEQ ID NO: 23012 - DNA, 25 bp, S. cerevisiae
ctatcttgggcgtggtgtcacacca

SEQ ID NO: 23013 - DNA, 25 bp, S. cerevisiae
cttccaagctgttctggcggtgaaa

SEQ ID NO: 23014 - DNA, 25 bp, S. cerevisiae
cttccaatctgttgtgccagttaga

SEQ ID NO: 23015 - DNA, 25 bp, S. cerevisiae
cttagatacgttggcaagtgctgta

SEQ ID NO: 23016 - DNA, 25 bp, S. cerevisiae
ctctacgactcctttgaacttcata

SEQ ID NO: 23017 - DNA, 25 bp, S. cerevisiae
cttaccgtcacatgctaccaattat

SEQ ID NO: 23018 - DNA, 25 bp, S. cerevisiae
ctttacaacgcatctggtccagatt

SEQ ID NO: 23019 - DNA, 25 bp, S. cerevisiae
ctattaccaccaccatttatttcta

SEQ ID NO: 23020 - DNA, 25 bp, S. cerevisiae
cttaaccaggagcttgtgaccatta

SEQ ID NO: 23021 - DNA, 25 bp, S. cerevisiae
ctatccaaacttctttcccagtaat

SEQ ID NO: 23022 - DNA, 25 bp, S. cerevisiae
cttggttctgtatttgcttctgtca

SEQ ID NO: 23023 - DNA, 25 bp, S. cerevisiae
ctatggtgcagacagattccttaca

SEQ ID NO: 23024 - DNA, 25 bp, S. cerevisiae
ctagcgtgcatcttgatatttcccc

SEQ ID NO: 23025 - DNA, 25 bp, S. cerevisiae
ctacccacaaattttggcgccttat

SEQ ID NO: 23026 - DNA, 25 bp, S. cerevisiae
ctacttattgggttttgccgtccat

SEQ ID NO: 23027 - DNA, 25 bp, S. cerevisiae
ctatctaacggtttcggtggtgtct

SEQ ID NO: 23028 - DNA, 25 bp, S. cerevisiae
cttgcgtacggtgtttgtttgtcag

SEQ ID NO: 23029 - DNA, 25 bp, S. cerevisiae
cttcgtagagttttccgattcgacg

SEQ ID NO: 23030 - DNA, 25 bp, S. cerevisiae
cgctaggcagtttttatggtcccgc

SEQ ID NO: 23031 - DNA, 25 bp, S. cerevisiae
cttgtatggttgttttcgcttctgt

SEQ ID NO: 23032 - DNA, 25 bp, S. cerevisiae
cttttgggagaacgactgtgtcatt

SEQ ID NO: 23033 - DNA, 25 bp, S. cerevisiae
gcctttaaagttcgacaggtcctct

SEQ ID NO: 23034 - DNA, 25 bp, S. cerevisiae
cttatccagggagcaagcgttaatg

SEQ ID NO: 23035 - DNA, 25 bp, S. cerevisiae
cttattcctggtgcagagaacttac

SEQ ID NO: 23036 - DNA, 25 bp, S. cerevisiae
cttatccctggtgcagagaatttat

SEQ ID NO: 23037 - DNA, 25 bp, S. cerevisiae
ctctacccgggttgaaatttgcatt

SEQ ID NO: 23038 - DNA, 25 bp, S. cerevisiae
cttcaaacagcggttggcagggatt

SEQ ID NO: 23039 - DNA, 25 bp, S. cerevisiae
cttcgtcaagcttctgcagaggttt

SEQ ID NO: 23040 - DNA, 25 bp, S. cerevisiae
ctgtcgtcagtgaacgcatgagcgg

SEQ ID NO: 23041 - DNA, 25 bp, S. cerevisiae
cttgatctggatacccgtttgtgtt

SEQ ID NO: 23042 - DNA, 25 bp, S. cerevisiae
cttatgctgttattggttccaacga

SEQ ID NO: 23043 - DNA, 25 bp, S. cerevisiae
tgctttaaacggcttccgcggagga

SEQ ID NO: 23044 - DNA, 25 bp, S. cerevisiae
ctttcttagtgatatgctccagtaa

SEQ ID NO: 23045 - DNA, 25 bp, S. cerevisiae
cttatcgtttcatcgttagtggcaa

SEQ ID NO: 23046 - DNA, 25 bp, S. cerevisiae
cttccgttgccatccgaaatggaga

SEQ ID NO: 23047 - DNA, 25 bp, S. cerevisiae
cttccattgcattcaacccattaga

SEQ ID NO: 23048 - DNA, 25 bp, S. cerevisiae
cttattctccaattctgcttctaga

SEQ ID NO: 23049 - DNA, 25 bp, S. cerevisiae
ctattattccttgcaccttggtgga

SEQ ID NO: 23050 - DNA, 25 bp, S. cerevisiae
cttgcattatgcttttgagaccgaa

SEQ ID NO: 23051 - DNA, 25 bp, S. cerevisiae
cttatttgtttctctgtcagctggt

SEQ ID NO: 23052 - DNA, 25 bp, S. cerevisiae
cttcgagggtattgttacatgatgc

SEQ ID NO: 23053 - DNA, 25 bp, S. cerevisiae
cttcaggtggtgttttgcctcatat

SEQ ID NO: 23054 - DNA, 25 bp, S. cerevisiae
cttctggtgcgaattgactcccata

SEQ ID NO: 23055 - DNA, 25 bp, S. cerevisiae
ctttgcgtggcaatatacctcatat

SEQ ID NO: 23056 - DNA, 25 bp, S. cerevisiae
cttctgggtcttccactcataagaa

SEQ ID NO: 23057 - DNA, 25 bp, S. cerevisiae
cttgctcgtcaacattccattaatt

SEQ ID NO: 23058 - DNA, 25 bp, S. cerevisiae
ctactggagtacatcattcggctga

SEQ ID NO: 23059 - DNA, 25 bp, S. cerevisiae
cttcgggctctaaagctttgctcaa

SEQ ID NO: 23060 - DNA, 25 bp, S. cerevisiae
ctaagccccgtatctatactcaata

SEQ ID NO: 23061 - DNA, 25 bp, S. cerevisiae
cttagccccgctgatgagaataaaa

SEQ ID NO: 23062 - DNA, 25 bp, S. cerevisiae
ctttcgctcctatctgaacattaca

SEQ ID NO: 23063 - DNA, 25 bp, S. cerevisiae
ctaccgggcaaaatgagtcctacat

SEQ ID NO: 23064 - DNA, 25 bp, S. cerevisiae
cttgcttcgggatattggattgtca

SEQ ID NO: 23065 - DNA, 25 bp, S. cerevisiae
cttcccagtggttatgtcgattgac

SEQ ID NO: 23066 - DNA, 25 bp, S. cerevisiae
cttcctcacttgttttgtcactaga

SEQ ID NO: 23067 - DNA, 25 bp, S. cerevisiae
cttatgctcctgaacctgtgaaatg

SEQ ID NO: 23068 - DNA, 25 bp, S. cerevisiae
cttcttccatgtcacttgaatcttc

SEQ ID NO: 23069 - DNA, 25 bp, S. cerevisiae
cttttccaggaatgctatgactatc

SEQ ID NO: 23070 - DNA, 25 bp, S. cerevisiae
cttactgttggaagctcttgatgca

SEQ ID NO: 23071 - DNA, 25 bp, S. cerevisiae
cttttggctacatacagtggttcga

SEQ ID NO: 23072 - DNA, 25 bp, S. cerevisiae
ctttctgcccaacaagtttctcaaa

SEQ ID NO: 23073 - DNA, 25 bp, S. cerevisiae
cttcttcttattctatgtcgtccaa

SEQ ID NO: 23074 - DNA, 25 bp, S. cerevisiae
ctattgttttccttttgctttccag

SEQ ID NO: 23075 - DNA, 25 bp, S. cerevisiae
cttccgtttgaattactctgcttaa

SEQ ID NO: 23076 - DNA, 25 bp, S. cerevisiae
cttttgtcgacaacacttctcaagc

SEQ ID NO: 23077 - DNA, 25 bp, S. cerevisiae
cttccgttgctgatcctattctaga

SEQ ID NO: 23078 - DNA, 25 bp, S. cerevisiae
cttccacttttacgagattgctcac

SEQ ID NO: 23079 - DNA, 25 bp, S. cerevisiae
cttctacatattctgggttcatcaa

SEQ ID NO: 23080 - DNA, 25 bp, S. cerevisiae
ctgacaataggaagatatgcgagct

SEQ ID NO: 23081 - DNA, 25 bp, S. cerevisiae
ctggtacgatcaagagaagagtcat

SEQ ID NO: 23082 - DNA, 25 bp, S. cerevisiae
ctattgggcgcatttggagtacttt

SEQ ID NO: 23083 - DNA, 25 bp, S. cerevisiae
ctttggtcatgctttgaatgctttt

SEQ ID NO: 23084 - DNA, 25 bp, S. cerevisiae
ctttgacggcgaatggactccacaa

SEQ ID NO: 23085 - DNA, 25 bp, S. cerevisiae
ctttgaaggctgttggtgctcactc

SEQ ID NO: 23086 - DNA, 25 bp, S. cerevisiae
ctttaggccctgatggatactggat

SEQ ID NO: 23087 - DNA, 25 bp, S. cerevisiae
ctttgccgccctattagtcagtata

SEQ ID NO: 23088 - DNA, 25 bp, S. cerevisiae
ctaagatggccgcacatatggaatt

SEQ ID NO: 23089 - DNA, 25 bp, S. cerevisiae
ctagcacaggctctaaagatgatgt

SEQ ID NO: 23090 - DNA, 25 bp, S. cerevisiae
ctacacatggccttcacgagattga

SEQ ID NO: 23091 - DNA, 25 bp, S. cerevisiae
cttcttcgctcagcttcgataagga

SEQ ID NO: 23092 - DNA, 25 bp, S. cerevisiae
ctacccgtgtgccataagctatttg

SEQ ID NO: 23093 - DNA, 25 bp, S. cerevisiae
ctacgtgtgggcctcttcttagtgc

SEQ ID NO: 23094 - DNA, 25 bp, S. cerevisiae
ctagtgaccgttcggccgctgaaaa

SEQ ID NO: 23095 - DNA, 25 bp, S. cerevisiae
ctagatatccctgctgtggactgga

SEQ ID NO: 23096 - DNA, 25 bp, S. cerevisiae
cttcttctcctatatccagcataat

SEQ ID NO: 23097 - DNA, 25 bp, S. cerevisiae
cttcatccgctcatcagaacaaaac

SEQ ID NO: 23098 - DNA, 25 bp, S. cerevisiae
ctttccctgttgtcctgggaaatat

SEQ ID NO: 23099 - DNA, 25 bp, S. cerevisiae
cttccctgtcattttcggtgaacta

SEQ ID NO: 23100 - DNA, 25 bp, S. cerevisiae
cttctcttgtaggtttgttaataat

SEQ ID NO: 23101 - DNA, 25 bp, S. cerevisiae
ctttccagctccatatcgcaattaa

SEQ ID NO: 23102 - DNA, 25 bp, S. cerevisiae
ctacgtgcacgctggctcgaaaaaa

SEQ ID NO: 23103 - DNA, 25 bp, S. cerevisiae
ctacagattgcattagacctagtga

SEQ ID NO: 23104 - DNA, 25 bp, S. cerevisiae
ctactgatttacaggtcctcgacct

SEQ ID NO: 23105 - DNA, 25 bp, S. cerevisiae
cttcgatttactgtgtttctaccat

SEQ ID NO: 23106 - DNA, 25 bp, S. cerevisiae
ctgatatcgacggatgtttgggcgc

SEQ ID NO: 23107 - DNA, 25 bp, S. cerevisiae
cttctgctggcggtgctgctgctgc

SEQ ID NO: 23108 - DNA, 25 bp, S. cerevisiae
cttctctggcgcatgtatcagacga

SEQ ID NO: 23109 - DNA, 25 bp, S. cerevisiae
cttctcacagacaggtacagcactt

SEQ ID NO: 23110 - DNA, 25 bp, S. cerevisiae
ctattccaccttctaatgactgtac

SEQ ID NO: 23111 - DNA, 25 bp, S. cerevisiae
ctgccccagccaccactactttatc

SEQ ID NO: 23112 - DNA, 25 bp, S. cerevisiae
cttttgtttaaggtttgagcctgca

SEQ ID NO: 23113 - DNA, 25 bp, S. cerevisiae
cttttggcttaaattcttccgctga

SEQ ID NO: 23114 - DNA, 25 bp, S. cerevisiae
ctaattcagagtttttcaatcccga

SEQ ID NO: 23115 - DNA, 25 bp, S. cerevisiae
ctatattcacggacaaccaggcata

SEQ ID NO: 23116 - DNA, 25 bp, S. cerevisiae
cttctggaagcagcgcatcgggcaa

SEQ ID NO: 23117 - DNA, 25 bp, S. cerevisiae
cttctagagatatcactgtgggcga

SEQ ID NO: 23118 - DNA, 25 bp, S. cerevisiae
ctttgggtttcaggatatgtggcat

SEQ ID NO: 23119 - DNA, 25 bp, S. cerevisiae
ctttggatttctctgtgtctggtaa

SEQ ID NO: 23120 - DNA, 25 bp, S. cerevisiae
ctcattggtttcacggttcgttaca

SEQ ID NO: 23121 - DNA, 25 bp, S. cerevisiae
ctaactcagatgaccccgattgggt

SEQ ID NO: 23122 - DNA, 25 bp, S. cerevisiae
ctaacgggcctcttacacgatagta

SEQ ID NO: 23123 - DNA, 25 bp, S. cerevisiae
ctgaccgttaccacagagttgctga

SEQ ID NO: 23124 - DNA, 25 bp, S. cerevisiae
ctaggcgaaagtgatgaggaaattc

SEQ ID NO: 23125 - DNA, 25 bp, S. cerevisiae
ctaccgtaatatcgaaggaagaagg

SEQ ID NO: 23126 - DNA, 25 bp, S. cerevisiae
ctagggataacaagaagaccagaat

SEQ ID NO: 23127 - DNA, 25 bp, S. cerevisiae
tccagtgaccccagacaacaagtta

SEQ ID NO: 23128 - DNA, 25 bp, S. cerevisiae
ccaagttcaatcagacccaggtgct

SEQ ID NO: 23129 - DNA, 25 bp, S. cerevisiae
cttcatccgccaattcttcgagaat

SEQ ID NO: 23130 - DNA, 25 bp, S. cerevisiae
cttactcgcagagttctgtctgtgt

SEQ ID NO: 23131 - DNA, 25 bp, S. cerevisiae
cttcatttcccttgagagcctaata

SEQ ID NO: 23132 - DNA, 25 bp, S. cerevisiae
ctatgcgtataggtacaggcctgat

SEQ ID NO: 23133 - DNA, 25 bp, S. cerevisiae
gctgacgtttgcataccgactttag

SEQ ID NO: 23134 - DNA, 25 bp, S. cerevisiae
ctcaatgaatctatggacgctctaa

SEQ ID NO: 23135 - DNA, 25 bp, S. cerevisiae
ctacacctactagaacacttggaaa

SEQ ID NO: 23136 - DNA, 25 bp, S. cerevisiae
ctactccgacttccaattctttgaa

SEQ ID NO: 23137 - DNA, 25 bp, S. cerevisiae
ctacaagagaccttccactttctac

SEQ ID NO: 23138 - DNA, 25 bp, S. cerevisiae
ctaaatctggctatctaattcctga

SEQ ID NO: 23139 - DNA, 25 bp, S. cerevisiae
ctacaattggttttacagacggaat

SEQ ID NO: 23140 - DNA, 25 bp, S. cerevisiae
ctaagaaggttggtatcactggtaa

SEQ ID NO: 23141 - DNA, 25 bp, S. cerevisiae
gctaaaccgatcgaggtactaggaa

SEQ ID NO: 23142 - DNA, 25 bp, S. cerevisiae
ctgccgtcgaaaccttataccaaga

SEQ ID NO: 23143 - DNA, 25 bp, S. cerevisiae
ctgccggaaataactctaagcctat

SEQ ID NO: 23144 - DNA, 25 bp, S. cerevisiae
ctccggaaatctatccactgttttc

SEQ ID NO: 23145 - DNA, 25 bp, S. cerevisiae
ctatcacggaaaccctcaactttat

SEQ ID NO: 23146 - DNA, 25 bp, S. cerevisiae
cttcacctgaattccgctcaaaatt

SEQ ID NO: 23147 - DNA, 25 bp, S. cerevisiae
ctccggcgtggttcccaatgaagaa

SEQ ID NO: 23148 - DNA, 25 bp, S. cerevisiae
ccctggaatttctagccctgatgag

SEQ ID NO: 23149 - DNA, 25 bp, S. cerevisiae
cttcttgaactaaatgccatcttgg

SEQ ID NO: 23150 - DNA, 25 bp, S. cerevisiae
cggattgttctataccatttggtgg

SEQ ID NO: 23151 - DNA, 25 bp, S. cerevisiae
ctgcgattgtttctcccattaagga

SEQ ID NO: 23152 - DNA, 25 bp, S. cerevisiae
ctctttgttgagttcggcatcgttc

SEQ ID NO: 23153 - DNA, 25 bp, S. cerevisiae
cttcatgcctttctataccgagtat

SEQ ID NO: 23154 - DNA, 25 bp, S. cerevisiae
ctatagctcacattaatccgccatg

SEQ ID NO: 23155 - DNA, 25 bp, S. cerevisiae
cttagcccaatactacatgttccaa

SEQ ID NO: 23156 - DNA, 25 bp, S. cerevisiae
ccattggccgggtcgtacatacaaa

SEQ ID NO: 23157 - DNA, 25 bp, S. cerevisiae
ctaagcatccgcattgttcatcaac

SEQ ID NO: 23158 - DNA, 25 bp, S. cerevisiae
ctcgcatcacagtcgattcatcaat

SEQ ID NO: 23159 - DNA, 25 bp, S. cerevisiae
gccacgcaagaccagttcaacgaga

SEQ ID NO: 23160 - DNA, 25 bp, S. cerevisiae
ctccaccatgtctcctaagaactaa

SEQ ID NO: 23161 - DNA, 25 bp, S. cerevisiae
ctccccaatctaccgactgaaaaag

SEQ ID NO: 23162 - DNA, 25 bp, S. cerevisiae
ctaatgccgtgatagctgcaatgga

SEQ ID NO: 23163 - DNA, 25 bp, S. cerevisiae
ctaaaccatcgctaccaatgtcatt

SEQ ID NO: 23164 - DNA, 25 bp, S. cerevisiae
ctaaacttcatggactaggcactga

SEQ ID NO: 23165 - DNA, 25 bp, S. cerevisiae
ctaatacggagggtcacttggaatt

SEQ ID NO: 23166 - DNA, 25 bp, S. cerevisiae
ctactacgtcgtgggcattctggag

SEQ ID NO: 23167 - DNA, 25 bp, S. cerevisiae
ctttctcttttttacctcaacagag

SEQ ID NO: 23168 - DNA, 25 bp, S. cerevisiae
cttttccttattgaccttgacactg

SEQ ID NO: 23169 - DNA, 25 bp, S. cerevisiae
cttttaccagttgaccatttccagg

SEQ ID NO: 23170 - DNA, 25 bp, S. cerevisiae
ctagacatagatagcttgggccaat

SEQ ID NO: 23171 - DNA, 25 bp, S. cerevisiae
cgttgtgttgatgactcggtgattc

SEQ ID NO: 23172 - DNA, 25 bp, S. cerevisiae
ctttctgtgctgatgtctcggatac

SEQ ID NO: 23173 - DNA, 25 bp, S. cerevisiae
cttatctggatttttctggtgttga

SEQ ID NO: 23174 - DNA, 25 bp, S. cerevisiae
cttactacttggtgctggtgtcata

SEQ ID NO: 23175 - DNA, 25 bp, S. cerevisiae
ctatccttgttttcggttgtgcatt

SEQ ID NO: 23176 - DNA, 25 bp, S. cerevisiae
ctttgccgcatatcatagcgcatat

SEQ ID NO: 23177 - DNA, 25 bp, S. cerevisiae
ctgtagcgttactgacactgtggtc

SEQ ID NO: 23178 - DNA, 25 bp, S. cerevisiae
ctccgggtacatgagctcattggtc

SEQ ID NO: 23179 - DNA, 25 bp, S. cerevisiae
ctagggcctacaatgcagatgctga

SEQ ID NO: 23180 - DNA, 25 bp, S. cerevisiae
ctttggcatctcatgtgattgcgaa

SEQ ID NO: 23181 - DNA, 25 bp, S. cerevisiae
ctttggctccaaagattggtccttt

SEQ ID NO: 23182 - DNA, 25 bp, S. cerevisiae
ctttccctcgtctacaaacagtaat

SEQ ID NO: 23183 - DNA, 25 bp, S. cerevisiae
ctttcccctccatagtagcagatag

SEQ ID NO: 23184 - DNA, 25 bp, S. cerevisiae
ctatttccctcctcacaagtaagaa

SEQ ID NO: 23185 - DNA, 25 bp, S. cerevisiae
ctttcccaacctcagcaacaagaaa

SEQ ID NO: 23186 - DNA, 25 bp, S. cerevisiae
ctttcttcccctgatgaatcaagca

SEQ ID NO: 23187 - DNA, 25 bp, S. cerevisiae
ctttggtcttggctaatctcaaaat

SEQ ID NO: 23188 - DNA, 25 bp, S. cerevisiae
ctattttcggagctactacagttat

SEQ ID NO: 23189 - DNA, 25 bp, S. cerevisiae
ctttatctcaaggacgtgcaatcac

SEQ ID NO: 23190 - DNA, 25 bp, S. cerevisiae
ctatgcctggtggatacgggacttt

SEQ ID NO: 23191 - DNA, 25 bp, S. cerevisiae
ctatgcattgaaaaagcggtccttg

SEQ ID NO: 23192 - DNA, 25 bp, S. cerevisiae
ctttggacctaactgctgccagaaa

SEQ ID NO: 23193 - DNA, 25 bp, S. cerevisiae
ctatgttttgttagttgttccagaa

SEQ ID NO: 23194 - DNA, 25 bp, S. cerevisiae
ctttacttgatttgctcgcgtctaa

SEQ ID NO: 23195 - DNA, 25 bp, S. cerevisiae
ctaaacttggtattgagcgtctcaa

SEQ ID NO: 23196 - DNA, 25 bp, S. cerevisiae
ctgaaatgtctgtttaaaggcctag

SEQ ID NO: 23197 - DNA, 25 bp, S. cerevisiae
cttttccattacagatagcgccgat

SEQ ID NO: 23198 - DNA, 25 bp, S. cerevisiae
ctatttctgctaacggtgaggtctt

SEQ ID NO: 23199 - DNA, 25 bp, S. cerevisiae
ctttcttgctatacgaggtggtccg

SEQ ID NO: 23200 - DNA, 25 bp, S. cerevisiae
ctatatcgatgtttccagactggtc

SEQ ID NO: 23201 - DNA, 25 bp, S. cerevisiae
ctagacaacaatccggtgcgactat

SEQ ID NO: 23202 - DNA, 25 bp, S. cerevisiae
ctttgcaagaatccgtcgaagcata

SEQ ID NO: 23203 - DNA, 25 bp, S. cerevisiae
ctttcaggaatacctctccgatatt

SEQ ID NO: 23204 - DNA, 25 bp, S. cerevisiae
ctttttcagattccgctgtaccaga

SEQ ID NO: 23205 - DNA, 25 bp, S. cerevisiae
ctttttatcattacagcctgcacca

SEQ ID NO: 23206 - DNA, 25 bp, S. cerevisiae
ctttcttgacaaactatctccggga

SEQ ID NO: 23207 - DNA, 25 bp, S. cerevisiae
cttttgggccaaacgcttcgtgaga

SEQ ID NO: 23208 - DNA, 25 bp, S. cerevisiae
ctttgtcggcaaattcctcggaaga

SEQ ID NO: 23209 - DNA, 25 bp, S. cerevisiae
cttttcctggaatctctcgtagtga

SEQ ID NO: 23210 - DNA, 25 bp, S. cerevisiae
cttattctgggttgtttcgctatta

SEQ ID NO: 23211 - DNA, 25 bp, S. cerevisiae
ctcgttcggtttaggtcgtatcata

SEQ ID NO: 23212 - DNA, 25 bp, S. cerevisiae
ctcgttcattgtcttttggtttgga

SEQ ID NO: 23213 - DNA, 25 bp, S. cerevisiae
cttttatttaatggcctcttttgat

SEQ ID NO: 23214 - DNA, 25 bp, S. cerevisiae
ctttgtttacgctatggcctttgtt

SEQ ID NO: 23215 - DNA, 25 bp, S. cerevisiae
ctatatgccttcgagaatatgtctt

SEQ ID NO: 23216 - DNA, 25 bp, S. cerevisiae
ctatggccttagaaagtccttgtga

SEQ ID NO: 23217 - DNA, 25 bp, S. cerevisiae
ctttctcgtcgtggttatgcattta

SEQ ID NO: 23218 - DNA, 25 bp, S. cerevisiae
ctttcctgcgtgtattgtttttctg

SEQ ID NO: 23219 - DNA, 25 bp, S. cerevisiae
ctttgcctggcttttgatttcattt

SEQ ID NO: 23220 - DNA, 25 bp, S. cerevisiae
ctttccatgtgtcgttgtctgtaga

SEQ ID NO: 23221 - DNA, 25 bp, S. cerevisiae
ctttgtatttgctatctatctgggt

SEQ ID NO: 23222 - DNA, 25 bp, S. cerevisiae
ctattgctgttttctttctgtgtgg

SEQ ID NO: 23223 - DNA, 25 bp, S. cerevisiae
ctttgcctccattttctggttgaaa

SEQ ID NO: 23224 - DNA, 25 bp, S. cerevisiae
ctttggctagactttatggtgcgaa

SEQ ID NO: 23225 - DNA, 25 bp, S. cerevisiae
ctttggctaactacatggcatacgt

SEQ ID NO: 23226 - DNA, 25 bp, S. cerevisiae
ctaagtcttgcggtgttgacgctat

SEQ ID NO: 23227 - DNA, 25 bp, S. cerevisiae
ctacccctacttatatggcagctaa

SEQ ID NO: 23228 - DNA, 25 bp, S. cerevisiae
ctgacctaggaatttttggccatag

SEQ ID NO: 23229 - DNA, 25 bp, S. cerevisiae
ctacctaaggtactgttgactgcta

SEQ ID NO: 23230 - DNA, 25 bp, S. cerevisiae
ctactccaaatttcgatctttccat

SEQ ID NO: 23231 - DNA, 25 bp, S. cerevisiae
ctcacccaaattatcagttagcgtt

SEQ ID NO: 23232 - DNA, 25 bp, S. cerevisiae
ctaccagaccttctcaatctatttt

SEQ ID NO: 23233 - DNA, 25 bp, S. cerevisiae
ctccgcacctttgtcatttttagat

SEQ ID NO: 23234 - DNA, 25 bp, S. cerevisiae
ctacgacagcgttttccttgatata

SEQ ID NO: 23235 - DNA, 25 bp, S. cerevisiae
ctttagattatgttggtattgcgaa

SEQ ID NO: 23236 - DNA, 25 bp, S. cerevisiae
tctaaagctacgtcggtttccacct

SEQ ID NO: 23237 - DNA, 25 bp, S. cerevisiae
ctaacgcatcggtctcgagcagtaa

SEQ ID NO: 23238 - DNA, 25 bp, S. cerevisiae
ctaacaatgacgacgctgcacgcga

SEQ ID NO: 23239 - DNA, 25 bp, S. cerevisiae
ctattgtccacatgcctaggtatac

SEQ ID NO: 23240 - DNA, 25 bp, S. cerevisiae
ctatggtgctaccaccttggatgta

SEQ ID NO: 23241 - DNA, 25 bp, S. cerevisiae
ctacgggtgttgttcaggttctgca

SEQ ID NO: 23242 - DNA, 25 bp, S. cerevisiae
ctatgggttgttttctggcatgtca

SEQ ID NO: 23243 - DNA, 25 bp, S. cerevisiae
ctatcagtgatatcggtctccattc

SEQ ID NO: 23244 - DNA, 25 bp, S. cerevisiae
cgacagttcatacacttccttcaaa

SEQ ID NO: 23245 - DNA, 25 bp, S. cerevisiae
ctcaagttcaaggagattcgctact

SEQ ID NO: 23246 - DNA, 25 bp, S. cerevisiae
ctaagcgtcattgcaggctgccata

SEQ ID NO: 23247 - DNA, 25 bp, S. cerevisiae
ctatggtcggttcgcctgattatat

SEQ ID NO: 23248 - DNA, 25 bp, S. cerevisiae
ctttgggttgcatattcgttcctaa

SEQ ID NO: 23249 - DNA, 25 bp, S. cerevisiae
cgctgttaaaagatcccgtcattga

SEQ ID NO: 23250 - DNA, 25 bp, S. cerevisiae
cccttcaaacaaaccacgtgatggt

SEQ ID NO: 23251 - DNA, 25 bp, S. cerevisiae
ctcactacaaaatcccagcttggtt

SEQ ID NO: 23252 - DNA, 25 bp, S. cerevisiae
ctagcatcatcaaatttcccctttt

SEQ ID NO: 23253 - DNA, 25 bp, S. cerevisiae
gactggttacgagacacccgtcaaa

SEQ ID NO: 23254 - DNA, 25 bp, S. cerevisiae
ccgtgatttggagacacaccttaaa

SEQ ID NO: 23255 - DNA, 25 bp, S. cerevisiae
ctttgacccttatgctctatccgag

SEQ ID NO: 23256 - DNA, 25 bp, S. cerevisiae
ctttcttctccctatgttacacaat

SEQ ID NO: 23257 - DNA, 25 bp, S. cerevisiae
ctttctggattgatactgtctctgt

SEQ ID NO: 23258 - DNA, 25 bp, S. cerevisiae
gctacacttgaaccacatgcgttac

SEQ ID NO: 23259 - DNA, 25 bp, S. cerevisiae
ctatcatctatcaactagtagttac

SEQ ID NO: 23260 - DNA, 25 bp, S. cerevisiae
ctatccgtcaccttgctaatgatga

SEQ ID NO: 23261 - DNA, 25 bp, S. cerevisiae
ctatgcgggctctatcattgaatgt

SEQ ID NO: 23262 - DNA, 25 bp, S. cerevisiae
ctatgcttgttctatttggccaggc

SEQ ID NO: 23263 - DNA, 25 bp, S. cerevisiae
ctatattatgtcttggtcccagcaa

SEQ ID NO: 23264 - DNA, 25 bp, S. cerevisiae
ctatttagaggtgggccgcgacaat

SEQ ID NO: 23265 - DNA, 25 bp, S. cerevisiae
ctagtgttgagggttcgccgtcatc

SEQ ID NO: 23266 - DNA, 25 bp, S. cerevisiae
ctttggtgaaggttcctctcgtgaa

SEQ ID NO: 23267 - DNA, 25 bp, S. cerevisiae
ctaccttctgttttcgcgagattaa

SEQ ID NO: 23268 - DNA, 25 bp, S. cerevisiae
ctacgtgggctaattccgatttcaa

SEQ ID NO: 23269 - DNA, 25 bp, S. cerevisiae
ctacgtggttcaagctttggttaca

SEQ ID NO: 23270 - DNA, 25 bp, S. cerevisiae
ctagttggttaagtcctggtgtcac

SEQ ID NO: 23271 - DNA, 25 bp, S. cerevisiae
ctatttactctctaccattatggct

SEQ ID NO: 23272 - DNA, 25 bp, S. cerevisiae
ctcagcaatccgtgtctacatcaat

SEQ ID NO: 23273 - DNA, 25 bp, S. cerevisiae
ctatgtgtcttcttcccattcaaaa

SEQ ID NO: 23274 - DNA, 25 bp, S. cerevisiae
ctagttcctttaactccatgggaga

SEQ ID NO: 23275 - DNA, 25 bp, S. cerevisiae
ctaaacctttgtttcactcggcaat

SEQ ID NO: 23276 - DNA, 25 bp, S. cerevisiae
ctaactgctgtcttagaatatttgg

SEQ ID NO: 23277 - DNA, 25 bp, S. cerevisiae
ctaatccggctattcaatatttgga

SEQ ID NO: 23278 - DNA, 25 bp, S. cerevisiae
ctcaagaggtcttcccattgttgga

SEQ ID NO: 23279 - DNA, 25 bp, S. cerevisiae
ctccaaggctctatccaaagatggt

SEQ ID NO: 23280 - DNA, 25 bp, S. cerevisiae
ctatcgagagatgccaagctgttct

SEQ ID NO: 23281 - DNA, 25 bp, S. cerevisiae
ctatttcctcggcacgttaatcaaa

SEQ ID NO: 23282 - DNA, 25 bp, S. cerevisiae
ctcttcgccctacgtagttgatgaa

SEQ ID NO: 23283 - DNA, 25 bp, S. cerevisiae
ctttccattccacctacttgatgaa

SEQ ID NO: 23284 - DNA, 25 bp, S. cerevisiae
ctatgactttagatcgctgcccaaa

SEQ ID NO: 23285 - DNA, 25 bp, S. cerevisiae
ctagggcaagagatcgactggcaaa

SEQ ID NO: 23286 - DNA, 25 bp, S. cerevisiae
ctatggcattgctcgctatgggcta

SEQ ID NO: 23287 - DNA, 25 bp, S. cerevisiae
ctctcatgcttctccaagctgaaag

SEQ ID NO: 23288 - DNA, 25 bp, S. cerevisiae
ctccatcttcatcggcaagcagtga

SEQ ID NO: 23289 - DNA, 25 bp, S. cerevisiae
ctaatttattagacgctgtgcaaga

SEQ ID NO: 23290 - DNA, 25 bp, S. cerevisiae
ccccttctgacatactaccgaaagt

SEQ ID NO: 23291 - DNA, 25 bp, S. cerevisiae
ctcgagttccgatagcagtggcagt

SEQ ID NO: 23292 - DNA, 25 bp, S. cerevisiae
ctcagagcttccaacagaggttctt

SEQ ID NO: 23293 - DNA, 25 bp, S. cerevisiae
ctttgttccatctagagttgcttta

SEQ ID NO: 23294 - DNA, 25 bp, S. cerevisiae
ctcaggatattaccattccggctat

SEQ ID NO: 23295 - DNA, 25 bp, S. cerevisiae
ctacgcctcatatcaagacagcact

SEQ ID NO: 23296 - DNA, 25 bp, S. cerevisiae
ctaccctcaacgcagaatccataaa

SEQ ID NO: 23297 - DNA, 25 bp, S. cerevisiae
ctacctcaagagcagcagtcggatt

SEQ ID NO: 23298 - DNA, 25 bp, S. cerevisiae
ctacgctctctatcatctagatcta

SEQ ID NO: 23299 - DNA, 25 bp, S. cerevisiae
ctccatacgttcatttgattcccga

SEQ ID NO: 23300 - DNA, 25 bp, S. cerevisiae
gactaacgtcacttgtaataaccta

SEQ ID NO: 23301 - DNA, 25 bp, S. cerevisiae
ctatccacgtctttgtaaaccattc

SEQ ID NO: 23302 - DNA, 25 bp, S. cerevisiae
ctatctacgatccatttgacttctc

SEQ ID NO: 23303 - DNA, 25 bp, S. cerevisiae
ctatattcgtcttgttggtgatcac

SEQ ID NO: 23304 - DNA, 25 bp, S. cerevisiae
ctagcatttggttacatggtgcaac

SEQ ID NO: 23305 - DNA, 25 bp, S. cerevisiae
ctacttcacacacttgcaattgggc

SEQ ID NO: 23306 - DNA, 25 bp, S. cerevisiae
ctgcgaatcctgctcaacaattttg

SEQ ID NO: 23307 - DNA, 25 bp, S. cerevisiae
ctggtaagcgtttggcctttgtgca

SEQ ID NO: 23308 - DNA, 25 bp, S. cerevisiae
ctaatagaggttttccaatttgcaa

SEQ ID NO: 23309 - DNA, 25 bp, S. cerevisiae
ctattccaacactttgagacattgt

SEQ ID NO: 23310 - DNA, 25 bp, S. cerevisiae
ctaggcattcatcatccacaggtaa

SEQ ID NO: 23311 - DNA, 25 bp, S. cerevisiae
ctagccatggctgatcgaattataa

SEQ ID NO: 23312 - DNA, 25 bp, S. cerevisiae
ctatgccaagtgctgcttctgctta

SEQ ID NO: 23313 - DNA, 25 bp, S. cerevisiae
ctagcggaccatcatatcgaattct

SEQ ID NO: 23314 - DNA, 25 bp, S. cerevisiae
ctatggatatactactgcgtggcga

SEQ ID NO: 23315 - DNA, 25 bp, S. cerevisiae
ctaggcatcggcttttggatcggat

SEQ ID NO: 23316 - DNA, 25 bp, S. cerevisiae
ctgatactgggctcgattgtcggat

SEQ ID NO: 23317 - DNA, 25 bp, S. cerevisiae
ctgcaactgacttctctacactaaa

SEQ ID NO: 23318 - DNA, 25 bp, S. cerevisiae
ctaagaactcccaacaaacagatgt

SEQ ID NO: 23319 - DNA, 25 bp, S. cerevisiae
ctatggacgctgataaagaaagact

SEQ ID NO: 23320 - DNA, 25 bp, S. cerevisiae
ctatttgcttgctctttttcagaca

SEQ ID NO: 23321 - DNA, 25 bp, S. cerevisiae
ctatcttctgaataccatgctttaa

SEQ ID NO: 23322 - DNA, 25 bp, S. cerevisiae
ctatctccgttactcaagctgtcat

SEQ ID NO: 23323 - DNA, 25 bp, S. cerevisiae
ctacctcactcactgtggtacgaaa

SEQ ID NO: 23324 - DNA, 25 bp, S. cerevisiae
ctactgtcactccatgggcataatg

SEQ ID NO: 23325 - DNA, 25 bp, S. cerevisiae
ctacgatatgcccaagagttatgag

SEQ ID NO: 23326 - DNA, 25 bp, S. cerevisiae
ctcttttggcaatggtttgggccca

SEQ ID NO: 23327 - DNA, 25 bp, S. cerevisiae
cgttttgacagctttgggtgggctc

SEQ ID NO: 23328 - DNA, 25 bp, S. cerevisiae
ctgcatttgcagaccgtttaggaca

SEQ ID NO: 23329 - DNA, 25 bp, S. cerevisiae
ctctctccagtctttatctatggca

SEQ ID NO: 23330 - DNA, 25 bp, S. cerevisiae
ctatctctagcgctctatccgcaga

SEQ ID NO: 23331 - DNA, 25 bp, S. cerevisiae
ctagctccgctgatgatgaccaaga

SEQ ID NO: 23332 - DNA, 25 bp, S. cerevisiae
ctatgcttccgtgggtgtcaccaga

SEQ ID NO: 23333 - DNA, 25 bp, S. cerevisiae
ctctttaagtgggtgtatctcagta

SEQ ID NO: 23334 - DNA, 25 bp, S. cerevisiae
ctcactccaagtgccgtttcagaag

SEQ ID NO: 23335 - DNA, 25 bp, S. cerevisiae
ctactataatgcttccgttgtctgg

SEQ ID NO: 23336 - DNA, 25 bp, S. cerevisiae
ctatattgatttgccagtcctcgaa

SEQ ID NO: 23337 - DNA, 25 bp, S. cerevisiae
ctatgtcatggttcccagaccttaa

SEQ ID NO: 23338 - DNA, 25 bp, S. cerevisiae
ctcgtctgaggatcgtagccatcaa

SEQ ID NO: 23339 - DNA, 25 bp, S. cerevisiae
ctagctgtgggcactgtcatggaca

SEQ ID NO: 23340 - DNA, 25 bp, S. cerevisiae
ctacgctgagcgcatggtctaatac

SEQ ID NO: 23341 - DNA, 25 bp, S. cerevisiae
ctactagactgcaatggctccatta

SEQ ID NO: 23342 - DNA, 25 bp, S. cerevisiae
ctagcttcagctaatggctctattt

SEQ ID NO: 23343 - DNA, 25 bp, S. cerevisiae
ctataatcctgttacctcactattg

SEQ ID NO: 23344 - DNA, 25 bp, S. cerevisiae
ctctaatgccggtatcgagactatt

SEQ ID NO: 23345 - DNA, 25 bp, S. cerevisiae
ctcgtatcgaggcagaaactatcaa

SEQ ID NO: 23346 - DNA, 25 bp, S. cerevisiae
ctctgtacggtctccaacgaataga

SEQ ID NO: 23347 - DNA, 25 bp, S. cerevisiae
ctaagactagactggcacgcgtttc

SEQ ID NO: 23348 - DNA, 25 bp, S. cerevisiae
ctgatagcactatatgggacctgtt

SEQ ID NO: 23349 - DNA, 25 bp, S. cerevisiae
ctaacgtatgtagacgataatgacg

SEQ ID NO: 23350 - DNA, 25 bp, S. cerevisiae
ctcaaacgcttatgctgccgaagtt

SEQ ID NO: 23351 - DNA, 25 bp, S. cerevisiae
ccatcaaagctttcagtccgacagg

SEQ ID NO: 23352 - DNA, 25 bp, S. cerevisiae
ctatgaagccatacctattaaggaa

SEQ ID NO: 23353 - DNA, 25 bp, S. cerevisiae
ctagacttgtctccgattataatat

SEQ ID NO: 23354 - DNA, 25 bp, S. cerevisiae
gtagagtagtcgctgcaacaacgat

SEQ ID NO: 23355 - DNA, 25 bp, S. cerevisiae
ctaccaatgctacgtttaactccag

SEQ ID NO: 23356 - DNA, 25 bp, S. cerevisiae
ctcagggtccaatcatagccaattt

SEQ ID NO: 23357 - DNA, 25 bp, S. cerevisiae
ctatgggatgcgatgtatctctctc

SEQ ID NO: 23358 - DNA, 25 bp, S. cerevisiae
ctaagggtactgttgacattgcgaa

SEQ ID NO: 23359 - DNA, 25 bp, S. cerevisiae
ctatctccaaggctctatccaagga

SEQ ID NO: 23360 - DNA, 25 bp, S. cerevisiae
ctatctccaaggctctatccaaaga

SEQ ID NO: 23361 - DNA, 25 bp, S. cerevisiae
ctactggtctcttcctgagggataa

SEQ ID NO: 23362 - DNA, 25 bp, S. cerevisiae
ctacgatgtctttccaggcaaatat

SEQ ID NO: 23363 - DNA, 25 bp, S. cerevisiae
ctaccactctaacgcgcagtatgaa

SEQ ID NO: 23364 - DNA, 25 bp, S. cerevisiae
ctactctccacatcggactttgaat

SEQ ID NO: 23365 - DNA, 25 bp, S. cerevisiae
ctacttccacaaacaacctattatc

SEQ ID NO: 23366 - DNA, 25 bp, S. cerevisiae
ctgcatcagacagaggatcccgtat

SEQ ID NO: 23367 - DNA, 25 bp, S. cerevisiae
ctgacgatagaagaccctgcaataa

SEQ ID NO: 23368 - DNA, 25 bp, S. cerevisiae
ctgtcagaacatttcccggatttga

SEQ ID NO: 23369 - DNA, 25 bp, S. cerevisiae
ctgattgcaaggtttcccaagggtt

SEQ ID NO: 23370 - DNA, 25 bp, S. cerevisiae
ctgttccagaatttccagttggttt

SEQ ID NO: 23371 - DNA, 25 bp, S. cerevisiae
ctctctgcgtaaccattcacaattg

SEQ ID NO: 23372 - DNA, 25 bp, S. cerevisiae
ctctccagaagacctaacacacatt

SEQ ID NO: 23373 - DNA, 25 bp, S. cerevisiae
ctgccgttctctccaatcaaagaaa

SEQ ID NO: 23374 - DNA, 25 bp, S. cerevisiae
ctgccatttaaggaccacgtacggt

SEQ ID NO: 23375 - DNA, 25 bp, S. cerevisiae
ctctgtttaacattctaggtactga

SEQ ID NO: 23376 - DNA, 25 bp, S. cerevisiae
ctacttgactgctgtcttggaatat

SEQ ID NO: 23377 - DNA, 25 bp, S. cerevisiae
ccgttgaatgatgcccgtagtatac

SEQ ID NO: 23378 - DNA, 25 bp, S. cerevisiae
ctcttctgggatcccgcctgtgtta

SEQ ID NO: 23379 - DNA, 25 bp, S. cerevisiae
ctcattcctctcataacaacagcag

SEQ ID NO: 23380 - DNA, 25 bp, S. cerevisiae
ctcacccttttccaattcagatggt

SEQ ID NO: 23381 - DNA, 25 bp, S. cerevisiae
ctacccaattgaagttgctgaggcc

SEQ ID NO: 23382 - DNA, 25 bp, S. cerevisiae
ctcatccatgcacgctacattataa

SEQ ID NO: 23383 - DNA, 25 bp, S. cerevisiae
ctaatcccttcaacgatccaagtat

SEQ ID NO: 23384 - DNA, 25 bp, S. cerevisiae
ctaacccctgctaatatcctaaata

SEQ ID NO: 23385 - DNA, 25 bp, S. cerevisiae
ctaactctacggatgctactaaagg

SEQ ID NO: 23386 - DNA, 25 bp, S. cerevisiae
ctaccactacctttgctagcatgaa

SEQ ID NO: 23387 - DNA, 25 bp, S. cerevisiae
ctagctatcaatttgttcccatgaa

SEQ ID NO: 23388 - DNA, 25 bp, S. cerevisiae
ctcatcgtggtatcagacacttctg

SEQ ID NO: 23389 - DNA, 25 bp, S. cerevisiae
ctagacaacatatcatgcacagatg

SEQ ID NO: 23390 - DNA, 25 bp, S. cerevisiae
ctaagccagcttatccaggtcatgt

SEQ ID NO: 23391 - DNA, 25 bp, S. cerevisiae
ctaagcggattaacatcaggtcgat

SEQ ID NO: 23392 - DNA, 25 bp, S. cerevisiae
ctaccactgataataatccctccat

SEQ ID NO: 23393 - DNA, 25 bp, S. cerevisiae
ctaccggtattaatgtctctggcaa

SEQ ID NO: 23394 - DNA, 25 bp, S. cerevisiae
ctaccatggtgtctgtggctgcaaa

SEQ ID NO: 23395 - DNA, 25 bp, S. cerevisiae
ctaggcatggtttctgctatggcat

SEQ ID NO: 23396 - DNA, 25 bp, S. cerevisiae
ctaagtgatgttctggtctttccaa

SEQ ID NO: 23397 - DNA, 25 bp, S. cerevisiae
ctacgttcccgctttatattttgca

SEQ ID NO: 23398 - DNA, 25 bp, S. cerevisiae
ctccggaactcgactattttttgca

SEQ ID NO: 23399 - DNA, 25 bp, S. cerevisiae
ctggtggtacacaacggtcttatca

SEQ ID NO: 23400 - DNA, 25 bp, S. cerevisiae
ctctcggtacaacgccttggttgaa

SEQ ID NO: 23401 - DNA, 25 bp, S. cerevisiae
gcctcaactaatacttttggtccaa

SEQ ID NO: 23402 - DNA, 25 bp, S. cerevisiae
ctcatcaatctatgtctcgggtgtc

SEQ ID NO: 23403 - DNA, 25 bp, S. cerevisiae
ctgccaatgctgaagctaagggtct

SEQ ID NO: 23404 - DNA, 25 bp, S. cerevisiae
ctgcaacactgcatgatcaagtttt

SEQ ID NO: 23405 - DNA, 25 bp, S. cerevisiae
ctcgacactcctacaagcatattga

SEQ ID NO: 23406 - DNA, 25 bp, S. cerevisiae
ctctgggccatcctacaaagtggta

SEQ ID NO: 23407 - DNA, 25 bp, S. cerevisiae
ctccggtatctgcacattatgtagt

SEQ ID NO: 23408 - DNA, 25 bp, S. cerevisiae
ctacggcatctacctgtgttaattt

SEQ ID NO: 23409 - DNA, 25 bp, S. cerevisiae
ctaagaagttcgtgcgtcacctgca

SEQ ID NO: 23410 - DNA, 25 bp, S. cerevisiae
ctcttctactactgacttcacgaat

SEQ ID NO: 23411 - DNA, 25 bp, S. cerevisiae
ctctcttacttctttcaccagggaa

SEQ ID NO: 23412 - DNA, 25 bp, S. cerevisiae
ctgtcttatatcagagtccataaac

SEQ ID NO: 23413 - DNA, 25 bp, S. cerevisiae
ctgctggatgccgaactagtgataa

SEQ ID NO: 23414 - DNA, 25 bp, S. cerevisiae
ctctgttcacttctggcttaacgta

SEQ ID NO: 23415 - DNA, 25 bp, S. cerevisiae
ctcacttagcccaatactacatgtt

SEQ ID NO: 23416 - DNA, 25 bp, S. cerevisiae
ctcacatcgatgtctgccaggatag

SEQ ID NO: 23417 - DNA, 25 bp, S. cerevisiae
ctccatcgagagcaaggtactacat

SEQ ID NO: 23418 - DNA, 25 bp, S. cerevisiae
ctctgccgaacctagtgtcattaat

SEQ ID NO: 23419 - DNA, 25 bp, S. cerevisiae
ctctccgggttcagcatcgaatgaa

SEQ ID NO: 23420 - DNA, 25 bp, S. cerevisiae
ctgctaatgtggcttctttcgttaa

SEQ ID NO: 23421 - DNA, 25 bp, S. cerevisiae
ctcgtaggtggtggtgttttgcaac

SEQ ID NO: 23422 - DNA, 25 bp, S. cerevisiae
ctcaaactcttcctaacggtcagaa

SEQ ID NO: 23423 - DNA, 25 bp, S. cerevisiae
ctaaactcttttatgggcgcaggta

SEQ ID NO: 23424 - DNA, 25 bp, S. cerevisiae
ctcaaggctctatttcatgtgtggg

SEQ ID NO: 23425 - DNA, 25 bp, S. cerevisiae
ctaatggtgctatatatctcgggaa

SEQ ID NO: 23426 - DNA, 25 bp, S. cerevisiae
ctccaagttaaaatctctgcctgta

SEQ ID NO: 23427 - DNA, 25 bp, S. cerevisiae
ctcccagataactcttatgcctgaa

SEQ ID NO: 23428 - DNA, 25 bp, S. cerevisiae
ctgcccaagtactgtacgctggaat

SEQ ID NO: 23429 - DNA, 25 bp, S. cerevisiae
ctgcccctagggaaattgactttat

SEQ ID NO: 23430 - DNA, 25 bp, S. cerevisiae
ctccacctttcactaattactatca

SEQ ID NO: 23431 - DNA, 25 bp, S. cerevisiae
ctacgctatgttgagttgctacgca

SEQ ID NO: 23432 - DNA, 25 bp, S. cerevisiae
ctgggatgatgttgaagttgacgac

SEQ ID NO: 23433 - DNA, 25 bp, S. cerevisiae
ctacttgtccggctcttcaaataag

SEQ ID NO: 23434 - DNA, 25 bp, S. cerevisiae
ctacttacccgttggacttgatcaa

SEQ ID NO: 23435 - DNA, 25 bp, S. cerevisiae
ctgcgggaccattcactaacttgga

SEQ ID NO: 23436 - DNA, 25 bp, S. cerevisiae
ctacagtcagatatccagaagcggg

SEQ ID NO: 23437 - DNA, 25 bp, S. cerevisiae
ctaatgatgatgtttccagttctga

SEQ ID NO: 23438 - DNA, 25 bp, S. cerevisiae
ctcagacagattttcccttaggctt

SEQ ID NO: 23439 - DNA, 25 bp, S. cerevisiae
ctacgaattgtaggcgttgctaatt

SEQ ID NO: 23440 - DNA, 25 bp, S. cerevisiae
ctgatacattcaaagggcaaccaat

SEQ ID NO: 23441 - DNA, 25 bp, S. cerevisiae
ctgaaattcatatggccagtggcca

SEQ ID NO: 23442 - DNA, 25 bp, S. cerevisiae
ctaaatcaatcgacctgcaaacctt

SEQ ID NO: 23443 - DNA, 25 bp, S. cerevisiae
ctaacaccatccagcatgcaataca

SEQ ID NO: 23444 - DNA, 25 bp, S. cerevisiae
cgagtatccgattttcgaagacgaa

SEQ ID NO: 23445 - DNA, 25 bp, S. cerevisiae
tcggtttcggtactttagtcggcat

SEQ ID NO: 23446 - DNA, 25 bp, S. cerevisiae
ctggtggtcgtaacttgggtcgtat

SEQ ID NO: 23447 - DNA, 25 bp, S. cerevisiae
ctaacttgggtggtgttgctgtttc

SEQ ID NO: 23448 - DNA, 25 bp, S. cerevisiae
ctaattctagcgagtgcccttttca

SEQ ID NO: 23449 - DNA, 25 bp, S. cerevisiae
ctaccccagcagaaatgtcgctttt

SEQ ID NO: 23450 - DNA, 25 bp, S. cerevisiae
ctacttgctgtacgagatggctcat

SEQ ID NO: 23451 - DNA, 25 bp, S. cerevisiae
ctacggctctcggattggtatctaa

SEQ ID NO: 23452 - DNA, 25 bp, S. cerevisiae
ctacaggcccgcgttgatatgtcaa

SEQ ID NO: 23453 - DNA, 25 bp, S. cerevisiae
ctactgatccgcgttatctagaaat

SEQ ID NO: 23454 - DNA, 25 bp, S. cerevisiae
ctacctcccgttgattatgtcataa

SEQ ID NO: 23455 - DNA, 25 bp, S. cerevisiae
ctcccttccatcaaattcacttgaa

SEQ ID NO: 23456 - DNA, 25 bp, S. cerevisiae
ctctactcgcctcaagaaatctgga

SEQ ID NO: 23457 - DNA, 25 bp, S. cerevisiae
ctaaccgcagaggaggagcaactgg

SEQ ID NO: 23458 - DNA, 25 bp, S. cerevisiae
ctgaggtccgagaagtactactgtt

SEQ ID NO: 23459 - DNA, 25 bp, S. cerevisiae
ctaagcgatatgttctgtaccgtat

SEQ ID NO: 23460 - DNA, 25 bp, S. cerevisiae
ctcgaggatgatgttgtgacgccaa

SEQ ID NO: 23461 - DNA, 25 bp, S. cerevisiae
ctcatgggatgactttgttgctaga

SEQ ID NO: 23462 - DNA, 25 bp, S. cerevisiae
ctcccgaggagttgttgacgtgttc

SEQ ID NO: 23463 - DNA, 25 bp, S. cerevisiae
ctccacgacagaaatttaaggcttt

SEQ ID NO: 23464 - DNA, 25 bp, S. cerevisiae
ctctcctggcgaaatttattgtttt

SEQ ID NO: 23465 - DNA, 25 bp, S. cerevisiae
ctcccaggaatggttctcctttgaa

SEQ ID NO: 23466 - DNA, 25 bp, S. cerevisiae
ctctcagttacgctttgcctggtaa

SEQ ID NO: 23467 - DNA, 25 bp, S. cerevisiae
ctctcgttaaggatttcagcggtac

SEQ ID NO: 23468 - DNA, 25 bp, S. cerevisiae
ctccggctacagagtttgccaacga

SEQ ID NO: 23469 - DNA, 25 bp, S. cerevisiae
ctccgagttaacctcttctcaaata

SEQ ID NO: 23470 - DNA, 25 bp, S. cerevisiae
cctacgccgcgtcattagtaatggt

SEQ ID NO: 23471 - DNA, 25 bp, S. cerevisiae
cctactcaacggaaaagtgattgga

SEQ ID NO: 23472 - DNA, 25 bp, S. cerevisiae
ctctactcataccactcacaagtat

SEQ ID NO: 23473 - DNA, 25 bp, S. cerevisiae
ctctgcgccattcaatcagtggtta

SEQ ID NO: 23474 - DNA, 25 bp, S. cerevisiae
gtaccgtttacatggttaccgctgg

SEQ ID NO: 23475 - DNA, 25 bp, S. cerevisiae
ctgaacgtcgtgttttgttatctgc

SEQ ID NO: 23476 - DNA, 25 bp, S. cerevisiae
ctgagacgctaaaggttttgaccac

SEQ ID NO: 23477 - DNA, 25 bp, S. cerevisiae
ctcacgtctattttgcttcctaaag

SEQ ID NO: 23478 - DNA, 25 bp, S. cerevisiae
ctactcctgtggctcgtatcgagaa

SEQ ID NO: 23479 - DNA, 25 bp, S. cerevisiae
ctcacaccttgtttaccatgcatta

SEQ ID NO: 23480 - DNA, 25 bp, S. cerevisiae
ctcaacttcgaattccgcatcaaat

SEQ ID NO: 23481 - DNA, 25 bp, S. cerevisiae
ctactgctgctgttacttctgtata

SEQ ID NO: 23482 - DNA, 25 bp, S. cerevisiae
ctactggatatttttttgcattttc

SEQ ID NO: 23483 - DNA, 25 bp, S. cerevisiae
ctactgacaagttctcgctatcgtt

SEQ ID NO: 23484 - DNA, 25 bp, S. cerevisiae
ctaatgttagagaccccatcgttaa

SEQ ID NO: 23485 - DNA, 25 bp, S. cerevisiae
cgagaattcatacgcctctacgtta

SEQ ID NO: 23486 - DNA, 25 bp, S. cerevisiae
cgaagttactggtttaggtggcaga

SEQ ID NO: 23487 - DNA, 25 bp, S. cerevisiae
cgtttgttgaacaccaatgtcgatg

SEQ ID NO: 23488 - DNA, 25 bp, S. cerevisiae
ctccgcagatatcaaccctattggg

SEQ ID NO: 23489 - DNA, 25 bp, S. cerevisiae
cggccacatcaaatacccaataggg

SEQ ID NO: 23490 - DNA, 25 bp, S. cerevisiae
ctctgcgcacaacctcaatgaagat

SEQ ID NO: 23491 - DNA, 25 bp, S. cerevisiae
ctctctacaccccaatgacaatgaa

SEQ ID NO: 23492 - DNA, 25 bp, S. cerevisiae
ctctcccactctgatgaggatctaa

SEQ ID NO: 23493 - DNA, 25 bp, S. cerevisiae
ctcattcgctatcctcaaagttcat

SEQ ID NO: 23494 - DNA, 25 bp, S. cerevisiae
ctccctctgccaattcgagagataa

SEQ ID NO: 23495 - DNA, 25 bp, S. cerevisiae
ctctccatcggcattctatttaaac

SEQ ID NO: 23496 - DNA, 25 bp, S. cerevisiae
ctgctgcgtcagtagttaaccaact

SEQ ID NO: 23497 - DNA, 25 bp, S. cerevisiae
ctgctggtaaggctaacaaacaatt

SEQ ID NO: 23498 - DNA, 25 bp, S. cerevisiae
ctctgtgtatagtctttcaagcaaa

SEQ ID NO: 23499 - DNA, 25 bp, S. cerevisiae
ctctgcttctaaggcttctgcttaa

SEQ ID NO: 23500 - DNA, 25 bp, S. cerevisiae
ctcgtccactgtctacttgagggaa

SEQ ID NO: 23501 - DNA, 25 bp, S. cerevisiae
ctcgcattgggattccttttggtca

SEQ ID NO: 23502 - DNA, 25 bp, S. cerevisiae
ctctgtgtgggatttgcctgtttga

SEQ ID NO: 23503 - DNA, 25 bp, S. cerevisiae
ctctgttggctgttggtgttgctaa

SEQ ID NO: 23504 - DNA, 25 bp, S. cerevisiae
ctcatctttatcatcaccttctgaa

SEQ ID NO: 23505 - DNA, 25 bp, S. cerevisiae
ctcgtttccatgaacacttctcaag

SEQ ID NO: 23506 - DNA, 25 bp, S. cerevisiae
ctgctagttccagtgccgctaagaa

SEQ ID NO: 23507 - DNA, 25 bp, S. cerevisiae
ctgacttctgatatgccgttaattt

SEQ ID NO: 23508 - DNA, 25 bp, S. cerevisiae
cgagtcgctcaaatgggttccaggc

SEQ ID NO: 23509 - DNA, 25 bp, S. cerevisiae
ctacatttctcattgcattcgcatc

SEQ ID NO: 23510 - DNA, 25 bp, S. cerevisiae
ctgctgaaacgactaccaatactgt

SEQ ID NO: 23511 - DNA, 25 bp, S. cerevisiae
ctcatctcagatttccacagttagt

SEQ ID NO: 23512 - DNA, 25 bp, S. cerevisiae
ctcatcattgttgccgagttcctga

SEQ ID NO: 23513 - DNA, 25 bp, S. cerevisiae
ccggttataagggatgctagtacta

SEQ ID NO: 23514 - DNA, 25 bp, S. cerevisiae
ctgccctttaagaggctagtacaaa

SEQ ID NO: 23515 - DNA, 25 bp, S. cerevisiae
ctgcccttatcacgtagagcttcaa

SEQ ID NO: 23516 - DNA, 25 bp, S. cerevisiae
ctctgccgttagcttgagccaaaat

SEQ ID NO: 23517 - DNA, 25 bp, S. cerevisiae
ctcaattgccctttatttcatccat

SEQ ID NO: 23518 - DNA, 25 bp, S. cerevisiae
ctctttaatgcctggtttctggaca

SEQ ID NO: 23519 - DNA, 25 bp, S. cerevisiae
ctgctgccatccaaagagtcggttt

SEQ ID NO: 23520 - DNA, 25 bp, S. cerevisiae
ctaacctccaatccagcgaattatt

SEQ ID NO: 23521 - DNA, 25 bp, S. cerevisiae
ctgccccgctatggatattcatgta

SEQ ID NO: 23522 - DNA, 25 bp, S. cerevisiae
ctcggcgtcatccacaaatttaaca

SEQ ID NO: 23523 - DNA, 25 bp, S. cerevisiae
gttggagtactgagcgaaactttct

SEQ ID NO: 23524 - DNA, 25 bp, S. cerevisiae
cggtgagtacggtggctactttcaa

SEQ ID NO: 23525 - DNA, 25 bp, S. cerevisiae
ctgtcatcagggtcggtggtgcatc

SEQ ID NO: 23526 - DNA, 25 bp, S. cerevisiae
gggcaaaacgtgctgccactttggc

SEQ ID NO: 23527 - DNA, 25 bp, S. cerevisiae
ctcagaaaacggttccatcagtgct

SEQ ID NO: 23528 - DNA, 25 bp, S. cerevisiae
ctcttatccatcacttcaagtcgat

SEQ ID NO: 23529 - DNA, 25 bp, S. cerevisiae
ctcccacactggtttggtcagaaag

SEQ ID NO: 23530 - DNA, 25 bp, S. cerevisiae
ctcccacactggtttggtcagaaag

SEQ ID NO: 23531 - DNA, 25 bp, S. cerevisiae
ctcccgttggtgcagctattgcaaa

SEQ ID NO: 23532 - DNA, 25 bp, S. cerevisiae
ctccggatgggccttcattgtgaaa

SEQ ID NO: 23533 - DNA, 25 bp, S. cerevisiae
ctcgtctcacgaacatattccggaa

SEQ ID NO: 23534 - DNA, 25 bp, S. cerevisiae
ctcagctactttactgcgttctaaa

SEQ ID NO: 23535 - DNA, 25 bp, S. cerevisiae
ctgatccaattgctgttgccgatac

SEQ ID NO: 23536 - DNA, 25 bp, S. cerevisiae
ctgctcctgaacctgtatcggaaaa

SEQ ID NO: 23537 - DNA, 25 bp, S. cerevisiae
cgtgctgccacgcattaaggacgaa

SEQ ID NO: 23538 - DNA, 25 bp, S. cerevisiae
ctgtcaagttggaaaaggaagctac

SEQ ID NO: 23539 - DNA, 25 bp, S. cerevisiae
ctgtcaatttgcgatacctggaacc

SEQ ID NO: 23540 - DNA, 25 bp, S. cerevisiae
ctctttccattttccagtgcaatag

SEQ ID NO: 23541 - DNA, 25 bp, S. cerevisiae
ctccggctggtgatttcgcaataaa

SEQ ID NO: 23542 - DNA, 25 bp, S. cerevisiae
cgggattgcaactcttttcgccata

SEQ ID NO: 23543 - DNA, 25 bp, S. cerevisiae
cgggtatgatacagttgcgtcgtta

SEQ ID NO: 23544 - DNA, 25 bp, S. cerevisiae
ctgctgttggtggtgctttggcctt

SEQ ID NO: 23545 - DNA, 25 bp, S. cerevisiae
cgctagctggtgttcgtactgacga

SEQ ID NO: 23546 - DNA, 25 bp, S. cerevisiae
ctcggctggtgctctaatgctgaaa

SEQ ID NO: 23547 - DNA, 25 bp, S. cerevisiae
ctcctgtttgtttgcgtgatggtaa

SEQ ID NO: 23548 - DNA, 25 bp, S. cerevisiae
ctccttcttgtttggcaggtctgaa

SEQ ID NO: 23549 - DNA, 25 bp, S. cerevisiae
ctccttcttggatgagacgtatgaa

SEQ ID NO: 23550 - DNA, 25 bp, S. cerevisiae
ctcctcagtcctctcatagtaatat

SEQ ID NO: 23551 - DNA, 25 bp, S. cerevisiae
ctgatgattgtgtatactccaagca

SEQ ID NO: 23552 - DNA, 25 bp, S. cerevisiae
ctgcagtgaggagtccttagcgtaa

SEQ ID NO: 23553 - DNA, 25 bp, S. cerevisiae
cgtggctacagatgtcgctgcgaga

SEQ ID NO: 23554 - DNA, 25 bp, S. cerevisiae
ctctacatccgtgcattattacata

SEQ ID NO: 23555 - DNA, 25 bp, S. cerevisiae
ctgctatatacgacagaaataccat

SEQ ID NO: 23556 - DNA, 25 bp, S. cerevisiae
cgtagctacgccgatgaaacctcat

SEQ ID NO: 23557 - DNA, 25 bp, S. cerevisiae
cccaagagccttcatgacctattag

SEQ ID NO: 23558 - DNA, 25 bp, S. cerevisiae
ctgcctgagggagctactgatcatt

SEQ ID NO: 23559 - DNA, 25 bp, S. cerevisiae
ctcatctcactaacctggacatttt

SEQ ID NO: 23560 - DNA, 25 bp, S. cerevisiae
ctctgccactggacttgaattcttt

SEQ ID NO: 23561 - DNA, 25 bp, S. cerevisiae
ctcatccctagcttgtactgtattg

SEQ ID NO: 23562 - DNA, 25 bp, S. cerevisiae
ctctctattcatgttgtctctgtat

SEQ ID NO: 23563 - DNA, 25 bp, S. cerevisiae
ctccggcacaaggtttagatgatat

SEQ ID NO: 23564 - DNA, 25 bp, S. cerevisiae
ctcattcaccttcctattctggaaa

SEQ ID NO: 23565 - DNA, 25 bp, S. cerevisiae
ctcaggctctttggcttatcttaaa

SEQ ID NO: 23566 - DNA, 25 bp, S. cerevisiae
ctgaggtcttgagtgcacattcttc

SEQ ID NO: 23567 - DNA, 25 bp, S. cerevisiae
ctgacgaattatctgactcattgag

SEQ ID NO: 23568 - DNA, 25 bp, S. cerevisiae
ctgaatactttgagccacatcgagg

SEQ ID NO: 23569 - DNA, 25 bp, S. cerevisiae
ctgactcgcctacatcacaaagaag

SEQ ID NO: 23570 - DNA, 25 bp, S. cerevisiae
ctcaggctctgcttggctttaaatt

SEQ ID NO: 23571 - DNA, 25 bp, S. cerevisiae
ctcatcgcctctggttttcaaatta

SEQ ID NO: 23572 - DNA, 25 bp, S. cerevisiae
ctcggcaatcatgcgcaataccatt

SEQ ID NO: 23573 - DNA, 25 bp, S. cerevisiae
ctctggattccgctgatgactatta

SEQ ID NO: 23574 - DNA, 25 bp, S. cerevisiae
ctggatgcacaagcctttttcgaaa

SEQ ID NO: 23575 - DNA, 25 bp, S. cerevisiae
ctgtaacatactttttcgcctcaat

SEQ ID NO: 23576 - DNA, 25 bp, S. cerevisiae
ctggcagggatcgtgtaggtcaaaa

SEQ ID NO: 23577 - DNA, 25 bp, S. cerevisiae
ctccagcatactccgcatattttga

SEQ ID NO: 23578 - DNA, 25 bp, S. cerevisiae
ctccgctatgtcgaccagtatatga

SEQ ID NO: 23579 - DNA, 25 bp, S. cerevisiae
ctccgttatctaccctcaagaaagt

SEQ ID NO: 23580 - DNA, 25 bp, S. cerevisiae
ctcctcttccacaaaattatgcgca

SEQ ID NO: 23581 - DNA, 25 bp, S. cerevisiae
ctcttcttcctcaactactgatgaa

SEQ ID NO: 23582 - DNA, 25 bp, S. cerevisiae
ctcatcatctcctgatttccaaaag

SEQ ID NO: 23583 - DNA, 25 bp, S. cerevisiae
ctctctcctacccttatgaagaaat

SEQ ID NO: 23584 - DNA, 25 bp, S. cerevisiae
ctgaccattaccttgttggaccaat

SEQ ID NO: 23585 - DNA, 25 bp, S. cerevisiae
tctactgaaactttcgaacaacctt

SEQ ID NO: 23586 - DNA, 25 bp, S. cerevisiae
cgttgcgacaccttcaaaaaccatt

SEQ ID NO: 23587 - DNA, 25 bp, S. cerevisiae
cgaaaacgcctcactgtactattta

SEQ ID NO: 23588 - DNA, 25 bp, S. cerevisiae
gctaaccaaggtgacttcgattttc

SEQ ID NO: 23589 - DNA, 25 bp, S. cerevisiae
cggcgcccaggaaattaccatttat

SEQ ID NO: 23590 - DNA, 25 bp, S. cerevisiae
ctctcacgtgtatctgactcgtatt

SEQ ID NO: 23591 - DNA, 25 bp, S. cerevisiae
ctgatccgtttactgacaccaatgg

SEQ ID NO: 23592 - DNA, 25 bp, S. cerevisiae
ctcctcctcggatgataactatggt

SEQ ID NO: 23593 - DNA, 25 bp, S. cerevisiae
ctccacttcaagtaagagtttggtt

SEQ ID NO: 23594 - DNA, 25 bp, S. cerevisiae
ctccctgtatagtaacgttgctcca

SEQ ID NO: 23595 - DNA, 25 bp, S. cerevisiae
ctgcccgaaactaccagattcttga

SEQ ID NO: 23596 - DNA, 25 bp, S. cerevisiae
ctgacgctgttactatccgtactag

SEQ ID NO: 23597 - DNA, 25 bp, S. cerevisiae
ctgactctgattttactactggtgg

SEQ ID NO: 23598 - DNA, 25 bp, S. cerevisiae
ctgctttaggcttcccaaatgctat

SEQ ID NO: 23599 - DNA, 25 bp, S. cerevisiae
cgcttgtcgggctctcaaaggaaga

SEQ ID NO: 23600 - DNA, 25 bp, S. cerevisiae
ctgttctggcggtgaaaagtgcaaa

SEQ ID NO: 23601 - DNA, 25 bp, S. cerevisiae
ctgccccaggcaatcaactagagtg

SEQ ID NO: 23602 - DNA, 25 bp, S. cerevisiae
ctccacctcctatgacaaatgtttc

SEQ ID NO: 23603 - DNA, 25 bp, S. cerevisiae
ccttaccatcatctgatccgggaaa

SEQ ID NO: 23604 - DNA, 25 bp, S. cerevisiae
ctctatccctgttgatgacgcggaa

SEQ ID NO: 23605 - DNA, 25 bp, S. cerevisiae
ctctctcgcaactgatcttattcaa

SEQ ID NO: 23606 - DNA, 25 bp, S. cerevisiae
ctcctctaatacatcatctcttcaa

SEQ ID NO: 23607 - DNA, 25 bp, S. cerevisiae
ctctccttcatattctcagcataaa

SEQ ID NO: 23608 - DNA, 25 bp, S. cerevisiae
ctgcatgcttctgatgtctcacgaa

SEQ ID NO: 23609 - DNA, 25 bp, S. cerevisiae
ctgcaggtgcagatgtcccaagaaa

SEQ ID NO: 23610 - DNA, 25 bp, S. cerevisiae
ctgcggtccattactcaatgagaac

SEQ ID NO: 23611 - DNA, 25 bp, S. cerevisiae
ctctcgtcgctaaaccaattctata

SEQ ID NO: 23612 - DNA, 25 bp, S. cerevisiae
ctgcccgatgtttgctatagttggt

SEQ ID NO: 23613 - DNA, 25 bp, S. cerevisiae
ctgaccattgtcctgtgtattctga

SEQ ID NO: 23614 - DNA, 25 bp, S. cerevisiae
ctcgcctgtattcctttggtatata

SEQ ID NO: 23615 - DNA, 25 bp, S. cerevisiae
ctccgctgctattcaatttaccatt

SEQ ID NO: 23616 - DNA, 25 bp, S. cerevisiae
ctgctaggtttattggttgttccaa

SEQ ID NO: 23617 - DNA, 25 bp, S. cerevisiae
ctgccggtattatgggtggtctaga

SEQ ID NO: 23618 - DNA, 25 bp, S. cerevisiae
gagccggatttgagggtagattaaa

SEQ ID NO: 23619 - DNA, 25 bp, S. cerevisiae
cgagccgttgatgaggttagttaaa

SEQ ID NO: 23620 - DNA, 25 bp, S. cerevisiae
ctcccgttcacacagtattttcata

SEQ ID NO: 23621 - DNA, 25 bp, S. cerevisiae
ctgctttgtacccacgtttcaagaa

SEQ ID NO: 23622 - DNA, 25 bp, S. cerevisiae
ctgtcggtgcttccaatttgatttg

SEQ ID NO: 23623 - DNA, 25 bp, S. cerevisiae
ctccatatctgtgtcttctgcaaat

SEQ ID NO: 23624 - DNA, 25 bp, S. cerevisiae
ctcgtacatatcaatttcgccatct

SEQ ID NO: 23625 - DNA, 25 bp, S. cerevisiae
ctctgacgctaaatgtttgctcttc

SEQ ID NO: 23626 - DNA, 25 bp, S. cerevisiae
ctgtcagactgcttggcgcttatga

SEQ ID NO: 23627 - DNA, 25 bp, S. cerevisiae
ctgtcgatcaattggcgtttgcgcc

SEQ ID NO: 23628 - DNA, 25 bp, S. cerevisiae
ctgtcgatacctggcgtgttatgat

SEQ ID NO: 23629 - DNA, 25 bp, S. cerevisiae
ctcgggtgtcatctatttacttcaa

SEQ ID NO: 23630 - DNA, 25 bp, S. cerevisiae
ctgcgaaggctttccaaattgggct

SEQ ID NO: 23631 - DNA, 25 bp, S. cerevisiae
cggaaagcgttctatctaatgggat

SEQ ID NO: 23632 - DNA, 25 bp, S. cerevisiae
cggcaaacgtgccaatttcctaatg

SEQ ID NO: 23633 - DNA, 25 bp, S. cerevisiae
ctcccaggttttactgttccaagtg

SEQ ID NO: 23634 - DNA, 25 bp, S. cerevisiae
ctcgacaactcttctagtaccaatt

SEQ ID NO: 23635 - DNA, 25 bp, S. cerevisiae
ctcgtcgtcgtctttggaatccatt

SEQ ID NO: 23636 - DNA, 25 bp, S. cerevisiae
ctcctgcccatttttgaagactcat

SEQ ID NO: 23637 - DNA, 25 bp, S. cerevisiae
ctcgtgctagctccaattaaatctc

SEQ ID NO: 23638 - DNA, 25 bp, S. cerevisiae
ctcccctcatctttatatgtcatag

SEQ ID NO: 23639 - DNA, 25 bp, S. cerevisiae
ctcctccttctactgtgatttatca

SEQ ID NO: 23640 - DNA, 25 bp, S. cerevisiae
ctgcagcatcactcggtgtgttatt

SEQ ID NO: 23641 - DNA, 25 bp, S. cerevisiae
ctgaggcttcgcgagaaggtgcatt

SEQ ID NO: 23642 - DNA, 25 bp, S. cerevisiae
ctcgttgacgaggatggcaccaatc

SEQ ID NO: 23643 - DNA, 25 bp, S. cerevisiae
tcactgattgcagagttgacggaat

SEQ ID NO: 23644 - DNA, 25 bp, S. cerevisiae
ctctgctctgatgggttacggtttg

SEQ ID NO: 23645 - DNA, 25 bp, S. cerevisiae
ctctgctcgtgatgtagccttggaa

SEQ ID NO: 23646 - DNA, 25 bp, S. cerevisiae
ctctgattctgcttctttcttggaa

SEQ ID NO: 23647 - DNA, 25 bp, S. cerevisiae
ctgccaaagcatttttcgacgagaa

SEQ ID NO: 23648 - DNA, 25 bp, S. cerevisiae
ctctgcttggcatcctttacaaaac

SEQ ID NO: 23649 - DNA, 25 bp, S. cerevisiae
gctcggaaccgttgtattgcaggaa

SEQ ID NO: 23650 - DNA, 25 bp, S. cerevisiae
ctctggccgcctatgaattattcaa

SEQ ID NO: 23651 - DNA, 25 bp, S. cerevisiae
ctcgtgtcgtctttgctttattagc

SEQ ID NO: 23652 - DNA, 25 bp, S. cerevisiae
ctgcgagcagcgtttcaattgagtg

SEQ ID NO: 23653 - DNA, 25 bp, S. cerevisiae
ctgaggctgcaaattcaagtggtac

SEQ ID NO: 23654 - DNA, 25 bp, S. cerevisiae
ctggccaatgtcgttagtgagctac

SEQ ID NO: 23655 - DNA, 25 bp, S. cerevisiae
ctgaccaagtttccgtgatcttcgt

SEQ ID NO: 23656 - DNA, 25 bp, S. cerevisiae
ctgcacgatggttgcgacttatcat

SEQ ID NO: 23657 - DNA, 25 bp, S. cerevisiae
ctgccgtggaaggtgtttgctttca

SEQ ID NO: 23658 - DNA, 25 bp, S. cerevisiae
cgccgtcaaaggctctggttccaga

SEQ ID NO: 23659 - DNA, 25 bp, S. cerevisiae
cggcgctaagatctacccaggtaga

SEQ ID NO: 23660 - DNA, 25 bp, S. cerevisiae
ctccaaaagaaaagaccagcagtga

SEQ ID NO: 23661 - DNA, 25 bp, S. cerevisiae
ctgcaatacatacaatactctcccg

SEQ ID NO: 23662 - DNA, 25 bp, S. cerevisiae
ctgcacgtatgctatatcgaaacca

SEQ ID NO: 23663 - DNA, 25 bp, S. cerevisiae
ctggctctatttgtattacccaaga

SEQ ID NO: 23664 - DNA, 25 bp, S. cerevisiae
ctgtgaaatttaccattccgccaaa

SEQ ID NO: 23665 - DNA, 25 bp, S. cerevisiae
ctgtgacttttatttcggcgccaac

SEQ ID NO: 23666 - DNA, 25 bp, S. cerevisiae
ctgaattctttactgtgggcggcac

SEQ ID NO: 23667 - DNA, 25 bp, S. cerevisiae
cggcaagcaaattagggacaccatt

SEQ ID NO: 23668 - DNA, 25 bp, S. cerevisiae
cggacgcaatcagtacttgtaccta

SEQ ID NO: 23669 - DNA, 25 bp, S. cerevisiae
ctgttcccacaatctattacctaaa

SEQ ID NO: 23670 - DNA, 25 bp, S. cerevisiae
ctgcttcccctatttccataattaa

SEQ ID NO: 23671 - DNA, 25 bp, S. cerevisiae
ctcccctccattagtttcgattata

SEQ ID NO: 23672 - DNA, 25 bp, S. cerevisiae
ctgggccccaattgcttacgttgtt

SEQ ID NO: 23673 - DNA, 25 bp, S. cerevisiae
cgtcccggagaactctataggtgtt

SEQ ID NO: 23674 - DNA, 25 bp, S. cerevisiae
cgtctccgaaggtactagggctgtt

SEQ ID NO: 23675 - DNA, 25 bp, S. cerevisiae
cgattacgacgaaactgcagcctgg

SEQ ID NO: 23676 - DNA, 25 bp, S. cerevisiae
cgatctgagtactgaacgcactgca

SEQ ID NO: 23677 - DNA, 25 bp, S. cerevisiae
ctgactagtcacacatgggccgata

SEQ ID NO: 23678 - DNA, 25 bp, S. cerevisiae
ctgactgagtctattgaagccgcca

SEQ ID NO: 23679 - DNA, 25 bp, S. cerevisiae
ctgtcaacttctcattcgagccaat

SEQ ID NO: 23680 - DNA, 25 bp, S. cerevisiae
ctgccaacttctctacctatatgat

SEQ ID NO: 23681 - DNA, 25 bp, S. cerevisiae
ctcgcctctgctctaaatttatcaa

SEQ ID NO: 23682 - DNA, 25 bp, S. cerevisiae
ctgcgccaccgagaggagttcaaga

SEQ ID NO: 23683 - DNA, 25 bp, S. cerevisiae
ctcgccattcttgaagcctatcaaa

SEQ ID NO: 23684 - DNA, 25 bp, S. cerevisiae
ctgactcccctgtaaaccatagaaa

SEQ ID NO: 23685 - DNA, 25 bp, S. cerevisiae
gcataacacccgttggacctggaaa

SEQ ID NO: 23686 - DNA, 25 bp, S. cerevisiae
ctgaaaccggatcgagcctcatcaa

SEQ ID NO: 23687 - DNA, 25 bp, S. cerevisiae
ctgagtaacatggtcgtcttctgga

SEQ ID NO: 23688 - DNA, 25 bp, S. cerevisiae
ctgcggtgcaggatggaccaccaat

SEQ ID NO: 23689 - DNA, 25 bp, S. cerevisiae
ctgcggatgcggattgattcgtcaa

SEQ ID NO: 23690 - DNA, 25 bp, S. cerevisiae
ctgcttgtatggttgtctatgcttc

SEQ ID NO: 23691 - DNA, 25 bp, S. cerevisiae
ctccgcgggtatgttcatcattatt

SEQ ID NO: 23692 - DNA, 25 bp, S. cerevisiae
ctcgttggagcgctattaatgttga

SEQ ID NO: 23693 - DNA, 25 bp, S. cerevisiae
ctcgtttgtcttacctatctctata

SEQ ID NO: 23694 - DNA, 25 bp, S. cerevisiae
ctgcgctattttcacgtatcttcaa

SEQ ID NO: 23695 - DNA, 25 bp, S. cerevisiae
ctcctggtggatacaagaagctttc

SEQ ID NO: 23696 - DNA, 25 bp, S. cerevisiae
ctcgacgtgttgaccatggacttta

SEQ ID NO: 23697 - DNA, 25 bp, S. cerevisiae
ctgctgtgcgcaacgaggacgagta

SEQ ID NO: 23698 - DNA, 25 bp, S. cerevisiae
ctggctccgattaccaatgggctaa

SEQ ID NO: 23699 - DNA, 25 bp, S. cerevisiae
ctgccactggttactcaatggtgat

SEQ ID NO: 23700 - DNA, 25 bp, S. cerevisiae
ctgcattcgttgtcctttttattgt

SEQ ID NO: 23701 - DNA, 25 bp, S. cerevisiae
ctggctactttacttttaactgact

SEQ ID NO: 23702 - DNA, 25 bp, S. cerevisiae
gcgacggcgtttcttttagctcctg

SEQ ID NO: 23703 - DNA, 25 bp, S. cerevisiae
ctgggaggcaagactattcctcgaa

SEQ ID NO: 23704 - DNA, 25 bp, S. cerevisiae
ctgaactggctgctatccataaagt

SEQ ID NO: 23705 - DNA, 25 bp, S. cerevisiae
ctgcagctgctttaccatgggacaa

SEQ ID NO: 23706 - DNA, 25 bp, S. cerevisiae
ctgaggctgctaatcgtgacgaaac

SEQ ID NO: 23707 - DNA, 25 bp, S. cerevisiae
cggtgatgttgggtacgtaactcta

SEQ ID NO: 23708 - DNA, 25 bp, S. cerevisiae
cgggtgtgacacgtacgcttacaat

SEQ ID NO: 23709 - DNA, 25 bp, S. cerevisiae
cggcgaattcgctgacacttaatag

SEQ ID NO: 23710 - DNA, 25 bp, S. cerevisiae
cgagttaatttctgtatccttggtc

SEQ ID NO: 23711 - DNA, 25 bp, S. cerevisiae
cgatgatggaacaccttaccttttc

SEQ ID NO: 23712 - DNA, 25 bp, S. cerevisiae
ctgtgtggtcgatatgcaatgctca

SEQ ID NO: 23713 - DNA, 25 bp, S. cerevisiae
cgaatgttcggccaagactggttat

SEQ ID NO: 23714 - DNA, 25 bp, S. cerevisiae
cgaagcgttggccaatgtcaagtat

SEQ ID NO: 23715 - DNA, 25 bp, S. cerevisiae
ctgattgcgcccgtaatgaactaaa

SEQ ID NO: 23716 - DNA, 25 bp, S. cerevisiae
ctgtactcatctgtttcgccagaaa

SEQ ID NO: 23717 - DNA, 25 bp, S. cerevisiae
ctgctactatttttctaccttcatg

SEQ ID NO: 23718 - DNA, 25 bp, S. cerevisiae
ctgaccttggtcaatcactggttat

SEQ ID NO: 23719 - DNA, 25 bp, S. cerevisiae
ctgctgttatgttgtctatgcctct

SEQ ID NO: 23720 - DNA, 25 bp, S. cerevisiae
ctgcagttaagtagcgcctctcaaa

SEQ ID NO: 23721 - DNA, 25 bp, S. cerevisiae
ctggcgacagagacgctattgttca

SEQ ID NO: 23722 - DNA, 25 bp, S. cerevisiae
ctgcgtccacttcaaattcacggaa

SEQ ID NO: 23723 - DNA, 25 bp, S. cerevisiae
ctgcaattatggttacaccctcgac

SEQ ID NO: 23724 - DNA, 25 bp, S. cerevisiae
ctgattctgatccaaacactcctaa

SEQ ID NO: 23725 - DNA, 25 bp, S. cerevisiae
ctgttcaatctgaaagagctttcca

SEQ ID NO: 23726 - DNA, 25 bp, S. cerevisiae
cgtatctattgttggcagcttctgc

SEQ ID NO: 23727 - DNA, 25 bp, S. cerevisiae
ctgatatgttacagcgcttcatgaa

SEQ ID NO: 23728 - DNA, 25 bp, S. cerevisiae
ctgttttcagtgctgctgctatcaa

SEQ ID NO: 23729 - DNA, 25 bp, S. cerevisiae
ctgttttgtggcttggcgtacatga

SEQ ID NO: 23730 - DNA, 25 bp, S. cerevisiae
ctgaattcattttccccattttcga

SEQ ID NO: 23731 - DNA, 25 bp, S. cerevisiae
cgaaatgtttgtgcccatggactca

SEQ ID NO: 23732 - DNA, 25 bp, S. cerevisiae
cggatacatcgcatgcttcgtggaa

SEQ ID NO: 23733 - DNA, 25 bp, S. cerevisiae
cgagtaatactttgccgaggacgag

SEQ ID NO: 23734 - DNA, 25 bp, S. cerevisiae
cggaaaacgatttggagcgaagcag

SEQ ID NO: 23735 - DNA, 25 bp, S. cerevisiae
ctcctcctgatgcaatgggtacttt

SEQ ID NO: 23736 - DNA, 25 bp, S. cerevisiae
ctgcgtactgtttcgggtacttcta

SEQ ID NO: 23737 - DNA, 25 bp, S. cerevisiae
ctgggcctatatcgactggcaatat

SEQ ID NO: 23738 - DNA, 25 bp, S. cerevisiae
ctgctagaaagctacgtgtccacag

SEQ ID NO: 23739 - DNA, 25 bp, S. cerevisiae
cggacgatcctttgctattatcagc

SEQ ID NO: 23740 - DNA, 25 bp, S. cerevisiae
ctggacgctactatctcaaatcttc

SEQ ID NO: 23741 - DNA, 25 bp, S. cerevisiae
gttacttaacggcttcatggtttat

SEQ ID NO: 23742 - DNA, 25 bp, S. cerevisiae
gttactccgccagagttgttgactt

SEQ ID NO: 23743 - DNA, 25 bp, S. cerevisiae
ctccactccgcaggaagttgttgat

SEQ ID NO: 23744 - DNA, 25 bp, S. cerevisiae
ctgcccaccgccaaagatgagttaa

SEQ ID NO: 23745 - DNA, 25 bp, S. cerevisiae
ctggaaccagccacactggtactaa

SEQ ID NO: 23746 - DNA, 25 bp, S. cerevisiae
ctgggcattactaggacggtggtta

SEQ ID NO: 23747 - DNA, 25 bp, S. cerevisiae
ctgggcaatattagggcgttccatt

SEQ ID NO: 23748 - DNA, 25 bp, S. cerevisiae
ctgagctgacagctgtggtcacaat

SEQ ID NO: 23749 - DNA, 25 bp, S. cerevisiae
ctccaatacttgctgttgccgataa

SEQ ID NO: 23750 - DNA, 25 bp, S. cerevisiae
ctgatcttgccgttggtgaagccaa

SEQ ID NO: 23751 - DNA, 25 bp, S. cerevisiae
ctgaacctcttcgtgatattgtgga

SEQ ID NO: 23752 - DNA, 25 bp, S. cerevisiae
ctgactgcaagtggatcggtttaca

SEQ ID NO: 23753 - DNA, 25 bp, S. cerevisiae
ctggcgcagatgataaagatttaca

SEQ ID NO: 23754 - DNA, 25 bp, S. cerevisiae
ctggccagaagttgagcgcactact

SEQ ID NO: 23755 - DNA, 25 bp, S. cerevisiae
ctgtcgcggcacatgacgcagtaat

SEQ ID NO: 23756 - DNA, 25 bp, S. cerevisiae
ctgttggtggccgttctgataatac

SEQ ID NO: 23757 - DNA, 25 bp, S. cerevisiae
ctggtcgatcagtgcctgtatggca

SEQ ID NO: 23758 - DNA, 25 bp, S. cerevisiae
ctgttccacatgtaacgtctgcgta

SEQ ID NO: 23759 - DNA, 25 bp, S. cerevisiae
ctgtgacattgttcccttagatttc

SEQ ID NO: 23760 - DNA, 25 bp, S. cerevisiae
ctgatatggcataggcacacggatg

SEQ ID NO: 23761 - DNA, 25 bp, S. cerevisiae
ctgcggatgaaccattgaccacttt

SEQ ID NO: 23762 - DNA, 25 bp, S. cerevisiae
ctgctgttgccgctatgttaatcta

SEQ ID NO: 23763 - DNA, 25 bp, S. cerevisiae
ctgccattgcctttgtttacgagta

SEQ ID NO: 23764 - DNA, 25 bp, S. cerevisiae
cgctgaatgcactggttttaggaat

SEQ ID NO: 23765 - DNA, 25 bp, S. cerevisiae
ctggtggcggctctgtatttaatat

SEQ ID NO: 23766 - DNA, 25 bp, S. cerevisiae
ctgtgtacggatacgatttcgagtt

SEQ ID NO: 23767 - DNA, 25 bp, S. cerevisiae
ctgctagagcgttcctttttgagat

SEQ ID NO: 23768 - DNA, 25 bp, S. cerevisiae
ctgccgccaatttgaatttcttcca

SEQ ID NO: 23769 - DNA, 25 bp, S. cerevisiae
ctgctttaatggctcttctagggaa

SEQ ID NO: 23770 - DNA, 25 bp, S. cerevisiae
ctgttttagtagcacgtgacgaatt

SEQ ID NO: 23771 - DNA, 25 bp, S. cerevisiae
ctgttatggctctataccgtacgga

SEQ ID NO: 23772 - DNA, 25 bp, S. cerevisiae
ctgttgttttctaccccaagagaag

SEQ ID NO: 23773 - DNA, 25 bp, S. cerevisiae
ctgatggatttgaccctgcggcaaa

SEQ ID NO: 23774 - DNA, 25 bp, S. cerevisiae
ctgccattcactctcctatgaaaaa

SEQ ID NO: 23775 - DNA, 25 bp, S. cerevisiae
cggagaccttctacgtgctgagcag

SEQ ID NO: 23776 - DNA, 25 bp, S. cerevisiae
ctgggtcttttgacgctggacggta

SEQ ID NO: 23777 - DNA, 25 bp, S. cerevisiae
tcggtgcccatttaaggaaacagct

SEQ ID NO: 23778 - DNA, 25 bp, S. cerevisiae
cgggcgacttgaacggaatatctgt

SEQ ID NO: 23779 - DNA, 25 bp, S. cerevisiae
cgagggagctgtgccggttataaat

SEQ ID NO: 23780 - DNA, 25 bp, S. cerevisiae
cggagggctgggtctgaatttaact

SEQ ID NO: 23781 - DNA, 25 bp, S. cerevisiae
ctgcactggcgttttgctaattcta

SEQ ID NO: 23782 - DNA, 25 bp, S. cerevisiae
ctggtggtgctgatagcgtcgacat

SEQ ID NO: 23783 - DNA, 25 bp, S. cerevisiae
ctgcaattatcttcacctcattagg

SEQ ID NO: 23784 - DNA, 25 bp, S. cerevisiae
ctgatgctccattcaacaaggttgt

SEQ ID NO: 23785 - DNA, 25 bp, S. cerevisiae
ctgcttcatgatcagctttcagatg

SEQ ID NO: 23786 - DNA, 25 bp, S. cerevisiae
ctgctgctcaacaagaatctgcctg

SEQ ID NO: 23787 - DNA, 25 bp, S. cerevisiae
ctgctgctctggaaggtgctttgaa

SEQ ID NO: 23788 - DNA, 25 bp, S. cerevisiae
ctgctgttggcgttgcttactataa

SEQ ID NO: 23789 - DNA, 25 bp, S. cerevisiae
ctgcgttgcagcgtattgggcttac

SEQ ID NO: 23790 - DNA, 25 bp, S. cerevisiae
ctggcttacaagatgctacggttca

SEQ ID NO: 23791 - DNA, 25 bp, S. cerevisiae
ctggctatacaaactgcatgggctt

SEQ ID NO: 23792 - DNA, 25 bp, S. cerevisiae
ctgcgccattatcatctgtttcatt

SEQ ID NO: 23793 - DNA, 25 bp, S. cerevisiae
ctggcttccggaatactatttctct

SEQ ID NO: 23794 - DNA, 25 bp, S. cerevisiae
ctgtcccgttgaaagatacctctat

SEQ ID NO: 23795 - DNA, 25 bp, S. cerevisiae
ctggagaggccaactaggtcgctac

SEQ ID NO: 23796 - DNA, 25 bp, S. cerevisiae
ctggaagcagcctctaagttttata

SEQ ID NO: 23797 - DNA, 25 bp, S. cerevisiae
ctggaagcgctgtcaaatcgaattt

SEQ ID NO: 23798 - DNA, 25 bp, S. cerevisiae
ctggcccatcaacaactcgaagtat

SEQ ID NO: 23799 - DNA, 25 bp, S. cerevisiae
ctgtccgcatattctaactcgattg

SEQ ID NO: 23800 - DNA, 25 bp, S. cerevisiae
ctgtccagccattagaactcgattt

SEQ ID NO: 23801 - DNA, 25 bp, S. cerevisiae
ctggtggttaatggcgacctctgca

SEQ ID NO: 23802 - DNA, 25 bp, S. cerevisiae
ctgaaagttctgttgcaagctctgt

SEQ ID NO: 23803 - DNA, 25 bp, S. cerevisiae
ctgaacctggtgtctttgacgtgaa

SEQ ID NO: 23804 - DNA, 25 bp, S. cerevisiae
ctggtgcagcacgtgttttaagaat

SEQ ID NO: 23805 - DNA, 25 bp, S. cerevisiae
cgtgggttccacattcatgagtttg

SEQ ID NO: 23806 - DNA, 25 bp, S. cerevisiae
ctgttttcgccgaaaccttgaagca

SEQ ID NO: 23807 - DNA, 25 bp, S. cerevisiae
cgtattgccgctcaaactttggaag

SEQ ID NO: 23808 - DNA, 25 bp, S. cerevisiae
ctgctgtcccgtcaatttcagaaga

SEQ ID NO: 23809 - DNA, 25 bp, S. cerevisiae
ctggaactcgccaaatgtatcgatt

SEQ ID NO: 23810 - DNA, 25 bp, S. cerevisiae
ctgggaacacctgatgatgacgaaa

SEQ ID NO: 23811 - DNA, 25 bp, S. cerevisiae
ctggtgggcagcgttctgaacgtaa

SEQ ID NO: 23812 - DNA, 25 bp, S. cerevisiae
ctggcgctggcgtagatgtaaatac

SEQ ID NO: 23813 - DNA, 25 bp, S. cerevisiae
ctgggcgcacgcagtgtatcaattt

SEQ ID NO: 23814 - DNA, 25 bp, S. cerevisiae
ctgtggccacgaccagtgtgatgat

SEQ ID NO: 23815 - DNA, 25 bp, S. cerevisiae
ctgatggcccagtaacttttagaaa

SEQ ID NO: 23816 - DNA, 25 bp, S. cerevisiae
ctgagactttgctacctttggaact

SEQ ID NO: 23817 - DNA, 25 bp, S. cerevisiae
ctggttattcatctctttggcacat

SEQ ID NO: 23818 - DNA, 25 bp, S. cerevisiae
ctgcttccttctatctgtttgatga

SEQ ID NO: 23819 - DNA, 25 bp, S. cerevisiae
ctgtcgcctcttacatgaccaaaat

SEQ ID NO: 23820 - DNA, 25 bp, S. cerevisiae
ctgatcgcacctttagtctagacaa

SEQ ID NO: 23821 - DNA, 25 bp, S. cerevisiae
ctgcatctacctcctggttggaaaa

SEQ ID NO: 23822 - DNA, 25 bp, S. cerevisiae
cgctgccaatgtcccagttgaaaat

SEQ ID NO: 23823 - DNA, 25 bp, S. cerevisiae
ctgctgcgggctacaatttgaacaa

SEQ ID NO: 23824 - DNA, 25 bp, S. cerevisiae
ctgctgctcctgttcaactggaaaa

SEQ ID NO: 23825 - DNA, 25 bp, S. cerevisiae
ctgtcagccaagaatctaccacttt

SEQ ID NO: 23826 - DNA, 25 bp, S. cerevisiae
ctgctttgaacttcagctctgattc

SEQ ID NO: 23827 - DNA, 25 bp, S. cerevisiae
ctgatttggatcgtgagcttttgca

SEQ ID NO: 23828 - DNA, 25 bp, S. cerevisiae
ctgcacttggtggtactgtcactat

SEQ ID NO: 23829 - DNA, 25 bp, S. cerevisiae
ctgcaatattgtgctttgtcccatt

SEQ ID NO: 23830 - DNA, 25 bp, S. cerevisiae
ctgcaggctcttacattagtccaat

SEQ ID NO: 23831 - DNA, 25 bp, S. cerevisiae
cgtgttgaacagagattttgagcgt

SEQ ID NO: 23832 - DNA, 25 bp, S. cerevisiae
cgtgttgaacagagattttgagcgt

SEQ ID NO: 23833 - DNA, 25 bp, S. cerevisiae
cggtctgaaagaacgtttgagctat

SEQ ID NO: 23834 - DNA, 25 bp, S. cerevisiae
cggtgctcaaggtactaagtttaga

SEQ ID NO: 23835 - DNA, 25 bp, S. cerevisiae
ctgtgctatttgcaggaaccatata

SEQ ID NO: 23836 - DNA, 25 bp, S. cerevisiae
ctggttctccctgattcagagtgta

SEQ ID NO: 23837 - DNA, 25 bp, S. cerevisiae
ctggtcttctggtctgttagggcaa

SEQ ID NO: 23838 - DNA, 25 bp, S. cerevisiae
ctgagcacccgttaagtctgggaca

SEQ ID NO: 23839 - DNA, 25 bp, S. cerevisiae
ctgtccaccgtatcaccgatgaaga

SEQ ID NO: 23840 - DNA, 25 bp, S. cerevisiae
ctgtcagaccagcatacacactatt

SEQ ID NO: 23841 - DNA, 25 bp, S. cerevisiae
cgtcaaagctgcatggccatcattt

SEQ ID NO: 23842 - DNA, 25 bp, S. cerevisiae
ctggaaagctgttggcaaaccttgc

SEQ ID NO: 23843 - DNA, 25 bp, S. cerevisiae
cgtgtacaccaacgcatggcagggt

SEQ ID NO: 23844 - DNA, 25 bp, S. cerevisiae
cgatctcgccgatgatggactgaat

SEQ ID NO: 23845 - DNA, 25 bp, S. cerevisiae
cgaccccgaagacgttgacacatgg

SEQ ID NO: 23846 - DNA, 25 bp, S. cerevisiae
cggctcccaacgttattgtcaatga

SEQ ID NO: 23847 - DNA, 25 bp, S. cerevisiae
ctggccccaatgatcttgatctgtg

SEQ ID NO: 23848 - DNA, 25 bp, S. cerevisiae
ctggcgccgcagtgtattatggtat

SEQ ID NO: 23849 - DNA, 25 bp, S. cerevisiae
ctgggccgcagattggtaatgcaat

SEQ ID NO: 23850 - DNA, 25 bp, S. cerevisiae
ctgtggccactgttttcactggaac

SEQ ID NO: 23851 - DNA, 25 bp, S. cerevisiae
cgtccggtattgtcgtttgatcaac

SEQ ID NO: 23852 - DNA, 25 bp, S. cerevisiae
cgtccggttctgttgacggtcagaa

SEQ ID NO: 23853 - DNA, 25 bp, S. cerevisiae
ctggtctcgttttgctactaacaca

SEQ ID NO: 23854 - DNA, 25 bp, S. cerevisiae
cggctttacattgggcgtcgttgaa

SEQ ID NO: 23855 - DNA, 25 bp, S. cerevisiae
cgactgtttgttgtgggctctagac

SEQ ID NO: 23856 - DNA, 25 bp, S. cerevisiae
cgggatcttctacggtaacttcttg

SEQ ID NO: 23857 - DNA, 25 bp, S. cerevisiae
ctggtttttcgggtgctgatttaca

SEQ ID NO: 23858 - DNA, 25 bp, S. cerevisiae
ctgacatccttacagtcctttgtaa

SEQ ID NO: 23859 - DNA, 25 bp, S. cerevisiae
cgtcgccttcactggtttagtaagt

SEQ ID NO: 23860 - DNA, 25 bp, S. cerevisiae
cggttcccctcttctataataatgg

SEQ ID NO: 23861 - DNA, 25 bp, S. cerevisiae
ctggttatcctttcttaattcacgg

SEQ ID NO: 23862 - DNA, 25 bp, S. cerevisiae
cgacaagttcccatctttgttagat

SEQ ID NO: 23863 - DNA, 25 bp, S. cerevisiae
ctgaaacatacatcgctgctggaga

SEQ ID NO: 23864 - DNA, 25 bp, S. cerevisiae
ctgttctgtacatgctcacgtttta

SEQ ID NO: 23865 - DNA, 25 bp, S. cerevisiae
ctgtgtgtcattccaattcttcttg

SEQ ID NO: 23866 - DNA, 25 bp, S. cerevisiae
ctgtgcttttccgttgtttggtaga

SEQ ID NO: 23867 - DNA, 25 bp, S. cerevisiae
ctgtcttctccatgtttggtggtaa

SEQ ID NO: 23868 - DNA, 25 bp, S. cerevisiae
cggcaacatccaacttttactacta

SEQ ID NO: 23869 - DNA, 25 bp, S. cerevisiae
gaaccatactcataatttgcccggc

SEQ ID NO: 23870 - DNA, 25 bp, S. cerevisiae
gcaactcaaacattaggtcccaagg

SEQ ID NO: 23871 - DNA, 25 bp, S. cerevisiae
ctggaacaaccttttccaatgggat

SEQ ID NO: 23872 - DNA, 25 bp, S. cerevisiae
ctggacacaacccactgagcaaagt

SEQ ID NO: 23873 - DNA, 25 bp, S. cerevisiae
cggaccaactctataatcagccttg

SEQ ID NO: 23874 - DNA, 25 bp, S. cerevisiae
cggcaccatcgcatttaaaacttca

SEQ ID NO: 23875 - DNA, 25 bp, S. cerevisiae
cgtggtatcgatattcaagccgtta

SEQ ID NO: 23876 - DNA, 25 bp, S. cerevisiae
cggtgatacgccattaacatttgtc

SEQ ID NO: 23877 - DNA, 25 bp, S. cerevisiae
cggtgatattgctttcggattacta

SEQ ID NO: 23878 - DNA, 25 bp, S. cerevisiae
ctgttattgctgctttggcccaaaa

SEQ ID NO: 23879 - DNA, 25 bp, S. cerevisiae
ctgacggccatctgcagtttttgaa

SEQ ID NO: 23880 - DNA, 25 bp, S. cerevisiae
ctggccctcacacggattatttatg

SEQ ID NO: 23881 - DNA, 25 bp, S. cerevisiae
ctgggttcaagtcgccgaagcatat

SEQ ID NO: 23882 - DNA, 25 bp, S. cerevisiae
ctgtgaatgatgttgttacggtcta

SEQ ID NO: 23883 - DNA, 25 bp, S. cerevisiae
cggactttgacttgggcgatttgca

SEQ ID NO: 23884 - DNA, 25 bp, S. cerevisiae
cggacgtgaaattggatgcgctatt

SEQ ID NO: 23885 - DNA, 25 bp, S. cerevisiae
cggagaacatatttggccctgccat

SEQ ID NO: 23886 - DNA, 25 bp, S. cerevisiae
ctggatttggctgcttggctcggaa

SEQ ID NO: 23887 - DNA, 25 bp, S. cerevisiae
ctggttctggtgtcttgattgccga

SEQ ID NO: 23888 - DNA, 25 bp, S. cerevisiae
cggattcatgggtcttttctccaaa

SEQ ID NO: 23889 - DNA, 25 bp, S. cerevisiae
cggcctagcaggtgtacatttcaaa

SEQ ID NO: 23890 - DNA, 25 bp, S. cerevisiae
cgtcacccactgtgatgacaatgga

SEQ ID NO: 23891 - DNA, 25 bp, S. cerevisiae
cgtacatcgccccagaggaatatat

SEQ ID NO: 23892 - DNA, 25 bp, S. cerevisiae
ctgtgatgattgtcggtgggcctaa

SEQ ID NO: 23893 - DNA, 25 bp, S. cerevisiae
ctggatgacatgtttgagggcgaaa

SEQ ID NO: 23894 - DNA, 25 bp, S. cerevisiae
cgggttcaacacaatcttttccaag

SEQ ID NO: 23895 - DNA, 25 bp, S. cerevisiae
cggacaccaaccaatcgttttcaag

SEQ ID NO: 23896 - DNA, 25 bp, S. cerevisiae
cggacatctcattactacggctagt

SEQ ID NO: 23897 - DNA, 25 bp, S. cerevisiae
cgatactgtattggcaacggctggc

SEQ ID NO: 23898 - DNA, 25 bp, S. cerevisiae
cggcactgatttggacgcgttggtc

SEQ ID NO: 23899 - DNA, 25 bp, S. cerevisiae
cggtgctgataatacggctcgctta

SEQ ID NO: 23900 - DNA, 25 bp, S. cerevisiae
cgattgctgaaatagacggcgacga

SEQ ID NO: 23901 - DNA, 25 bp, S. cerevisiae
gcctacaaggagttacgtgacatgc

SEQ ID NO: 23902 - DNA, 25 bp, S. cerevisiae
gggacctagaagacctgtacacgga

SEQ ID NO: 23903 - DNA, 25 bp, S. cerevisiae
cgttcttaaacagcgatccaccgag

SEQ ID NO: 23904 - DNA, 25 bp, S. cerevisiae
cgtcctatagttgccgataccacgg

SEQ ID NO: 23905 - DNA, 25 bp, S. cerevisiae
cgtgtgctttttgaccataggccat

SEQ ID NO: 23906 - DNA, 25 bp, S. cerevisiae
cggaacttttcacttgttcaaagat

SEQ ID NO: 23907 - DNA, 25 bp, S. cerevisiae
tcggaccaaaacaccttcaaagatg

SEQ ID NO: 23908 - DNA, 25 bp, S. cerevisiae
cgttccacctacacctttaatgata

SEQ ID NO: 23909 - DNA, 25 bp, S. cerevisiae
ctggaacccagctgattttgacaaa

SEQ ID NO: 23910 - DNA, 25 bp, S. cerevisiae
ctgtgtccacagttgagttttgtta

SEQ ID NO: 23911 - DNA, 25 bp, S. cerevisiae
ctgtatccaagttttctactgttga

SEQ ID NO: 23912 - DNA, 25 bp, S. cerevisiae
ctgatttaattgttcctttggtgca

SEQ ID NO: 23913 - DNA, 25 bp, S. cerevisiae
cgttggtcgctatcacatctagtta

SEQ ID NO: 23914 - DNA, 25 bp, S. cerevisiae
cgttgaatcctattatcccactatt

SEQ ID NO: 23915 - DNA, 25 bp, S. cerevisiae
gcgtgagttttttgatacccgctct

SEQ ID NO: 23916 - DNA, 25 bp, S. cerevisiae
cggtggttcttcgaggatcctgact

SEQ ID NO: 23917 - DNA, 25 bp, S. cerevisiae
ctggcggattctaagcacgtactga

SEQ ID NO: 23918 - DNA, 25 bp, S. cerevisiae
cggtgattcggctggtggtcataat

SEQ ID NO: 23919 - DNA, 25 bp, S. cerevisiae
cggtgattctgttgtcgacgtccaa

SEQ ID NO: 23920 - DNA, 25 bp, S. cerevisiae
ctggtgcttacttgtacctgtcaaa

SEQ ID NO: 23921 - DNA, 25 bp, S. cerevisiae
cggttacgcaactgccttgaaaatt

SEQ ID NO: 23922 - DNA, 25 bp, S. cerevisiae
ctgtttttgctttaatgtcccgtgt

SEQ ID NO: 23923 - DNA, 25 bp, S. cerevisiae
ctggcgaatacccattggctgtgta

SEQ ID NO: 23924 - DNA, 25 bp, S. cerevisiae
ctgtgctgcatctcccaaggaagaa

SEQ ID NO: 23925 - DNA, 25 bp, S. cerevisiae
ctgggtcccactgaagaaacacgct

SEQ ID NO: 23926 - DNA, 25 bp, S. cerevisiae
gcgggtacggtctggataaacactt

SEQ ID NO: 23927 - DNA, 25 bp, S. cerevisiae
cggccggagcgttgttcaaaaatat

SEQ ID NO: 23928 - DNA, 25 bp, S. cerevisiae
ccgccgaagcggatttcatcgaaac

SEQ ID NO: 23929 - DNA, 25 bp, S. cerevisiae
cgggcgacggtgttgttcaccataa

SEQ ID NO: 23930 - DNA, 25 bp, S. cerevisiae
cgctttagttgttggtggcttcgaa

SEQ ID NO: 23931 - DNA, 25 bp, S. cerevisiae
cgcctacgtttacagagcttccaag

SEQ ID NO: 23932 - DNA, 25 bp, S. cerevisiae
cggcgtgccaaccatcagaattttt

SEQ ID NO: 23933 - DNA, 25 bp, S. cerevisiae
cgtgcttccaacctaagaccaatta

SEQ ID NO: 23934 - DNA, 25 bp, S. cerevisiae
cggctgcctctaccttagaagatat

SEQ ID NO: 23935 - DNA, 25 bp, S. cerevisiae
ctggtcggtaactgataatcctgat

SEQ ID NO: 23936 - DNA, 25 bp, S. cerevisiae
ctgttggctatcttctgttgatgtt

SEQ ID NO: 23937 - DNA, 25 bp, S. cerevisiae
ctgtgggcgttttgtctggtcagaa

SEQ ID NO: 23938 - DNA, 25 bp, S. cerevisiae
cgtcgtcgaatctgtcggtgctgaa

SEQ ID NO: 23939 - DNA, 25 bp, S. cerevisiae
cggctcctgttttagctcaaactat

SEQ ID NO: 23940 - DNA, 25 bp, S. cerevisiae
ccctctcctcttttagaacacgatg

SEQ ID NO: 23941 - DNA, 25 bp, S. cerevisiae
ctgtgtttcttaccagagcagaata

SEQ ID NO: 23942 - DNA, 25 bp, S. cerevisiae
ctgtgttccagctaccatttattgt

SEQ ID NO: 23943 - DNA, 25 bp, S. cerevisiae
ctgttgttgttgttgcttatcctgc

SEQ ID NO: 23944 - DNA, 25 bp, S. cerevisiae
cgtgtgttgggagtcgtatactgtt

SEQ ID NO: 23945 - DNA, 25 bp, S. cerevisiae
ctgtcggtaacttgggtaacgctgt

SEQ ID NO: 23946 - DNA, 25 bp, S. cerevisiae
cgtctttgaacgtgagtgaacctaa

SEQ ID NO: 23947 - DNA, 25 bp, S. cerevisiae
cggtttgattgccgccagaagaact

SEQ ID NO: 23948 - DNA, 25 bp, S. cerevisiae
cggtattgttgtcccaagaaacaca

SEQ ID NO: 23949 - DNA, 25 bp, S. cerevisiae
cgggatttggctctcaaaaaaggat

SEQ ID NO: 23950 - DNA, 25 bp, S. cerevisiae
ccgactcttcctctcaaatagtaga

SEQ ID NO: 23951 - DNA, 25 bp, S. cerevisiae
cgtggcgcttgagaataccgtttat

SEQ ID NO: 23952 - DNA, 25 bp, S. cerevisiae
cgggctctttggctacaagcttata

SEQ ID NO: 23953 - DNA, 25 bp, S. cerevisiae
cggtggctttggtagcactggtaac

SEQ ID NO: 23954 - DNA, 25 bp, S. cerevisiae
cggtatgaccatgaccaacgataat

SEQ ID NO: 23955 - DNA, 25 bp, S. cerevisiae
cggtctggtatcgattgcaattgag

SEQ ID NO: 23956 - DNA, 25 bp, S. cerevisiae
cggaagcttttttaatcgtggcaat

SEQ ID NO: 23957 - DNA, 25 bp, S. cerevisiae
cggttgcctttgtagttggtcggat

SEQ ID NO: 23958 - DNA, 25 bp, S. cerevisiae
ctgtatggctttttcctggttcata

SEQ ID NO: 23959 - DNA, 25 bp, S. cerevisiae
ctgtttgctgtctcgcgccttttaa

SEQ ID NO: 23960 - DNA, 25 bp, S. cerevisiae
ctggctaatgccaagtttaacaaga

SEQ ID NO: 23961 - DNA, 25 bp, S. cerevisiae
cggtattgagtccatgttgaagcac

SEQ ID NO: 23962 - DNA, 25 bp, S. cerevisiae
cggtgttggtaagttgaacaaattg

SEQ ID NO: 23963 - DNA, 25 bp, S. cerevisiae
cgggctgggttcaattgttcgttat

SEQ ID NO: 23964 - DNA, 25 bp, S. cerevisiae
ctggctttgctaaacactgcttgta

SEQ ID NO: 23965 - DNA, 25 bp, S. cerevisiae
ctggaccattgtcagtgagcgtatg

SEQ ID NO: 23966 - DNA, 25 bp, S. cerevisiae
cggcagcgacgacatgaactcagat

SEQ ID NO: 23967 - DNA, 25 bp, S. cerevisiae
ctggctcaagccttagacactatta

SEQ ID NO: 23968 - DNA, 25 bp, S. cerevisiae
ctggcaaagccattcctgacattat

SEQ ID NO: 23969 - DNA, 25 bp, S. cerevisiae
cgagcaataatcctcctggcatatt

SEQ ID NO: 23970 - DNA, 25 bp, S. cerevisiae
cgagtgataaccctgctgctgtaat

SEQ ID NO: 23971 - DNA, 25 bp, S. cerevisiae
cgtggataccgctgctgggaagatt

SEQ ID NO: 23972 - DNA, 25 bp, S. cerevisiae
cgttgtcaattgtaccagtgggtta

SEQ ID NO: 23973 - DNA, 25 bp, S. cerevisiae
cgttaattatgattgcccgggttct

SEQ ID NO: 23974 - DNA, 25 bp, S. cerevisiae
cggtactctagctaacgcgaatatt

SEQ ID NO: 23975 - DNA, 25 bp, S. cerevisiae
ctggctgtgataattttcctgctac

SEQ ID NO: 23976 - DNA, 25 bp, S. cerevisiae
ctggagtggcatattctgccgctaa

SEQ ID NO: 23977 - DNA, 25 bp, S. cerevisiae
ctggacactcactgggtcgtgaaaa

SEQ ID NO: 23978 - DNA, 25 bp, S. cerevisiae
cggtttgatcagaaagtacggctta

SEQ ID NO: 23979 - DNA, 25 bp, S. cerevisiae
cggtttgatcagaaagtacggctta

SEQ ID NO: 23980 - DNA, 25 bp, S. cerevisiae
cgatccaaagagacagtttccagtt

SEQ ID NO: 23981 - DNA, 25 bp, S. cerevisiae
cgattaagagaacgctgggacagct

SEQ ID NO: 23982 - DNA, 25 bp, S. cerevisiae
cggtgccaagcgtgctcaattcaga

SEQ ID NO: 23983 - DNA, 25 bp, S. cerevisiae
cggtggccaaacctcatcaatttga

SEQ ID NO: 23984 - DNA, 25 bp, S. cerevisiae
cggttccacatatcgctaagctaaa

SEQ ID NO: 23985 - DNA, 25 bp, S. cerevisiae
cgaaatgagctatcgcgtgcgtcga

SEQ ID NO: 23986 - DNA, 25 bp, S. cerevisiae
ctgtgaattctatcgcttggctgga

SEQ ID NO: 23987 - DNA, 25 bp, S. cerevisiae
ctgtgatcatctctttttgtgcgga

SEQ ID NO: 23988 - DNA, 25 bp, S. cerevisiae
ctggtacccgtgacatggccaagaa

SEQ ID NO: 23989 - DNA, 25 bp, S. cerevisiae
cggcataattcgtcgtggtcacaat

SEQ ID NO: 23990 - DNA, 25 bp, S. cerevisiae
cggcaatattggctacattccgtat

SEQ ID NO: 23991 - DNA, 25 bp, S. cerevisiae
cggcgatttcggtaatgttgcacta

SEQ ID NO: 23992 - DNA, 25 bp, S. cerevisiae
ctggcgtttcaggagtcattatcaa

SEQ ID NO: 23993 - DNA, 25 bp, S. cerevisiae
ctgggcctcagtccgtattggaaaa

SEQ ID NO: 23994 - DNA, 25 bp, S. cerevisiae
cggctcgtgccaacaaatcagacaa

SEQ ID NO: 23995 - DNA, 25 bp, S. cerevisiae
cggcggtgcaccatcacaacaaaag

SEQ ID NO: 23996 - DNA, 25 bp, S. cerevisiae
ctggtggttacattgctgctgatca

SEQ ID NO: 23997 - DNA, 25 bp, S. cerevisiae
ctggttactcaatggtgatgacaat

SEQ ID NO: 23998 - DNA, 25 bp, S. cerevisiae
cgtggaatttatcctgctggtcttc

SEQ ID NO: 23999 - DNA, 25 bp, S. cerevisiae
cgtgaatttttctcccctgaaatgt

SEQ ID NO: 24000 - DNA, 25 bp, S. cerevisiae
ctgtggcaattattcggccgttaat

SEQ ID NO: 24001 - DNA, 25 bp, S. cerevisiae
ctggcgagactattattccgttgtt

SEQ ID NO: 24002 - DNA, 25 bp, S. cerevisiae
cggcgtatgatgtttaccagttctt

SEQ ID NO: 24003 - DNA, 25 bp, S. cerevisiae
cgaggtagcgggtaccatggtcatt

SEQ ID NO: 24004 - DNA, 25 bp, S. cerevisiae
cgtgcagtagcaggtgttcttggta

SEQ ID NO: 24005 - DNA, 25 bp, S. cerevisiae
cggtgctacgcgtttctatagctag

SEQ ID NO: 24006 - DNA, 25 bp, S. cerevisiae
gctggtcccctcattattagggcta

SEQ ID NO: 24007 - DNA, 25 bp, S. cerevisiae
cggtgacacgtctttattcgatcaa

SEQ ID NO: 24008 - DNA, 25 bp, S. cerevisiae
gccaggacggtccttcttcgaaagg

SEQ ID NO: 24009 - DNA, 25 bp, S. cerevisiae
gccaggacggtccttcttcgaaagg

SEQ ID NO: 24010 - DNA, 25 bp, S. cerevisiae
cgtggtgccggattttttatgtgaa

SEQ ID NO: 24011 - DNA, 25 bp, S. cerevisiae
ctgggttaccgctatttattatcat

SEQ ID NO: 24012 - DNA, 25 bp, S. cerevisiae
cggctttaccgtttctattcatgaa

SEQ ID NO: 24013 - DNA, 25 bp, S. cerevisiae
cgtgccttaccaatgaatctttcca

SEQ ID NO: 24014 - DNA, 25 bp, S. cerevisiae
cgtcagttaggtcccaattcttgaa

SEQ ID NO: 24015 - DNA, 25 bp, S. cerevisiae
ccaggatacggttctcgtgtggtaa

SEQ ID NO: 24016 - DNA, 25 bp, S. cerevisiae
cgtctgttttcaaaggtgtcgggat

SEQ ID NO: 24017 - DNA, 25 bp, S. cerevisiae
cgtaatgaccaaacctcttccgata

SEQ ID NO: 24018 - DNA, 25 bp, S. cerevisiae
cgttgtttatactcttcttaggctt

SEQ ID NO: 24019 - DNA, 25 bp, S. cerevisiae
ctggagcttcattacgtgctggttt

SEQ ID NO: 24020 - DNA, 25 bp, S. cerevisiae
ctggctgctctaaacgtgtggtacg

SEQ ID NO: 24021 - DNA, 25 bp, S. cerevisiae
ctggattcttcattagttgggacga

SEQ ID NO: 24022 - DNA, 25 bp, S. cerevisiae
cgtgcctatttcgtctggtcaagat

SEQ ID NO: 24023 - DNA, 25 bp, S. cerevisiae
cggcacgatttcatagtcactctag

SEQ ID NO: 24024 - DNA, 25 bp, S. cerevisiae
cgagaccattgtggagcgattttaa

SEQ ID NO: 24025 - DNA, 25 bp, S. cerevisiae
cggaagtaatgctgactctgtctat

SEQ ID NO: 24026 - DNA, 25 bp, S. cerevisiae
cggagaaattgttgatgccatttat

SEQ ID NO: 24027 - DNA, 25 bp, S. cerevisiae
cggtcagtgtcgttctaagttcatt

SEQ ID NO: 24028 - DNA, 25 bp, S. cerevisiae
cggtcatgcttttgtctctagtaat

SEQ ID NO: 24029 - DNA, 25 bp, S. cerevisiae
cggatgcatctcataatttgacgaa

SEQ ID NO: 24030 - DNA, 25 bp, S. cerevisiae
cgggattcattatttgtgtgggaca

SEQ ID NO: 24031 - DNA, 25 bp, S. cerevisiae
cggtgattaatcaattcttggtcaa

SEQ ID NO: 24032 - DNA, 25 bp, S. cerevisiae
ctggtactactgaatctcctggtga

SEQ ID NO: 24033 - DNA, 25 bp, S. cerevisiae
cgtatcatatactgcatcttcgacc

SEQ ID NO: 24034 - DNA, 25 bp, S. cerevisiae
cggcctgatgcttaacttagtcgta

SEQ ID NO: 24035 - DNA, 25 bp, S. cerevisiae
cgcagcctggtctggttgacataat

SEQ ID NO: 24036 - DNA, 25 bp, S. cerevisiae
cggccgtgtcgttttgatcaaaaag

SEQ ID NO: 24037 - DNA, 25 bp, S. cerevisiae
ctggttggcctttttcttcattata

SEQ ID NO: 24038 - DNA, 25 bp, S. cerevisiae
cgtgtgtggtacaatgtgtgtgttt

SEQ ID NO: 24039 - DNA, 25 bp, S. cerevisiae
ctggtatcactggactttgcctata

SEQ ID NO: 24040 - DNA, 25 bp, S. cerevisiae
ctggagcatccttacttgtctatat

SEQ ID NO: 24041 - DNA, 25 bp, S. cerevisiae
ctggatatgccatgttttagctaca

SEQ ID NO: 24042 - DNA, 25 bp, S. cerevisiae
cggttcgaccatgggtagctcacat

SEQ ID NO: 24043 - DNA, 25 bp, S. cerevisiae
cggtccgatggcttcgcaaacaata

SEQ ID NO: 24044 - DNA, 25 bp, S. cerevisiae
cggctgccgtggatgtgcaagcaca

SEQ ID NO: 24045 - DNA, 25 bp, S. cerevisiae
cggtgcctccgttgttgttgtcaag

SEQ ID NO: 24046 - DNA, 25 bp, S. cerevisiae
cggagcctgctactcatgaagttat

SEQ ID NO: 24047 - DNA, 25 bp, S. cerevisiae
cgatgccggcttcgcagaaatttca

SEQ ID NO: 24048 - DNA, 25 bp, S. cerevisiae
cgatgcctcttctcaaagtttcagt

SEQ ID NO: 24049 - DNA, 25 bp, S. cerevisiae
cgggctctatcattgaatgtggaac

SEQ ID NO: 24050 - DNA, 25 bp, S. cerevisiae
cggtgctcttcttcatgacaggaga

SEQ ID NO: 24051 - DNA, 25 bp, S. cerevisiae
cgtagatttcattgtggcgctgttc

SEQ ID NO: 24052 - DNA, 25 bp, S. cerevisiae
cggcgttgatgtctgccatatatca

SEQ ID NO: 24053 - DNA, 25 bp, S. cerevisiae
cgggcagtctctacatgccaatatt

SEQ ID NO: 24054 - DNA, 25 bp, S. cerevisiae
cggatcctcttcttcagaatctgag

SEQ ID NO: 24055 - DNA, 25 bp, S. cerevisiae
ccgtcccgaaagatttggttgcgag

SEQ ID NO: 24056 - DNA, 25 bp, S. cerevisiae
cggatcccgacaagttctggttgat

SEQ ID NO: 24057 - DNA, 25 bp, S. cerevisiae
ctggagcccgttgatttgttgaata

SEQ ID NO: 24058 - DNA, 25 bp, S. cerevisiae
cggcggctgcttctcaaaatgttga

SEQ ID NO: 24059 - DNA, 25 bp, S. cerevisiae
cggccaggctgacttcgatatagtt

SEQ ID NO: 24060 - DNA, 25 bp, S. cerevisiae
cggcaatatgtgtggcttgaactat

SEQ ID NO: 24061 - DNA, 25 bp, S. cerevisiae
gctgtggctccaggacagacctgtc

SEQ ID NO: 24062 - DNA, 25 bp, S. cerevisiae
ctggcgctgtacaaggactctgtca

SEQ ID NO: 24063 - DNA, 25 bp, S. cerevisiae
cggccattatgtttccctatgtaaa

SEQ ID NO: 24064 - DNA, 25 bp, S. cerevisiae
cggccatggtgttatcgtgtatcta

SEQ ID NO: 24065 - DNA, 25 bp, S. cerevisiae
cgtgctgctcgtaagaaccgttatg

SEQ ID NO: 24066 - DNA, 25 bp, S. cerevisiae
cgcatcgtcgctcgataacggtaat

SEQ ID NO: 24067 - DNA, 25 bp, S. cerevisiae
cgaggccctggctaaagagagatca

SEQ ID NO: 24068 - DNA, 25 bp, S. cerevisiae
cggtgtcctggccactaataacaag

SEQ ID NO: 24069 - DNA, 25 bp, S. cerevisiae
cggctacgcggatcttgaacacaag

SEQ ID NO: 24070 - DNA, 25 bp, S. cerevisiae
cggccacctggatttgctgaagaaa

SEQ ID NO: 24071 - DNA, 25 bp, S. cerevisiae
cgtccatcctctattgccataaagg

SEQ ID NO: 24072 - DNA, 25 bp, S. cerevisiae
cggccatcatttgcttcgtattagg

SEQ ID NO: 24073 - DNA, 25 bp, S. cerevisiae
tctaaacaagtcttacgttttgcca

SEQ ID NO: 24074 - DNA, 25 bp, S. cerevisiae
gcgatagcgctaactcacaactgga

SEQ ID NO: 24075 - DNA, 25 bp, S. cerevisiae
cgacggtcaactgcgtttttcgaat

SEQ ID NO: 24076 - DNA, 25 bp, S. cerevisiae
cgacgatttactgaaccgcattggt

SEQ ID NO: 24077 - DNA, 25 bp, S. cerevisiae
cgacggtttcgttcagccaattaat

SEQ ID NO: 24078 - DNA, 25 bp, S. cerevisiae
cggcaggtttcgatactacgctaag

SEQ ID NO: 24079 - DNA, 25 bp, S. cerevisiae
cggaggtagtaatttctttgccaat

SEQ ID NO: 24080 - DNA, 25 bp, S. cerevisiae
cgtcgtctatattccggttattaat

SEQ ID NO: 24081 - DNA, 25 bp, S. cerevisiae
cgtgttctttactctttagctagga

SEQ ID NO: 24082 - DNA, 25 bp, S. cerevisiae
cggttatttcgagcttcttgccaaa

SEQ ID NO: 24083 - DNA, 25 bp, S. cerevisiae
cggttatctgactacccctatgaaa

SEQ ID NO: 24084 - DNA, 25 bp, S. cerevisiae
cggtccatagacacttccttagaat

SEQ ID NO: 24085 - DNA, 25 bp, S. cerevisiae
gaggccctgggttcaattcccagct

SEQ ID NO: 24086 - DNA, 25 bp, S. cerevisiae
ggactctgggcgataagttacgtaa

SEQ ID NO: 24087 - DNA, 25 bp, S. cerevisiae
cggctctgggcgaacaatgtgctat

SEQ ID NO: 24088 - DNA, 25 bp, S. cerevisiae
cggcatctcatcgtctattatcaat

SEQ ID NO: 24089 - DNA, 25 bp, S. cerevisiae
cggatctacgcccagcagatatgat

SEQ ID NO: 24090 - DNA, 25 bp, S. cerevisiae
cggccattcctccaagtagtgatga

SEQ ID NO: 24091 - DNA, 25 bp, S. cerevisiae
cgtccttcgaatccctgaagagtat

SEQ ID NO: 24092 - DNA, 25 bp, S. cerevisiae
cgatacatgaactgaccgaaattgc

SEQ ID NO: 24093 - DNA, 25 bp, S. cerevisiae
cgtcgtgtcgattcggtggcaacta

SEQ ID NO: 24094 - DNA, 25 bp, S. cerevisiae
cgatagaccgcaactttgggacttt

SEQ ID NO: 24095 - DNA, 25 bp, S. cerevisiae
cgcaatcccaattcggtttgacttt

SEQ ID NO: 24096 - DNA, 25 bp, S. cerevisiae
cggcgatgacactagcgtaatggat

SEQ ID NO: 24097 - DNA, 25 bp, S. cerevisiae
cggcgagatcgcttatctaatggca

SEQ ID NO: 24098 - DNA, 25 bp, S. cerevisiae
cggcgtattgccttgtcagagcgag

SEQ ID NO: 24099 - DNA, 25 bp, S. cerevisiae
cggtgtagttgtatccagcgggtca

SEQ ID NO: 24100 - DNA, 25 bp, S. cerevisiae
cgggtactgttttccatgtacaaca

SEQ ID NO: 24101 - DNA, 25 bp, S. cerevisiae
cggcgggtgttaattcagtggcaat

SEQ ID NO: 24102 - DNA, 25 bp, S. cerevisiae
cggctagctggtatggatcgttcaa

SEQ ID NO: 24103 - DNA, 25 bp, S. cerevisiae
cggtcgcagtgtcagtacctcataa

SEQ ID NO: 24104 - DNA, 25 bp, S. cerevisiae
cggccgctttattgctacacaatga

SEQ ID NO: 24105 - DNA, 25 bp, S. cerevisiae
cggtgctccttctgctaatcaagga

SEQ ID NO: 24106 - DNA, 25 bp, S. cerevisiae
cggtgtctctggtgttgtcaagttc

SEQ ID NO: 24107 - DNA, 25 bp, S. cerevisiae
cgaggtgccgcattggtttgaagtt

SEQ ID NO: 24108 - DNA, 25 bp, S. cerevisiae
cggcgatcgtcttggttgctttaat

SEQ ID NO: 24109 - DNA, 25 bp, S. cerevisiae
cggtatccacttctacatctaaatc

SEQ ID NO: 24110 - DNA, 25 bp, S. cerevisiae
cgtttataccccactcatatatgtc

SEQ ID NO: 24111 - DNA, 25 bp, S. cerevisiae
cggtgttttcttcttgtctatccat

SEQ ID NO: 24112 - DNA, 25 bp, S. cerevisiae
cggtcttttcggttatgtctgttat

SEQ ID NO: 24113 - DNA, 25 bp, S. cerevisiae
cgtcctattgatgagtttgcggtta

SEQ ID NO: 24114 - DNA, 25 bp, S. cerevisiae
cgtgcgcaagtattcggtaacctca

SEQ ID NO: 24115 - DNA, 25 bp, S. cerevisiae
cgtgctgccagagacttgttaacta

SEQ ID NO: 24116 - DNA, 25 bp, S. cerevisiae
cgtggacgacgacttgattttatca

SEQ ID NO: 24117 - DNA, 25 bp, S. cerevisiae
cggatttactgtcccttattaatag

SEQ ID NO: 24118 - DNA, 25 bp, S. cerevisiae
cgttcaatgcaaatcttcgagtatt

SEQ ID NO: 24119 - DNA, 25 bp, S. cerevisiae
cgtttctaagaagtgggctgctgct

SEQ ID NO: 24120 - DNA, 25 bp, S. cerevisiae
cgttgttgagagatatggtcgtcgt

SEQ ID NO: 24121 - DNA, 25 bp, S. cerevisiae
cggtgcatttatctacgtctgtggt

SEQ ID NO: 24122 - DNA, 25 bp, S. cerevisiae
cgggctcttcgcaacagaggtttga

SEQ ID NO: 24123 - DNA, 25 bp, S. cerevisiae
cggtgcatttccaaaagcttctgaa

SEQ ID NO: 24124 - DNA, 25 bp, S. cerevisiae
gcgtttcccaagtcgatttggacat

SEQ ID NO: 24125 - DNA, 25 bp, S. cerevisiae
ggtactcccgaatatttggcaccag

SEQ ID NO: 24126 - DNA, 25 bp, S. cerevisiae
gcgttacgtaggactgcccaaacta

SEQ ID NO: 24127 - DNA, 25 bp, S. cerevisiae
cgttgacaaaggttctatcaagaaa

SEQ ID NO: 24128 - DNA, 25 bp, S. cerevisiae
cggtgcgcacgatgatattataaac

SEQ ID NO: 24129 - DNA, 25 bp, S. cerevisiae
cggaccccattactgatagaggctc

SEQ ID NO: 24130 - DNA, 25 bp, S. cerevisiae
cgtggtccagcgttgaaaggcattt

SEQ ID NO: 24131 - DNA, 25 bp, S. cerevisiae
cgggtgcatccgtcttaagtttgat

SEQ ID NO: 24132 - DNA, 25 bp, S. cerevisiae
cgaattgggtgtttacgtctccgat

SEQ ID NO: 24133 - DNA, 25 bp, S. cerevisiae
cgaatgcggctgcagtatattttgc

SEQ ID NO: 24134 - DNA, 25 bp, S. cerevisiae
cgaacggcatcgttgatgttttcaa

SEQ ID NO: 24135 - DNA, 25 bp, S. cerevisiae
cgacgcctactactggttcattgac

SEQ ID NO: 24136 - DNA, 25 bp, S. cerevisiae
cgggcttagctattcgttcactgaa

SEQ ID NO: 24137 - DNA, 25 bp, S. cerevisiae
cggtgtggcacctttcatgattaag

SEQ ID NO: 24138 - DNA, 25 bp, S. cerevisiae
cggacgatatcactcttgagcgcat

SEQ ID NO: 24139 - DNA, 25 bp, S. cerevisiae
cgtactgtacatgcagtggcctgaa

SEQ ID NO: 24140 - DNA, 25 bp, S. cerevisiae
cgctgacatcaaggccgtcgtcgaa

SEQ ID NO: 24141 - DNA, 25 bp, S. cerevisiae
cgtcattaagacaagctcctccaag

SEQ ID NO: 24142 - DNA, 25 bp, S. cerevisiae
cggatgcttgcttggagtgttctaa

SEQ ID NO: 24143 - DNA, 25 bp, S. cerevisiae
cgatgacattacttggtatgcggta

SEQ ID NO: 24144 - DNA, 25 bp, S. cerevisiae
cgtactgtacggcttggaagagttt

SEQ ID NO: 24145 - DNA, 25 bp, S. cerevisiae
cgggatgtcacccaggtgccaaaat

SEQ ID NO: 24146 - DNA, 25 bp, S. cerevisiae
cgatgcttccgccagaatggtttga

SEQ ID NO: 24147 - DNA, 25 bp, S. cerevisiae
gcgcatatcacgtgtcgggcgaata

SEQ ID NO: 24148 - DNA, 25 bp, S. cerevisiae
cggcagcagctgtgtcgagtgtaat

SEQ ID NO: 24149 - DNA, 25 bp, S. cerevisiae
cgaccgactgataaaggttcgtcaa

SEQ ID NO: 24150 - DNA, 25 bp, S. cerevisiae
cgaccccataaaaagtacagccgat

SEQ ID NO: 24151 - DNA, 25 bp, S. cerevisiae
cgtcacaaaagatccgctaccggtg

SEQ ID NO: 24152 - DNA, 25 bp, S. cerevisiae
cgttatattctttctggcaacccag

SEQ ID NO: 24153 - DNA, 25 bp, S. cerevisiae
cgtcctaggcttgcatggtgtcaaa

SEQ ID NO: 24154 - DNA, 25 bp, S. cerevisiae
cgcatcactagcgttacagcgtggt

SEQ ID NO: 24155 - DNA, 25 bp, S. cerevisiae
cgagttctgattccgaagatcgttc

SEQ ID NO: 24156 - DNA, 25 bp, S. cerevisiae
cggaaggtgagagccagatccaaat

SEQ ID NO: 24157 - DNA, 25 bp, S. cerevisiae
cgaagacgttgctgccccaaagaaa

SEQ ID NO: 24158 - DNA, 25 bp, S. cerevisiae
cggattctagtgagtcttcgctgga

SEQ ID NO: 24159 - DNA, 25 bp, S. cerevisiae
cggaggtagaacttcatgggcacat

SEQ ID NO: 24160 - DNA, 25 bp, S. cerevisiae
cggaggttaggctctgctcagataa

SEQ ID NO: 24161 - DNA, 25 bp, S. cerevisiae
cggttctttctcaatcttctcaaat

SEQ ID NO: 24162 - DNA, 25 bp, S. cerevisiae
cggtcatccattcagattccacaaa

SEQ ID NO: 24163 - DNA, 25 bp, S. cerevisiae
cgaagtttgcttggctgacttacag

SEQ ID NO: 24164 - DNA, 25 bp, S. cerevisiae
cgatagctttgcttactcatccaag

SEQ ID NO: 24165 - DNA, 25 bp, S. cerevisiae
cgtacttgtacaatggattacaaca

SEQ ID NO: 24166 - DNA, 25 bp, S. cerevisiae
cgtctgcggttggatttcgctacaa

SEQ ID NO: 24167 - DNA, 25 bp, S. cerevisiae
cgttcgtgtctggatttggtccatt

SEQ ID NO: 24168 - DNA, 25 bp, S. cerevisiae
cgtctttttcgaaatgtctccattg

SEQ ID NO: 24169 - DNA, 25 bp, S. cerevisiae
cgggctttcgactcgttcaagaatg

SEQ ID NO: 24170 - DNA, 25 bp, S. cerevisiae
cggttctgttgattccgtgtcaaga

SEQ ID NO: 24171 - DNA, 25 bp, S. cerevisiae
cggttcctacgttattatctccaat

SEQ ID NO: 24172 - DNA, 25 bp, S. cerevisiae
cgatattggtttggcaactaccgaa

SEQ ID NO: 24173 - DNA, 25 bp, S. cerevisiae
cgacattggtttcaacaaattcaga

SEQ ID NO: 24174 - DNA, 25 bp, S. cerevisiae
ccgggccaaccattgaatgccaatt

SEQ ID NO: 24175 - DNA, 25 bp, S. cerevisiae
cgcgggcggcaaactaatccaattt

SEQ ID NO: 24176 - DNA, 25 bp, S. cerevisiae
cgggcctccaagacgcaagaagata

SEQ ID NO: 24177 - DNA, 25 bp, S. cerevisiae
ccgccgctccaaaagaaaagaccag

SEQ ID NO: 24178 - DNA, 25 bp, S. cerevisiae
ccgccgcttcaataggtacgttcag

SEQ ID NO: 24179 - DNA, 25 bp, S. cerevisiae
gctacccgtaatcaagttgccttgg

SEQ ID NO: 24180 - DNA, 25 bp, S. cerevisiae
cgtcccgaatttcccaatgacttgg

SEQ ID NO: 24181 - DNA, 25 bp, S. cerevisiae
cgacggaacctcgaattgtggcttc

SEQ ID NO: 24182 - DNA, 25 bp, S. cerevisiae
cgacgctgacggtgtatttgttatc

SEQ ID NO: 24183 - DNA, 25 bp, S. cerevisiae
cccgtcctgatataccacttattaa

SEQ ID NO: 24184 - DNA, 25 bp, S. cerevisiae
ccctttcatttatctcaacgttatt

SEQ ID NO: 24185 - DNA, 25 bp, S. cerevisiae
gcatgcccattagataaccaacctt

SEQ ID NO: 24186 - DNA, 25 bp, S. cerevisiae
cctcttccgcttccagaaaatttga

SEQ ID NO: 24187 - DNA, 25 bp, S. cerevisiae
cgtctatttcattcactttacctgg

SEQ ID NO: 24188 - DNA, 25 bp, S. cerevisiae
cgttgtggccaaattttagcttctt

SEQ ID NO: 24189 - DNA, 25 bp, S. cerevisiae
cgtggtggtcgctattttacttcta

SEQ ID NO: 24190 - DNA, 25 bp, S. cerevisiae
cggtatcttcgctatattcttttta

SEQ ID NO: 24191 - DNA, 25 bp, S. cerevisiae
cctttgagttcaagcgttacggcga

SEQ ID NO: 24192 - DNA, 25 bp, S. cerevisiae
cggtgaatccgagtcttccttataa

SEQ ID NO: 24193 - DNA, 25 bp, S. cerevisiae
cgcctttgaagattgtcccggacat

SEQ ID NO: 24194 - DNA, 25 bp, S. cerevisiae
cgttcaatcaactgcttccgtaatg

SEQ ID NO: 24195 - DNA, 25 bp, S. cerevisiae
cggtatcacaggtaaatacggtgtc

SEQ ID NO: 24196 - DNA, 25 bp, S. cerevisiae
cggtgatgacgctgacaattctgtt

SEQ ID NO: 24197 - DNA, 25 bp, S. cerevisiae
cggtagttactatacattgatgtga

SEQ ID NO: 24198 - DNA, 25 bp, S. cerevisiae
cggtacttttcccagacgatgatga

SEQ ID NO: 24199 - DNA, 25 bp, S. cerevisiae
cggtccttcttcgaaaggtgcaggt

SEQ ID NO: 24200 - DNA, 25 bp, S. cerevisiae
cggtccttcttcgaaaggtgcaggt

SEQ ID NO: 24201 - DNA, 25 bp, S. cerevisiae
gcgacatcgtttttcgaggcggcag

SEQ ID NO: 24202 - DNA, 25 bp, S. cerevisiae
cgaaggtttggttgctgatgcgcca

SEQ ID NO: 24203 - DNA, 25 bp, S. cerevisiae
cgacttttgtttgcgtttgtatcag

SEQ ID NO: 24204 - DNA, 25 bp, S. cerevisiae
cgactcttacggttcctctaataga

SEQ ID NO: 24205 - DNA, 25 bp, S. cerevisiae
cgaccactgcaatccttagtagact

SEQ ID NO: 24206 - DNA, 25 bp, S. cerevisiae
cggtcttgactgctatatgtgcgga

SEQ ID NO: 24207 - DNA, 25 bp, S. cerevisiae
cggtgtgtcttcatcttccggaaat

SEQ ID NO: 24208 - DNA, 25 bp, S. cerevisiae
cgagctgcccagagatcaaatcaag

SEQ ID NO: 24209 - DNA, 25 bp, S. cerevisiae
cgttctgcctgggatagagctcaaa

SEQ ID NO: 24210 - DNA, 25 bp, S. cerevisiae
cgttgcattcggatgctgtgcacaa

SEQ ID NO: 24211 - DNA, 25 bp, S. cerevisiae
cgatgagcatcaccctttcgagaag

SEQ ID NO: 24212 - DNA, 25 bp, S. cerevisiae
cgtatcgcctacgtttacagagctt

SEQ ID NO: 24213 - DNA, 25 bp, S. cerevisiae
cggtcgcctattgcctatgaatgta

SEQ ID NO: 24214 - DNA, 25 bp, S. cerevisiae
cgatattgacattccattctccatc

SEQ ID NO: 24215 - DNA, 25 bp, S. cerevisiae
cgtttcagcaaaagatctcgccagc

SEQ ID NO: 24216 - DNA, 25 bp, S. cerevisiae
gcggaactgctattgggccaaccaa

SEQ ID NO: 24217 - DNA, 25 bp, S. cerevisiae
cgagaatgtctcaaggcgccaatgc

SEQ ID NO: 24218 - DNA, 25 bp, S. cerevisiae
cgatggtatcatcgaaagccattta

SEQ ID NO: 24219 - DNA, 25 bp, S. cerevisiae
cgagccgattcgtcaactttacaaa

SEQ ID NO: 24220 - DNA, 25 bp, S. cerevisiae
cggtggtaatgtttcttcctctaca

SEQ ID NO: 24221 - DNA, 25 bp, S. cerevisiae
cggtgcttattggtgtcgttcctaa

SEQ ID NO: 24222 - DNA, 25 bp, S. cerevisiae
cgaagtgttagatgattctgaccta

SEQ ID NO: 24223 - DNA, 25 bp, S. cerevisiae
cgaggatttgaagctaccacgtact

SEQ ID NO: 24224 - DNA, 25 bp, S. cerevisiae
cgaaataagctattcaaccacgtga

SEQ ID NO: 24225 - DNA, 25 bp, S. cerevisiae
ccaaatgaagatatcgccccggtta

SEQ ID NO: 24226 - DNA, 25 bp, S. cerevisiae
cggtgcctaaacatatgctcgataa

SEQ ID NO: 24227 - DNA, 25 bp, S. cerevisiae
cggtgactccaacgtatctcaaagg

SEQ ID NO: 24228 - DNA, 25 bp, S. cerevisiae
cgtggtccaagacggcctcagaaaa

SEQ ID NO: 24229 - DNA, 25 bp, S. cerevisiae
cgattctatcgcactattgaggcta

SEQ ID NO: 24230 - DNA, 25 bp, S. cerevisiae
cgatttgcaggcatttgctcggcat

SEQ ID NO: 24231 - DNA, 25 bp, S. cerevisiae
cgtattgctggcaatcgtatggtaa

SEQ ID NO: 24232 - DNA, 25 bp, S. cerevisiae
cgtatctgctgtctcaactttgaac

SEQ ID NO: 24233 - DNA, 25 bp, S. cerevisiae
cgtattccggctccagcgatgtcaa

SEQ ID NO: 24234 - DNA, 25 bp, S. cerevisiae
cgattactaagtccagattctcaaa

SEQ ID NO: 24235 - DNA, 25 bp, S. cerevisiae
cgaactcttcgaagttttcactcct

SEQ ID NO: 24236 - DNA, 25 bp, S. cerevisiae
cgcccatttagtagcatctttcatc

SEQ ID NO: 24237 - DNA, 25 bp, S. cerevisiae
cccggcgacagaggcattgctcaag

SEQ ID NO: 24238 - DNA, 25 bp, S. cerevisiae
cgagcgcacatattcctacttggag

SEQ ID NO: 24239 - DNA, 25 bp, S. cerevisiae
cgagctcccattgccattggagaaa

SEQ ID NO: 24240 - DNA, 25 bp, S. cerevisiae
cgggaactccacaaacagaacattt

SEQ ID NO: 24241 - DNA, 25 bp, S. cerevisiae
cggtgaatctccaaatcacatcaag

SEQ ID NO: 24242 - DNA, 25 bp, S. cerevisiae
cgttattcccacacacatcaattga

SEQ ID NO: 24243 - DNA, 25 bp, S. cerevisiae
cgtattcccctctacaacaaatatg

SEQ ID NO: 24244 - DNA, 25 bp, S. cerevisiae
cgggcttgcccttaaatcaatttat

SEQ ID NO: 24245 - DNA, 25 bp, S. cerevisiae
cgggatattaattgcctgtttttca

SEQ ID NO: 24246 - DNA, 25 bp, S. cerevisiae
cgttagtttattcatcgcagtacaa

SEQ ID NO: 24247 - DNA, 25 bp, S. cerevisiae
cgttagttcaattctgacaggtggc

SEQ ID NO: 24248 - DNA, 25 bp, S. cerevisiae
cgtttattcaatctccactcatgga

SEQ ID NO: 24249 - DNA, 25 bp, S. cerevisiae
ccgagcttttgaatggcaccgtgac

SEQ ID NO: 24250 - DNA, 25 bp, S. cerevisiae
cgtctgttctcacgttaatcatgaa

SEQ ID NO: 24251 - DNA, 25 bp, S. cerevisiae
cgatgcttttgcactggccaaggaa

SEQ ID NO: 24252 - DNA, 25 bp, S. cerevisiae
cgctctaattgttctgatccagggc

SEQ ID NO: 24253 - DNA, 25 bp, S. cerevisiae
gccttgaaggatatcttgggtgacc

SEQ ID NO: 24254 - DNA, 25 bp, S. cerevisiae
cggtggtgtcttaatggtttcccat

SEQ ID NO: 24255 - DNA, 25 bp, S. cerevisiae
cgggcgattcatctggttcatttga

SEQ ID NO: 24256 - DNA, 25 bp, S. cerevisiae
cgtcacgtgttttgccattttgtac

SEQ ID NO: 24257 - DNA, 25 bp, S. cerevisiae
cgttaaggactactcatttctggga

SEQ ID NO: 24258 - DNA, 25 bp, S. cerevisiae
cgtcgtttgtttctgtatgtggtgt

SEQ ID NO: 24259 - DNA, 25 bp, S. cerevisiae
cgtcagttctttcccttgagaggag

SEQ ID NO: 24260 - DNA, 25 bp, S. cerevisiae
cgaccagattcaaacgtctcttcta

SEQ ID NO: 24261 - DNA, 25 bp, S. cerevisiae
cgcctacaatcaatacttcacgact

SEQ ID NO: 24262 - DNA, 25 bp, S. cerevisiae
cgcgccataacgaaattgcccaatt

SEQ ID NO: 24263 - DNA, 25 bp, S. cerevisiae
cgtcgctaagcgttcatatgcagaa

SEQ ID NO: 24264 - DNA, 25 bp, S. cerevisiae
cgtcctcacaactgcattcgaaaaa

SEQ ID NO: 24265 - DNA, 25 bp, S. cerevisiae
cgtccttatttctgttgcaacaacc

SEQ ID NO: 24266 - DNA, 25 bp, S. cerevisiae
cgcataagctattttgacgtcaatt

SEQ ID NO: 24267 - DNA, 25 bp, S. cerevisiae
cgaaagctccatcatatccacaaat

SEQ ID NO: 24268 - DNA, 25 bp, S. cerevisiae
cgatacggttatcctcttcatggag

SEQ ID NO: 24269 - DNA, 25 bp, S. cerevisiae
tccatacttacctttcggtggtggt

SEQ ID NO: 24270 - DNA, 25 bp, S. cerevisiae
gtaaactactggattctacgatttt

SEQ ID NO: 24271 - DNA, 25 bp, S. cerevisiae
gtaacggtagttcatcgtcgcccag

SEQ ID NO: 24272 - DNA, 25 bp, S. cerevisiae
gatcaagggtacgttttgtccccag

SEQ ID NO: 24273 - DNA, 25 bp, S. cerevisiae
ccaacgtcaatcttttttcccaatg

SEQ ID NO: 24274 - DNA, 25 bp, S. cerevisiae
cgcaacttcaatttttaggcttcaa

SEQ ID NO: 24275 - DNA, 25 bp, S. cerevisiae
cgagcgatgtcgtgggcatgtatta

SEQ ID NO: 24276 - DNA, 25 bp, S. cerevisiae
cgatgcgtgcattgaccagtgtttg

SEQ ID NO: 24277 - DNA, 25 bp, S. cerevisiae
cgggcggcgccaatgatatgactca

SEQ ID NO: 24278 - DNA, 25 bp, S. cerevisiae
cgaagccctccactgatgaattatt

SEQ ID NO: 24279 - DNA, 25 bp, S. cerevisiae
cgtacacacctgtcgcattacaaaa

SEQ ID NO: 24280 - DNA, 25 bp, S. cerevisiae
cgatttcgcgtatgataagacagat

SEQ ID NO: 24281 - DNA, 25 bp, S. cerevisiae
cgttgccttttccactgtatgatga

SEQ ID NO: 24282 - DNA, 25 bp, S. cerevisiae
cgttctctaggtcgacgtctatgaa

SEQ ID NO: 24283 - DNA, 25 bp, S. cerevisiae
cgatacaccatggacgttgtttagt

SEQ ID NO: 24284 - DNA, 25 bp, S. cerevisiae
cgtgccccatcatgacttattttat

SEQ ID NO: 24285 - DNA, 25 bp, S. cerevisiae
cgaccgctctcattttcatgattta

SEQ ID NO: 24286 - DNA, 25 bp, S. cerevisiae
cgtcgcgctgcgtcattatcattga

SEQ ID NO: 24287 - DNA, 25 bp, S. cerevisiae
cgtggcttgcgatcccagtgagata

SEQ ID NO: 24288 - DNA, 25 bp, S. cerevisiae
cgatggattctcaccacgatggtaa

SEQ ID NO: 24289 - DNA, 25 bp, S. cerevisiae
cgaagagtatgttgcgctatccggt

SEQ ID NO: 24290 - DNA, 25 bp, S. cerevisiae
cgaacacttcctcatcactaaattt

SEQ ID NO: 24291 - DNA, 25 bp, S. cerevisiae
ccgttcttcgtcagtacaaggtctt

SEQ ID NO: 24292 - DNA, 25 bp, S. cerevisiae
cgactcctctggtgtttactggaat

SEQ ID NO: 24293 - DNA, 25 bp, S. cerevisiae
cgacttcatcggtaaatcttttggt

SEQ ID NO: 24294 - DNA, 25 bp, S. cerevisiae
cgatgatttcgatatgctttttggc

SEQ ID NO: 24295 - DNA, 25 bp, S. cerevisiae
cgatgttccgtttttctttatgcca

SEQ ID NO: 24296 - DNA, 25 bp, S. cerevisiae
cgtcgctggcgaggagagattctcc

SEQ ID NO: 24297 - DNA, 25 bp, S. cerevisiae
ccgtgcgcagcgtggaattgactat

SEQ ID NO: 24298 - DNA, 25 bp, S. cerevisiae
cgtcgcatgcagaacgtgaccattt

SEQ ID NO: 24299 - DNA, 25 bp, S. cerevisiae
cgctcccgcagaagatgactcatta

SEQ ID NO: 24300 - DNA, 25 bp, S. cerevisiae
cgtccccattacaacatttcaaaca

SEQ ID NO: 24301 - DNA, 25 bp, S. cerevisiae
cgaccaagttaccagagttatcact

SEQ ID NO: 24302 - DNA, 25 bp, S. cerevisiae
cgaccaagttaccagagttatcact

SEQ ID NO: 24303 - DNA, 25 bp, S. cerevisiae
cgacaacatcttccacaaaatcacg

SEQ ID NO: 24304 - DNA, 25 bp, S. cerevisiae
cgatcgatgcgctgctgacaaaaga

SEQ ID NO: 24305 - DNA, 25 bp, S. cerevisiae
cgctgctggagctactacatacgga

SEQ ID NO: 24306 - DNA, 25 bp, S. cerevisiae
cgcagctagctctatcgttggatac

SEQ ID NO: 24307 - DNA, 25 bp, S. cerevisiae
cgcaccattttctattgccagacaa

SEQ ID NO: 24308 - DNA, 25 bp, S. cerevisiae
cgctcctatctgaacattacaaaag

SEQ ID NO: 24309 - DNA, 25 bp, S. cerevisiae
cgtccactctaaatccagaaccaga

SEQ ID NO: 24310 - DNA, 25 bp, S. cerevisiae
cgctcccgctataaaggtttctgat

SEQ ID NO: 24311 - DNA, 25 bp, S. cerevisiae
cgatacactatttaccgctggttgc

SEQ ID NO: 24312 - DNA, 25 bp, S. cerevisiae
cgaacaattcctgcctatagtacgt

SEQ ID NO: 24313 - DNA, 25 bp, S. cerevisiae
cgtattattcctgccatcgcaacaa

SEQ ID NO: 24314 - DNA, 25 bp, S. cerevisiae
cgattttttctgcataccaagcaag

SEQ ID NO: 24315 - DNA, 25 bp, S. cerevisiae
cgttgctgctttgagaaccgtcaag

SEQ ID NO: 24316 - DNA, 25 bp, S. cerevisiae
cgtagtgctattcacaagcctgatt

SEQ ID NO: 24317 - DNA, 25 bp, S. cerevisiae
cgattttttcaaagctggttcagca

SEQ ID NO: 24318 - DNA, 25 bp, S. cerevisiae
cgttactacagcacatcgttctatt

SEQ ID NO: 24319 - DNA, 25 bp, S. cerevisiae
cgattcctggaatatgctttgttat

SEQ ID NO: 24320 - DNA, 25 bp, S. cerevisiae
gccacttgggtgcacgaggaattcc

SEQ ID NO: 24321 - DNA, 25 bp, S. cerevisiae
gccgccctaggtgttggaattgcca

SEQ ID NO: 24322 - DNA, 25 bp, S. cerevisiae
gcctcacctaaatctgcggaagctg

SEQ ID NO: 24323 - DNA, 25 bp, S. cerevisiae
gctctaccgaagaagcccaaagctc

SEQ ID NO: 24324 - DNA, 25 bp, S. cerevisiae
cgtacatgaccatacctcagcaata

SEQ ID NO: 24325 - DNA, 25 bp, S. cerevisiae
cgtattttgaaagctcgcctagaat

SEQ ID NO: 24326 - DNA, 25 bp, S. cerevisiae
cgaatttaacatcggctcgtccaaa

SEQ ID NO: 24327 - DNA, 25 bp, S. cerevisiae
cgttcaatcgaagctgggtgaccat

SEQ ID NO: 24328 - DNA, 25 bp, S. cerevisiae
cgatcattatcctcctggttacgat

SEQ ID NO: 24329 - DNA, 25 bp, S. cerevisiae
cgtatgtatcgtttccgttaagcat

SEQ ID NO: 24330 - DNA, 25 bp, S. cerevisiae
cgtctgtgatcccatttcttatagg

SEQ ID NO: 24331 - DNA, 25 bp, S. cerevisiae
cgatcaaatcgccatcaggtataag

SEQ ID NO: 24332 - DNA, 25 bp, S. cerevisiae
cgtctcagcattatgttgtcccaga

SEQ ID NO: 24333 - DNA, 25 bp, S. cerevisiae
cgttagcagccatcgtcacaggaaa

SEQ ID NO: 24334 - DNA, 25 bp, S. cerevisiae
cgattattccgagttgtgtattata

SEQ ID NO: 24335 - DNA, 25 bp, S. cerevisiae
cgtttgctcatcatctttgtcgaaa

SEQ ID NO: 24336 - DNA, 25 bp, S. cerevisiae
cgtttgtatcctatttcatctctca

SEQ ID NO: 24337 - DNA, 25 bp, S. cerevisiae
ccattgaactcctcacctttgaaaa

SEQ ID NO: 24338 - DNA, 25 bp, S. cerevisiae
cgaagtagcgcctcatttttataaa

SEQ ID NO: 24339 - DNA, 25 bp, S. cerevisiae
cgacattgcgcgtttccttagaaaa

SEQ ID NO: 24340 - DNA, 25 bp, S. cerevisiae
cgtctttgatgtctccttctaaaac

SEQ ID NO: 24341 - DNA, 25 bp, S. cerevisiae
cgtcattatacgctccttcatatta

SEQ ID NO: 24342 - DNA, 25 bp, S. cerevisiae
cgttcaggaaccactctatgactac

SEQ ID NO: 24343 - DNA, 25 bp, S. cerevisiae
cgttcggaaattgatgacttgatgc

SEQ ID NO: 24344 - DNA, 25 bp, S. cerevisiae
cgcttttaagaaaatggctagtcaa

SEQ ID NO: 24345 - DNA, 25 bp, S. cerevisiae
cgttctctgcactaacatttcgaat

SEQ ID NO: 24346 - DNA, 25 bp, S. cerevisiae
cgtctgtcgtactctttctgaataa

SEQ ID NO: 24347 - DNA, 25 bp, S. cerevisiae
cgccttccaaggcagaaagcttact

SEQ ID NO: 24348 - DNA, 25 bp, S. cerevisiae
cgccgaccaagttaccagagttatc

SEQ ID NO: 24349 - DNA, 25 bp, S. cerevisiae
ccagagaaaggattcaccattttag

SEQ ID NO: 24350 - DNA, 25 bp, S. cerevisiae
cgcagaaacttgctccacattttga

SEQ ID NO: 24351 - DNA, 25 bp, S. cerevisiae
cgagcaatccactttccaattttgt

SEQ ID NO: 24352 - DNA, 25 bp, S. cerevisiae
cgtatacccattttcaattctttga

SEQ ID NO: 24353 - DNA, 25 bp, S. cerevisiae
cgatctctcctcatttaactgttta

SEQ ID NO: 24354 - DNA, 25 bp, S. cerevisiae
cgactcatcctgattattatcccac

SEQ ID NO: 24355 - DNA, 25 bp, S. cerevisiae
cgaggctgcctatgttgtttctaaa

SEQ ID NO: 24356 - DNA, 25 bp, S. cerevisiae
cgtagcagctggtgttttcatcgaa

SEQ ID NO: 24357 - DNA, 25 bp, S. cerevisiae
cgctatcgtcgaaattattgaccaa

SEQ ID NO: 24358 - DNA, 25 bp, S. cerevisiae
cctacggcagcgattcatggaacat

SEQ ID NO: 24359 - DNA, 25 bp, S. cerevisiae
cgctcgttcagcaattcacaactgg

SEQ ID NO: 24360 - DNA, 25 bp, S. cerevisiae
cgccctacaaatccgttcagagtta

SEQ ID NO: 24361 - DNA, 25 bp, S. cerevisiae
ccgccgaccaagttaccagagttat

SEQ ID NO: 24362 - DNA, 25 bp, S. cerevisiae
ccgccgaccaagttaccagagttat

SEQ ID NO: 24363 - DNA, 25 bp, S. cerevisiae
ccggcgcacctattgtaaggagtct

SEQ ID NO: 24364 - DNA, 25 bp, S. cerevisiae
ccgatcgccctattcttagttagta

SEQ ID NO: 24365 - DNA, 25 bp, S. cerevisiae
cgttgtccaatgtagctgctatatt

SEQ ID NO: 24366 - DNA, 25 bp, S. cerevisiae
cgcttgctatcattgctgctggtta

SEQ ID NO: 24367 - DNA, 25 bp, S. cerevisiae
gccataccgcaagtttaccatatca

SEQ ID NO: 24368 - DNA, 25 bp, S. cerevisiae
cgatgcccatgatctgtatttccaa

SEQ ID NO: 24369 - DNA, 25 bp, S. cerevisiae
cgatgattcttacggatcttccaat

SEQ ID NO: 24370 - DNA, 25 bp, S. cerevisiae
cgattattctgcaggttcgaaccaa

SEQ ID NO: 24371 - DNA, 25 bp, S. cerevisiae
cgatttctctaagggcccaaaagag

SEQ ID NO: 24372 - DNA, 25 bp, S. cerevisiae
cgcagtttcccgagcgtgaagaatt

SEQ ID NO: 24373 - DNA, 25 bp, S. cerevisiae
cgcagtttccctcagctttagaaaa

SEQ ID NO: 24374 - DNA, 25 bp, S. cerevisiae
cgatttaccttatctattcgacaat

SEQ ID NO: 24375 - DNA, 25 bp, S. cerevisiae
cgaatgttcctcatcttaccgaaaa

SEQ ID NO: 24376 - DNA, 25 bp, S. cerevisiae
cgaacattgccttactaagctccaa

SEQ ID NO: 24377 - DNA, 25 bp, S. cerevisiae
gccaaaagcctaacagagtctccaa

SEQ ID NO: 24378 - DNA, 25 bp, S. cerevisiae
ccaaagcgagcttagcagaggcccc

SEQ ID NO: 24379 - DNA, 25 bp, S. cerevisiae
cgatgcaaaggtagtgagtgacgct

SEQ ID NO: 24380 - DNA, 25 bp, S. cerevisiae
ccgattcagatggttggtgcacatt

SEQ ID NO: 24381 - DNA, 25 bp, S. cerevisiae
cgtatgtcgcgagtgtggttctatt

SEQ ID NO: 24382 - DNA, 25 bp, S. cerevisiae
cgaagacggcgttgaatttcattca

SEQ ID NO: 24383 - DNA, 25 bp, S. cerevisiae
cgagaccggcgatgcaattggcttt

SEQ ID NO: 24384 - DNA, 25 bp, S. cerevisiae
cgctgccggtggtaagttgacttta

SEQ ID NO: 24385 - DNA, 25 bp, S. cerevisiae
cgaatcgactaggaacgtggctgtt

SEQ ID NO: 24386 - DNA, 25 bp, S. cerevisiae
gcaacgcgaccggaaactactttca

SEQ ID NO: 24387 - DNA, 25 bp, S. cerevisiae
gcaacagaactagaaactaacaaaa

SEQ ID NO: 24388 - DNA, 25 bp, S. cerevisiae
gcgcggcaactataaagtacagcaa

SEQ ID NO: 24389 - DNA, 25 bp, S. cerevisiae
cgtaggcctgaaacaagctcccaag

SEQ ID NO: 24390 - DNA, 25 bp, S. cerevisiae
tcttgtctacgaagcattggttgcc

SEQ ID NO: 24391 - DNA, 25 bp, S. cerevisiae
cgcttatgccgctagatgggttgcc

SEQ ID NO: 24392 - DNA, 25 bp, S. cerevisiae
cgctattgcggctactgagatgaat

SEQ ID NO: 24393 - DNA, 25 bp, S. cerevisiae
cgcgcacaggctaagtacgatcaga

SEQ ID NO: 24394 - DNA, 25 bp, S. cerevisiae
cgcaaaaatatccatcttcgcaaat

SEQ ID NO: 24395 - DNA, 25 bp, S. cerevisiae
cgagtgcctatttcttgctacaatg

SEQ ID NO: 24396 - DNA, 25 bp, S. cerevisiae
cgaactccatttgattcctgctaat

SEQ ID NO: 24397 - DNA, 25 bp, S. cerevisiae
cgatattcgattacggcgcatttaa

SEQ ID NO: 24398 - DNA, 25 bp, S. cerevisiae
cgacattggattagggcgctggctt

SEQ ID NO: 24399 - DNA, 25 bp, S. cerevisiae
cgaattagacaatctgggccatttt

SEQ ID NO: 24400 - DNA, 25 bp, S. cerevisiae
cgaagtggacaatctgcgtgacaat

SEQ ID NO: 24401 - DNA, 25 bp, S. cerevisiae
cgatacggtgatcctttgcttgata

SEQ ID NO: 24402 - DNA, 25 bp, S. cerevisiae
cgttgccgcatattgtggctcgaaa

SEQ ID NO: 24403 - DNA, 25 bp, S. cerevisiae
cgcatcccgatgactcggctaataa

SEQ ID NO: 24404 - DNA, 25 bp, S. cerevisiae
cgacgctaatgaatcccacctaaaa

SEQ ID NO: 24405 - DNA, 25 bp, S. cerevisiae
cgcttcttatggtcacttcactaat

SEQ ID NO: 24406 - DNA, 25 bp, S. cerevisiae
cccactttgggctgatacaagacat

SEQ ID NO: 24407 - DNA, 25 bp, S. cerevisiae
cgaatgctcttctgaatttgttaga

SEQ ID NO: 24408 - DNA, 25 bp, S. cerevisiae
cgatttttgccggtgtgattgttaa

SEQ ID NO: 24409 - DNA, 25 bp, S. cerevisiae
cgctaaatattctcctgttccaatt

SEQ ID NO: 24410 - DNA, 25 bp, S. cerevisiae
cgctgtacctgatgaaatgctgcca

SEQ ID NO: 24411 - DNA, 25 bp, S. cerevisiae
cctttcctgcaaaaatatggcccca

SEQ ID NO: 24412 - DNA, 25 bp, S. cerevisiae
gcactttttactcaaagggtcaaag

SEQ ID NO: 24413 - DNA, 25 bp, S. cerevisiae
cgcctttcctcacctaaagaacaat

SEQ ID NO: 24414 - DNA, 25 bp, S. cerevisiae
cccgaatccttcagcaaactcataa

SEQ ID NO: 24415 - DNA, 25 bp, S. cerevisiae
cgccaagcttccaatatcacgagta

SEQ ID NO: 24416 - DNA, 25 bp, S. cerevisiae
ccacgggctacttacagggcattaa

SEQ ID NO: 24417 - DNA, 25 bp, S. cerevisiae
cgcccaaatactgcaatcggactat

SEQ ID NO: 24418 - DNA, 25 bp, S. cerevisiae
cgccgaaaccttgaagcatgactag

SEQ ID NO: 24419 - DNA, 25 bp, S. cerevisiae
cgcacgggagccttaaatctactac

SEQ ID NO: 24420 - DNA, 25 bp, S. cerevisiae
cgccgggcggcagagattctattat

SEQ ID NO: 24421 - DNA, 25 bp, S. cerevisiae
cccggagggacgtatacattggcat

SEQ ID NO: 24422 - DNA, 25 bp, S. cerevisiae
cgcactttttgcattaacctctttt

SEQ ID NO: 24423 - DNA, 25 bp, S. cerevisiae
cgcctcttttaaaatctgcaccttt

SEQ ID NO: 24424 - DNA, 25 bp, S. cerevisiae
ccatccttctaatcaaccaacatat

SEQ ID NO: 24425 - DNA, 25 bp, S. cerevisiae
cgactgttcccattcaaccaaataa

SEQ ID NO: 24426 - DNA, 25 bp, S. cerevisiae
cgaaattatgggtctgttgctacag

SEQ ID NO: 24427 - DNA, 25 bp, S. cerevisiae
cgagcaattggctgactacttgatt

SEQ ID NO: 24428 - DNA, 25 bp, S. cerevisiae
cgcaacattgcgtggagtatcttct

SEQ ID NO: 24429 - DNA, 25 bp, S. cerevisiae
cgccctaccaaatcatgtcattact

SEQ ID NO: 24430 - DNA, 25 bp, S. cerevisiae
ccctccaccaaatcattttttctgt

SEQ ID NO: 24431 - DNA, 25 bp, S. cerevisiae
ccctaacctcaatatcttcttctga

SEQ ID NO: 24432 - DNA, 25 bp, S. cerevisiae
cgaatcaacttccaaccttcttata

SEQ ID NO: 24433 - DNA, 25 bp, S. cerevisiae
cgaatcaatttccagccgactatgt

SEQ ID NO: 24434 - DNA, 25 bp, S. cerevisiae
cgagatttttcgagcccattgttat

SEQ ID NO: 24435 - DNA, 25 bp, S. cerevisiae
ccgtagactacgtggccatgggcaa

SEQ ID NO: 24436 - DNA, 25 bp, S. cerevisiae
ccagctggacgggttcgacgacaga

SEQ ID NO: 24437 - DNA, 25 bp, S. cerevisiae
cgacgaggccgctttcaaagaggaa

SEQ ID NO: 24438 - DNA, 25 bp, S. cerevisiae
cgcacccgccagttttaataagaat

SEQ ID NO: 24439 - DNA, 25 bp, S. cerevisiae
cgcagctgccgctatgttgttataa

SEQ ID NO: 24440 - DNA, 25 bp, S. cerevisiae
cgccaagggtattgtcttggaaaag

SEQ ID NO: 24441 - DNA, 25 bp, S. cerevisiae
ccccatgggtgatatttgcggacta

SEQ ID NO: 24442 - DNA, 25 bp, S. cerevisiae
gcgcctacgaggacagaaccgtttt

SEQ ID NO: 24443 - DNA, 25 bp, S. cerevisiae
cgccgaacgggccattcaaatagtt

SEQ ID NO: 24444 - DNA, 25 bp, S. cerevisiae
tgccgtttcccgaaaaagttcgctg

SEQ ID NO: 24445 - DNA, 25 bp, S. cerevisiae
cgcaagtttagttcgagtcagctct

SEQ ID NO: 24446 - DNA, 25 bp, S. cerevisiae
cgacaggcattgtaatatggtttta

SEQ ID NO: 24447 - DNA, 25 bp, S. cerevisiae
cgaagtgcatcctttatccttttac

SEQ ID NO: 24448 - DNA, 25 bp, S. cerevisiae
cgcaccgtcaattgatgtcctttta

SEQ ID NO: 24449 - DNA, 25 bp, S. cerevisiae
cgactcgcccagctattttattaag

SEQ ID NO: 24450 - DNA, 25 bp, S. cerevisiae
cgaccacccaactttggctgataat

SEQ ID NO: 24451 - DNA, 25 bp, S. cerevisiae
cgatcctgacagacctatttgtgaa

SEQ ID NO: 24452 - DNA, 25 bp, S. cerevisiae
cgcatcctaacctatacttcgaaag

SEQ ID NO: 24453 - DNA, 25 bp, S. cerevisiae
cctttgcgtccccaatatcgaaagt

SEQ ID NO: 24454 - DNA, 25 bp, S. cerevisiae
ccgttggtcccatttcaagcaatag

SEQ ID NO: 24455 - DNA, 25 bp, S. cerevisiae
cgctgttactatccgtactagaaag

SEQ ID NO: 24456 - DNA, 25 bp, S. cerevisiae
cgcagttgaatacaatcaccgcatt

SEQ ID NO: 24457 - DNA, 25 bp, S. cerevisiae
cgcagattaagcaatttcccagcct

SEQ ID NO: 24458 - DNA, 25 bp, S. cerevisiae
cgagattaaatctttgtccgctaaa

SEQ ID NO: 24459 - DNA, 25 bp, S. cerevisiae
cgaattttatcgtgaccctgagaaa

SEQ ID NO: 24460 - DNA, 25 bp, S. cerevisiae
cgcagttattatttcgacccgaacg

SEQ ID NO: 24461 - DNA, 25 bp, S. cerevisiae
cgcagattccgtcgccagaacaaaa

SEQ ID NO: 24462 - DNA, 25 bp, S. cerevisiae
cgagcctccgcgttatgacgaaata

SEQ ID NO: 24463 - DNA, 25 bp, S. cerevisiae
cgatgcgttagcttctataccagaa

SEQ ID NO: 24464 - DNA, 25 bp, S. cerevisiae
cgaaggatgctttgtctactagaga

SEQ ID NO: 24465 - DNA, 25 bp, S. cerevisiae
cgctaccacatatgcttcttatatc

SEQ ID NO: 24466 - DNA, 25 bp, S. cerevisiae
cgagcatctgtattcgtgccaagaa

SEQ ID NO: 24467 - DNA, 25 bp, S. cerevisiae
cgaggctaaactgcgtcacacatga

SEQ ID NO: 24468 - DNA, 25 bp, S. cerevisiae
cgaggtgtatccgttgctgcaagaa

SEQ ID NO: 24469 - DNA, 25 bp, S. cerevisiae
cgaggatgctgctcttggtatcgaa

SEQ ID NO: 24470 - DNA, 25 bp, S. cerevisiae
cgcagtatgcttgttgtgtggccaa

SEQ ID NO: 24471 - DNA, 25 bp, S. cerevisiae
cgactccctatatgtctctacaatt

SEQ ID NO: 24472 - DNA, 25 bp, S. cerevisiae
cgaggagtttgaatcttttgccaga

SEQ ID NO: 24473 - DNA, 25 bp, S. cerevisiae
cgagccattttcatttcgtgcaata

SEQ ID NO: 24474 - DNA, 25 bp, S. cerevisiae
cgagcaggttaatttcgcagcttaa

SEQ ID NO: 24475 - DNA, 25 bp, S. cerevisiae
cgaagggctaactatcacagatgaa

SEQ ID NO: 24476 - DNA, 25 bp, S. cerevisiae
gcgaaagcgccatatctgacgtgaa

SEQ ID NO: 24477 - DNA, 25 bp, S. cerevisiae
cgaacgcctattttgctcaggacag

SEQ ID NO: 24478 - DNA, 25 bp, S. cerevisiae
cgacttcctcgctatccaaatataa

SEQ ID NO: 24479 - DNA, 25 bp, S. cerevisiae
cgacttctctcgtccaggaatgtaa

SEQ ID NO: 24480 - DNA, 25 bp, S. cerevisiae
cgactccacgttgggcaaggctgaa

SEQ ID NO: 24481 - DNA, 25 bp, S. cerevisiae
cgatctccagatttagtgaagttaa

SEQ ID NO: 24482 - DNA, 25 bp, S. cerevisiae
cgagattttatgacgaagcgctcat

SEQ ID NO: 24483 - DNA, 25 bp, S. cerevisiae
cgatgattatgttgccgctggcttc

SEQ ID NO: 24484 - DNA, 25 bp, S. cerevisiae
ccccattattctggtgatcagttag

SEQ ID NO: 24485 - DNA, 25 bp, S. cerevisiae
cgctccgtattcgagtgttgttact

SEQ ID NO: 24486 - DNA, 25 bp, S. cerevisiae
ccgccgcttatacgcttgatattgc

SEQ ID NO: 24487 - DNA, 25 bp, S. cerevisiae
cgccatcggtgctcaagttgcaaag

SEQ ID NO: 24488 - DNA, 25 bp, S. cerevisiae
gccactcagcgtccacaagatatga

SEQ ID NO: 24489 - DNA, 25 bp, S. cerevisiae
cgcaccatgagtcgcaccaagataa

SEQ ID NO: 24490 - DNA, 25 bp, S. cerevisiae
cgacgcagagtttgcccaatggcaa

SEQ ID NO: 24491 - DNA, 25 bp, S. cerevisiae
cgctcatgtagttgtctccaatggc

SEQ ID NO: 24492 - DNA, 25 bp, S. cerevisiae
cgcatttcagcgtatctacaaggat

SEQ ID NO: 24493 - DNA, 25 bp, S. cerevisiae
cgacggtggatacaaatctgccttt

SEQ ID NO: 24494 - DNA, 25 bp, S. cerevisiae
cgacgattgttgtataggacttctt

SEQ ID NO: 24495 - DNA, 25 bp, S. cerevisiae
cgatgctttacgctttggtttggaa

SEQ ID NO: 24496 - DNA, 25 bp, S. cerevisiae
cgcagcgttgcatggattgggtttc

SEQ ID NO: 24497 - DNA, 25 bp, S. cerevisiae
cgcggctgatgatgacgaggttcta

SEQ ID NO: 24498 - DNA, 25 bp, S. cerevisiae
cgaagtttgtttggctgacttgcaa

SEQ ID NO: 24499 - DNA, 25 bp, S. cerevisiae
cgccaagatccgtttcaagtcgtta

SEQ ID NO: 24500 - DNA, 25 bp, S. cerevisiae
cccagccattcgttacaaccatatt

SEQ ID NO: 24501 - DNA, 25 bp, S. cerevisiae
cgccaattatgcgtttcaataccaa

SEQ ID NO: 24502 - DNA, 25 bp, S. cerevisiae
cgccctctctgattatttaagccat

SEQ ID NO: 24503 - DNA, 25 bp, S. cerevisiae
cgcagacctggtacgatatcaacaa

SEQ ID NO: 24504 - DNA, 25 bp, S. cerevisiae
cgagtatgaggtacgattcaccata

SEQ ID NO: 24505 - DNA, 25 bp, S. cerevisiae
cgcagtaggtgcttcgctttggata

SEQ ID NO: 24506 - DNA, 25 bp, S. cerevisiae
ccgtacttgtacaatggattacaac

SEQ ID NO: 24507 - DNA, 25 bp, S. cerevisiae
cgcctacatgtttttcgctaacgaa

SEQ ID NO: 24508 - DNA, 25 bp, S. cerevisiae
cgacgaattgtgttctctgctaaat

SEQ ID NO: 24509 - DNA, 25 bp, S. cerevisiae
ccaagagatccgttgttgaaagttt

SEQ ID NO: 24510 - DNA, 25 bp, S. cerevisiae
cgccggcagcacatatcactaagaa

SEQ ID NO: 24511 - DNA, 25 bp, S. cerevisiae
gccagtgtcaagctttcgagtcatt

SEQ ID NO: 24512 - DNA, 25 bp, S. cerevisiae
gcctatactgatcttttggtcggga

SEQ ID NO: 24513 - DNA, 25 bp, S. cerevisiae
ccgtcctgacaatttgggttgggca

SEQ ID NO: 24514 - DNA, 25 bp, S. cerevisiae
cccctaatcatatcgttttggtcag

SEQ ID NO: 24515 - DNA, 25 bp, S. cerevisiae
ccgcgctttgggtcattttagtgta

SEQ ID NO: 24516 - DNA, 25 bp, S. cerevisiae
gccggtttgtttgtttcaggcgcaa

SEQ ID NO: 24517 - DNA, 25 bp, S. cerevisiae
gcgccgttgttaagtttggagccca

SEQ ID NO: 24518 - DNA, 25 bp, S. cerevisiae
cgctttttctttattgggtcacaca

SEQ ID NO: 24519 - DNA, 25 bp, S. cerevisiae
cgcccttttcttttctacaatgcaa

SEQ ID NO: 24520 - DNA, 25 bp, S. cerevisiae
ccgcctttgcatctctattaaacta

SEQ ID NO: 24521 - DNA, 25 bp, S. cerevisiae
cccactcaagtcgttgcattgctaa

SEQ ID NO: 24522 - DNA, 25 bp, S. cerevisiae
cccatccaagcttgttatcactaag

SEQ ID NO: 24523 - DNA, 25 bp, S. cerevisiae
ccgccgtcaacgttgtcaaatgcaa

SEQ ID NO: 24524 - DNA, 25 bp, S. cerevisiae
cgacgcccactgatttgagcaaatt

SEQ ID NO: 24525 - DNA, 25 bp, S. cerevisiae
ccggtcccgtttatggcaatgtgtg

SEQ ID NO: 24526 - DNA, 25 bp, S. cerevisiae
ccgtgacaccgaaaatttgccagat

SEQ ID NO: 24527 - DNA, 25 bp, S. cerevisiae
cgccagaaccacacattttgctatt

SEQ ID NO: 24528 - DNA, 25 bp, S. cerevisiae
cgaaaagcttttccgtgactggttg

SEQ ID NO: 24529 - DNA, 25 bp, S. cerevisiae
ccttatccggacagggtcttgttga

SEQ ID NO: 24530 - DNA, 25 bp, S. cerevisiae
gcccaaggtggtgttttgccaaaca

SEQ ID NO: 24531 - DNA, 25 bp, S. cerevisiae
cgccgattcggtggtactgacagtg

SEQ ID NO: 24532 - DNA, 25 bp, S. cerevisiae
ccatcgttggcgcatgatgttgcac

SEQ ID NO: 24533 - DNA, 25 bp, S. cerevisiae
cgaccgatgcgcctggatttgataa

SEQ ID NO: 24534 - DNA, 25 bp, S. cerevisiae
cgacgctgatgtgctcgataaataa

SEQ ID NO: 24535 - DNA, 25 bp, S. cerevisiae
cgacagcgacgacttggagaacatt

SEQ ID NO: 24536 - DNA, 25 bp, S. cerevisiae
cgactgccgcaactcacgaaaatat

SEQ ID NO: 24537 - DNA, 25 bp, S. cerevisiae
cgcctgcctagaatgcctgagataa

SEQ ID NO: 24538 - DNA, 25 bp, S. cerevisiae
cgcagtcctcgtggacggtatagtt

SEQ ID NO: 24539 - DNA, 25 bp, S. cerevisiae
cctcttgggagggattctgactggt

SEQ ID NO: 24540 - DNA, 25 bp, S. cerevisiae
cgctcattcgggactgtttacggta

SEQ ID NO: 24541 - DNA, 25 bp, S. cerevisiae
cgacttatctcgagcacatgctgga

SEQ ID NO: 24542 - DNA, 25 bp, S. cerevisiae
cgaaatgcttaacgccagaggaaca

SEQ ID NO: 24543 - DNA, 25 bp, S. cerevisiae
cgccaactcccatcgtattattgat

SEQ ID NO: 24544 - DNA, 25 bp, S. cerevisiae
cccgcttttattgcaggctttggat

SEQ ID NO: 24545 - DNA, 25 bp, S. cerevisiae
cgacttatgccgatgacttttctca

SEQ ID NO: 24546 - DNA, 25 bp, S. cerevisiae
ccctgttgccgttgtaatgtttaca

SEQ ID NO: 24547 - DNA, 25 bp, S. cerevisiae
cgcagctctcgtcaaacaaggtatt

SEQ ID NO: 24548 - DNA, 25 bp, S. cerevisiae
cccaccgtggtattagacacttctg

SEQ ID NO: 24549 - DNA, 25 bp, S. cerevisiae
ccgcccgtagctggaatatgttttg

SEQ ID NO: 24550 - DNA, 25 bp, S. cerevisiae
cgccaagaccttcatcgatctagaa

SEQ ID NO: 24551 - DNA, 25 bp, S. cerevisiae
cccagagtcgtttttccatgagcaa

SEQ ID NO: 24552 - DNA, 25 bp, S. cerevisiae
ccccaccgtgacatttgaagtcttt

SEQ ID NO: 24553 - DNA, 25 bp, S. cerevisiae
cgcgcaatcgccacaaactttaaaa

SEQ ID NO: 24554 - DNA, 25 bp, S. cerevisiae
cgcgtgcttcatacaacccaattat

SEQ ID NO: 24555 - DNA, 25 bp, S. cerevisiae
cgcggccctcattgttcaagagtaa

SEQ ID NO: 24556 - DNA, 25 bp, S. cerevisiae
cgcaggacgctatttctccagataa

SEQ ID NO: 24557 - DNA, 25 bp, S. cerevisiae
cgcaaattgttacctgccgtggaat

SEQ ID NO: 24558 - DNA, 25 bp, S. cerevisiae
cgacttacgtgttcttatcgatgta

SEQ ID NO: 24559 - DNA, 25 bp, S. cerevisiae
cgcatctattaccaactctttcggt

SEQ ID NO: 24560 - DNA, 25 bp, S. cerevisiae
ccgctgatcaagtcactagagtcat

SEQ ID NO: 24561 - DNA, 25 bp, S. cerevisiae
ccctaagaggcggttgtcagcttat

SEQ ID NO: 24562 - DNA, 25 bp, S. cerevisiae
ccctcaaggtggtcgatgtactttt

SEQ ID NO: 24563 - DNA, 25 bp, S. cerevisiae
cccgctatgggaattgctggacatt

SEQ ID NO: 24564 - DNA, 25 bp, S. cerevisiae
ccgtcaagagaggtgctgctggtat

SEQ ID NO: 24565 - DNA, 25 bp, S. cerevisiae
cgcctcacacattggtcttttgatt

SEQ ID NO: 24566 - DNA, 25 bp, S. cerevisiae
cccatcccaaagacctcaaagaaga

SEQ ID NO: 24567 - DNA, 25 bp, S. cerevisiae
cccatcccaaagacctcaaagaaga

SEQ ID NO: 24568 - DNA, 25 bp, S. cerevisiae
cccacgtaagaaagctatcaaacta

SEQ ID NO: 24569 - DNA, 25 bp, S. cerevisiae
gcgatacttaagaaagctccccaac

SEQ ID NO: 24570 - DNA, 25 bp, S. cerevisiae
gtcactgtaagagattggccccaac

SEQ ID NO: 24571 - DNA, 25 bp, S. cerevisiae
cctactcaaggtatggtgcccaatc

SEQ ID NO: 24572 - DNA, 25 bp, S. cerevisiae
cgctttgttgacttctggtttcagt

SEQ ID NO: 24573 - DNA, 25 bp, S. cerevisiae
cgctgtttgtattgttgccttggca

SEQ ID NO: 24574 - DNA, 25 bp, S. cerevisiae
cgcctgtttaactctttgtgactat

SEQ ID NO: 24575 - DNA, 25 bp, S. cerevisiae
cgcacgatgttatctccttcatgaa

SEQ ID NO: 24576 - DNA, 25 bp, S. cerevisiae
cgcaatgtggttaactatctcagta

SEQ ID NO: 24577 - DNA, 25 bp, S. cerevisiae
cgctacacagaatcttcactaccaa

SEQ ID NO: 24578 - DNA, 25 bp, S. cerevisiae
cgcctccagagacttgtacttcgaa

SEQ ID NO: 24579 - DNA, 25 bp, S. cerevisiae
cgcctttggactcctacgattgaga

SEQ ID NO: 24580 - DNA, 25 bp, S. cerevisiae
cgcgctttggcgctctagtaagaga

SEQ ID NO: 24581 - DNA, 25 bp, S. cerevisiae
ccgctgtcatttatgccatttccaa

SEQ ID NO: 24582 - DNA, 25 bp, S. cerevisiae
cgcttaccgtgggactttcagaaga

SEQ ID NO: 24583 - DNA, 25 bp, S. cerevisiae
cccgtaccaaccttatgcgatgaat

SEQ ID NO: 24584 - DNA, 25 bp, S. cerevisiae
cccgttactgccttggtggataata

SEQ ID NO: 24585 - DNA, 25 bp, S. cerevisiae
gcagcgcctaactacgacccaaaaa

SEQ ID NO: 24586 - DNA, 25 bp, S. cerevisiae
gccccgaaaactgccctgaaataat

SEQ ID NO: 24587 - DNA, 25 bp, S. cerevisiae
ccccgagcaaactcacacttttgaa

SEQ ID NO: 24588 - DNA, 25 bp, S. cerevisiae
ccttctggaaaatggcacgtgttgg

SEQ ID NO: 24589 - DNA, 25 bp, S. cerevisiae
cgcgtcacaggaaaaggcccacatg

SEQ ID NO: 24590 - DNA, 25 bp, S. cerevisiae
cgccatcagttacgtcttctaagaa

SEQ ID NO: 24591 - DNA, 25 bp, S. cerevisiae
cgctttcaagatctaatcacgctga

SEQ ID NO: 24592 - DNA, 25 bp, S. cerevisiae
cgctttcaaacacaagagagccttg

SEQ ID NO: 24593 - DNA, 25 bp, S. cerevisiae
cgcatattacaacggacgataccat

SEQ ID NO: 24594 - DNA, 25 bp, S. cerevisiae
cgccttcccagaggtcagaattgtt

SEQ ID NO: 24595 - DNA, 25 bp, S. cerevisiae
gcccttccctaagtatactgtgcat

SEQ ID NO: 24596 - DNA, 25 bp, S. cerevisiae
ccttgatccgctgagtgagacgcta

SEQ ID NO: 24597 - DNA, 25 bp, S. cerevisiae
cctgcgatccgctttattacgtata

SEQ ID NO: 24598 - DNA, 25 bp, S. cerevisiae
cgctgtcggtgctgttttcaacata

SEQ ID NO: 24599 - DNA, 25 bp, S. cerevisiae
cgcgccgggctatgttgattatgat

SEQ ID NO: 24600 - DNA, 25 bp, S. cerevisiae
cgccctgttgtttcacgattggatc

SEQ ID NO: 24601 - DNA, 25 bp, S. cerevisiae
cgcctccaatgttgatgccttagaa

SEQ ID NO: 24602 - DNA, 25 bp, S. cerevisiae
cccaccagggcgttatagatgtcta

SEQ ID NO: 24603 - DNA, 25 bp, S. cerevisiae
cgccatgccatattttttcacagtt

SEQ ID NO: 24604 - DNA, 25 bp, S. cerevisiae
cgcttccgaattttgccacatgtat

SEQ ID NO: 24605 - DNA, 25 bp, S. cerevisiae
cgcttcccacttcgaattcaataga

SEQ ID NO: 24606 - DNA, 25 bp, S. cerevisiae
cgcttcttcatcttctgaatcatca

SEQ ID NO: 24607 - DNA, 25 bp, S. cerevisiae
cgctggtaccttttctttgtcaaat

SEQ ID NO: 24608 - DNA, 25 bp, S. cerevisiae
cgcgggaagcttaacgtttcttgat

SEQ ID NO: 24609 - DNA, 25 bp, S. cerevisiae
cgcgggctggttattgatccttgga

SEQ ID NO: 24610 - DNA, 25 bp, S. cerevisiae
ccgccttgacgttgaagccttgaaa

SEQ ID NO: 24611 - DNA, 25 bp, S. cerevisiae
cctgtcagctacctagataccttaa

SEQ ID NO: 24612 - DNA, 25 bp, S. cerevisiae
ccggtattcctgctaactctgaatt

SEQ ID NO: 24613 - DNA, 25 bp, S. cerevisiae
cccaacgagttgtcaggcatgtcag

SEQ ID NO: 24614 - DNA, 25 bp, S. cerevisiae
cgcaaggcatgtttcatcaggtgta

SEQ ID NO: 24615 - DNA, 25 bp, S. cerevisiae
cctcgccttcaaatatttaccaacg

SEQ ID NO: 24616 - DNA, 25 bp, S. cerevisiae
cccctggccgtttatgtgagcaaat

SEQ ID NO: 24617 - DNA, 25 bp, S. cerevisiae
cccagcagcgtctatttcggaaggt

SEQ ID NO: 24618 - DNA, 25 bp, S. cerevisiae
cctataggactattcttggcaacgt

SEQ ID NO: 24619 - DNA, 25 bp, S. cerevisiae
ccctgaagagtatttggacgccaat

SEQ ID NO: 24620 - DNA, 25 bp, S. cerevisiae
cccagggatgacttaggtgcctcaa

SEQ ID NO: 24621 - DNA, 25 bp, S. cerevisiae
cctctggtgcgcctaagttgaaaaa

SEQ ID NO: 24622 - DNA, 25 bp, S. cerevisiae
cgctgtggcagcagaactttgggat

SEQ ID NO: 24623 - DNA, 25 bp, S. cerevisiae
cgctgcagacgttgaaggtttgtgt

SEQ ID NO: 24624 - DNA, 25 bp, S. cerevisiae
cgctagaggctacagtgatgtttgt

SEQ ID NO: 24625 - DNA, 25 bp, S. cerevisiae
gcatctaggtaaaacgcttttgcgt

SEQ ID NO: 24626 - DNA, 25 bp, S. cerevisiae
ccaggtgttaaatatgtccaagact

SEQ ID NO: 24627 - DNA, 25 bp, S. cerevisiae
gggcggcttaaatctgtcccaaggt

SEQ ID NO: 24628 - DNA, 25 bp, S. cerevisiae
cctgaggacccttatgaacatttta

SEQ ID NO: 24629 - DNA, 25 bp, S. cerevisiae
gcctgaggacatattagcacatcta

SEQ ID NO: 24630 - DNA, 25 bp, S. cerevisiae
ccaatggccattttccgtcagggaa

SEQ ID NO: 24631 - DNA, 25 bp, S. cerevisiae
cgcaggagctcgaggctctcaaaaa

SEQ ID NO: 24632 - DNA, 25 bp, S. cerevisiae
cctatatgagagtttggtacccaaa

SEQ ID NO: 24633 - DNA, 25 bp, S. cerevisiae
cccatccatcggtattttcggtatg

SEQ ID NO: 24634 - DNA, 25 bp, S. cerevisiae
ccgatgagttatccaaggctttgtt

SEQ ID NO: 24635 - DNA, 25 bp, S. cerevisiae
ccgatgcgtggaaaatggccgtttt

SEQ ID NO: 24636 - DNA, 25 bp, S. cerevisiae
cctaacttgatgtctctgggtattt

SEQ ID NO: 24637 - DNA, 25 bp, S. cerevisiae
cgctctgcctataattcctgaattt

SEQ ID NO: 24638 - DNA, 25 bp, S. cerevisiae
cctctagattcaagtcggcgcatta

SEQ ID NO: 24639 - DNA, 25 bp, S. cerevisiae
cccagcattggcaccgatttgtaat

SEQ ID NO: 24640 - DNA, 25 bp, S. cerevisiae
cccgcattgggctccaagggtataa

SEQ ID NO: 24641 - DNA, 25 bp, S. cerevisiae
gccgtcgtagcctccaagggtatag

SEQ ID NO: 24642 - DNA, 25 bp, S. cerevisiae
ccgtcaatgtcgtgtttgttcttcc

SEQ ID NO: 24643 - DNA, 25 bp, S. cerevisiae
ccgtcaatgtcgtgtttgttcttcc

SEQ ID NO: 24644 - DNA, 25 bp, S. cerevisiae
ccgtcaattgaggagttctgtgcta

SEQ ID NO: 24645 - DNA, 25 bp, S. cerevisiae
cgcgattattccgagttgtgtatta

SEQ ID NO: 24646 - DNA, 25 bp, S. cerevisiae
cgcctctttccaagtctgtttatga

SEQ ID NO: 24647 - DNA, 25 bp, S. cerevisiae
ccctctagctttgacgattcactaa

SEQ ID NO: 24648 - DNA, 25 bp, S. cerevisiae
cccaaattttgcttctgttatctta

SEQ ID NO: 24649 - DNA, 25 bp, S. cerevisiae
tcatcctatgttgcggttttgggta

SEQ ID NO: 24650 - DNA, 25 bp, S. cerevisiae
ccgatactttcgtttccatgggtga

SEQ ID NO: 24651 - DNA, 25 bp, S. cerevisiae
gcccataggtttgctagccgggaaa

SEQ ID NO: 24652 - DNA, 25 bp, S. cerevisiae
ccgctattgggtgctcctggaggaa

SEQ ID NO: 24653 - DNA, 25 bp, S. cerevisiae
cgctgttcttggaccgctctgaaat

SEQ ID NO: 24654 - DNA, 25 bp, S. cerevisiae
cgctgtcactattcgtaccagaaag

SEQ ID NO: 24655 - DNA, 25 bp, S. cerevisiae
ccctacatgcctggtactgcaaaat

SEQ ID NO: 24656 - DNA, 25 bp, S. cerevisiae
ccttcatcgccgcatgcaaaaaata

SEQ ID NO: 24657 - DNA, 25 bp, S. cerevisiae
ccctggaattcctttgatgagcgta

SEQ ID NO: 24658 - DNA, 25 bp, S. cerevisiae
ccaaaggtctacacagggattccaa

SEQ ID NO: 24659 - DNA, 25 bp, S. cerevisiae
ccaagcaactgatggcacagccgat

SEQ ID NO: 24660 - DNA, 25 bp, S. cerevisiae
gcctaggttcgcaaaagggtcgcaa

SEQ ID NO: 24661 - DNA, 25 bp, S. cerevisiae
tccaagttacgtttgactaagtttg

SEQ ID NO: 24662 - DNA, 25 bp, S. cerevisiae
ccaaggctacgcattcatcgaattt

SEQ ID NO: 24663 - DNA, 25 bp, S. cerevisiae
ccgcatctttggagtacgtttcatt

SEQ ID NO: 24664 - DNA, 25 bp, S. cerevisiae
ccccgttgttgtattggcttctaat

SEQ ID NO: 24665 - DNA, 25 bp, S. cerevisiae
ccacctgggtttatagacgcttcta

SEQ ID NO: 24666 - DNA, 25 bp, S. cerevisiae
cgccgcttctttattacacgatgtt

SEQ ID NO: 24667 - DNA, 25 bp, S. cerevisiae
cgcctttcatgcttattgtaccaac

SEQ ID NO: 24668 - DNA, 25 bp, S. cerevisiae
ccgtcgtttgccaactgaatctgtt

SEQ ID NO: 24669 - DNA, 25 bp, S. cerevisiae
cgcgttttacgtctacatcagttca

SEQ ID NO: 24670 - DNA, 25 bp, S. cerevisiae
cctgtttcctcgaagtacggtatca

SEQ ID NO: 24671 - DNA, 25 bp, S. cerevisiae
ccagttggccacacgtatcgaggag

SEQ ID NO: 24672 - DNA, 25 bp, S. cerevisiae
ccgcctatgcctaacgaatctaaat

SEQ ID NO: 24673 - DNA, 25 bp, S. cerevisiae
cccctcgttaagtgtgcatcagcaa

SEQ ID NO: 24674 - DNA, 25 bp, S. cerevisiae
cgccgattggtcatattaatcatga

SEQ ID NO: 24675 - DNA, 25 bp, S. cerevisiae
ccctgtatggccgttgacaatatcg

SEQ ID NO: 24676 - DNA, 25 bp, S. cerevisiae
ccctagaggctctagatgccatata

SEQ ID NO: 24677 - DNA, 25 bp, S. cerevisiae
cccgcagtgaggtgctcttagtgta

SEQ ID NO: 24678 - DNA, 25 bp, S. cerevisiae
ccgccgcagtgaagttgaccgtgga

SEQ ID NO: 24679 - DNA, 25 bp, S. cerevisiae
cgccgcgactcaaaaacatacatac

SEQ ID NO: 24680 - DNA, 25 bp, S. cerevisiae
ccttgcgctgcatgttgaaaaccta

SEQ ID NO: 24681 - DNA, 25 bp, S. cerevisiae
ccttgcgttggagggaacagtttca

SEQ ID NO: 24682 - DNA, 25 bp, S. cerevisiae
ccttggttagcatggactttcttga

SEQ ID NO: 24683 - DNA, 25 bp, S. cerevisiae
cctagtttcaattggagcgctcacg

SEQ ID NO: 24684 - DNA, 25 bp, S. cerevisiae
cgcctttgcacaccgatgaaatttt

SEQ ID NO: 24685 - DNA, 25 bp, S. cerevisiae
cgccttatgccccagaagttaatta

SEQ ID NO: 24686 - DNA, 25 bp, S. cerevisiae
cgccttgctccagcatgattttgaa

SEQ ID NO: 24687 - DNA, 25 bp, S. cerevisiae
cccatccttagtcatttattccatt

SEQ ID NO: 24688 - DNA, 25 bp, S. cerevisiae
cccgtcgctggaactttggtaatga

SEQ ID NO: 24689 - DNA, 25 bp, S. cerevisiae
cgctggctgctttagaactttgtat

SEQ ID NO: 24690 - DNA, 25 bp, S. cerevisiae
gcctggtgttaaaagaactgcctca

SEQ ID NO: 24691 - DNA, 25 bp, S. cerevisiae
ccgtctccccacaagaagtagatat

SEQ ID NO: 24692 - DNA, 25 bp, S. cerevisiae
cgctgccaccatcgtcaatgaaaaa

SEQ ID NO: 24693 - DNA, 25 bp, S. cerevisiae
cgccatctccttccattgattaaaa

SEQ ID NO: 24694 - DNA, 25 bp, S. cerevisiae
cgctcatcctctgcaatttctaaaa

SEQ ID NO: 24695 - DNA, 25 bp, S. cerevisiae
cccatactgccttgattctttacaa

SEQ ID NO: 24696 - DNA, 25 bp, S. cerevisiae
cgccacctgggagtatctttacaaa

SEQ ID NO: 24697 - DNA, 25 bp, S. cerevisiae
cccaccgtgcctcagctgagaaggt

SEQ ID NO: 24698 - DNA, 25 bp, S. cerevisiae
cctctcggtcctcacaaattatgtt

SEQ ID NO: 24699 - DNA, 25 bp, S. cerevisiae
ccattggcctcactgtagaagattt

SEQ ID NO: 24700 - DNA, 25 bp, S. cerevisiae
ccttgtgcaccactacgaggagtgt

SEQ ID NO: 24701 - DNA, 25 bp, S. cerevisiae
ccttttgtcttttgcaccgcttata

SEQ ID NO: 24702 - DNA, 25 bp, S. cerevisiae
ccgattttctttagctcaggtctgt

SEQ ID NO: 24703 - DNA, 25 bp, S. cerevisiae
cctattgttattcatccggtctgga

SEQ ID NO: 24704 - DNA, 25 bp, S. cerevisiae
ccgttttatcagcttccactaattt

SEQ ID NO: 24705 - DNA, 25 bp, S. cerevisiae
ccagacgggcagtcatattccgaaa

SEQ ID NO: 24706 - DNA, 25 bp, S. cerevisiae
ccgacgtcgtggatctactaagcaa

SEQ ID NO: 24707 - DNA, 25 bp, S. cerevisiae
cgcggcctgtatcatcgttgggaca

SEQ ID NO: 24708 - DNA, 25 bp, S. cerevisiae
cctcctgttctggtggacgatgtta

SEQ ID NO: 24709 - DNA, 25 bp, S. cerevisiae
cccttggatattttcattgcatgca

SEQ ID NO: 24710 - DNA, 25 bp, S. cerevisiae
ccaactctttggtgaaatctccttc

SEQ ID NO: 24711 - DNA, 25 bp, S. cerevisiae
cctcctcttatccaagaagtccgta

SEQ ID NO: 24712 - DNA, 25 bp, S. cerevisiae
cgccatcatttctaccattatctac

SEQ ID NO: 24713 - DNA, 25 bp, S. cerevisiae
cctatcattatcgtctaacatctaa

SEQ ID NO: 24714 - DNA, 25 bp, S. cerevisiae
cgccatcgcagcaatcgcaaaatta

SEQ ID NO: 24715 - DNA, 25 bp, S. cerevisiae
gatgctgatgcaatagatcatgaca

SEQ ID NO: 24716 - DNA, 25 bp, S. cerevisiae
gcgcatgtgcataaagagccaactt

SEQ ID NO: 24717 - DNA, 25 bp, S. cerevisiae
cgctgtgaatgatacgcgttcgatc

SEQ ID NO: 24718 - DNA, 25 bp, S. cerevisiae
gttggcttacgaacaccctggtgga

SEQ ID NO: 24719 - DNA, 25 bp, S. cerevisiae
cctgcgggaatttattggtactggt

SEQ ID NO: 24720 - DNA, 25 bp, S. cerevisiae
ccggtaagcgtcaagttttaatcag

SEQ ID NO: 24721 - DNA, 25 bp, S. cerevisiae
cgcggttcttatatttgtgctctaa

SEQ ID NO: 24722 - DNA, 25 bp, S. cerevisiae
cgcgtttgctgtattccatgtttta

SEQ ID NO: 24723 - DNA, 25 bp, S. cerevisiae
cccggtcgcgtttcagatcataata

SEQ ID NO: 24724 - DNA, 25 bp, S. cerevisiae
cccaattccagttcacgttcaataa

SEQ ID NO: 24725 - DNA, 25 bp, S. cerevisiae
gcccaatactactctttccaagtcg

SEQ ID NO: 24726 - DNA, 25 bp, S. cerevisiae
cccatccaagcttgtcattactaaa

SEQ ID NO: 24727 - DNA, 25 bp, S. cerevisiae
cccagcacctcagtcgatgttgaaa

SEQ ID NO: 24728 - DNA, 25 bp, S. cerevisiae
cccgctgacaattcctctaatttta

SEQ ID NO: 24729 - DNA, 25 bp, S. cerevisiae
cctgtggcacaaagcttggcggatt

SEQ ID NO: 24730 - DNA, 25 bp, S. cerevisiae
ccagctggccagtcaatttggttgt

SEQ ID NO: 24731 - DNA, 25 bp, S. cerevisiae
ccctggctactatttcactggtgat

SEQ ID NO: 24732 - DNA, 25 bp, S. cerevisiae
cccctggatcttgttgtgtattata

SEQ ID NO: 24733 - DNA, 25 bp, S. cerevisiae
ccggtggtgcttatactgtttctac

SEQ ID NO: 24734 - DNA, 25 bp, S. cerevisiae
cctggttggttttacttgatgttca

SEQ ID NO: 24735 - DNA, 25 bp, S. cerevisiae
cccgcttttgttctcttgatgttag

SEQ ID NO: 24736 - DNA, 25 bp, S. cerevisiae
cctctgttttcgtatgggctttaat

SEQ ID NO: 24737 - DNA, 25 bp, S. cerevisiae
cccggatctgttccatgggattttg

SEQ ID NO: 24738 - DNA, 25 bp, S. cerevisiae
ccctgtgctgatgtccgagaattta

SEQ ID NO: 24739 - DNA, 25 bp, S. cerevisiae
gccgcggcttccagcaatgggattg

SEQ ID NO: 24740 - DNA, 25 bp, S. cerevisiae
cgcctctattccgtttgacaaactg

SEQ ID NO: 24741 - DNA, 25 bp, S. cerevisiae
ccgccgcccaagatgctataaattg

SEQ ID NO: 24742 - DNA, 25 bp, S. cerevisiae
cgccccttgcgtttatcatattgta

SEQ ID NO: 24743 - DNA, 25 bp, S. cerevisiae
ccgggccttgcttcaattttacaat

SEQ ID NO: 24744 - DNA, 25 bp, S. cerevisiae
cctgcattgcgcttttaatttcggc

SEQ ID NO: 24745 - DNA, 25 bp, S. cerevisiae
gactactaggcggtttgttcggtgt

SEQ ID NO: 24746 - DNA, 25 bp, S. cerevisiae
cccacatggtggttacggtatcggt

SEQ ID NO: 24747 - DNA, 25 bp, S. cerevisiae
cccaacgtcgtgttttgctatctgc

SEQ ID NO: 24748 - DNA, 25 bp, S. cerevisiae
ccgagtggccattgagggaccttat

SEQ ID NO: 24749 - DNA, 25 bp, S. cerevisiae
ccgtgtctggtggtgttaagctgtc

SEQ ID NO: 24750 - DNA, 25 bp, S. cerevisiae
cccattgtgtggtgctgtaaggatc

SEQ ID NO: 24751 - DNA, 25 bp, S. cerevisiae
cccatttctcagtcggattcacaag

SEQ ID NO: 24752 - DNA, 25 bp, S. cerevisiae
cccagttctcccctgatataatagt

SEQ ID NO: 24753 - DNA, 25 bp, S. cerevisiae
cgccggattcatggcacttgtaatt

SEQ ID NO: 24754 - DNA, 25 bp, S. cerevisiae
cccagcgattatgcccgatagattt

SEQ ID NO: 24755 - DNA, 25 bp, S. cerevisiae
cctcatcgttacaccgttctttggg

SEQ ID NO: 24756 - DNA, 25 bp, S. cerevisiae
cctcctacaccatgttttttggcaa

SEQ ID NO: 24757 - DNA, 25 bp, S. cerevisiae
gcgccctaacgctgagtttgtcgaa

SEQ ID NO: 24758 - DNA, 25 bp, S. cerevisiae
ccgcttcatgggtttttcttagata

SEQ ID NO: 24759 - DNA, 25 bp, S. cerevisiae
ccctacggtgttggtttgttgatca

SEQ ID NO: 24760 - DNA, 25 bp, S. cerevisiae
cccggtggctctacgtgttgtgaag

SEQ ID NO: 24761 - DNA, 25 bp, S. cerevisiae
ccggtgtccctgacgttattgtaga

SEQ ID NO: 24762 - DNA, 25 bp, S. cerevisiae
ccgttctaccgatgacgtcagtgaa

SEQ ID NO: 24763 - DNA, 25 bp, S. cerevisiae
gaagtagcaaagcacccgccaagaa

SEQ ID NO: 24764 - DNA, 25 bp, S. cerevisiae
gaagtagcactacatccgggccggc

SEQ ID NO: 24765 - DNA, 25 bp, S. cerevisiae
gaatgaagttagctcacgggaagta

SEQ ID NO: 24766 - DNA, 25 bp, S. cerevisiae
gcgaatattgattcctcaccagcga

SEQ ID NO: 24767 - DNA, 25 bp, S. cerevisiae
cctggcattatctgcacacggtaat

SEQ ID NO: 24768 - DNA, 25 bp, S. cerevisiae
cgccttgtctatggtcgtttattaa

SEQ ID NO: 24769 - DNA, 25 bp, S. cerevisiae
cgccttatctactcacatgtttttg

SEQ ID NO: 24770 - DNA, 25 bp, S. cerevisiae
ccctttatgttatcgtttattggct

SEQ ID NO: 24771 - DNA, 25 bp, S. cerevisiae
ccgttatttctatctttgttctaca

SEQ ID NO: 24772 - DNA, 25 bp, S. cerevisiae
cctgcgtgtattgtttttctgtttc

SEQ ID NO: 24773 - DNA, 25 bp, S. cerevisiae
cccctccattagtttcgattatata

SEQ ID NO: 24774 - DNA, 25 bp, S. cerevisiae
tcccacccttacctatgtttggtag

SEQ ID NO: 24775 - DNA, 25 bp, S. cerevisiae
cccagccagtttctttattgtgcga

SEQ ID NO: 24776 - DNA, 25 bp, S. cerevisiae
cctaccgttggctaattgactctag

SEQ ID NO: 24777 - DNA, 25 bp, S. cerevisiae
cctcgctcggtggtgaagtattcat

SEQ ID NO: 24778 - DNA, 25 bp, S. cerevisiae
cccgtcgttcgtaatgcagagtcat

SEQ ID NO: 24779 - DNA, 25 bp, S. cerevisiae
cccagtcactttagccaaggtcatc

SEQ ID NO: 24780 - DNA, 25 bp, S. cerevisiae
ccgaccaagttaccagagttatcac

SEQ ID NO: 24781 - DNA, 25 bp, S. cerevisiae
cccgcacgttgctggtattttaagt

SEQ ID NO: 24782 - DNA, 25 bp, S. cerevisiae
ccggacatgggcttggtacatattt

SEQ ID NO: 24783 - DNA, 25 bp, S. cerevisiae
ccaaattggcggtgacgtatacgaa

SEQ ID NO: 24784 - DNA, 25 bp, S. cerevisiae
gcaaatcaaggtgtaacggcaacga

SEQ ID NO: 24785 - DNA, 25 bp, S. cerevisiae
gccactcaacgtgcccaaggaaagt

SEQ ID NO: 24786 - DNA, 25 bp, S. cerevisiae
ccgatgctgcattaacccaacaaat

SEQ ID NO: 24787 - DNA, 25 bp, S. cerevisiae
ccgagctactacttcactgaacaat

SEQ ID NO: 24788 - DNA, 25 bp, S. cerevisiae
ccgagctgacgccttcttgaaaaaa

SEQ ID NO: 24789 - DNA, 25 bp, S. cerevisiae
ccttatgcggtaatggtctagattt

SEQ ID NO: 24790 - DNA, 25 bp, S. cerevisiae
gcctcagcactcttaccaggaagat

SEQ ID NO: 24791 - DNA, 25 bp, S. cerevisiae
ccgaagctgattacattggcctgat

SEQ ID NO: 24792 - DNA, 25 bp, S. cerevisiae
cctggagcgcttaccatcagtggaa

SEQ ID NO: 24793 - DNA, 25 bp, S. cerevisiae
cccgatggctctattttggaaaatg

SEQ ID NO: 24794 - DNA, 25 bp, S. cerevisiae
ccctcatacattgtctgtgtggcag

SEQ ID NO: 24795 - DNA, 25 bp, S. cerevisiae
cccactatttcatgctttggctgaa

SEQ ID NO: 24796 - DNA, 25 bp, S. cerevisiae
cccttacaaaagtttcctgcgatca

SEQ ID NO: 24797 - DNA, 25 bp, S. cerevisiae
cctcatctgaaaaagtcctccggtg

SEQ ID NO: 24798 - DNA, 25 bp, S. cerevisiae
ccgttagcacaccaagccatagtaa

SEQ ID NO: 24799 - DNA, 25 bp, S. cerevisiae
cctctgtaccaattagctcatcata

SEQ ID NO: 24800 - DNA, 25 bp, S. cerevisiae
ccgcgtataatttcgtccacaacag

SEQ ID NO: 24801 - DNA, 25 bp, S. cerevisiae
ccgctagaaagttgcgtgtccacag

SEQ ID NO: 24802 - DNA, 25 bp, S. cerevisiae
ccccagtcaagttgcattgctctat

SEQ ID NO: 24803 - DNA, 25 bp, S. cerevisiae
cctcgctgtcaatttgttggtggtt

SEQ ID NO: 24804 - DNA, 25 bp, S. cerevisiae
cctctcctgaaatctccacatggaa

SEQ ID NO: 24805 - DNA, 25 bp, S. cerevisiae
cctccaccaagatctccaaataaat

SEQ ID NO: 24806 - DNA, 25 bp, S. cerevisiae
ccgtcctgaggagccattcaattta

SEQ ID NO: 24807 - DNA, 25 bp, S. cerevisiae
cctgattcatcaatgctcgacactg

SEQ ID NO: 24808 - DNA, 25 bp, S. cerevisiae
ccatatgtacggctgccacacctaa

SEQ ID NO: 24809 - DNA, 25 bp, S. cerevisiae
ccttgatattggatctagcgccaac

SEQ ID NO: 24810 - DNA, 25 bp, S. cerevisiae
ccctttggctgtgtggatgatgtaa

SEQ ID NO: 24811 - DNA, 25 bp, S. cerevisiae
ccctttgtgatttcgggctatgcaa

SEQ ID NO: 24812 - DNA, 25 bp, S. cerevisiae
cccctttacttcttcatttagcgat

SEQ ID NO: 24813 - DNA, 25 bp, S. cerevisiae
ccccttgtttattatcttctacgca

SEQ ID NO: 24814 - DNA, 25 bp, S. cerevisiae
ccctgtctcagaatgtcccaataag

SEQ ID NO: 24815 - DNA, 25 bp, S. cerevisiae
ccatcggtagaactgctcaaggtaa

SEQ ID NO: 24816 - DNA, 25 bp, S. cerevisiae
ccgctatcgctgaaggtaagtctaa

SEQ ID NO: 24817 - DNA, 25 bp, S. cerevisiae
cccgtcgttggctaggatcatcaaa

SEQ ID NO: 24818 - DNA, 25 bp, S. cerevisiae
ccgctgctgcggtgtcaggaaacaa

SEQ ID NO: 24819 - DNA, 25 bp, S. cerevisiae
cctcgctgggtgtttggcaagtcaa

SEQ ID NO: 24820 - DNA, 25 bp, S. cerevisiae
ccctctgtttgtacttcaaccaatg

SEQ ID NO: 24821 - DNA, 25 bp, S. cerevisiae
cccattgctgttcactttagtcgat

SEQ ID NO: 24822 - DNA, 25 bp, S. cerevisiae
ccgatgttatcgcaattttccaaga

SEQ ID NO: 24823 - DNA, 25 bp, S. cerevisiae
cccctcatcctaattctactaatat

SEQ ID NO: 24824 - DNA, 25 bp, S. cerevisiae
ccctgatactctgcatccttaaaga

SEQ ID NO: 24825 - DNA, 25 bp, S. cerevisiae
ccctgtatccattccatctgtaaaa

SEQ ID NO: 24826 - DNA, 25 bp, S. cerevisiae
ccctcagacaattcccattcaaata

SEQ ID NO: 24827 - DNA, 25 bp, S. cerevisiae
gccccagaatttccctaaggtagct

SEQ ID NO: 24828 - DNA, 25 bp, S. cerevisiae
gccaccggttcgaaaatcaacttca

SEQ ID NO: 24829 - DNA, 25 bp, S. cerevisiae
ccatccgatttcaaaaacccactat

SEQ ID NO: 24830 - DNA, 25 bp, S. cerevisiae
gcccttgggtttttcaacgcattga

SEQ ID NO: 24831 - DNA, 25 bp, S. cerevisiae
ccgctcatacgtttgttcaactcat

SEQ ID NO: 24832 - DNA, 25 bp, S. cerevisiae
ccattgtagttgacgttgaaggcac

SEQ ID NO: 24833 - DNA, 25 bp, S. cerevisiae
gccgttagtcttgttgaggcctaat

SEQ ID NO: 24834 - DNA, 25 bp, S. cerevisiae
gccatttaagcgacacgtgggcctt

SEQ ID NO: 24835 - DNA, 25 bp, S. cerevisiae
cctgggttcgtcttatgatttggca

SEQ ID NO: 24836 - DNA, 25 bp, S. cerevisiae
ccgggctgggacttcaatgttcaga

SEQ ID NO: 24837 - DNA, 25 bp, S. cerevisiae
ccgccagtgggctattgtttatcaa

SEQ ID NO: 24838 - DNA, 25 bp, S. cerevisiae
ccccatggcttcgttgatttatcag

SEQ ID NO: 24839 - DNA, 25 bp, S. cerevisiae
ccgtcgaccgcaagtattctgataa

SEQ ID NO: 24840 - DNA, 25 bp, S. cerevisiae
cctgaattgttggaggcccttaata

SEQ ID NO: 24841 - DNA, 25 bp, S. cerevisiae
ccgaacttcgttatccctaatgtga

SEQ ID NO: 24842 - DNA, 25 bp, S. cerevisiae
ccgaactcatgtttggtgccactaa

SEQ ID NO: 24843 - DNA, 25 bp, S. cerevisiae
cctgtcactaggtatatcgtctttg

SEQ ID NO: 24844 - DNA, 25 bp, S. cerevisiae
cctgtcctactttactgggcattga

SEQ ID NO: 24845 - DNA, 25 bp, S. cerevisiae
ccttataacgaatctgcgccattac

SEQ ID NO: 24846 - DNA, 25 bp, S. cerevisiae
ccgtcgaacgcattagtcaggctta

SEQ ID NO: 24847 - DNA, 25 bp, S. cerevisiae
ccgccgaactgattggtgaagccat

SEQ ID NO: 24848 - DNA, 25 bp, S. cerevisiae
ccacgtcaagttttggttgtgccag

SEQ ID NO: 24849 - DNA, 25 bp, S. cerevisiae
gaccctaaagtcttcgatttggcct

SEQ ID NO: 24850 - DNA, 25 bp, S. cerevisiae
gaagttcaaaactctactttggctc

SEQ ID NO: 24851 - DNA, 25 bp, S. cerevisiae
ccttcctcgcagatatcatttgtga

SEQ ID NO: 24852 - DNA, 25 bp, S. cerevisiae
cctcagttctgggtatcattgtcta

SEQ ID NO: 24853 - DNA, 25 bp, S. cerevisiae
ccacgaaagggctggattcacaaat

SEQ ID NO: 24854 - DNA, 25 bp, S. cerevisiae
cccgcacatcgttctctgatgataa

SEQ ID NO: 24855 - DNA, 25 bp, S. cerevisiae
ccgcgcttactgacactgctaaaag

SEQ ID NO: 24856 - DNA, 25 bp, S. cerevisiae
ccgcgcctcctaagctgaataatag

SEQ ID NO: 24857 - DNA, 25 bp, S. cerevisiae
ccgcatggctctcaagggataatac

SEQ ID NO: 24858 - DNA, 25 bp, S. cerevisiae
ccgcccatcatcctagattatacaa

SEQ ID NO: 24859 - DNA, 25 bp, S. cerevisiae
ccgccttggctattcatggtgacaa

SEQ ID NO: 24860 - DNA, 25 bp, S. cerevisiae
ccaggcttagctattggcagtaaac

SEQ ID NO: 24861 - DNA, 25 bp, S. cerevisiae
ccttctgctactactggtgagtcta

SEQ ID NO: 24862 - DNA, 25 bp, S. cerevisiae
ccttcaaacagcatgggacctatag

SEQ ID NO: 24863 - DNA, 25 bp, S. cerevisiae
cctgaagaatcattgtacgtcctat

SEQ ID NO: 24864 - DNA, 25 bp, S. cerevisiae
cctttctcgcactcaactattaatg

SEQ ID NO: 24865 - DNA, 25 bp, S. cerevisiae
ccttccgcgtcatccagtaataata

SEQ ID NO: 24866 - DNA, 25 bp, S. cerevisiae
tcctttggtgcagaggttcgttaaa

SEQ ID NO: 24867 - DNA, 25 bp, S. cerevisiae
tcaaatcgggcgcacgttacgtaaa

SEQ ID NO: 24868 - DNA, 25 bp, S. cerevisiae
ttcaaggatagggagcttttcgcta

SEQ ID NO: 24869 - DNA, 25 bp, S. cerevisiae
gcctacaagttgcaatacgggctag

SEQ ID NO: 24870 - DNA, 25 bp, S. cerevisiae
ccattcaggtctccacgacggagaa

SEQ ID NO: 24871 - DNA, 25 bp, S. cerevisiae
ccattcatgacctcactactagatg

SEQ ID NO: 24872 - DNA, 25 bp, S. cerevisiae
gccatacaacgacagctgcacaaga

SEQ ID NO: 24873 - DNA, 25 bp, S. cerevisiae
cctgggcagcagtctcgacatcgaa

SEQ ID NO: 24874 - DNA, 25 bp, S. cerevisiae
ccgtgccacttccaactaagttgaa

SEQ ID NO: 24875 - DNA, 25 bp, S. cerevisiae
ccggtttgtccccatatgaaagaag

SEQ ID NO: 24876 - DNA, 25 bp, S. cerevisiae
cctaggtaacctgcttgacaatgaa

SEQ ID NO: 24877 - DNA, 25 bp, S. cerevisiae
gccctagtaaccacaattccatgaa

SEQ ID NO: 24878 - DNA, 25 bp, S. cerevisiae
ccgtcgttgcatatgtttccctaaa

SEQ ID NO: 24879 - DNA, 25 bp, S. cerevisiae
ccccagctgtgaatattttcggtaa

SEQ ID NO: 24880 - DNA, 25 bp, S. cerevisiae
cctcggcttcacgtgtttcaagaaa

SEQ ID NO: 24881 - DNA, 25 bp, S. cerevisiae
cctgcatggctagtgttcaaagtta

SEQ ID NO: 24882 - DNA, 25 bp, S. cerevisiae
ccagatggtatggtggcacgccttt

SEQ ID NO: 24883 - DNA, 25 bp, S. cerevisiae
ccccaggagtttctgcaatatcata

SEQ ID NO: 24884 - DNA, 25 bp, S. cerevisiae
gccctgggagttgacgacatcttga

SEQ ID NO: 24885 - DNA, 25 bp, S. cerevisiae
ccagtgctactaatgcggttttaat

SEQ ID NO: 24886 - DNA, 25 bp, S. cerevisiae
cctgtgtaatgcttgtgggttgttt

SEQ ID NO: 24887 - DNA, 25 bp, S. cerevisiae
ccgctcccaactgtcgattattgaa

SEQ ID NO: 24888 - DNA, 25 bp, S. cerevisiae
ccgctcttcttctatacattctatt

SEQ ID NO: 24889 - DNA, 25 bp, S. cerevisiae
ccgctcctctgcatgacgaattata

SEQ ID NO: 24890 - DNA, 25 bp, S. cerevisiae
ccgccacattgctcacttattgaag

SEQ ID NO: 24891 - DNA, 25 bp, S. cerevisiae
ccgtcacttgcctacttttgaatgt

SEQ ID NO: 24892 - DNA, 25 bp, S. cerevisiae
ccgtcacttcattccaaactgttga

SEQ ID NO: 24893 - DNA, 25 bp, S. cerevisiae
gccgtactctttgtcaacgactact

SEQ ID NO: 24894 - DNA, 25 bp, S. cerevisiae
ccgtactttcttcactcgttatgat

SEQ ID NO: 24895 - DNA, 25 bp, S. cerevisiae
ccttctgcttccactactaaattat

SEQ ID NO: 24896 - DNA, 25 bp, S. cerevisiae
cctttcttccgtaacatcaactttg

SEQ ID NO: 24897 - DNA, 25 bp, S. cerevisiae
ccatgttgcgtttgtaagccagaaa

SEQ ID NO: 24898 - DNA, 25 bp, S. cerevisiae
ccaagaaggttttctggagggccag

SEQ ID NO: 24899 - DNA, 25 bp, S. cerevisiae
ccaagagattggagaccgagcggtc

SEQ ID NO: 24900 - DNA, 25 bp, S. cerevisiae
ccaagagatttctgcagccgtcaag

SEQ ID NO: 24901 - DNA, 25 bp, S. cerevisiae
ccaagaatcttgtccaccggtagaa

SEQ ID NO: 24902 - DNA, 25 bp, S. cerevisiae
gccagaaaccagtgcaaaggtcctt

SEQ ID NO: 24903 - DNA, 25 bp, S. cerevisiae
ccaaagaccaattaccggtgcttct

SEQ ID NO: 24904 - DNA, 25 bp, S. cerevisiae
tcctaaggagttttcggtggcttct

SEQ ID NO: 24905 - DNA, 25 bp, S. cerevisiae
ccgtccatctttctacttacttgaa

SEQ ID NO: 24906 - DNA, 25 bp, S. cerevisiae
ccgacattcttgagtctctacatca

SEQ ID NO: 24907 - DNA, 25 bp, S. cerevisiae
ccgttgataccttcattgctgttat

SEQ ID NO: 24908 - DNA, 25 bp, S. cerevisiae
ccgtgattcccttcatctataattt

SEQ ID NO: 24909 - DNA, 25 bp, S. cerevisiae
ccgttcgcatgttttattactgtta

SEQ ID NO: 24910 - DNA, 25 bp, S. cerevisiae
ccgattcagcggttgtttcatctat

SEQ ID NO: 24911 - DNA, 25 bp, S. cerevisiae
ccgtgtggcggattctataatggat

SEQ ID NO: 24912 - DNA, 25 bp, S. cerevisiae
ccgtgctgaccgtatctattgtggg

SEQ ID NO: 24913 - DNA, 25 bp, S. cerevisiae
ccgttcacctacagagatcttggca

SEQ ID NO: 24914 - DNA, 25 bp, S. cerevisiae
ccgttcaatccgagagagctttcca

SEQ ID NO: 24915 - DNA, 25 bp, S. cerevisiae
cctggcctgcgcttttgaaatataa

SEQ ID NO: 24916 - DNA, 25 bp, S. cerevisiae
cctggacctctgtcgatggcaataa

SEQ ID NO: 24917 - DNA, 25 bp, S. cerevisiae
gcctccgcgggtgtctcaaggatag

SEQ ID NO: 24918 - DNA, 25 bp, S. cerevisiae
ccagacatgggctccttatgggtag

SEQ ID NO: 24919 - DNA, 25 bp, S. cerevisiae
ccgcagtgaggtgctcttagtgtag

SEQ ID NO: 24920 - DNA, 25 bp, S. cerevisiae
tatccagggtgtgttaacgtttctt

SEQ ID NO: 24921 - DNA, 25 bp, S. cerevisiae
ggtaaggatgtctctaacgttttca

SEQ ID NO: 24922 - DNA, 25 bp, S. cerevisiae
gcgtagaatttcatccaaagttgtt

SEQ ID NO: 24923 - DNA, 25 bp, S. cerevisiae
cctccaattacatccacaaacttta

SEQ ID NO: 24924 - DNA, 25 bp, S. cerevisiae
gcctcaactaaccaagacaacactt

SEQ ID NO: 24925 - DNA, 25 bp, S. cerevisiae
gccaatacttcctcaaaacctttag

SEQ ID NO: 24926 - DNA, 25 bp, S. cerevisiae
gccgaacctaaagatgctaccgaaa

SEQ ID NO: 24927 - DNA, 25 bp, S. cerevisiae
ccgacaggatcaaggctatgccaca

SEQ ID NO: 24928 - DNA, 25 bp, S. cerevisiae
cctgacactgccattgattctcaaa

SEQ ID NO: 24929 - DNA, 25 bp, S. cerevisiae
ccgcatcttcttcggattcattgaa

SEQ ID NO: 24930 - DNA, 25 bp, S. cerevisiae
cctcatttcataccgtttctacaat

SEQ ID NO: 24931 - DNA, 25 bp, S. cerevisiae
gcacgcgtttctgttttagacctaa

SEQ ID NO: 24932 - DNA, 25 bp, S. cerevisiae
ccgcttataatttttgtcagtccta

SEQ ID NO: 24933 - DNA, 25 bp, S. cerevisiae
ccgtgtcataagatcatccatcgtt

SEQ ID NO: 24934 - DNA, 25 bp, S. cerevisiae
cctggttgtacttccaatgggtgca

SEQ ID NO: 24935 - DNA, 25 bp, S. cerevisiae
gccgtcgccaaagtttccagaatgt

SEQ ID NO: 24936 - DNA, 25 bp, S. cerevisiae
ccggccctgataacgatctcataag

SEQ ID NO: 24937 - DNA, 25 bp, S. cerevisiae
ccgaggccttcgactatgctaaaga

SEQ ID NO: 24938 - DNA, 25 bp, S. cerevisiae
ccgagttgtgtattatagtaggaac

SEQ ID NO: 24939 - DNA, 25 bp, S. cerevisiae
cctctttgctgcttgtactgaagga

SEQ ID NO: 24940 - DNA, 25 bp, S. cerevisiae
ccttgcttttgaacattggccgtta

SEQ ID NO: 24941 - DNA, 25 bp, S. cerevisiae
ccaggtgttagattcaaggtcgtta

SEQ ID NO: 24942 - DNA, 25 bp, S. cerevisiae
gcctagtaaagatccagagagcgtt

SEQ ID NO: 24943 - DNA, 25 bp, S. cerevisiae
ccttctttctagacctgtgtttcag

SEQ ID NO: 24944 - DNA, 25 bp, S. cerevisiae
ccgtcatttatcaccaccattggta

SEQ ID NO: 24945 - DNA, 25 bp, S. cerevisiae
ccaccttatgataactgcccattgg

SEQ ID NO: 24946 - DNA, 25 bp, S. cerevisiae
ccagtttcaatggttgccctaggaa

SEQ ID NO: 24947 - DNA, 25 bp, S. cerevisiae
ccatgttcccaggtattgccgaaag

SEQ ID NO: 24948 - DNA, 25 bp, S. cerevisiae
ccgttcgacagtattggcgcatgac

SEQ ID NO: 24949 - DNA, 25 bp, S. cerevisiae
ccgtatgcttgtgtgacttgtcgaa

SEQ ID NO: 24950 - DNA, 25 bp, S. cerevisiae
ccatgacgtgttgaaattgcctaaa

SEQ ID NO: 24951 - DNA, 25 bp, S. cerevisiae
ccgacgtttggaacttcgatatcaa

SEQ ID NO: 24952 - DNA, 25 bp, S. cerevisiae
cctagctgttttcggtttggttatg

SEQ ID NO: 24953 - DNA, 25 bp, S. cerevisiae
cctgggatttgcctactggtgagaa

SEQ ID NO: 24954 - DNA, 25 bp, S. cerevisiae
cctgtggatgtttttctcgtctaat

SEQ ID NO: 24955 - DNA, 25 bp, S. cerevisiae
ccaccggattctcttgttgcaataa

SEQ ID NO: 24956 - DNA, 25 bp, S. cerevisiae
ccaacaggttggcaggtatcagata

SEQ ID NO: 24957 - DNA, 25 bp, S. cerevisiae
cctctcatggttcggacttacttaa

SEQ ID NO: 24958 - DNA, 25 bp, S. cerevisiae
ccttctttttggtacatgccttgtt

SEQ ID NO: 24959 - DNA, 25 bp, S. cerevisiae
gccattgcccgttcattagagacta

SEQ ID NO: 24960 - DNA, 25 bp, S. cerevisiae
ccttctttcgctctattggatatca

SEQ ID NO: 24961 - DNA, 25 bp, S. cerevisiae
cctccgatcatgttcctacatttga

SEQ ID NO: 24962 - DNA, 25 bp, S. cerevisiae
gcctcatggattgtggatttcccgt

SEQ ID NO: 24963 - DNA, 25 bp, S. cerevisiae
gccatgcatgagtacttgcgcaatg

SEQ ID NO: 24964 - DNA, 25 bp, S. cerevisiae
cctcggaagatctcgttatgtaccc

SEQ ID NO: 24965 - DNA, 25 bp, S. cerevisiae
gctgagtttaactccgtttacgcca

SEQ ID NO: 24966 - DNA, 25 bp, S. cerevisiae
gccagtttagccaccacagtaacgg

SEQ ID NO: 24967 - DNA, 25 bp, S. cerevisiae
gccacgttacccaactcagatgaag

SEQ ID NO: 24968 - DNA, 25 bp, S. cerevisiae
gccatcggtaaggacgctgctgcta

SEQ ID NO: 24969 - DNA, 25 bp, S. cerevisiae
gccgccgaagaggaagctttaggta

SEQ ID NO: 24970 - DNA, 25 bp, S. cerevisiae
ccggcagtgatagtttggttcgagc

SEQ ID NO: 24971 - DNA, 25 bp, S. cerevisiae
ccggcatggtttctgtgtttctaat

SEQ ID NO: 24972 - DNA, 25 bp, S. cerevisiae
ccggattcatttttggctttttcat

SEQ ID NO: 24973 - DNA, 25 bp, S. cerevisiae
ccaccttggatttacgttttgctag

SEQ ID NO: 24974 - DNA, 25 bp, S. cerevisiae
ccaacggcgctttacaattttcata

SEQ ID NO: 24975 - DNA, 25 bp, S. cerevisiae
cctacccactttgcagttctataat

SEQ ID NO: 24976 - DNA, 25 bp, S. cerevisiae
cctcccacactggtttggtcagaaa

SEQ ID NO: 24977 - DNA, 25 bp, S. cerevisiae
ccatctccacttctactgaaactaa

SEQ ID NO: 24978 - DNA, 25 bp, S. cerevisiae
ccatagctagcgtgccagcgaatag

SEQ ID NO: 24979 - DNA, 25 bp, S. cerevisiae
ccttaccaaatctctctgctatgaa

SEQ ID NO: 24980 - DNA, 25 bp, S. cerevisiae
cctgctgatcaaaatccaccttgta

SEQ ID NO: 24981 - DNA, 25 bp, S. cerevisiae
ccttgtcgttttcccaatcatagta

SEQ ID NO: 24982 - DNA, 25 bp, S. cerevisiae
cctgcttcctgatttctccaaaatt

SEQ ID NO: 24983 - DNA, 25 bp, S. cerevisiae
ccactctccgttgatgacagcaatg

SEQ ID NO: 24984 - DNA, 25 bp, S. cerevisiae
ccactgctgcaccatatcttaagga

SEQ ID NO: 24985 - DNA, 25 bp, S. cerevisiae
ccacatctcaactatcttcggaata

SEQ ID NO: 24986 - DNA, 25 bp, S. cerevisiae
tccatctaaagatcatccctacgac

SEQ ID NO: 24987 - DNA, 25 bp, S. cerevisiae
ccattaacaatgctcttctgacctt

SEQ ID NO: 24988 - DNA, 25 bp, S. cerevisiae
ccactctatcattgccttatcgagg

SEQ ID NO: 24989 - DNA, 25 bp, S. cerevisiae
ccacacaattgggttatcgatgctg

SEQ ID NO: 24990 - DNA, 25 bp, S. cerevisiae
ccactaattcccaatgatgtctctg

SEQ ID NO: 24991 - DNA, 25 bp, S. cerevisiae
ccaccagattctccgatatttcata

SEQ ID NO: 24992 - DNA, 25 bp, S. cerevisiae
ccataaattccatgattatctacat

SEQ ID NO: 24993 - DNA, 25 bp, S. cerevisiae
ccataaattccatgattatctacat

SEQ ID NO: 24994 - DNA, 25 bp, S. cerevisiae
ccaactgtacactgattacaacaag

SEQ ID NO: 24995 - DNA, 25 bp, S. cerevisiae
ccaggactagcgcaaagaccattat

SEQ ID NO: 24996 - DNA, 25 bp, S. cerevisiae
ccagggctaccaccgagaagatatt

SEQ ID NO: 24997 - DNA, 25 bp, S. cerevisiae
cctgcagctgcgaacctttgataaa

SEQ ID NO: 24998 - DNA, 25 bp, S. cerevisiae
cctgtgatgccctcatttgatgtaa

SEQ ID NO: 24999 - DNA, 25 bp, S. cerevisiae
ccgtgagcgcctttatctcaagata

SEQ ID NO: 25000 - DNA, 25 bp, S. cerevisiae
gccgatggccgtatcctagatatca

SEQ ID NO: 25001 - DNA, 25 bp, S. cerevisiae
gccgtagccggtgccttattactat

SEQ ID NO: 25002 - DNA, 25 bp, S. cerevisiae
gccaggacctggtatcgttttacca

SEQ ID NO: 25003 - DNA, 25 bp, S. cerevisiae
ccatgttccggtactggtgttatcg

SEQ ID NO: 25004 - DNA, 25 bp, S. cerevisiae
ccttctttgcgtacggtgtgtatgt

SEQ ID NO: 25005 - DNA, 25 bp, S. cerevisiae
gccctgctaagggaatcgtcttcag

SEQ ID NO: 25006 - DNA, 25 bp, S. cerevisiae
gcgcctgcgaagtttccgctttcgg

SEQ ID NO: 25007 - DNA, 25 bp, S. cerevisiae
cctgcgaagtttccgctttcggtca

SEQ ID NO: 25008 - DNA, 25 bp, S. cerevisiae
ccatgaaaggtttggcttccgatat

SEQ ID NO: 25009 - DNA, 25 bp, S. cerevisiae
cctatcgcaggtgactatggtttga

SEQ ID NO: 25010 - DNA, 25 bp, S. cerevisiae
cctgatctgaaaattgccggcttga

SEQ ID NO: 25011 - DNA, 25 bp, S. cerevisiae
cctgacgttcaattatcccttggat

SEQ ID NO: 25012 - DNA, 25 bp, S. cerevisiae
gccgatcctaaagtacccgtggtat

SEQ ID NO: 25013 - DNA, 25 bp, S. cerevisiae
ccagatcctaaactcaccacagagg

SEQ ID NO: 25014 - DNA, 25 bp, S. cerevisiae
ccagcctcattttgcgtaatcgaga

SEQ ID NO: 25015 - DNA, 25 bp, S. cerevisiae
gccagcctcattttgcgtaatcgag

SEQ ID NO: 25016 - DNA, 25 bp, S. cerevisiae
cctcactcttcattgctgctaaata

SEQ ID NO: 25017 - DNA, 25 bp, S. cerevisiae
cctgccatcatttctgctgtagaga

SEQ ID NO: 25018 - DNA, 25 bp, S. cerevisiae
cctcgcacagttttgctcatcataa

SEQ ID NO: 25019 - DNA, 25 bp, S. cerevisiae
ccttgtcatatccttctactgatgt

SEQ ID NO: 25020 - DNA, 25 bp, S. cerevisiae
ccttcaactccgtctttgatgttaa

SEQ ID NO: 25021 - DNA, 25 bp, S. cerevisiae
ccttccacctaacgttgtatcgaat

SEQ ID NO: 25022 - DNA, 25 bp, S. cerevisiae
ccttccagacatatttcgttcgcaa

SEQ ID NO: 25023 - DNA, 25 bp, S. cerevisiae
cctaaatgcggtgtgtgggttataa

SEQ ID NO: 25024 - DNA, 25 bp, S. cerevisiae
ccatgggcggtgttacggcttatac

SEQ ID NO: 25025 - DNA, 25 bp, S. cerevisiae
ccttatttgtgcttgttgggttgat

SEQ ID NO: 25026 - DNA, 25 bp, S. cerevisiae
ccataatcttaaaccgcctggcatt

SEQ ID NO: 25027 - DNA, 25 bp, S. cerevisiae
cctccttgaacctagactctttgaa

SEQ ID NO: 25028 - DNA, 25 bp, S. cerevisiae
cctttggatgttttcttggccgcat

SEQ ID NO: 25029 - DNA, 25 bp, S. cerevisiae
ccggtcacttcttctttactgataa

SEQ ID NO: 25030 - DNA, 25 bp, S. cerevisiae
cctgcagctcacattactcttgaat

SEQ ID NO: 25031 - DNA, 25 bp, S. cerevisiae
cctgaacacgttgcaccatttgatg

SEQ ID NO: 25032 - DNA, 25 bp, S. cerevisiae
cctactctcgataaacctaatgctg

SEQ ID NO: 25033 - DNA, 25 bp, S. cerevisiae
cctaccatcttttatcttaagcgat

SEQ ID NO: 25034 - DNA, 25 bp, S. cerevisiae
ccttctatcatttctgactctactg

SEQ ID NO: 25035 - DNA, 25 bp, S. cerevisiae
ccacgaccctacagtcagttgtaat

SEQ ID NO: 25036 - DNA, 25 bp, S. cerevisiae
ccacacaagaccctttgcatttagt

SEQ ID NO: 25037 - DNA, 25 bp, S. cerevisiae
ccaacgtcacggctttaatcaatat

SEQ ID NO: 25038 - DNA, 25 bp, S. cerevisiae
gccaatcggttggtccttttatcaa

SEQ ID NO: 25039 - DNA, 25 bp, S. cerevisiae
gccaaccctacgcacttataaagat

SEQ ID NO: 25040 - DNA, 25 bp, S. cerevisiae
ccaaccctttcatcatatctagacg

SEQ ID NO: 25041 - DNA, 25 bp, S. cerevisiae
cctcacccctgcaaactgtaaatat

SEQ ID NO: 25042 - DNA, 25 bp, S. cerevisiae
ccttgtcccttattctgctgaagat

SEQ ID NO: 25043 - DNA, 25 bp, S. cerevisiae
ccatatggccctgatttcgacaata

SEQ ID NO: 25044 - DNA, 25 bp, S. cerevisiae
ccttcagtgctgttagtttaccgtg

SEQ ID NO: 25045 - DNA, 25 bp, S. cerevisiae
ccaatcacccttcatggatcagtat

SEQ ID NO: 25046 - DNA, 25 bp, S. cerevisiae
cctacatcctcattttctgtgggta

SEQ ID NO: 25047 - DNA, 25 bp, S. cerevisiae
ccacttggtctcattcagggatgta

SEQ ID NO: 25048 - DNA, 25 bp, S. cerevisiae
ccatttggcccaaaagggtcatata

SEQ ID NO: 25049 - DNA, 25 bp, S. cerevisiae
ccatttacccataaattccatgatt

SEQ ID NO: 25050 - DNA, 25 bp, S. cerevisiae
ccatttacccataaattccatgatt

SEQ ID NO: 25051 - DNA, 25 bp, S. cerevisiae
ccattattccttccaaacctgattt

SEQ ID NO: 25052 - DNA, 25 bp, S. cerevisiae
gccttgcttgcttatccaaacagtg

SEQ ID NO: 25053 - DNA, 25 bp, S. cerevisiae
gccttctgtcagcattagcaacgat

SEQ ID NO: 25054 - DNA, 25 bp, S. cerevisiae
ccttgtgtagattaccattcgcgga

SEQ ID NO: 25055 - DNA, 25 bp, S. cerevisiae
ccaggatctggattatttggagcca

SEQ ID NO: 25056 - DNA, 25 bp, S. cerevisiae
ccaccatttatgaagttgccccagg

SEQ ID NO: 25057 - DNA, 25 bp, S. cerevisiae
gcccgtctttgatgctccggaaagt

SEQ ID NO: 25058 - DNA, 25 bp, S. cerevisiae
cctcgcattcattgacctcttttaa

SEQ ID NO: 25059 - DNA, 25 bp, S. cerevisiae
cctgtcctgtcatcactttttatga

SEQ ID NO: 25060 - DNA, 25 bp, S. cerevisiae
ccagtcctcaaatctctttctaaaa

SEQ ID NO: 25061 - DNA, 25 bp, S. cerevisiae
cctattcagaggaccatatgctaaa

SEQ ID NO: 25062 - DNA, 25 bp, S. cerevisiae
cctattaggactggctgttgcggaa

SEQ ID NO: 25063 - DNA, 25 bp, S. cerevisiae
ccatatttggtgaccgagggcgaca

SEQ ID NO: 25064 - DNA, 25 bp, S. cerevisiae
ccattttttgatccggagtcgccaa

SEQ ID NO: 25065 - DNA, 25 bp, S. cerevisiae
ccaaggtagttgtcgaaatcgtcaa

SEQ ID NO: 25066 - DNA, 25 bp, S. cerevisiae
cctgcttccatcaatgtgccatata

SEQ ID NO: 25067 - DNA, 25 bp, S. cerevisiae
ccatatgcttatggcccacgtggtt

SEQ ID NO: 25068 - DNA, 25 bp, S. cerevisiae
ccatctgatatgtggtcatgcggtt

SEQ ID NO: 25069 - DNA, 25 bp, S. cerevisiae
ccacttggtgcggtccatgtaaaat

SEQ ID NO: 25070 - DNA, 25 bp, S. cerevisiae
ccagccatggttgcctcagttagaa

SEQ ID NO: 25071 - DNA, 25 bp, S. cerevisiae
ccaccaagaacctggctctgatgaa

SEQ ID NO: 25072 - DNA, 25 bp, S. cerevisiae
cctccattagtttcgattatataaa

SEQ ID NO: 25073 - DNA, 25 bp, S. cerevisiae
cctcccttgatgacacttccaaaaa

SEQ ID NO: 25074 - DNA, 25 bp, S. cerevisiae
ccttacattcatccttttccagaga

SEQ ID NO: 25075 - DNA, 25 bp, S. cerevisiae
cctctgtttcatcattttctggcaa

SEQ ID NO: 25076 - DNA, 25 bp, S. cerevisiae
cctcatttctttacatttcatccac

SEQ ID NO: 25077 - DNA, 25 bp, S. cerevisiae
cctccaagtgccctgttaatgaaat

SEQ ID NO: 25078 - DNA, 25 bp, S. cerevisiae
gccttcggaattatttacggagctt

SEQ ID NO: 25079 - DNA, 25 bp, S. cerevisiae
gtcctcaggaccgaatttacgcgga

SEQ ID NO: 25080 - DNA, 25 bp, S. cerevisiae
gccaggcaatttcaatttcaccctt

SEQ ID NO: 25081 - DNA, 25 bp, S. cerevisiae
gcctgggtttacaaattgccaccat

SEQ ID NO: 25082 - DNA, 25 bp, S. cerevisiae
gccgggattggacaaatcactcctg

SEQ ID NO: 25083 - DNA, 25 bp, S. cerevisiae
gccaaattcgtatgggaacctgctt

SEQ ID NO: 25084 - DNA, 25 bp, S. cerevisiae
gccaagaagggctcactgacaatcc

SEQ ID NO: 25085 - DNA, 25 bp, S. cerevisiae
gcgcaattaatgctaccgtcaatcc

SEQ ID NO: 25086 - DNA, 25 bp, S. cerevisiae
gcagcagttattcacccggaggcac

SEQ ID NO: 25087 - DNA, 25 bp, S. cerevisiae
gccattggaatttcccggtgacaaa

SEQ ID NO: 25088 - DNA, 25 bp, S. cerevisiae
gccaagtaatgctgacgccgtccaa

SEQ ID NO: 25089 - DNA, 25 bp, S. cerevisiae
ccaagctagatctgcctgaaggcca

SEQ ID NO: 25090 - DNA, 25 bp, S. cerevisiae
ccaaggctctatccaaagatggtat

SEQ ID NO: 25091 - DNA, 25 bp, S. cerevisiae
cctatcacaccagtttcttctaata

SEQ ID NO: 25092 - DNA, 25 bp, S. cerevisiae
ccagaaaccacttcctattcaattc

SEQ ID NO: 25093 - DNA, 25 bp, S. cerevisiae
ccagacgtcttgtacacttccaagt

SEQ ID NO: 25094 - DNA, 25 bp, S. cerevisiae
ccagggtccattaagtcatccagaa

SEQ ID NO: 25095 - DNA, 25 bp, S. cerevisiae
cctttgtttcgcagtcatccagaag

SEQ ID NO: 25096 - DNA, 25 bp, S. cerevisiae
ccagaatcacttgcggctgacttaa

SEQ ID NO: 25097 - DNA, 25 bp, S. cerevisiae
ccatcgtctagtaaggcgccagtta

SEQ ID NO: 25098 - DNA, 25 bp, S. cerevisiae
ccttcattcctgagacgctggtaaa

SEQ ID NO: 25099 - DNA, 25 bp, S. cerevisiae
ccttcctgaggaaagcggctacaac

SEQ ID NO: 25100 - DNA, 25 bp, S. cerevisiae
ccattctctgggacaagctggtaga

SEQ ID NO: 25101 - DNA, 25 bp, S. cerevisiae
ccaacattggtgaaactgcgggagt

SEQ ID NO: 25102 - DNA, 25 bp, S. cerevisiae
ccaaatataggttagccggctcatt

SEQ ID NO: 25103 - DNA, 25 bp, S. cerevisiae
ccaacatcaaggtggcggttcaatg

SEQ ID NO: 25104 - DNA, 25 bp, S. cerevisiae
ccacgtttggttctcatttcagtaa

SEQ ID NO: 25105 - DNA, 25 bp, S. cerevisiae
ccaggttacgttgacattgtcaaga

SEQ ID NO: 25106 - DNA, 25 bp, S. cerevisiae
ccttaggcggtggtgctgcattgaa

SEQ ID NO: 25107 - DNA, 25 bp, S. cerevisiae
cctatcgtctgccatggtgtatgag

SEQ ID NO: 25108 - DNA, 25 bp, S. cerevisiae
gccaattcggccatgtgtgagtacg

SEQ ID NO: 25109 - DNA, 25 bp, S. cerevisiae
ccaaatatggccttgcttgcttatc

SEQ ID NO: 25110 - DNA, 25 bp, S. cerevisiae
gccaaattagtattgcggtttccca

SEQ ID NO: 25111 - DNA, 25 bp, S. cerevisiae
ccaagtcattggtcgtcgtttacca

SEQ ID NO: 25112 - DNA, 25 bp, S. cerevisiae
ccacggcattcgacgtttgttttga

SEQ ID NO: 25113 - DNA, 25 bp, S. cerevisiae
ccatgcaggccaatcgacgaattaa

SEQ ID NO: 25114 - DNA, 25 bp, S. cerevisiae
ccattctatcatccggctggtttag

SEQ ID NO: 25115 - DNA, 25 bp, S. cerevisiae
ccatggcaaagcaaggtcgttcgat

SEQ ID NO: 25116 - DNA, 25 bp, S. cerevisiae
ccttcagtgcagtggtacagttctt

SEQ ID NO: 25117 - DNA, 25 bp, S. cerevisiae
gccttcttgaagttggtcgagccat

SEQ ID NO: 25118 - DNA, 25 bp, S. cerevisiae
gcggtcgtgtagtaggtgccaatcc

SEQ ID NO: 25119 - DNA, 25 bp, S. cerevisiae
ccaacgcagtggaatcgctatcgga

SEQ ID NO: 25120 - DNA, 25 bp, S. cerevisiae
ccaatggaggacttcgctaccgaat

SEQ ID NO: 25121 - DNA, 25 bp, S. cerevisiae
ccatcaaaatttaccaactccttca

SEQ ID NO: 25122 - DNA, 25 bp, S. cerevisiae
ccatccaaattttcaaggctccttt

SEQ ID NO: 25123 - DNA, 25 bp, S. cerevisiae
ccatccaaactatatcctggcgttt

SEQ ID NO: 25124 - DNA, 25 bp, S. cerevisiae
ccaatcctagcggtttaagagagtc

SEQ ID NO: 25125 - DNA, 25 bp, S. cerevisiae
cctactgctgagacctgacgaaatc

SEQ ID NO: 25126 - DNA, 25 bp, S. cerevisiae
cctttctcttccacgcaagatgtaa

SEQ ID NO: 25127 - DNA, 25 bp, S. cerevisiae
ccttcctttccctagcattgaataa

SEQ ID NO: 25128 - DNA, 25 bp, S. cerevisiae
ccttcgtttcccatcttatataagg

SEQ ID NO: 25129 - DNA, 25 bp, S. cerevisiae
ccagttgaacaaagtgaggcacgta

SEQ ID NO: 25130 - DNA, 25 bp, S. cerevisiae
ccagtttgccaaatttgccgcggaa

SEQ ID NO: 25131 - DNA, 25 bp, S. cerevisiae
ccagtcgatgctgtctcctgtaaga

SEQ ID NO: 25132 - DNA, 25 bp, S. cerevisiae
ccatgggtgctggttcattgccgga

SEQ ID NO: 25133 - DNA, 25 bp, S. cerevisiae
ccaccgttggcgtcactagattatg

SEQ ID NO: 25134 - DNA, 25 bp, S. cerevisiae
ccaggcagtatccaagacgatgttt

SEQ ID NO: 25135 - DNA, 25 bp, S. cerevisiae
gccgtaggaatgtcacagctcaatt

SEQ ID NO: 25136 - DNA, 25 bp, S. cerevisiae
gcctaaaggcattccccaaatatat

SEQ ID NO: 25137 - DNA, 25 bp, S. cerevisiae
gcccggcggatcaacccaaattaga

SEQ ID NO: 25138 - DNA, 25 bp, S. cerevisiae
gcacggaaatcagacgcctacttaa

SEQ ID NO: 25139 - DNA, 25 bp, S. cerevisiae
gcgcggaaggaagccctctttaatt

SEQ ID NO: 25140 - DNA, 25 bp, S. cerevisiae
gctggtaagaccaccttctttgaaa

SEQ ID NO: 25141 - DNA, 25 bp, S. cerevisiae
tatggtaaaactccctttagtatct

SEQ ID NO: 25142 - DNA, 25 bp, S. cerevisiae
gccaaggttcaagcagttcggacac

SEQ ID NO: 25143 - DNA, 25 bp, S. cerevisiae
ccaagcctcataccgcatggtttta

SEQ ID NO: 25144 - DNA, 25 bp, S. cerevisiae
gcctataccaaagagagccttctaa

SEQ ID NO: 25145 - DNA, 25 bp, S. cerevisiae
ccattaccttccagcattttttcaa

SEQ ID NO: 25146 - DNA, 25 bp, S. cerevisiae
gccgtgttgtcagaaaacttttcga

SEQ ID NO: 25147 - DNA, 25 bp, S. cerevisiae
gcctgccgttcccaaatatttttag

SEQ ID NO: 25148 - DNA, 25 bp, S. cerevisiae
gccaactttccctcaactttatata

SEQ ID NO: 25149 - DNA, 25 bp, S. cerevisiae
ccaaactctcctggcgaaatttatt

SEQ ID NO: 25150 - DNA, 25 bp, S. cerevisiae
gccaaactctcctggcgaaatttat

SEQ ID NO: 25151 - DNA, 25 bp, S. cerevisiae
gcgaaactacgctgggcaactcgtt

SEQ ID NO: 25152 - DNA, 25 bp, S. cerevisiae
ccaatactactctttccaagtcgct

SEQ ID NO: 25153 - DNA, 25 bp, S. cerevisiae
ccaaactttactacagcggagcgaa

SEQ ID NO: 25154 - DNA, 25 bp, S. cerevisiae
ccagattctttacaacggcgtcgat

SEQ ID NO: 25155 - DNA, 25 bp, S. cerevisiae
gccaatctttataattacgggtcgt

SEQ ID NO: 25156 - DNA, 25 bp, S. cerevisiae
ccaatttctattgtacggcccatta

SEQ ID NO: 25157 - DNA, 25 bp, S. cerevisiae
gccaaaatctttggtgttgacccta

SEQ ID NO: 25158 - DNA, 25 bp, S. cerevisiae
gccaatttatttatgggcccttgac

SEQ ID NO: 25159 - DNA, 25 bp, S. cerevisiae
ccagggctgccttcgagattagaga

SEQ ID NO: 25160 - DNA, 25 bp, S. cerevisiae
ccattccatcttctaatgactgtag

SEQ ID NO: 25161 - DNA, 25 bp, S. cerevisiae
ccaagccaactctagaaatgccatt

SEQ ID NO: 25162 - DNA, 25 bp, S. cerevisiae
ccattccaaccatatctagcgattt

SEQ ID NO: 25163 - DNA, 25 bp, S. cerevisiae
ccattgctgctggtaaattactttt

SEQ ID NO: 25164 - DNA, 25 bp, S. cerevisiae
ccacaggctggtcatttgatcctaa

SEQ ID NO: 25165 - DNA, 25 bp, S. cerevisiae
ccatactgggtactattgttctgcc

SEQ ID NO: 25166 - DNA, 25 bp, S. cerevisiae
ccttcttgtgttcttgtttggcata

SEQ ID NO: 25167 - DNA, 25 bp, S. cerevisiae
ccttcttggcactttcagtttcaat

SEQ ID NO: 25168 - DNA, 25 bp, S. cerevisiae
ccattcttagcgcttgcttttcaat

SEQ ID NO: 25169 - DNA, 25 bp, S. cerevisiae
ccttgctgccgtcatgttattgtaa

SEQ ID NO: 25170 - DNA, 25 bp, S. cerevisiae
ccttcatgaaggtgttttggctaaa

SEQ ID NO: 25171 - DNA, 25 bp, S. cerevisiae
ccttccatccgctaatgttatctta

SEQ ID NO: 25172 - DNA, 25 bp, S. cerevisiae
gcttaccggagaaactttgcgtcag

SEQ ID NO: 25173 - DNA, 25 bp, S. cerevisiae
gcagctttcggcacgtgagtacgga

SEQ ID NO: 25174 - DNA, 25 bp, S. cerevisiae
gcctttccctgtggtcaattcggaa

SEQ ID NO: 25175 - DNA, 25 bp, S. cerevisiae
ccttctaagtcgctcaatctgggaa

SEQ ID NO: 25176 - DNA, 25 bp, S. cerevisiae
gcgctaccgatacccaaactatgaa

SEQ ID NO: 25177 - DNA, 25 bp, S. cerevisiae
gcctgacgcgtatccaacaatgaac

SEQ ID NO: 25178 - DNA, 25 bp, S. cerevisiae
gcccaagctggctccaacgatggat

SEQ ID NO: 25179 - DNA, 25 bp, S. cerevisiae
gccacaccggaactaacgtgagcta

SEQ ID NO: 25180 - DNA, 25 bp, S. cerevisiae
gcatcagcactgcagaatcgttcgt

SEQ ID NO: 25181 - DNA, 25 bp, S. cerevisiae
gaataaaagcctgtaccggtggtat

SEQ ID NO: 25182 - DNA, 25 bp, S. cerevisiae
gaactaagcggtgtcaacggtgttt

SEQ ID NO: 25183 - DNA, 25 bp, S. cerevisiae
gaacaactcgaagccaaccttttgg

SEQ ID NO: 25184 - DNA, 25 bp, S. cerevisiae
gcaacgactgcgagtaaaccttttt

SEQ ID NO: 25185 - DNA, 25 bp, S. cerevisiae
gccagaccactaaagaactccgtta

SEQ ID NO: 25186 - DNA, 25 bp, S. cerevisiae
gccaaggccaaaggcgtcgtcagtt

SEQ ID NO: 25187 - DNA, 25 bp, S. cerevisiae
ccagaacccattgttgactcactaa

SEQ ID NO: 25188 - DNA, 25 bp, S. cerevisiae
ccttggaagagtcagatcagagatt

SEQ ID NO: 25189 - DNA, 25 bp, S. cerevisiae
gccaatgtggtagctgcaaaaataa

SEQ ID NO: 25190 - DNA, 25 bp, S. cerevisiae
ccatgttgtctctttgattgaaaac

SEQ ID NO: 25191 - DNA, 25 bp, S. cerevisiae
ccatctttatcttcctttatttcca

SEQ ID NO: 25192 - DNA, 25 bp, S. cerevisiae
ccagttcaggaacgttcgtggcatt

SEQ ID NO: 25193 - DNA, 25 bp, S. cerevisiae
ccttctcttgaacgttggtggctga

SEQ ID NO: 25194 - DNA, 25 bp, S. cerevisiae
ccatggccatgtttgtaggtttgac

SEQ ID NO: 25195 - DNA, 25 bp, S. cerevisiae
gcctagagatttccaagcacctttt

SEQ ID NO: 25196 - DNA, 25 bp, S. cerevisiae
gccagcaattttccaagtcctttat

SEQ ID NO: 25197 - DNA, 25 bp, S. cerevisiae
gccgctttgagaaccgttaaatctt

SEQ ID NO: 25198 - DNA, 25 bp, S. cerevisiae
gccgttgtggaatggactcaagatt

SEQ ID NO: 25199 - DNA, 25 bp, S. cerevisiae
gccaactgtgttaaggaaagaatta

SEQ ID NO: 25200 - DNA, 25 bp, S. cerevisiae
gccagagttgttgacttgatcgaat

SEQ ID NO: 25201 - DNA, 25 bp, S. cerevisiae
gcccaatgtggaactagtaacggta

SEQ ID NO: 25202 - DNA, 25 bp, S. cerevisiae
gccaccgttttcagtacctgagata

SEQ ID NO: 25203 - DNA, 25 bp, S. cerevisiae
ccaccgctttggctgtaggtataag

SEQ ID NO: 25204 - DNA, 25 bp, S. cerevisiae
gccgaagttactatcgaagatgctt

SEQ ID NO: 25205 - DNA, 25 bp, S. cerevisiae
gccctagttagtcatggaggtgcta

SEQ ID NO: 25206 - DNA, 25 bp, S. cerevisiae
ccattattctcttctacttttcatc

SEQ ID NO: 25207 - DNA, 25 bp, S. cerevisiae
ccatctcggtttagacgtctttaat

SEQ ID NO: 25208 - DNA, 25 bp, S. cerevisiae
ccacatctgatgaatttccccttaa

SEQ ID NO: 25209 - DNA, 25 bp, S. cerevisiae
ccactgctatgattgctttaccttt

SEQ ID NO: 25210 - DNA, 25 bp, S. cerevisiae
ccatttgtggcgtcattgttgcgtg

SEQ ID NO: 25211 - DNA, 25 bp, S. cerevisiae
ccatttgtgtggttgagctctgaag

SEQ ID NO: 25212 - DNA, 25 bp, S. cerevisiae
ccatattctgtcattgcacctaaaa

SEQ ID NO: 25213 - DNA, 25 bp, S. cerevisiae
ccagactctgatattccagccaata

SEQ ID NO: 25214 - DNA, 25 bp, S. cerevisiae
gccacctctaagaaggatcctttac

SEQ ID NO: 25215 - DNA, 25 bp, S. cerevisiae
gccacctgtcccagaatcattatta

SEQ ID NO: 25216 - DNA, 25 bp, S. cerevisiae
ccagtttcacctccttgttatatta

SEQ ID NO: 25217 - DNA, 25 bp, S. cerevisiae
ccatggtatacctctttgctaaaca

SEQ ID NO: 25218 - DNA, 25 bp, S. cerevisiae
ccaagttcaccttcctctgtaggaa

SEQ ID NO: 25219 - DNA, 25 bp, S. cerevisiae
ccatggttggctgtttttgtggcat

SEQ ID NO: 25220 - DNA, 25 bp, S. cerevisiae
ccagtgttcctgattttcattccat

SEQ ID NO: 25221 - DNA, 25 bp, S. cerevisiae
ccagtgttcttgattctacagctaa

SEQ ID NO: 25222 - DNA, 25 bp, S. cerevisiae
ccaagccagccggtttcatgaagaa

SEQ ID NO: 25223 - DNA, 25 bp, S. cerevisiae
gccatacaggttagcctcaaattaa

SEQ ID NO: 25224 - DNA, 25 bp, S. cerevisiae
ccaacggtggatgctaggcctattt

SEQ ID NO: 25225 - DNA, 25 bp, S. cerevisiae
gccaaccgtagaattagcagccaat

SEQ ID NO: 25226 - DNA, 25 bp, S. cerevisiae
ccaacccggatttcaagctgcataa

SEQ ID NO: 25227 - DNA, 25 bp, S. cerevisiae
ccacccttatcaatccttaaagcaa

SEQ ID NO: 25228 - DNA, 25 bp, S. cerevisiae
ccagctccaaaaatctcttacaaga

SEQ ID NO: 25229 - DNA, 25 bp, S. cerevisiae
gccggaggatgctacgaaattcgac

SEQ ID NO: 25230 - DNA, 25 bp, S. cerevisiae
gccaggaagctgcacgtcaatacta

SEQ ID NO: 25231 - DNA, 25 bp, S. cerevisiae
gccacgtgcattgtctggttgagca

SEQ ID NO: 25232 - DNA, 25 bp, S. cerevisiae
gctcaagtacgcacggttccaaaat

SEQ ID NO: 25233 - DNA, 25 bp, S. cerevisiae
ccaccttcagtatcgtctataacca

SEQ ID NO: 25234 - DNA, 25 bp, S. cerevisiae
ccacttctcatcacatggaactcaa

SEQ ID NO: 25235 - DNA, 25 bp, S. cerevisiae
ccaagtcttgcaccatcttaatcaa

SEQ ID NO: 25236 - DNA, 25 bp, S. cerevisiae
ccatgtggatctttcattggataaa

SEQ ID NO: 25237 - DNA, 25 bp, S. cerevisiae
ccattcgctccctaaggtattgcaa

SEQ ID NO: 25238 - DNA, 25 bp, S. cerevisiae
ccattatctccaacacgctgtatta

SEQ ID NO: 25239 - DNA, 25 bp, S. cerevisiae
ccactatccacaaatactctctatg

SEQ ID NO: 25240 - DNA, 25 bp, S. cerevisiae
ccaaatgccaaatctctgctcatag

SEQ ID NO: 25241 - DNA, 25 bp, S. cerevisiae
ccattaccacagctgtttctagaca

SEQ ID NO: 25242 - DNA, 25 bp, S. cerevisiae
gccttggccaagttgttacgagaca

SEQ ID NO: 25243 - DNA, 25 bp, S. cerevisiae
gcctttgctgacagtgtctacggtt

SEQ ID NO: 25244 - DNA, 25 bp, S. cerevisiae
gccattcacgccaagcgtgtcacta

SEQ ID NO: 25245 - DNA, 25 bp, S. cerevisiae
gccacatgtatattgaacaacctga

SEQ ID NO: 25246 - DNA, 25 bp, S. cerevisiae
gccacacagctatttcataaccatg

SEQ ID NO: 25247 - DNA, 25 bp, S. cerevisiae
gcgccgcaccaaatattagcctgga

SEQ ID NO: 25248 - DNA, 25 bp, S. cerevisiae
gccatcgaacagagactagccggta

SEQ ID NO: 25249 - DNA, 25 bp, S. cerevisiae
gccaagactacatatctgaccacat

SEQ ID NO: 25250 - DNA, 25 bp, S. cerevisiae
gccaatcctatctatattcttccag

SEQ ID NO: 25251 - DNA, 25 bp, S. cerevisiae
ccattcctgcatacaccttagatat

SEQ ID NO: 25252 - DNA, 25 bp, S. cerevisiae
ccagattctgctaccattttctatg

SEQ ID NO: 25253 - DNA, 25 bp, S. cerevisiae
gccaattgctctacaaggcttcaag

SEQ ID NO: 25254 - DNA, 25 bp, S. cerevisiae
ccagctagattttctccagacgaca

SEQ ID NO: 25255 - DNA, 25 bp, S. cerevisiae
ccactagcttggtcattgcgttaca

SEQ ID NO: 25256 - DNA, 25 bp, S. cerevisiae
ccacgactcaggtattgttaaattc

SEQ ID NO: 25257 - DNA, 25 bp, S. cerevisiae
ccactatgcccgtactgttacaaaa

SEQ ID NO: 25258 - DNA, 25 bp, S. cerevisiae
ccaccaaccggatatttgctgctaa

SEQ ID NO: 25259 - DNA, 25 bp, S. cerevisiae
ccaactcccgaatggttctatcaaa

SEQ ID NO: 25260 - DNA, 25 bp, S. cerevisiae
ccagagcatatttcaaaggcgccga

SEQ ID NO: 25261 - DNA, 25 bp, S. cerevisiae
ccataggtctaatcagcggcctgat

SEQ ID NO: 25262 - DNA, 25 bp, S. cerevisiae
ccaatgtgccatcatcatgttcgat

SEQ ID NO: 25263 - DNA, 25 bp, S. cerevisiae
gccagaatgcctgctgtgttgccat

SEQ ID NO: 25264 - DNA, 25 bp, S. cerevisiae
gccaatatggcgactgttccctcaa

SEQ ID NO: 25265 - DNA, 25 bp, S. cerevisiae
ccatcttacgatgccttcttagaga

SEQ ID NO: 25266 - DNA, 25 bp, S. cerevisiae
ccacccagcgggaaccttggagaat

SEQ ID NO: 25267 - DNA, 25 bp, S. cerevisiae
gctaccgcggagatacctttggcag

SEQ ID NO: 25268 - DNA, 25 bp, S. cerevisiae
gcagaccagaagtaaacctccggag

SEQ ID NO: 25269 - DNA, 25 bp, S. cerevisiae
gcaccggcggtcaaagttccgtgat

SEQ ID NO: 25270 - DNA, 25 bp, S. cerevisiae
gccgccggaggacaagaacagtaat

SEQ ID NO: 25271 - DNA, 25 bp, S. cerevisiae
ccagtcgaagttgctgaagccgttt

SEQ ID NO: 25272 - DNA, 25 bp, S. cerevisiae
ccaattgaagttgctgaggccgttt

SEQ ID NO: 25273 - DNA, 25 bp, S. cerevisiae
ccaaataactatgctggcgctcttt

SEQ ID NO: 25274 - DNA, 25 bp, S. cerevisiae
ccatgaattacttcgtggacgcatt

SEQ ID NO: 25275 - DNA, 25 bp, S. cerevisiae
gccaaactacatgagatctacgcag

SEQ ID NO: 25276 - DNA, 25 bp, S. cerevisiae
gccataaatgaagtgccctacagaa

SEQ ID NO: 25277 - DNA, 25 bp, S. cerevisiae
gccaagaatccaatgcgccaatcaa

SEQ ID NO: 25278 - DNA, 25 bp, S. cerevisiae
gccagacacattacgccagcaagaa

SEQ ID NO: 25279 - DNA, 25 bp, S. cerevisiae
ccaccacagctctttctaatatgac

SEQ ID NO: 25280 - DNA, 25 bp, S. cerevisiae
gcctggctgcatgacaaatcactgt

SEQ ID NO: 25281 - DNA, 25 bp, S. cerevisiae
gcgccgcgctcatgaagaacagttg

SEQ ID NO: 25282 - DNA, 25 bp, S. cerevisiae
gccatccccaaataagcacttacaa

SEQ ID NO: 25283 - DNA, 25 bp, S. cerevisiae
ccaccgccatcactacaaaaattaa

SEQ ID NO: 25284 - DNA, 25 bp, S. cerevisiae
ccactccaccgtatcaagtattcaa

SEQ ID NO: 25285 - DNA, 25 bp, S. cerevisiae
ccatctctactccttttatcgaaaa

SEQ ID NO: 25286 - DNA, 25 bp, S. cerevisiae
ccaccgagatggcagtttctgtcaa

SEQ ID NO: 25287 - DNA, 25 bp, S. cerevisiae
ccagcctggagacgagtcctatgaa

SEQ ID NO: 25288 - DNA, 25 bp, S. cerevisiae
ccatgccttctgctgagatatcgta

SEQ ID NO: 25289 - DNA, 25 bp, S. cerevisiae
ccatccgtgctttattacgtttgta

SEQ ID NO: 25290 - DNA, 25 bp, S. cerevisiae
ccacggcgattattacctggtcagt

SEQ ID NO: 25291 - DNA, 25 bp, S. cerevisiae
gccaatgaagttcgttcgcaagttt

SEQ ID NO: 25292 - DNA, 25 bp, S. cerevisiae
ccaggtcatacaagagtcccgtttt

SEQ ID NO: 25293 - DNA, 25 bp, S. cerevisiae
ccatgtatttcaacagctccaggct

SEQ ID NO: 25294 - DNA, 25 bp, S. cerevisiae
gccaatcatttaacgcagccggtaa

SEQ ID NO: 25295 - DNA, 25 bp, S. cerevisiae
gccaaaactacccagtcgtgtgata

SEQ ID NO: 25296 - DNA, 25 bp, S. cerevisiae
gcctcaacgcataccaactttggaa

SEQ ID NO: 25297 - DNA, 25 bp, S. cerevisiae
gcctcaacctttagatcctttggat

SEQ ID NO: 25298 - DNA, 25 bp, S. cerevisiae
ccagagctacactttatgcttcgta

SEQ ID NO: 25299 - DNA, 25 bp, S. cerevisiae
gccatgggccctatgtgttgcgtat

SEQ ID NO: 25300 - DNA, 25 bp, S. cerevisiae
ccaatcccttttatctttatcctga

SEQ ID NO: 25301 - DNA, 25 bp, S. cerevisiae
ccaaccattgctcaattccaataca

SEQ ID NO: 25302 - DNA, 25 bp, S. cerevisiae
ccatgacgatagaccaatctacaag

SEQ ID NO: 25303 - DNA, 25 bp, S. cerevisiae
gccaacgttcatgctatgtctttta

SEQ ID NO: 25304 - DNA, 25 bp, S. cerevisiae
gccacaaatttcctctattcttaag

SEQ ID NO: 25305 - DNA, 25 bp, S. cerevisiae
ccaagggcgcacttccatgaaaata

SEQ ID NO: 25306 - DNA, 25 bp, S. cerevisiae
gccaacgccatcgatatttcactaa

SEQ ID NO: 25307 - DNA, 25 bp, S. cerevisiae
ccacttccagccatttcatcaataa

SEQ ID NO: 25308 - DNA, 25 bp, S. cerevisiae
gccaattctgcatgggctttgtaca

SEQ ID NO: 25309 - DNA, 25 bp, S. cerevisiae
gccagaattctctgtattccagtcg

SEQ ID NO: 25310 - DNA, 25 bp, S. cerevisiae
gccgcagactgccatattattgcac

SEQ ID NO: 25311 - DNA, 25 bp, S. cerevisiae
gctcgccttggcagtcagtaatggt

SEQ ID NO: 25312 - DNA, 25 bp, S. cerevisiae
gccacgtggcgctttatctaatggt

SEQ ID NO: 25313 - DNA, 25 bp, S. cerevisiae
ccacctctgcgtttactaagttcaa

SEQ ID NO: 25314 - DNA, 25 bp, S. cerevisiae
ccaagatggcgtttgccgggttgaa

SEQ ID NO: 25315 - DNA, 25 bp, S. cerevisiae
ccaagatggcctttggtgggttgaa

SEQ ID NO: 25316 - DNA, 25 bp, S. cerevisiae
gccaagtaactgctggttcgcttta

SEQ ID NO: 25317 - DNA, 25 bp, S. cerevisiae
ccaagtaacctacagcacgctatta

SEQ ID NO: 25318 - DNA, 25 bp, S. cerevisiae
gccaaatatacagtagcgaccgcta

SEQ ID NO: 25319 - DNA, 25 bp, S. cerevisiae
ccaagaaggattattccatagatag

SEQ ID NO: 25320 - DNA, 25 bp, S. cerevisiae
ccaagtcgttgtcgttcgtagaaat

SEQ ID NO: 25321 - DNA, 25 bp, S. cerevisiae
ccagctcctggacttttgttttaga

SEQ ID NO: 25322 - DNA, 25 bp, S. cerevisiae
ccagattaaagccagctatctccaa

SEQ ID NO: 25323 - DNA, 25 bp, S. cerevisiae
gccaatatcgaggacgaccctgtga

SEQ ID NO: 25324 - DNA, 25 bp, S. cerevisiae
gccaatactggcctggagactttaa

SEQ ID NO: 25325 - DNA, 25 bp, S. cerevisiae
gccaaatctgcgtagtgagtcttta

SEQ ID NO: 25326 - DNA, 25 bp, S. cerevisiae
ccactaatgagatggctgccttaag

SEQ ID NO: 25327 - DNA, 25 bp, S. cerevisiae
gccgctaagaacactacttccagtt

SEQ ID NO: 25328 - DNA, 25 bp, S. cerevisiae
gccactatcccagtactacgtttgt

SEQ ID NO: 25329 - DNA, 25 bp, S. cerevisiae
gccactgcctcgatataccaaacga

SEQ ID NO: 25330 - DNA, 25 bp, S. cerevisiae
gccaattctttacccgacatgatga

SEQ ID NO: 25331 - DNA, 25 bp, S. cerevisiae
ccagctttcggcctgatatgaatat

SEQ ID NO: 25332 - DNA, 25 bp, S. cerevisiae
ccaccttctgctgggctgtcatata

SEQ ID NO: 25333 - DNA, 25 bp, S. cerevisiae
gccatcctttgttgggccatgtgga

SEQ ID NO: 25334 - DNA, 25 bp, S. cerevisiae
gccagcccttgatgggccctaagat

SEQ ID NO: 25335 - DNA, 25 bp, S. cerevisiae
ccactccagctgttcaaatctttag

SEQ ID NO: 25336 - DNA, 25 bp, S. cerevisiae
gccaccaacgtggataacttgatag

SEQ ID NO: 25337 - DNA, 25 bp, S. cerevisiae
gccaaagacgatgctgccactaaga

SEQ ID NO: 25338 - DNA, 25 bp, S. cerevisiae
ccactacactatctcaatctgacga

SEQ ID NO: 25339 - DNA, 25 bp, S. cerevisiae
ccactacattatctcaatctgacga

SEQ ID NO: 25340 - DNA, 25 bp, S. cerevisiae
gcacgttagttggtttcgacgactt

SEQ ID NO: 25341 - DNA, 25 bp, S. cerevisiae
gcccaattattgctttaacgtctct

SEQ ID NO: 25342 - DNA, 25 bp, S. cerevisiae
ccaatcttttaccttatcgaacgca

SEQ ID NO: 25343 - DNA, 25 bp, S. cerevisiae
gcctccaaggcccaagtggaaaatg

SEQ ID NO: 25344 - DNA, 25 bp, S. cerevisiae
gccatccaagacatctgcgctggaa

SEQ ID NO: 25345 - DNA, 25 bp, S. cerevisiae
gccactaagactccactcattaaag

SEQ ID NO: 25346 - DNA, 25 bp, S. cerevisiae
gcctttatacttcggcaaacctcag

SEQ ID NO: 25347 - DNA, 25 bp, S. cerevisiae
gcctcatttaatttggaagatccta

SEQ ID NO: 25348 - DNA, 25 bp, S. cerevisiae
gcctatcggactggctgctagagac

SEQ ID NO: 25349 - DNA, 25 bp, S. cerevisiae
gccaccgttgccactgctaagaagg

SEQ ID NO: 25350 - DNA, 25 bp, S. cerevisiae
ccaatgggcatgtttctaaaaaggc

SEQ ID NO: 25351 - DNA, 25 bp, S. cerevisiae
gccaagtcgctgttgacccaaagac

SEQ ID NO: 25352 - DNA, 25 bp, S. cerevisiae
gccgtaagtgccagtagcatcgtca

SEQ ID NO: 25353 - DNA, 25 bp, S. cerevisiae
gcctggagagtcaacgaagccggaa

SEQ ID NO: 25354 - DNA, 25 bp, S. cerevisiae
gccaacattgataacgctattccac

SEQ ID NO: 25355 - DNA, 25 bp, S. cerevisiae
gccaagattttgtctcaagctccaa

SEQ ID NO: 25356 - DNA, 25 bp, S. cerevisiae
gccaccttcagaaacaatttgccag

SEQ ID NO: 25357 - DNA, 25 bp, S. cerevisiae
gcccctgcggtaacaagtctgaaga

SEQ ID NO: 25358 - DNA, 25 bp, S. cerevisiae
gccgctcagcgtctcaaatttaaga

SEQ ID NO: 25359 - DNA, 25 bp, S. cerevisiae
gccagccgactcatacgtgtataag

SEQ ID NO: 25360 - DNA, 25 bp, S. cerevisiae
gccaccgtctgctgaagctgtaaaa

SEQ ID NO: 25361 - DNA, 25 bp, S. cerevisiae
gccattgagtctgctaagcgtgaaa

SEQ ID NO: 25362 - DNA, 25 bp, S. cerevisiae
gcctttatcgtcttgggtgctagca

SEQ ID NO: 25363 - DNA, 25 bp, S. cerevisiae
gccttgtacattgtcctacaagatt

SEQ ID NO: 25364 - DNA, 25 bp, S. cerevisiae
gcctcctaatgtccccaagaaagat

SEQ ID NO: 25365 - DNA, 25 bp, S. cerevisiae
gccaactttggcttctcaggttaat

SEQ ID NO: 25366 - DNA, 25 bp, S. cerevisiae
ccaattctaggcgtgtagcgtgtta

SEQ ID NO: 25367 - DNA, 25 bp, S. cerevisiae
ccacttctagggaacggctgtatca

SEQ ID NO: 25368 - DNA, 25 bp, S. cerevisiae
gccttcttatggcacaccggaaaac

SEQ ID NO: 25369 - DNA, 25 bp, S. cerevisiae
gccttttccgctcaaggtgcaaaga

SEQ ID NO: 25370 - DNA, 25 bp, S. cerevisiae
gcctaatcggtcacaacgtatgcaa

SEQ ID NO: 25371 - DNA, 25 bp, S. cerevisiae
gccaaacgaggcaagtcacagtgta

SEQ ID NO: 25372 - DNA, 25 bp, S. cerevisiae
gccataaagaggaagcgcacggtct

SEQ ID NO: 25373 - DNA, 25 bp, S. cerevisiae
ccaacaatgcggtgcggattcctta

SEQ ID NO: 25374 - DNA, 25 bp, S. cerevisiae
ccaattaatagatgcggatccgtta

SEQ ID NO: 25375 - DNA, 25 bp, S. cerevisiae
gcccttacaagagttggcaccggta

SEQ ID NO: 25376 - DNA, 25 bp, S. cerevisiae
gcctttgagaggttctaacactgcc

SEQ ID NO: 25377 - DNA, 25 bp, S. cerevisiae
gccaaaggtgcgctggtaacttaca

SEQ ID NO: 25378 - DNA, 25 bp, S. cerevisiae
gccaggagttcccatggatacagtt

SEQ ID NO: 25379 - DNA, 25 bp, S. cerevisiae
gccaggaatacgtatgccagatctt

SEQ ID NO: 25380 - DNA, 25 bp, S. cerevisiae
gcgctgctgaaacgcatttctgata

SEQ ID NO: 25381 - DNA, 25 bp, S. cerevisiae
gccgagctgattcctgcgagtgaat

SEQ ID NO: 25382 - DNA, 25 bp, S. cerevisiae
gccaatggtgatcagcgaggacttc

SEQ ID NO: 25383 - DNA, 25 bp, S. cerevisiae
gccagagtcgaccagttgaacttga

SEQ ID NO: 25384 - DNA, 25 bp, S. cerevisiae
gccaatgcttacgacttggtcttga

SEQ ID NO: 25385 - DNA, 25 bp, S. cerevisiae
ccaatgtgtggctactgggtcaatt

SEQ ID NO: 25386 - DNA, 25 bp, S. cerevisiae
gccagaggtgtcatcggtgtcattg

SEQ ID NO: 25387 - DNA, 25 bp, S. cerevisiae
gccacatccgacgttttgattgcta

SEQ ID NO: 25388 - DNA, 25 bp, S. cerevisiae
gccaccgaattcgtcaagttcatca

SEQ ID NO: 25389 - DNA, 25 bp, S. cerevisiae
ccaagcgataccgtccagtttagaa

SEQ ID NO: 25390 - DNA, 25 bp, S. cerevisiae
gccagcgagctttccgggtttagaa

SEQ ID NO: 25391 - DNA, 25 bp, S. cerevisiae
gccgcgacggtaggtggttcacaaa

SEQ ID NO: 25392 - DNA, 25 bp, S. cerevisiae
gccaatcactggaaaggtcggtatt

SEQ ID NO: 25393 - DNA, 25 bp, S. cerevisiae
gccactactgagaaattgtccgttt

SEQ ID NO: 25394 - DNA, 25 bp, S. cerevisiae
gccagtgacatgtctaagtccgcta

SEQ ID NO: 25395 - DNA, 25 bp, S. cerevisiae
gccaatgccaatgtggtagctgcaa

SEQ ID NO: 25396 - DNA, 25 bp, S. cerevisiae
gccagtgcagttgctgctgctagta

SEQ ID NO: 25397 - DNA, 25 bp, S. cerevisiae
ccaatggtctggctcttctaaaata

SEQ ID NO: 25398 - DNA, 25 bp, S. cerevisiae
gccaccatgttacgagctctctata

SEQ ID NO: 25399 - DNA, 25 bp, S. cerevisiae
gcctgccatacccatatcggaaaat

SEQ ID NO: 25400 - DNA, 25 bp, S. cerevisiae
gccattgccggagaaattagaggtt

SEQ ID NO: 25401 - DNA, 25 bp, S. cerevisiae
tcaccggctggataagaagagacgt

SEQ ID NO: 25402 - DNA, 25 bp, S. cerevisiae
tcgtgggtcgtcttaaccgatggta

SEQ ID NO: 25403 - DNA, 25 bp, S. cerevisiae
gccggtgtacccgaacatttcgaag

SEQ ID NO: 25404 - DNA, 25 bp, S. cerevisiae
gccggagttttcaccctttgaagat

SEQ ID NO: 25405 - DNA, 25 bp, S. cerevisiae
gccgacgttgtagactccctggaaa

SEQ ID NO: 25406 - DNA, 25 bp, S. cerevisiae
tagccctgccagtgcgttggacgaa

SEQ ID NO: 25407 - DNA, 25 bp, S. cerevisiae
gccgccggcaaaccattggacgaag

SEQ ID NO: 25408 - DNA, 25 bp, S. cerevisiae
gccagtcgccacagttattacaaca

SEQ ID NO: 25409 - DNA, 25 bp, S. cerevisiae
gccatgcacccctgagttgaagaac

SEQ ID NO: 25410 - DNA, 25 bp, S. cerevisiae
gccaggcgtcgatgagttcttgaac

SEQ ID NO: 25411 - DNA, 25 bp, S. cerevisiae
gccatgtccgtgctgttctggataa

SEQ ID NO: 25412 - DNA, 25 bp, S. cerevisiae
gccaaacttgccgatgcactggata

SEQ ID NO: 25413 - DNA, 25 bp, S. cerevisiae
gccaaaggtgatgggcagcttgata

SEQ ID NO: 25414 - DNA, 25 bp, S. cerevisiae
gccaatcaggctttcgatgctggat

SEQ ID NO: 25415 - DNA, 25 bp, S. cerevisiae
gccaacaggcgctaggctaggtcat

SEQ ID NO: 25416 - DNA, 25 bp, S. cerevisiae
gccagacagctgcgagactctcgtc

SEQ ID NO: 25417 - DNA, 25 bp, S. cerevisiae
gccagactgggaaacctcgagaata

SEQ ID NO: 25418 - DNA, 25 bp, S. cerevisiae
gccgtcggcgacaaactagaagata

SEQ ID NO: 25419 - DNA, 25 bp, S. cerevisiae
gcgcttcggaaaagagttgccagta

SEQ ID NO: 25420 - DNA, 25 bp, S. cerevisiae
gccaattggcactacctatttcgta

SEQ ID NO: 25421 - DNA, 25 bp, S. cerevisiae
gccgaagaccaatccgtatggtttt

SEQ ID NO: 25422 - DNA, 25 bp, S. cerevisiae
gccggagacccgatgagtatattga

SEQ ID NO: 25423 - DNA, 25 bp, S. cerevisiae
gccgggccatcacggtggtattata

SEQ ID NO: 25424 - DNA, 25 bp, S. cerevisiae
gccggtcgtgtttcatggtttgtag

SEQ ID NO: 25425 - DNA, 25 bp, S. cerevisiae
gccaggacacaattggatatggtca

SEQ ID NO: 25426 - DNA, 25 bp, S. cerevisiae
gccatagaccatgacgatagaccaa

SEQ ID NO: 25427 - DNA, 25 bp, S. cerevisiae
ccaaaatgcatcttctgtaccacaa

SEQ ID NO: 25428 - DNA, 25 bp, S. cerevisiae
gcctaaagctcatcgccagtgaaag

SEQ ID NO: 25429 - DNA, 25 bp, S. cerevisiae
gcctattatccctccaacagcaagg

SEQ ID NO: 25430 - DNA, 25 bp, S. cerevisiae
gccatttgttcctctagatccatat

SEQ ID NO: 25431 - DNA, 25 bp, S. cerevisiae
gcttttggtccatctcatttaaact

SEQ ID NO: 25432 - DNA, 25 bp, S. cerevisiae
gcctctttacactccatttctaaag

SEQ ID NO: 25433 - DNA, 25 bp, S. cerevisiae
gcccgtttacggatttcaatggagg

SEQ ID NO: 25434 - DNA, 25 bp, S. cerevisiae
gcctattttaggattcgctttgatt

SEQ ID NO: 25435 - DNA, 25 bp, S. cerevisiae
ccaagctgtaattattcccgtcaat

SEQ ID NO: 25436 - DNA, 25 bp, S. cerevisiae
gccaatgcctactggttacctaatg

SEQ ID NO: 25437 - DNA, 25 bp, S. cerevisiae
ccaaacttctctgggctttcaagga

SEQ ID NO: 25438 - DNA, 25 bp, S. cerevisiae
ccaagatttccatgggcttcaagaa

SEQ ID NO: 25439 - DNA, 25 bp, S. cerevisiae
gccatttattccagaagcctcgaga

SEQ ID NO: 25440 - DNA, 25 bp, S. cerevisiae
gccactgttgttactgaacgctctg

SEQ ID NO: 25441 - DNA, 25 bp, S. cerevisiae
gccacatatcttttggaagcgccat

SEQ ID NO: 25442 - DNA, 25 bp, S. cerevisiae
gccacgatttttgtgagctgcatcc

SEQ ID NO: 25443 - DNA, 25 bp, S. cerevisiae
gccattacttttgctgaagccgcta

SEQ ID NO: 25444 - DNA, 25 bp, S. cerevisiae
gccactgttttcactggaactgtat

SEQ ID NO: 25445 - DNA, 25 bp, S. cerevisiae
gccacttccactccagatatagatt

SEQ ID NO: 25446 - DNA, 25 bp, S. cerevisiae
gccacctcaatgtctcagtataact

SEQ ID NO: 25447 - DNA, 25 bp, S. cerevisiae
gcctcaggcaactcttgaaggttcg

SEQ ID NO: 25448 - DNA, 25 bp, S. cerevisiae
gcccactctacgacctgaagttagg

SEQ ID NO: 25449 - DNA, 25 bp, S. cerevisiae
gccaggcccaagtcacagaagtcat

SEQ ID NO: 25450 - DNA, 25 bp, S. cerevisiae
gccattgccgattggaaggacttat

SEQ ID NO: 25451 - DNA, 25 bp, S. cerevisiae
gccattgcgcagatttatagactca

SEQ ID NO: 25452 - DNA, 25 bp, S. cerevisiae
gcctttcgaggtcttatttgccaaa

SEQ ID NO: 25453 - DNA, 25 bp, S. cerevisiae
gccaatgctagtgtcgtttgttcca

SEQ ID NO: 25454 - DNA, 25 bp, S. cerevisiae
gccactgacgtaaaggttgctgcca

SEQ ID NO: 25455 - DNA, 25 bp, S. cerevisiae
gacttccctattgtcggtgttgcaa

SEQ ID NO: 25456 - DNA, 25 bp, S. cerevisiae
gtttaggttatggtcgtttgtcaga

SEQ ID NO: 25457 - DNA, 25 bp, S. cerevisiae
gccatttggtatatttctgcgggta

SEQ ID NO: 25458 - DNA, 25 bp, S. cerevisiae
gcgcttacggtacagttgggctatc

SEQ ID NO: 25459 - DNA, 25 bp, S. cerevisiae
gccgtaggtttggattttgtctaca

SEQ ID NO: 25460 - DNA, 25 bp, S. cerevisiae
gcgttaggtgccttttttgctggaa

SEQ ID NO: 25461 - DNA, 25 bp, S. cerevisiae
gccaatttggctgctaacttaggtt

SEQ ID NO: 25462 - DNA, 25 bp, S. cerevisiae
gccatttccgctgcagaactaggtt

SEQ ID NO: 25463 - DNA, 25 bp, S. cerevisiae
gccagctttccccagaattacgttt

SEQ ID NO: 25464 - DNA, 25 bp, S. cerevisiae
gccaccacgcttgagaaacacgata

SEQ ID NO: 25465 - DNA, 25 bp, S. cerevisiae
gccagtgcctttgaaaaccgacaga

SEQ ID NO: 25466 - DNA, 25 bp, S. cerevisiae
gccagtcagcgttcaaaaaccttta

SEQ ID NO: 25467 - DNA, 25 bp, S. cerevisiae
gccgacccaaattattgctccatta

SEQ ID NO: 25468 - DNA, 25 bp, S. cerevisiae
gccaacgatcctaaactcgcttata

SEQ ID NO: 25469 - DNA, 25 bp, S. cerevisiae
gccaacgatcgtagaattcctgatt

SEQ ID NO: 25470 - DNA, 25 bp, S. cerevisiae
gccataaacgttgataccgcatttg

SEQ ID NO: 25471 - DNA, 25 bp, S. cerevisiae
gccatgtgtctctctatcaggaata

SEQ ID NO: 25472 - DNA, 25 bp, S. cerevisiae
gccattcctggcctattacaaatta

SEQ ID NO: 25473 - DNA, 25 bp, S. cerevisiae
gccagcgtttcattttatctgcaag

SEQ ID NO: 25474 - DNA, 25 bp, S. cerevisiae
gccaggttaaagatattgcccagtt

SEQ ID NO: 25475 - DNA, 25 bp, S. cerevisiae
gccacggtaaataattctgcgccaa

SEQ ID NO: 25476 - DNA, 25 bp, S. cerevisiae
gccacggtcagattttggtacagga

SEQ ID NO: 25477 - DNA, 25 bp, S. cerevisiae
gccagcgaagagaccattttacgta

SEQ ID NO: 25478 - DNA, 25 bp, S. cerevisiae
gccaggattggcatctattttatcg

SEQ ID NO: 25479 - DNA, 25 bp, S. cerevisiae
gccacgattggtatagattttcttt

SEQ ID NO: 25480 - DNA, 25 bp, S. cerevisiae
gcctatttgcgcttattaccgttag

SEQ ID NO: 25481 - DNA, 25 bp, S. cerevisiae
gccaacctcgtcgatgatttcggta

SEQ ID NO: 25482 - DNA, 25 bp, S. cerevisiae
gccgaccctagcctaaacagagttg

SEQ ID NO: 25483 - DNA, 25 bp, S. cerevisiae
gccggtaacgatgactcttctggta

SEQ ID NO: 25484 - DNA, 25 bp, S. cerevisiae
gccctggattaaaagccttgcgctt

SEQ ID NO: 25485 - DNA, 25 bp, S. cerevisiae
gcgttggtccaaagacttggccatt

SEQ ID NO: 25486 - DNA, 25 bp, S. cerevisiae
gccttggctccaaagatcggtccat

SEQ ID NO: 25487 - DNA, 25 bp, S. cerevisiae
gccattgaattgtttgccgggttat

SEQ ID NO: 25488 - DNA, 25 bp, S. cerevisiae
gccgagagaagctttcccgtttgga

SEQ ID NO: 25489 - DNA, 25 bp, S. cerevisiae
gccaatgatcacttttacagggaat

SEQ ID NO: 25490 - DNA, 25 bp, S. cerevisiae
gccacaatccatccaattcagttga

SEQ ID NO: 25491 - DNA, 25 bp, S. cerevisiae
gccagcaatctccacaagacgatat

SEQ ID NO: 25492 - DNA, 25 bp, S. cerevisiae
gccagttcacatgatcacctattac

SEQ ID NO: 25493 - DNA, 25 bp, S. cerevisiae
gccatgaatcgcaaaccgcttatca

SEQ ID NO: 25494 - DNA, 25 bp, S. cerevisiae
gctcatctatgccacaaacgggaat

SEQ ID NO: 25495 - DNA, 25 bp, S. cerevisiae
gccactggtgctaaacgtgctcaat

SEQ ID NO: 25496 - DNA, 25 bp, S. cerevisiae
gccattatacgttgccattgctcaa

SEQ ID NO: 25497 - DNA, 25 bp, S. cerevisiae
gcctataacctaccaactgcatatt

SEQ ID NO: 25498 - DNA, 25 bp, S. cerevisiae
gccacctatctacttcaacttgtgt

SEQ ID NO: 25499 - DNA, 25 bp, S. cerevisiae
gccagcagccacagtctaatctagg

SEQ ID NO: 25500 - DNA, 25 bp, S. cerevisiae
gccaggcctttgatattgtagcagc

SEQ ID NO: 25501 - DNA, 25 bp, S. cerevisiae
gccaagactattttattctcagcac

SEQ ID NO: 25502 - DNA, 25 bp, S. cerevisiae
gccaaagctatttcttcatcgatca

SEQ ID NO: 25503 - DNA, 25 bp, S. cerevisiae
gccacaagctttttgtatgctgcat

SEQ ID NO: 25504 - DNA, 25 bp, S. cerevisiae
gccaaggcttgctcttaatgcagtt

SEQ ID NO: 25505 - DNA, 25 bp, S. cerevisiae
gccacacgctggatttgctattggt

SEQ ID NO: 25506 - DNA, 25 bp, S. cerevisiae
gccgtcgtcgactttgaaactcaaa

SEQ ID NO: 25507 - DNA, 25 bp, S. cerevisiae
gccgctactcaatgtctgcaaaata

SEQ ID NO: 25508 - DNA, 25 bp, S. cerevisiae
gccaggcatgcattctagatccaaa

SEQ ID NO: 25509 - DNA, 25 bp, S. cerevisiae
gccagtgccacattacatctcaaaa

SEQ ID NO: 25510 - DNA, 25 bp, S. cerevisiae
gcgcttccaagatcattgccattga

SEQ ID NO: 25511 - DNA, 25 bp, S. cerevisiae
gcctgtcactaattcttctattctg

SEQ ID NO: 25512 - DNA, 25 bp, S. cerevisiae
gccagcgatgtgcatgacgtacgtt

SEQ ID NO: 25513 - DNA, 25 bp, S. cerevisiae
gccacagtgcattttcagaatctaa

SEQ ID NO: 25514 - DNA, 25 bp, S. cerevisiae
gccgatgctgatggtgctagtaagt

SEQ ID NO: 25515 - DNA, 25 bp, S. cerevisiae
gcctgcgcatgattcgttggatttg

SEQ ID NO: 25516 - DNA, 25 bp, S. cerevisiae
gcgcgtgcatgatcagccattgatt

SEQ ID NO: 25517 - DNA, 25 bp, S. cerevisiae
gccactgctgacgatgaacatttcc

SEQ ID NO: 25518 - DNA, 25 bp, S. cerevisiae
gccatctgctgacgacaactgtatt

SEQ ID NO: 25519 - DNA, 25 bp, S. cerevisiae
gcccattccagatgcagactcatta

SEQ ID NO: 25520 - DNA, 25 bp, S. cerevisiae
gccatcgtcagcacgcagaatatta

SEQ ID NO: 25521 - DNA, 25 bp, S. cerevisiae
gccaggtcgcgttatgatcatacta

SEQ ID NO: 25522 - DNA, 25 bp, S. cerevisiae
gccaggcgaggaatatcatcatagt

SEQ ID NO: 25523 - DNA, 25 bp, S. cerevisiae
gccggcggagagtatgcatcaaaaa

SEQ ID NO: 25524 - DNA, 25 bp, S. cerevisiae
gccttcgatggccaacttacatata

SEQ ID NO: 25525 - DNA, 25 bp, S. cerevisiae
gcctcctgcaatcaagctattcatg

SEQ ID NO: 25526 - DNA, 25 bp, S. cerevisiae
gcctctgcatgctgcgaaaaggcat

SEQ ID NO: 25527 - DNA, 25 bp, S. cerevisiae
gcctcagcggccaaaacacagatta

SEQ ID NO: 25528 - DNA, 25 bp, S. cerevisiae
gccacgtcgctatcacaacagattt

SEQ ID NO: 25529 - DNA, 25 bp, S. cerevisiae
gccacgatgcgctacacgatactat

SEQ ID NO: 25530 - DNA, 25 bp, S. cerevisiae
gctgcaactgggacaaatttaccgt

SEQ ID NO: 25531 - DNA, 25 bp, S. cerevisiae
gccactttggctgatcgtttggatc

SEQ ID NO: 25532 - DNA, 25 bp, S. cerevisiae
gcctacactgcggaagcgatacaaa

SEQ ID NO: 25533 - DNA, 25 bp, S. cerevisiae
gccacaaaccaaattctactcacat

SEQ ID NO: 25534 - DNA, 25 bp, S. cerevisiae
gcctataccccagttttcaatcatt

SEQ ID NO: 25535 - DNA, 25 bp, S. cerevisiae
gccaaattccaggtttatgcaaact

SEQ ID NO: 25536 - DNA, 25 bp, S. cerevisiae
gccgagttagcgattgatagtacca

SEQ ID NO: 25537 - DNA, 25 bp, S. cerevisiae
gccaggtttttgtttattgctccac

SEQ ID NO: 25538 - DNA, 25 bp, S. cerevisiae
gccggtatttgggaatttgctcgat

SEQ ID NO: 25539 - DNA, 25 bp, S. cerevisiae
gccggttcctcaaagtttctcaaag

SEQ ID NO: 25540 - DNA, 25 bp, S. cerevisiae
gccggctacaggaagaggttgctat

SEQ ID NO: 25541 - DNA, 25 bp, S. cerevisiae
gcccgttcagacgatgaggattcta

SEQ ID NO: 25542 - DNA, 25 bp, S. cerevisiae
gccactggttactcaatggtgatga

SEQ ID NO: 25543 - DNA, 25 bp, S. cerevisiae
gcctcgttcaactcattgctggtat

SEQ ID NO: 25544 - DNA, 25 bp, S. cerevisiae
gccgagcatgctaaatctgtgtacg

SEQ ID NO: 25545 - DNA, 25 bp, S. cerevisiae
gccactattagtccattgttctgca

SEQ ID NO: 25546 - DNA, 25 bp, S. cerevisiae
gccacttttgtctatattgccgcat

SEQ ID NO: 25547 - DNA, 25 bp, S. cerevisiae
gccttctggtggctcatttcacaaa

SEQ ID NO: 25548 - DNA, 25 bp, S. cerevisiae
gccagtcgacttcatcattgctgat

SEQ ID NO: 25549 - DNA, 25 bp, S. cerevisiae
gccatgtccagcacattcagtggat

SEQ ID NO: 25550 - DNA, 25 bp, S. cerevisiae
gccagtccagcttccttggaatatg

SEQ ID NO: 25551 - DNA, 25 bp, S. cerevisiae
gccagccgcctctctaggtgatatg

SEQ ID NO: 25552 - DNA, 25 bp, S. cerevisiae
gccatcggcctatctttgtatgaag

SEQ ID NO: 25553 - DNA, 25 bp, S. cerevisiae
gccatggccagcactattttcaaga

SEQ ID NO: 25554 - DNA, 25 bp, S. cerevisiae
gccagattggctcagttgaaaaaca

SEQ ID NO: 25555 - DNA, 25 bp, S. cerevisiae
gcgctcatattacaaattgacgcca

SEQ ID NO: 25556 - DNA, 25 bp, S. cerevisiae
gcctatgacttactcgaggatacag

SEQ ID NO: 25557 - DNA, 25 bp, S. cerevisiae
gccgatggcttgatcaatggcacaa

SEQ ID NO: 25558 - DNA, 25 bp, S. cerevisiae
gccagttgctctattccatgacaag

SEQ ID NO: 25559 - DNA, 25 bp, S. cerevisiae
gccactatgtcttttgctcatggag

SEQ ID NO: 25560 - DNA, 25 bp, S. cerevisiae
gcctgccactctgtgaggatgataa

SEQ ID NO: 25561 - DNA, 25 bp, S. cerevisiae
gccaccatcgcttctgttaagcaat

SEQ ID NO: 25562 - DNA, 25 bp, S. cerevisiae
gccatccagcgcctttgaaagtgat

SEQ ID NO: 25563 - DNA, 25 bp, S. cerevisiae
gccatccaatgcatgaagtccaact

SEQ ID NO: 25564 - DNA, 25 bp, S. cerevisiae
gccaccgatgcagatttccaattca

SEQ ID NO: 25565 - DNA, 25 bp, S. cerevisiae
gccaccgagattaccttcagataaa

SEQ ID NO: 25566 - DNA, 25 bp, S. cerevisiae
gcctgcctactttccttaagcataa

SEQ ID NO: 25567 - DNA, 25 bp, S. cerevisiae
gccgcagtgactccttttgaagcaa

SEQ ID NO: 25568 - DNA, 25 bp, S. cerevisiae
gcctgctgtacgctgtggctaaaca

SEQ ID NO: 25569 - DNA, 25 bp, S. cerevisiae
gccgcctaaggaagatttggatgca

SEQ ID NO: 25570 - DNA, 25 bp, S. cerevisiae
gcctcgcaacttaaagcttttcagt

SEQ ID NO: 25571 - DNA, 25 bp, S. cerevisiae
gcctttcctcttctgagtttgacaa

SEQ ID NO: 25572 - DNA, 25 bp, S. cerevisiae
gcctatatctctattttcctgttct

SEQ ID NO: 25573 - DNA, 25 bp, S. cerevisiae
gcctctgtctttgttcttatttggt

SEQ ID NO: 25574 - DNA, 25 bp, S. cerevisiae
gcctagatatttgtgcgctcgggat

SEQ ID NO: 25575 - DNA, 25 bp, S. cerevisiae
gcctcagaagttgcacgccatggaa

SEQ ID NO: 25576 - DNA, 25 bp, S. cerevisiae
gccaggacccatgccatttttaaga

SEQ ID NO: 25577 - DNA, 25 bp, S. cerevisiae
gcctggtccgatgtcatttttacga

SEQ ID NO: 25578 - DNA, 25 bp, S. cerevisiae
gccatttttcattcctttttgcaag

SEQ ID NO: 25579 - DNA, 25 bp, S. cerevisiae
gccataagccttttaccctgtggga

SEQ ID NO: 25580 - DNA, 25 bp, S. cerevisiae
gctctactgctactgtaaccaagtg

SEQ ID NO: 25581 - DNA, 25 bp, S. cerevisiae
gcctacgcaatatactcagctactg

SEQ ID NO: 25582 - DNA, 25 bp, S. cerevisiae
gccatcaaatgcgtctactgttaat

SEQ ID NO: 25583 - DNA, 25 bp, S. cerevisiae
gccatactcaccttcacttatattg

SEQ ID NO: 25584 - DNA, 25 bp, S. cerevisiae
gccactgtctctttgcatctatatt

SEQ ID NO: 25585 - DNA, 25 bp, S. cerevisiae
gccattgccttcttcgtcgagaaat

SEQ ID NO: 25586 - DNA, 25 bp, S. cerevisiae
gcctatgcctactttatccaacaat

SEQ ID NO: 25587 - DNA, 25 bp, S. cerevisiae
gccttctctacaagactccgaaaat

SEQ ID NO: 25588 - DNA, 25 bp, S. cerevisiae
gcccgcaatgagaagcccctaaagt

SEQ ID NO: 25589 - DNA, 25 bp, S. cerevisiae
gccaggttattcctcattttaatga

SEQ ID NO: 25590 - DNA, 25 bp, S. cerevisiae
gccatagcttatgttcggtctaaag

SEQ ID NO: 25591 - DNA, 25 bp, S. cerevisiae
gccggctccactatcgagattgaaa

SEQ ID NO: 25592 - DNA, 25 bp, S. cerevisiae
gcccctccctttctgaatacaaatt

SEQ ID NO: 25593 - DNA, 25 bp, S. cerevisiae
gcctgcaaggcgttgctttcataga

SEQ ID NO: 25594 - DNA, 25 bp, S. cerevisiae
gccatgacgatgctttattgaatac

SEQ ID NO: 25595 - DNA, 25 bp, S. cerevisiae
gcgtaagctggtttataacatactc

SEQ ID NO: 25596 - DNA, 25 bp, S. cerevisiae
gccgacgctggatgttattgctact

SEQ ID NO: 25597 - DNA, 25 bp, S. cerevisiae
gccagacctggtgcttatcatgcaa

SEQ ID NO: 25598 - DNA, 25 bp, S. cerevisiae
gccagctgactggtgactttatcat

SEQ ID NO: 25599 - DNA, 25 bp, S. cerevisiae
gccattataatatgtcccagcttag

SEQ ID NO: 25600 - DNA, 25 bp, S. cerevisiae
gaatttgaagacatccccgtagcgt

SEQ ID NO: 25601 - DNA, 25 bp, S. cerevisiae
gagtttactacaaccccagtaggcg

SEQ ID NO: 25602 - DNA, 25 bp, S. cerevisiae
gagttaagggccacctcagagggaa

SEQ ID NO: 25603 - DNA, 25 bp, S. cerevisiae
gccttgaaggtctttccgagtccaa

SEQ ID NO: 25604 - DNA, 25 bp, S. cerevisiae
gctattgacaaagctaccggccaag

SEQ ID NO: 25605 - DNA, 25 bp, S. cerevisiae
gctactgaagcagctctgtaccgaa

SEQ ID NO: 25606 - DNA, 25 bp, S. cerevisiae
gcgaatgcaagcgaacttttgggaa

SEQ ID NO: 25607 - DNA, 25 bp, S. cerevisiae
gccctcaatgtaagagttgtggtga

SEQ ID NO: 25608 - DNA, 25 bp, S. cerevisiae
gccttctacgtctacattggttcga

SEQ ID NO: 25609 - DNA, 25 bp, S. cerevisiae
gccttctcggcatcgactaatattt

SEQ ID NO: 25610 - DNA, 25 bp, S. cerevisiae
gccattcgttggttcctttcataaa

SEQ ID NO: 25611 - DNA, 25 bp, S. cerevisiae
gccgtggttgggatttgtcgataaa

SEQ ID NO: 25612 - DNA, 25 bp, S. cerevisiae
gccttagaatatggcgcttccgcag

SEQ ID NO: 25613 - DNA, 25 bp, S. cerevisiae
gccatccgcaatagatttccgtgtt

SEQ ID NO: 25614 - DNA, 25 bp, S. cerevisiae
gccatcactgcgaaaaagccttatt

SEQ ID NO: 25615 - DNA, 25 bp, S. cerevisiae
gccataccgctgcagcaagtgttat

SEQ ID NO: 25616 - DNA, 25 bp, S. cerevisiae
gccagcacccattgagaggtcctaa

SEQ ID NO: 25617 - DNA, 25 bp, S. cerevisiae
gccgctgccaatacactggatttaa

SEQ ID NO: 25618 - DNA, 25 bp, S. cerevisiae
gccgtcccaaccatggagttagtgt

SEQ ID NO: 25619 - DNA, 25 bp, S. cerevisiae
gccagtgtcttcagagcttgatatt

SEQ ID NO: 25620 - DNA, 25 bp, S. cerevisiae
gccgttttcgccgttgatattattg

SEQ ID NO: 25621 - DNA, 25 bp, S. cerevisiae
gccgtcgtagcctatcttttatttg

SEQ ID NO: 25622 - DNA, 25 bp, S. cerevisiae
gccccaatcgtcatgatggctacaa

SEQ ID NO: 25623 - DNA, 25 bp, S. cerevisiae
gcctggcagatactttgtagctaca

SEQ ID NO: 25624 - DNA, 25 bp, S. cerevisiae
gccatgagagctacgttgaacgaat

SEQ ID NO: 25625 - DNA, 25 bp, S. cerevisiae
gccagtgagatgtgttaactgttcc

SEQ ID NO: 25626 - DNA, 25 bp, S. cerevisiae
gccctagagaggttgatttttcccg

SEQ ID NO: 25627 - DNA, 25 bp, S. cerevisiae
gcctgattgggctgtatttggtact

SEQ ID NO: 25628 - DNA, 25 bp, S. cerevisiae
gccttcggtgttgcattgggtatgt

SEQ ID NO: 25629 - DNA, 25 bp, S. cerevisiae
gcctattggtttgattggtgctaag

SEQ ID NO: 25630 - DNA, 25 bp, S. cerevisiae
gcgctttgggtcgactgggaaaaca

SEQ ID NO: 25631 - DNA, 25 bp, S. cerevisiae
gcccttgttgacgacggctacagga

SEQ ID NO: 25632 - DNA, 25 bp, S. cerevisiae
gttcggtcaccaattaacaagggca

SEQ ID NO: 25633 - DNA, 25 bp, S. cerevisiae
gccagggagccattatcgccaaaag

SEQ ID NO: 25634 - DNA, 25 bp, S. cerevisiae
gccagtgttgagaaacttgcagcat

SEQ ID NO: 25635 - DNA, 25 bp, S. cerevisiae
gccattagccatgtgatgggcctat

SEQ ID NO: 25636 - DNA, 25 bp, S. cerevisiae
gcctcagtattttgccattattggt

SEQ ID NO: 25637 - DNA, 25 bp, S. cerevisiae
gccgccagaagaactggtttgttac

SEQ ID NO: 25638 - DNA, 25 bp, S. cerevisiae
gcgatgtaccggaactggccaccat

SEQ ID NO: 25639 - DNA, 25 bp, S. cerevisiae
gcctcttactcccaagctatgaagg

SEQ ID NO: 25640 - DNA, 25 bp, S. cerevisiae
gccatatgtggctgctgacactaaa

SEQ ID NO: 25641 - DNA, 25 bp, S. cerevisiae
gctgcatatgcccatgtcgaagtcg

SEQ ID NO: 25642 - DNA, 25 bp, S. cerevisiae
gccattttgaccgagcattttgctg

SEQ ID NO: 25643 - DNA, 25 bp, S. cerevisiae
gccattgccataccaacacatttgt

SEQ ID NO: 25644 - DNA, 25 bp, S. cerevisiae
gccaggccaagttattgatcctttg

SEQ ID NO: 25645 - DNA, 25 bp, S. cerevisiae
gccggccaagtttatgttgcactgt

SEQ ID NO: 25646 - DNA, 25 bp, S. cerevisiae
gcctggtcacaggttcatacgacag

SEQ ID NO: 25647 - DNA, 25 bp, S. cerevisiae
gcctgttcaaggttctatctctgag

SEQ ID NO: 25648 - DNA, 25 bp, S. cerevisiae
gcctttgattacttggatgctccaa

SEQ ID NO: 25649 - DNA, 25 bp, S. cerevisiae
gcctgttggaggtggatctcctcaa

SEQ ID NO: 25650 - DNA, 25 bp, S. cerevisiae
gcctgcttacaagaggtacctacat

SEQ ID NO: 25651 - DNA, 25 bp, S. cerevisiae
gccgcctacaagctgcgaattctta

SEQ ID NO: 25652 - DNA, 25 bp, S. cerevisiae
gccttgttgctatgttattgtttta

SEQ ID NO: 25653 - DNA, 25 bp, S. cerevisiae
gccatttgctttttggtactcacaa

SEQ ID NO: 25654 - DNA, 25 bp, S. cerevisiae
gccatattgcctaacatttgtcctc

SEQ ID NO: 25655 - DNA, 25 bp, S. cerevisiae
gccatcagctggtatgatatttctc

SEQ ID NO: 25656 - DNA, 25 bp, S. cerevisiae
gccatgagtggtcctgattctttga

SEQ ID NO: 25657 - DNA, 25 bp, S. cerevisiae
gccggagtacccgtattacatgcaa

SEQ ID NO: 25658 - DNA, 25 bp, S. cerevisiae
gcgcggaaggccatgactacgacat

SEQ ID NO: 25659 - DNA, 25 bp, S. cerevisiae
gcccgaggccagattgtacgcaatg

SEQ ID NO: 25660 - DNA, 25 bp, S. cerevisiae
gccattcttctgatgtttctgcaag

SEQ ID NO: 25661 - DNA, 25 bp, S. cerevisiae
gccatcttgttgacattcttcctaa

SEQ ID NO: 25662 - DNA, 25 bp, S. cerevisiae
gccattgtgctgctatttccgataa

SEQ ID NO: 25663 - DNA, 25 bp, S. cerevisiae
gcctgtgcgacaatcttctgacaag

SEQ ID NO: 25664 - DNA, 25 bp, S. cerevisiae
gccttcatcatctacaacatcttaa

SEQ ID NO: 25665 - DNA, 25 bp, S. cerevisiae
gccgtcctagactataccaattctg

SEQ ID NO: 25666 - DNA, 25 bp, S. cerevisiae
gccgcgacaaacttaccatggtcta

SEQ ID NO: 25667 - DNA, 25 bp, S. cerevisiae
gccgcgacgaaaaagaatcagctta

SEQ ID NO: 25668 - DNA, 25 bp, S. cerevisiae
gccgcgctcgggaaaaccagcgata

SEQ ID NO: 25669 - DNA, 25 bp, S. cerevisiae
gccgatgcccggacaagactaaggt

SEQ ID NO: 25670 - DNA, 25 bp, S. cerevisiae
gcctcccttcatgcgtaagttgaaa

SEQ ID NO: 25671 - DNA, 25 bp, S. cerevisiae
gcgcctccgtttgaactgactgaaa

SEQ ID NO: 25672 - DNA, 25 bp, S. cerevisiae
gcctcctcctgttgtaaagccaaaa

SEQ ID NO: 25673 - DNA, 25 bp, S. cerevisiae
gcccagtggtggtagtttctcaact

SEQ ID NO: 25674 - DNA, 25 bp, S. cerevisiae
gcctaccgtgcgttgttatctggaa

SEQ ID NO: 25675 - DNA, 25 bp, S. cerevisiae
gccataccgtgatttgattttgttt

SEQ ID NO: 25676 - DNA, 25 bp, S. cerevisiae
gcccatagctggatcaagtacttca

SEQ ID NO: 25677 - DNA, 25 bp, S. cerevisiae
gcgcagacgctggtaacatatcaag

SEQ ID NO: 25678 - DNA, 25 bp, S. cerevisiae
gcgccttagcgggtattttcagttt

SEQ ID NO: 25679 - DNA, 25 bp, S. cerevisiae
gcccattagatcctcgtttacagtt

SEQ ID NO: 25680 - DNA, 25 bp, S. cerevisiae
gccgttagccatttgctttactatt

SEQ ID NO: 25681 - DNA, 25 bp, S. cerevisiae
gccgactagccaaccttattgatta

SEQ ID NO: 25682 - DNA, 25 bp, S. cerevisiae
gctgccccagccaccactactttat

SEQ ID NO: 25683 - DNA, 25 bp, S. cerevisiae
gccggagcagacaccaagagtttca

SEQ ID NO: 25684 - DNA, 25 bp, S. cerevisiae
gccggccaagcagcgcaaggatatt

SEQ ID NO: 25685 - DNA, 25 bp, S. cerevisiae
gccggttgtgctttgtatgtgttta

SEQ ID NO: 25686 - DNA, 25 bp, S. cerevisiae
gccgactactggtgtcatgttccaa

SEQ ID NO: 25687 - DNA, 25 bp, S. cerevisiae
gccttgattgcaaatctttcccaaa

SEQ ID NO: 25688 - DNA, 25 bp, S. cerevisiae
gcctgccatgatcagggcccgtaaa

SEQ ID NO: 25689 - DNA, 25 bp, S. cerevisiae
gcctgcttggtttgacatcttggaa

SEQ ID NO: 25690 - DNA, 25 bp, S. cerevisiae
gccgttggtagcaccattggacaca

SEQ ID NO: 25691 - DNA, 25 bp, S. cerevisiae
gcctggacttgactgttttgcggaa

SEQ ID NO: 25692 - DNA, 25 bp, S. cerevisiae
gccgtcgtacgaattcctagtgaaa

SEQ ID NO: 25693 - DNA, 25 bp, S. cerevisiae
gccttgcctggtatgtttattgcga

SEQ ID NO: 25694 - DNA, 25 bp, S. cerevisiae
gccattcttttcttagttggtcaat

SEQ ID NO: 25695 - DNA, 25 bp, S. cerevisiae
gccattgttctttcaggtggttcaa

SEQ ID NO: 25696 - DNA, 25 bp, S. cerevisiae
gcgcctttgttcacgggttcagaag

SEQ ID NO: 25697 - DNA, 25 bp, S. cerevisiae
gctgctttttcgctagggtttataa

SEQ ID NO: 25698 - DNA, 25 bp, S. cerevisiae
gcgaccaataacaagaagccacctc

SEQ ID NO: 25699 - DNA, 25 bp, S. cerevisiae
gcgaccaaactaagtcagtaccgtt

SEQ ID NO: 25700 - DNA, 25 bp, S. cerevisiae
gcaactaagattctccttgaccttt

SEQ ID NO: 25701 - DNA, 25 bp, S. cerevisiae
gcctctaagttgttcagtaaccttt

SEQ ID NO: 25702 - DNA, 25 bp, S. cerevisiae
gcccggcgtagatagtgcaactttt

SEQ ID NO: 25703 - DNA, 25 bp, S. cerevisiae
gccattccacagatagtgctacttt

SEQ ID NO: 25704 - DNA, 25 bp, S. cerevisiae
gcctcagtctgccatctaaagttga

SEQ ID NO: 25705 - DNA, 25 bp, S. cerevisiae
gcctggctacaacatcgagcagtta

SEQ ID NO: 25706 - DNA, 25 bp, S. cerevisiae
gccttgctaaacgatttgcccagac

SEQ ID NO: 25707 - DNA, 25 bp, S. cerevisiae
gccttgctagaaaattgtgcatcaa

SEQ ID NO: 25708 - DNA, 25 bp, S. cerevisiae
gcctctagcggtgttcattctaatg

SEQ ID NO: 25709 - DNA, 25 bp, S. cerevisiae
gccgtggcgattgcgtatattattt

SEQ ID NO: 25710 - DNA, 25 bp, S. cerevisiae
gccgttggtgtctctaatttttcta

SEQ ID NO: 25711 - DNA, 25 bp, S. cerevisiae
gccgtctgggattgttcatttttat

SEQ ID NO: 25712 - DNA, 25 bp, S. cerevisiae
gccgcttccaagtgtcgacagagaa

SEQ ID NO: 25713 - DNA, 25 bp, S. cerevisiae
gcctgctacactatctgacgacgag

SEQ ID NO: 25714 - DNA, 25 bp, S. cerevisiae
gccgtaagtgttatgctagattgcc

SEQ ID NO: 25715 - DNA, 25 bp, S. cerevisiae
gccggatttttcagtcagtatgcga

SEQ ID NO: 25716 - DNA, 25 bp, S. cerevisiae
gcctctgggtttgcctttgcaagta

SEQ ID NO: 25717 - DNA, 25 bp, S. cerevisiae
gccttacccttgcagtttgatgatt

SEQ ID NO: 25718 - DNA, 25 bp, S. cerevisiae
gccctatcacgcttggagaccattt

SEQ ID NO: 25719 - DNA, 25 bp, S. cerevisiae
gccctttgccaagatgtccatttga

SEQ ID NO: 25720 - DNA, 25 bp, S. cerevisiae
gcctctattccagcacaagttaagt

SEQ ID NO: 25721 - DNA, 25 bp, S. cerevisiae
gcctttttcaggttgactgctactg

SEQ ID NO: 25722 - DNA, 25 bp, S. cerevisiae
gcccagttgcaaggacttttcgtta

SEQ ID NO: 25723 - DNA, 25 bp, S. cerevisiae
gccggcgtataccactactttgaaa

SEQ ID NO: 25724 - DNA, 25 bp, S. cerevisiae
gcctggcgtgatatactactttgta

SEQ ID NO: 25725 - DNA, 25 bp, S. cerevisiae
gtatcgaagcttatgtttccaccgc

SEQ ID NO: 25726 - DNA, 25 bp, S. cerevisiae
gcctgagaacttactgcttacgcac

SEQ ID NO: 25727 - DNA, 25 bp, S. cerevisiae
gcctcaaaaggccatctactcaatt

SEQ ID NO: 25728 - DNA, 25 bp, S. cerevisiae
gcccaaatgaggcatcgcttcgaat

SEQ ID NO: 25729 - DNA, 25 bp, S. cerevisiae
gcctctgttaggcagcgattcaatt

SEQ ID NO: 25730 - DNA, 25 bp, S. cerevisiae
gcctgttgtcaacgcagctgttaac

SEQ ID NO: 25731 - DNA, 25 bp, S. cerevisiae
gcccctttggattctaaacgattct

SEQ ID NO: 25732 - DNA, 25 bp, S. cerevisiae
gcctcattttgcgtaatcgagaagt

SEQ ID NO: 25733 - DNA, 25 bp, S. cerevisiae
gctccgaccctattatttccgatta

SEQ ID NO: 25734 - DNA, 25 bp, S. cerevisiae
gcccgtcagccaaatttcgttattt

SEQ ID NO: 25735 - DNA, 25 bp, S. cerevisiae
gcccgtactcacttttttcattatt

SEQ ID NO: 25736 - DNA, 25 bp, S. cerevisiae
gcctttgttaccttttcgagcgaag

SEQ ID NO: 25737 - DNA, 25 bp, S. cerevisiae
gccttttatagccttattcgtttgg

SEQ ID NO: 25738 - DNA, 25 bp, S. cerevisiae
gccttcttcagtgcattattcgctg

SEQ ID NO: 25739 - DNA, 25 bp, S. cerevisiae
gccgctggtcaattaaccatccgta

SEQ ID NO: 25740 - DNA, 25 bp, S. cerevisiae
gcctctttgccctcttaatttaaag

SEQ ID NO: 25741 - DNA, 25 bp, S. cerevisiae
gcctcgatgttgaagacggtgatgt

SEQ ID NO: 25742 - DNA, 25 bp, S. cerevisiae
gcctactgttgatgacgttgctgat

SEQ ID NO: 25743 - DNA, 25 bp, S. cerevisiae
gcgaaaacgaggaacttgctgcgaa

SEQ ID NO: 25744 - DNA, 25 bp, S. cerevisiae
gcgaaaccacgtgcacttgtgaaaa

SEQ ID NO: 25745 - DNA, 25 bp, S. cerevisiae
gcgaaaagaacttcagtcattacaa

SEQ ID NO: 25746 - DNA, 25 bp, S. cerevisiae
gcgaaagaacttgagcccgatcaat

SEQ ID NO: 25747 - DNA, 25 bp, S. cerevisiae
gcgccaacgttctgatcacgggatt

SEQ ID NO: 25748 - DNA, 25 bp, S. cerevisiae
gcctgattcccataacaatatcgta

SEQ ID NO: 25749 - DNA, 25 bp, S. cerevisiae
gcgctacatcccagacaagaacgtt

SEQ ID NO: 25750 - DNA, 25 bp, S. cerevisiae
gcccacttgagcatacgagtacact

SEQ ID NO: 25751 - DNA, 25 bp, S. cerevisiae
gccgagccgccactatagtatatga

SEQ ID NO: 25752 - DNA, 25 bp, S. cerevisiae
gcgaaagtgtcaagcagtccatcct

SEQ ID NO: 25753 - DNA, 25 bp, S. cerevisiae
gcgaaaagttggttgccgtcttgaa

SEQ ID NO: 25754 - DNA, 25 bp, S. cerevisiae
gcgaaacatgttttcccattagtgg

SEQ ID NO: 25755 - DNA, 25 bp, S. cerevisiae
gcgaggaggtactatccacatacgt

SEQ ID NO: 25756 - DNA, 25 bp, S. cerevisiae
gcgcaaactagtaagcccctgtggt

SEQ ID NO: 25757 - DNA, 25 bp, S. cerevisiae
gcagtagactggtggactttaggaa

SEQ ID NO: 25758 - DNA, 25 bp, S. cerevisiae
gtaagactaacgaactttgggcacg

SEQ ID NO: 25759 - DNA, 25 bp, S. cerevisiae
gctaaggccacagaattacgcgtcc

SEQ ID NO: 25760 - DNA, 25 bp, S. cerevisiae
gctacaggccaacaagtacgtgtta

SEQ ID NO: 25761 - DNA, 25 bp, S. cerevisiae
gcaaagacaaggtaagctagaagtt

SEQ ID NO: 25762 - DNA, 25 bp, S. cerevisiae
gaacgggaactctgtagctggctgc

SEQ ID NO: 25763 - DNA, 25 bp, S. cerevisiae
ttttggtaacactggagaggcacgt

SEQ ID NO: 25764 - DNA, 25 bp, S. cerevisiae
tagtgtactaaaaaggaacgacgtg

SEQ ID NO: 25765 - DNA, 25 bp, S. cerevisiae
ttggcgacaaacaggcgaacggtat

SEQ ID NO: 25766 - DNA, 25 bp, S. cerevisiae
gtggaaaagacctcgaacggtatcg

SEQ ID NO: 25767 - DNA, 25 bp, S. cerevisiae
gggcaaaaaatctcaactatcgaat

SEQ ID NO: 25768 - DNA, 25 bp, S. cerevisiae
gcgaatagacagacgcctttctgct

SEQ ID NO: 25769 - DNA, 25 bp, S. cerevisiae
gcgttagaaaaggatatggcagata

SEQ ID NO: 25770 - DNA, 25 bp, S. cerevisiae
gcgccatcacaatcaagttctcgta

SEQ ID NO: 25771 - DNA, 25 bp, S. cerevisiae
gcccatcaagatctatttccacgaa

SEQ ID NO: 25772 - DNA, 25 bp, S. cerevisiae
gcgcccaaaatttgactacctctag

SEQ ID NO: 25773 - DNA, 25 bp, S. cerevisiae
gcccgctagagttcatattacccat

SEQ ID NO: 25774 - DNA, 25 bp, S. cerevisiae
gcccctcgagatgtttattgccaat

SEQ ID NO: 25775 - DNA, 25 bp, S. cerevisiae
gcgccgccgaaactgctgaattgca

SEQ ID NO: 25776 - DNA, 25 bp, S. cerevisiae
gccgggcaggcaatgctcatatgtt

SEQ ID NO: 25777 - DNA, 25 bp, S. cerevisiae
gcctctggctgctattcaagttttt

SEQ ID NO: 25778 - DNA, 25 bp, S. cerevisiae
gcctcggccttgaacaacttagaat

SEQ ID NO: 25779 - DNA, 25 bp, S. cerevisiae
gccgcggacttgaccacgtataaca

SEQ ID NO: 25780 - DNA, 25 bp, S. cerevisiae
gccgcggactattgcaggtgtgata

SEQ ID NO: 25781 - DNA, 25 bp, S. cerevisiae
gcctgaggccagtgagtctgttaca

SEQ ID NO: 25782 - DNA, 25 bp, S. cerevisiae
gcctgagcagtctgaacagcctgaa

SEQ ID NO: 25783 - DNA, 25 bp, S. cerevisiae
gcccctgatattgccggtcaagata

SEQ ID NO: 25784 - DNA, 25 bp, S. cerevisiae
gccgctcgtgtcgacattggtcaaa

SEQ ID NO: 25785 - DNA, 25 bp, S. cerevisiae
gcctaccttcgctattggtcatata

SEQ ID NO: 25786 - DNA, 25 bp, S. cerevisiae
gcctgactcgaccaatttctcaaaa

SEQ ID NO: 25787 - DNA, 25 bp, S. cerevisiae
gcctggcgtgcagcagatttcacaa

SEQ ID NO: 25788 - DNA, 25 bp, S. cerevisiae
gccccaagagtcacccaatggattt

SEQ ID NO: 25789 - DNA, 25 bp, S. cerevisiae
gcccctagacacattctcaaggatg

SEQ ID NO: 25790 - DNA, 25 bp, S. cerevisiae
gccccatagaccctattctattgag

SEQ ID NO: 25791 - DNA, 25 bp, S. cerevisiae
gcgaatttgtacctaacgactactt

SEQ ID NO: 25792 - DNA, 25 bp, S. cerevisiae
gccgtattgtacaaacctactttct

SEQ ID NO: 25793 - DNA, 25 bp, S. cerevisiae
gccgattttatcaaagcctttacct

SEQ ID NO: 25794 - DNA, 25 bp, S. cerevisiae
gccgaatttccacaactagctgatc

SEQ ID NO: 25795 - DNA, 25 bp, S. cerevisiae
gcatccaacaccacgagtaacgctg

SEQ ID NO: 25796 - DNA, 25 bp, S. cerevisiae
gccgacaagccaaagattactcctg

SEQ ID NO: 25797 - DNA, 25 bp, S. cerevisiae
gcctcatttccaacattatcaacaa

SEQ ID NO: 25798 - DNA, 25 bp, S. cerevisiae
gcctcaattgctatctatctccaaa

SEQ ID NO: 25799 - DNA, 25 bp, S. cerevisiae
gcctcagcggcttttgacattaata

SEQ ID NO: 25800 - DNA, 25 bp, S. cerevisiae
gcctcagcgaggttttgcaattcca

SEQ ID NO: 25801 - DNA, 25 bp, S. cerevisiae
gcctaaatgagctttcttcttctaa

SEQ ID NO: 25802 - DNA, 25 bp, S. cerevisiae
gccgagttcttttctttattgcaat

SEQ ID NO: 25803 - DNA, 25 bp, S. cerevisiae
gcctggtatttttatctttcccata

SEQ ID NO: 25804 - DNA, 25 bp, S. cerevisiae
gcctccttattttgattttgcccat

SEQ ID NO: 25805 - DNA, 25 bp, S. cerevisiae
gccctttctgggacacatggtttac

SEQ ID NO: 25806 - DNA, 25 bp, S. cerevisiae
gccccatctttgctttcgagtaata

SEQ ID NO: 25807 - DNA, 25 bp, S. cerevisiae
gcccacgtcttgcactatatgcagt

SEQ ID NO: 25808 - DNA, 25 bp, S. cerevisiae
gcagcaccagtgtttcagttggcat

SEQ ID NO: 25809 - DNA, 25 bp, S. cerevisiae
gcgcattggtgcattcgatcataca

SEQ ID NO: 25810 - DNA, 25 bp, S. cerevisiae
gcctgtggtgctataagtgcctata

SEQ ID NO: 25811 - DNA, 25 bp, S. cerevisiae
gcctgttggccatcaactgtttgaa

SEQ ID NO: 25812 - DNA, 25 bp, S. cerevisiae
gcctgtggtggatcaaatggactca

SEQ ID NO: 25813 - DNA, 25 bp, S. cerevisiae
gccgtggcatattactcggatgcat

SEQ ID NO: 25814 - DNA, 25 bp, S. cerevisiae
gccgcaataccactgttcttgatgt

SEQ ID NO: 25815 - DNA, 25 bp, S. cerevisiae
gcctgcgaacgcctcatttaatttg

SEQ ID NO: 25816 - DNA, 25 bp, S. cerevisiae
gcccgtacggaactcatatctgaat

SEQ ID NO: 25817 - DNA, 25 bp, S. cerevisiae
gcccttacctgtggaggcacaaaca

SEQ ID NO: 25818 - DNA, 25 bp, S. cerevisiae
gccgctgaacctcctgtggaaaaga

SEQ ID NO: 25819 - DNA, 25 bp, S. cerevisiae
gccgctgacggttctgtctataaca

SEQ ID NO: 25820 - DNA, 25 bp, S. cerevisiae
gccgtacggcagttgctggaagcaa

SEQ ID NO: 25821 - DNA, 25 bp, S. cerevisiae
gccctattggccttgggcaatattt

SEQ ID NO: 25822 - DNA, 25 bp, S. cerevisiae
gccgcgccattccaggtgaatacat

SEQ ID NO: 25823 - DNA, 25 bp, S. cerevisiae
gcctccagaccttttgcagaagatt

SEQ ID NO: 25824 - DNA, 25 bp, S. cerevisiae
gccccagcaggttttacacaagttt

SEQ ID NO: 25825 - DNA, 25 bp, S. cerevisiae
gcccgggttctaacatagcatacgt

SEQ ID NO: 25826 - DNA, 25 bp, S. cerevisiae
gccgggcatcttcttcaaatacaat

SEQ ID NO: 25827 - DNA, 25 bp, S. cerevisiae
gcctgtgatcattgtctttgtagca

SEQ ID NO: 25828 - DNA, 25 bp, S. cerevisiae
gcccgtcgtgttttgctgtgagaac

SEQ ID NO: 25829 - DNA, 25 bp, S. cerevisiae
gcccctgcgtgtggtgatgtgataa

SEQ ID NO: 25830 - DNA, 25 bp, S. cerevisiae
gcccactgggttcgagctcaaacaa

SEQ ID NO: 25831 - DNA, 25 bp, S. cerevisiae
gccgattccatttcgttgtgttcaa

SEQ ID NO: 25832 - DNA, 25 bp, S. cerevisiae
gccgtcggcttatttttgttcatta

SEQ ID NO: 25833 - DNA, 25 bp, S. cerevisiae
gccggcctattattttggtatccta

SEQ ID NO: 25834 - DNA, 25 bp, S. cerevisiae
gcccgtctcatttatttgcgtactt

SEQ ID NO: 25835 - DNA, 25 bp, S. cerevisiae
gcctcgcatactctatcgaattcga

SEQ ID NO: 25836 - DNA, 25 bp, S. cerevisiae
gcccagcaggtgtctacgaattcgt

SEQ ID NO: 25837 - DNA, 25 bp, S. cerevisiae
gtgccgaggtgccttgaaaacccct

SEQ ID NO: 25838 - DNA, 25 bp, S. cerevisiae
gccctgatgagtgcttgagacaaat

SEQ ID NO: 25839 - DNA, 25 bp, S. cerevisiae
gccggtgcttcgttcacaacagata

SEQ ID NO: 25840 - DNA, 25 bp, S. cerevisiae
gacggttcaccatagcaagttattg

SEQ ID NO: 25841 - DNA, 25 bp, S. cerevisiae
gatcttttactagaaggtcccgctt

SEQ ID NO: 25842 - DNA, 25 bp, S. cerevisiae
gctctttaactaatgaagggcccgt

SEQ ID NO: 25843 - DNA, 25 bp, S. cerevisiae
gcgccagctgttcaaataccatgtg

SEQ ID NO: 25844 - DNA, 25 bp, S. cerevisiae
gcctgcactgttaaacgcctttgat

SEQ ID NO: 25845 - DNA, 25 bp, S. cerevisiae
gccgcatcatgcttcgtttcattat

SEQ ID NO: 25846 - DNA, 25 bp, S. cerevisiae
gcccatgcagcgatggatgtcctga

SEQ ID NO: 25847 - DNA, 25 bp, S. cerevisiae
gccgaaactgttcttctggatcaaa

SEQ ID NO: 25848 - DNA, 25 bp, S. cerevisiae
gccgtttctttgcaatctgagtcga

SEQ ID NO: 25849 - DNA, 25 bp, S. cerevisiae
gccggttcctctgactctagaagaa

SEQ ID NO: 25850 - DNA, 25 bp, S. cerevisiae
gcccagttcaccgtattatcgaagc

SEQ ID NO: 25851 - DNA, 25 bp, S. cerevisiae
gcccagttaaacttccagctgcaaa

SEQ ID NO: 25852 - DNA, 25 bp, S. cerevisiae
gcgaacttacaactcggcatcatga

SEQ ID NO: 25853 - DNA, 25 bp, S. cerevisiae
gcgagtttcccaaggtcattgatca

SEQ ID NO: 25854 - DNA, 25 bp, S. cerevisiae
gcgaactgccccacttaaaaatcaa

SEQ ID NO: 25855 - DNA, 25 bp, S. cerevisiae
gcgtaggtctcagcccgctaaaaag

SEQ ID NO: 25856 - DNA, 25 bp, S. cerevisiae
gccgaaggctggtatgtgatttgtt

SEQ ID NO: 25857 - DNA, 25 bp, S. cerevisiae
gcgcccaagtcgttttgcattgtat

SEQ ID NO: 25858 - DNA, 25 bp, S. cerevisiae
gcgccgaaattgctataccagcttt

SEQ ID NO: 25859 - DNA, 25 bp, S. cerevisiae
gatgccgaaatatgtataccgaacg

SEQ ID NO: 25860 - DNA, 25 bp, S. cerevisiae
gcgcatccctagtgtttccaaaaga

SEQ ID NO: 25861 - DNA, 25 bp, S. cerevisiae
gcgcacggtcgtatttccaaaacaa

SEQ ID NO: 25862 - DNA, 25 bp, S. cerevisiae
gcgaacgcatagctgggtccaagaa

SEQ ID NO: 25863 - DNA, 25 bp, S. cerevisiae
gcgatactgtacttgggctctagga

SEQ ID NO: 25864 - DNA, 25 bp, S. cerevisiae
gcgactcgaatctctgacttactga

SEQ ID NO: 25865 - DNA, 25 bp, S. cerevisiae
gcgactaatagcaagccgactttta

SEQ ID NO: 25866 - DNA, 25 bp, S. cerevisiae
gcgaattcgcttacgattacgtgga

SEQ ID NO: 25867 - DNA, 25 bp, S. cerevisiae
gcggtctcgccaatggaaatgggtt

SEQ ID NO: 25868 - DNA, 25 bp, S. cerevisiae
gcgtgctcccgtactgggtggtaat

SEQ ID NO: 25869 - DNA, 25 bp, S. cerevisiae
gcagtacccgggtattacgaattat

SEQ ID NO: 25870 - DNA, 25 bp, S. cerevisiae
gcccgacctttgtgtttcgtacaag

SEQ ID NO: 25871 - DNA, 25 bp, S. cerevisiae
gctaaccctgatatggttccccaaa

SEQ ID NO: 25872 - DNA, 25 bp, S. cerevisiae
gcccatgcccatgtatggttccaaa

SEQ ID NO: 25873 - DNA, 25 bp, S. cerevisiae
gccgttatttctactttctctgaag

SEQ ID NO: 25874 - DNA, 25 bp, S. cerevisiae
gccctcaacttgcatacttactgaa

SEQ ID NO: 25875 - DNA, 25 bp, S. cerevisiae
gcccatcaagcttaatcacttccga

SEQ ID NO: 25876 - DNA, 25 bp, S. cerevisiae
gcagaagtttttcacaacgtcgaat

SEQ ID NO: 25877 - DNA, 25 bp, S. cerevisiae
gcggcctttactgctatagtttttc

SEQ ID NO: 25878 - DNA, 25 bp, S. cerevisiae
gcccactttgttgtgctttttctta

SEQ ID NO: 25879 - DNA, 25 bp, S. cerevisiae
gcccaaggtgtcctattctctaaag

SEQ ID NO: 25880 - DNA, 25 bp, S. cerevisiae
gccgaatggttggtcatatcacgca

SEQ ID NO: 25881 - DNA, 25 bp, S. cerevisiae
gccgcattggctctgaattcactga

SEQ ID NO: 25882 - DNA, 25 bp, S. cerevisiae
gcccgaactttgtattgctcagatg

SEQ ID NO: 25883 - DNA, 25 bp, S. cerevisiae
gcccaagatcttttgtttagcggac

SEQ ID NO: 25884 - DNA, 25 bp, S. cerevisiae
gccgaagtctttactggtatcccag

SEQ ID NO: 25885 - DNA, 25 bp, S. cerevisiae
gccgaattcaactctgtatacgcca

SEQ ID NO: 25886 - DNA, 25 bp, S. cerevisiae
gccggttctgcttactatacaaaat

SEQ ID NO: 25887 - DNA, 25 bp, S. cerevisiae
gccgtcctctgccaagtcttgaaaa

SEQ ID NO: 25888 - DNA, 25 bp, S. cerevisiae
gccgattcgcgcaatttttaaagca

SEQ ID NO: 25889 - DNA, 25 bp, S. cerevisiae
gccctgtgggcaagtcgctgttaaa

SEQ ID NO: 25890 - DNA, 25 bp, S. cerevisiae
gagccggtccttcaaacaaatcagt

SEQ ID NO: 25891 - DNA, 25 bp, S. cerevisiae
gcggcagaatccatacgtccaaatc

SEQ ID NO: 25892 - DNA, 25 bp, S. cerevisiae
gccgctgacaaactattgcctattg

SEQ ID NO: 25893 - DNA, 25 bp, S. cerevisiae
gactattaccctggaagttgaatct

SEQ ID NO: 25894 - DNA, 25 bp, S. cerevisiae
gccgttagccgtcagacttactatg

SEQ ID NO: 25895 - DNA, 25 bp, S. cerevisiae
gcgccattatgcagtccaacttgaa

SEQ ID NO: 25896 - DNA, 25 bp, S. cerevisiae
gccctttctcgcttcagtattgata

SEQ ID NO: 25897 - DNA, 25 bp, S. cerevisiae
gcccatttttgttgcttatttctgt

SEQ ID NO: 25898 - DNA, 25 bp, S. cerevisiae
gcccttttgcttgtatgttctgtga

SEQ ID NO: 25899 - DNA, 25 bp, S. cerevisiae
gcccctatcgcttgtgtttgtattg

SEQ ID NO: 25900 - DNA, 25 bp, S. cerevisiae
gccgccatttcccaggtgatttatt

SEQ ID NO: 25901 - DNA, 25 bp, S. cerevisiae
gcggacgccgatgaggaacacttaa

SEQ ID NO: 25902 - DNA, 25 bp, S. cerevisiae
gcgattgagaactctaacgtcgtaa

SEQ ID NO: 25903 - DNA, 25 bp, S. cerevisiae
gcgtcaagacatcagcaacctcaag

SEQ ID NO: 25904 - DNA, 25 bp, S. cerevisiae
gcgacaacgtctggaggcggaccta

SEQ ID NO: 25905 - DNA, 25 bp, S. cerevisiae
gctaaactccagcaagcttgacgga

SEQ ID NO: 25906 - DNA, 25 bp, S. cerevisiae
gcgaaactccagtctactttcagta

SEQ ID NO: 25907 - DNA, 25 bp, S. cerevisiae
gcgaatcacatcacctacagggcag

SEQ ID NO: 25908 - DNA, 25 bp, S. cerevisiae
gcgaagcacacaccgtatcaagcaa

SEQ ID NO: 25909 - DNA, 25 bp, S. cerevisiae
gcgcatggtctaatacagttccgtt

SEQ ID NO: 25910 - DNA, 25 bp, S. cerevisiae
gcgtcattacaatccagttccaatt

SEQ ID NO: 25911 - DNA, 25 bp, S. cerevisiae
gcgaaatcaaacttggctggccaac

SEQ ID NO: 25912 - DNA, 25 bp, S. cerevisiae
gcgggatagggctttgaaaccactc

SEQ ID NO: 25913 - DNA, 25 bp, S. cerevisiae
gaggctataaggctggaacaatcac

SEQ ID NO: 25914 - DNA, 25 bp, S. cerevisiae
gcgtgcaaaactcatggaagccatc

SEQ ID NO: 25915 - DNA, 25 bp, S. cerevisiae
gccgctgcaaacttttatggtctat

SEQ ID NO: 25916 - DNA, 25 bp, S. cerevisiae
gccgcaggtatggactcgtatgttt

SEQ ID NO: 25917 - DNA, 25 bp, S. cerevisiae
gccgcagttgttgctccaggtgaaa

SEQ ID NO: 25918 - DNA, 25 bp, S. cerevisiae
gccgccttagctgcatttgtcatag

SEQ ID NO: 25919 - DNA, 25 bp, S. cerevisiae
gcgcactctgaatacctgcagggta

SEQ ID NO: 25920 - DNA, 25 bp, S. cerevisiae
gcgttggacaagtgcctgccaagaa

SEQ ID NO: 25921 - DNA, 25 bp, S. cerevisiae
gcgatagaagaaccagcctcccaga

SEQ ID NO: 25922 - DNA, 25 bp, S. cerevisiae
gcgagagacgaccataacggccatt

SEQ ID NO: 25923 - DNA, 25 bp, S. cerevisiae
gcgaagacagtcaatccggaaatta

SEQ ID NO: 25924 - DNA, 25 bp, S. cerevisiae
gctccaacgtaccttgtcaaattca

SEQ ID NO: 25925 - DNA, 25 bp, S. cerevisiae
gcaccaatcgttcttgtaggcttga

SEQ ID NO: 25926 - DNA, 25 bp, S. cerevisiae
gccccattttctctgtagacgatga

SEQ ID NO: 25927 - DNA, 25 bp, S. cerevisiae
gccgctgtgttcatctcatttacaa

SEQ ID NO: 25928 - DNA, 25 bp, S. cerevisiae
gccgttacgttggtcatctcataga

SEQ ID NO: 25929 - DNA, 25 bp, S. cerevisiae
gccctgcggtatccttattggcaaa

SEQ ID NO: 25930 - DNA, 25 bp, S. cerevisiae
gccgctgctggatctttgattggta

SEQ ID NO: 25931 - DNA, 25 bp, S. cerevisiae
gccgcttggcatccagttattgaaa

SEQ ID NO: 25932 - DNA, 25 bp, S. cerevisiae
gcccctcaatgcaatctcacaatga

SEQ ID NO: 25933 - DNA, 25 bp, S. cerevisiae
gccgcttgccgcgatattgatcaag

SEQ ID NO: 25934 - DNA, 25 bp, S. cerevisiae
gcgccattccaggtgaatacatcac

SEQ ID NO: 25935 - DNA, 25 bp, S. cerevisiae
gcttacgtcgagtgaattttctggg

SEQ ID NO: 25936 - DNA, 25 bp, S. cerevisiae
gccgccgatcctttatcaaacgatg

SEQ ID NO: 25937 - DNA, 25 bp, S. cerevisiae
gcgcaccctgctttctataaacggg

SEQ ID NO: 25938 - DNA, 25 bp, S. cerevisiae
gccctctccttggtgaacggacaaa

SEQ ID NO: 25939 - DNA, 25 bp, S. cerevisiae
gccccacctgttaagctactgagaa

SEQ ID NO: 25940 - DNA, 25 bp, S. cerevisiae
gccccgaggctgaaggtactgtagt

SEQ ID NO: 25941 - DNA, 25 bp, S. cerevisiae
gcccttatgtggagtggagctgcct

SEQ ID NO: 25942 - DNA, 25 bp, S. cerevisiae
gcgctattttggagaaggctgtttc

SEQ ID NO: 25943 - DNA, 25 bp, S. cerevisiae
gccgatttacaaagaagtggtccta

SEQ ID NO: 25944 - DNA, 25 bp, S. cerevisiae
gcccatttggcttcaaaggagtctt

SEQ ID NO: 25945 - DNA, 25 bp, S. cerevisiae
gcccttggtgcttaagcaggcagaa

SEQ ID NO: 25946 - DNA, 25 bp, S. cerevisiae
gcccaagctttgtaagtgccagaaa

SEQ ID NO: 25947 - DNA, 25 bp, S. cerevisiae
gcccagtgtggatcttttatgtgac

SEQ ID NO: 25948 - DNA, 25 bp, S. cerevisiae
gccgcagttggagctatctgttttt

SEQ ID NO: 25949 - DNA, 25 bp, S. cerevisiae
gccccatcatgacttattttattta

SEQ ID NO: 25950 - DNA, 25 bp, S. cerevisiae
gccctctctgcgagatttatcacta

SEQ ID NO: 25951 - DNA, 25 bp, S. cerevisiae
gcgctcatcgtccaatatgtctatc

SEQ ID NO: 25952 - DNA, 25 bp, S. cerevisiae
gcgaacggcaattactcttctttga

SEQ ID NO: 25953 - DNA, 25 bp, S. cerevisiae
gcccaaggagcgtacacttctatgt

SEQ ID NO: 25954 - DNA, 25 bp, S. cerevisiae
gccgccatttgcattgtaaaagcta

SEQ ID NO: 25955 - DNA, 25 bp, S. cerevisiae
gcgcgccctgtgatcttgaaaactg

SEQ ID NO: 25956 - DNA, 25 bp, S. cerevisiae
gccgacttctattcctcatgaagag

SEQ ID NO: 25957 - DNA, 25 bp, S. cerevisiae
gccgatattcaaccacctgtggatt

SEQ ID NO: 25958 - DNA, 25 bp, S. cerevisiae
gcccacatgtaacactctcgatggt

SEQ ID NO: 25959 - DNA, 25 bp, S. cerevisiae
gcccatcttcacaaactcaggttat

SEQ ID NO: 25960 - DNA, 25 bp, S. cerevisiae
gcgccttccaaaaacattcaaatag

SEQ ID NO: 25961 - DNA, 25 bp, S. cerevisiae
gcgcaaagccaaaaacagtcgacat

SEQ ID NO: 25962 - DNA, 25 bp, S. cerevisiae
gccgaagatacagttacctccacag

SEQ ID NO: 25963 - DNA, 25 bp, S. cerevisiae
gccgactttactagtttctctgcag

SEQ ID NO: 25964 - DNA, 25 bp, S. cerevisiae
gaatcagttaggagctttagcccaa

SEQ ID NO: 25965 - DNA, 25 bp, S. cerevisiae
gcgtcagtaatcaaggctttaccct

SEQ ID NO: 25966 - DNA, 25 bp, S. cerevisiae
gcgacaatttcttcggtgtagcact

SEQ ID NO: 25967 - DNA, 25 bp, S. cerevisiae
gcgctctatttatttggtgctaccc

SEQ ID NO: 25968 - DNA, 25 bp, S. cerevisiae
gcgtattttaagtggttctctgaac

SEQ ID NO: 25969 - DNA, 25 bp, S. cerevisiae
gcgtcacgttttcgtattaccttga

SEQ ID NO: 25970 - DNA, 25 bp, S. cerevisiae
gcgtcctttttcaatattcaccttc

SEQ ID NO: 25971 - DNA, 25 bp, S. cerevisiae
gcggcccttttgactaatgaacttg

SEQ ID NO: 25972 - DNA, 25 bp, S. cerevisiae
gcgggcactggtttagtaggacttt

SEQ ID NO: 25973 - DNA, 25 bp, S. cerevisiae
gcgacgcacaggaaaagtgaaaatt

SEQ ID NO: 25974 - DNA, 25 bp, S. cerevisiae
gctgccgtgggagaaggacacctct

SEQ ID NO: 25975 - DNA, 25 bp, S. cerevisiae
gcttcggtgggttattaatcgcctt

SEQ ID NO: 25976 - DNA, 25 bp, S. cerevisiae
ggtacgatgggttacggtctccctg

SEQ ID NO: 25977 - DNA, 25 bp, S. cerevisiae
gccgaccaagttaccagagttatca

SEQ ID NO: 25978 - DNA, 25 bp, S. cerevisiae
gccgaccaagttaccagagttatca

SEQ ID NO: 25979 - DNA, 25 bp, S. cerevisiae
gccgacgatgattttgacgcagata

SEQ ID NO: 25980 - DNA, 25 bp, S. cerevisiae
gcgctacggaattgcttcatgatga

SEQ ID NO: 25981 - DNA, 25 bp, S. cerevisiae
gcgaaactgtatcattagagccatt

SEQ ID NO: 25982 - DNA, 25 bp, S. cerevisiae
gcgcaagcctattggattggcccaa

SEQ ID NO: 25983 - DNA, 25 bp, S. cerevisiae
gcgccgcctgatgacttaaccaaag

SEQ ID NO: 25984 - DNA, 25 bp, S. cerevisiae
gcgcactaccttctaaaccaattga

SEQ ID NO: 25985 - DNA, 25 bp, S. cerevisiae
gccctactggtttgcaaaagcttta

SEQ ID NO: 25986 - DNA, 25 bp, S. cerevisiae
gcgcgccactgggttaaggaattac

SEQ ID NO: 25987 - DNA, 25 bp, S. cerevisiae
gcgttcttttacaacctcggtattg

SEQ ID NO: 25988 - DNA, 25 bp, S. cerevisiae
gcgacactttattcattgccggttg

SEQ ID NO: 25989 - DNA, 25 bp, S. cerevisiae
gcccattttcattgcgtgttctgta

SEQ ID NO: 25990 - DNA, 25 bp, S. cerevisiae
gcccttgtggcaacgatttttctat

SEQ ID NO: 25991 - DNA, 25 bp, S. cerevisiae
gccctggttcagtcattcaagattt

SEQ ID NO: 25992 - DNA, 25 bp, S. cerevisiae
gccgcggaatccaaaaatgcatatt

SEQ ID NO: 25993 - DNA, 25 bp, S. cerevisiae
gccgccgccaccaagaaatgattgt

SEQ ID NO: 25994 - DNA, 25 bp, S. cerevisiae
gccccgtcacatacaaatctgttgt

SEQ ID NO: 25995 - DNA, 25 bp, S. cerevisiae
gccccagtaccaaacatcttatttt

SEQ ID NO: 25996 - DNA, 25 bp, S. cerevisiae
gctgttttcgccgaaaccttgaagc

SEQ ID NO: 25997 - DNA, 25 bp, S. cerevisiae
gcgaatcaccataccaaaccttaaa

SEQ ID NO: 25998 - DNA, 25 bp, S. cerevisiae
gcgagtccgatattagtcccggaaa

SEQ ID NO: 25999 - DNA, 25 bp, S. cerevisiae
gcgttcgtgtgttggtcaccgagaa

SEQ ID NO: 26000 - DNA, 25 bp, S. cerevisiae
gcgaaggactccaagttcaccggga

SEQ ID NO: 26001 - DNA, 25 bp, S. cerevisiae
gcgcaacgaaacatcattcccggaa

SEQ ID NO: 26002 - DNA, 25 bp, S. cerevisiae
gcgtatttaactgtcaccattttgg

SEQ ID NO: 26003 - DNA, 25 bp, S. cerevisiae
gcgctgtttaacactagaatctctt

SEQ ID NO: 26004 - DNA, 25 bp, S. cerevisiae
gccctctgtaccaccaagaaattat

SEQ ID NO: 26005 - DNA, 25 bp, S. cerevisiae
gccctttgaccttgacctgaatgag

SEQ ID NO: 26006 - DNA, 25 bp, S. cerevisiae
gcccgcgcactctaagttttacatg

SEQ ID NO: 26007 - DNA, 25 bp, S. cerevisiae
gctgttccatctctaatttaccgtt

SEQ ID NO: 26008 - DNA, 25 bp, S. cerevisiae
gctttgtgatatgtacttaaccgac

SEQ ID NO: 26009 - DNA, 25 bp, S. cerevisiae
gcgtttaagccgttgtattcgtgat

SEQ ID NO: 26010 - DNA, 25 bp, S. cerevisiae
gtgcttaaagggtgtatcggtacta

SEQ ID NO: 26011 - DNA, 25 bp, S. cerevisiae
gcgcttctaagggtggttacgtact

SEQ ID NO: 26012 - DNA, 25 bp, S. cerevisiae
gcgacataaataccggtaccgattt

SEQ ID NO: 26013 - DNA, 25 bp, S. cerevisiae
gcgcgtctaacggaagagcagcatc

SEQ ID NO: 26014 - DNA, 25 bp, S. cerevisiae
gcgcgtgtgacccaaataagcagca

SEQ ID NO: 26015 - DNA, 25 bp, S. cerevisiae
gcgggtaccccgaagagacagaaca

SEQ ID NO: 26016 - DNA, 25 bp, S. cerevisiae
gcttatcgaactctcaatacacctg

SEQ ID NO: 26017 - DNA, 25 bp, S. cerevisiae
gcgggcaccattgtagtaacttatt

SEQ ID NO: 26018 - DNA, 25 bp, S. cerevisiae
gcgagtactagcagaaggaccttat

SEQ ID NO: 26019 - DNA, 25 bp, S. cerevisiae
gcgagtactatgacgatgatgaacc

SEQ ID NO: 26020 - DNA, 25 bp, S. cerevisiae
gcgagaatactccaaagcagttaac

SEQ ID NO: 26021 - DNA, 25 bp, S. cerevisiae
gcgccaaaattcaatgctccggaaa

SEQ ID NO: 26022 - DNA, 25 bp, S. cerevisiae
gcgcataaacttacacctgcgttat

SEQ ID NO: 26023 - DNA, 25 bp, S. cerevisiae
gcgccagtcacttccaaagcgtttt

SEQ ID NO: 26024 - DNA, 25 bp, S. cerevisiae
gcgtttactacctatagagcctttg

SEQ ID NO: 26025 - DNA, 25 bp, S. cerevisiae
gcgcatttaccttctacgaacttta

SEQ ID NO: 26026 - DNA, 25 bp, S. cerevisiae
gcgctattgccagaatccagaactt

SEQ ID NO: 26027 - DNA, 25 bp, S. cerevisiae
gcagggtgcctcgtgcacagttaga

SEQ ID NO: 26028 - DNA, 25 bp, S. cerevisiae
gcgtaggcctcgaaagtcagtcaat

SEQ ID NO: 26029 - DNA, 25 bp, S. cerevisiae
gcgctatattgcgtgaggtccaatt

SEQ ID NO: 26030 - DNA, 25 bp, S. cerevisiae
gcgtatgatctgttctgagccaaag

SEQ ID NO: 26031 - DNA, 25 bp, S. cerevisiae
gcgatgcgttgctaaccgcagagga

SEQ ID NO: 26032 - DNA, 25 bp, S. cerevisiae
gcgcaggatgtgtttctggaatcga

SEQ ID NO: 26033 - DNA, 25 bp, S. cerevisiae
gcgccaaattgggttgttgcactgg

SEQ ID NO: 26034 - DNA, 25 bp, S. cerevisiae
gcgtcaagatttgcaattaactggt

SEQ ID NO: 26035 - DNA, 25 bp, S. cerevisiae
gcgaatacaacccaaatgcacctat

SEQ ID NO: 26036 - DNA, 25 bp, S. cerevisiae
gcgaatgacagagcccgaagccttg

SEQ ID NO: 26037 - DNA, 25 bp, S. cerevisiae
gattaacgaccctcaagagtgtgca

SEQ ID NO: 26038 - DNA, 25 bp, S. cerevisiae
gcattatacactttcccaagacgac

SEQ ID NO: 26039 - DNA, 25 bp, S. cerevisiae
gttaccatgtcctccagaattacga

SEQ ID NO: 26040 - DNA, 25 bp, S. cerevisiae
gattaaaaagtctctgaattccaaa

SEQ ID NO: 26041 - DNA, 25 bp, S. cerevisiae
gatttaacttcctctaatttcgcgg

SEQ ID NO: 26042 - DNA, 25 bp, S. cerevisiae
gcgattacaattaccgtccgtacta

SEQ ID NO: 26043 - DNA, 25 bp, S. cerevisiae
gcgaattagaaagcgatccgtctct

SEQ ID NO: 26044 - DNA, 25 bp, S. cerevisiae
gcgaatcaagaagttcccacgtttt

SEQ ID NO: 26045 - DNA, 25 bp, S. cerevisiae
gcgctacaatgtattcatgccaagt

SEQ ID NO: 26046 - DNA, 25 bp, S. cerevisiae
gcgcccgaagtcctcacaaagaaag

SEQ ID NO: 26047 - DNA, 25 bp, S. cerevisiae
gcccttggaacgttactgcagtgaa

SEQ ID NO: 26048 - DNA, 25 bp, S. cerevisiae
gccctgaccagcgtgttactagaac

SEQ ID NO: 26049 - DNA, 25 bp, S. cerevisiae
gcgcatccgaagttggtggtgatac

SEQ ID NO: 26050 - DNA, 25 bp, S. cerevisiae
gcgctgcacgaactggcgtctttaa

SEQ ID NO: 26051 - DNA, 25 bp, S. cerevisiae
gcgccagatacacagcagcaattta

SEQ ID NO: 26052 - DNA, 25 bp, S. cerevisiae
gcgccaagtccgcagcaaaatattg

SEQ ID NO: 26053 - DNA, 25 bp, S. cerevisiae
gagccaaacacgcacagggaaattt

SEQ ID NO: 26054 - DNA, 25 bp, S. cerevisiae
gccctttcaagctcaggcgaaattt

SEQ ID NO: 26055 - DNA, 25 bp, S. cerevisiae
gccctcttctactacaatgtcataa

SEQ ID NO: 26056 - DNA, 25 bp, S. cerevisiae
gcgatcaatggcctgactatgctaa

SEQ ID NO: 26057 - DNA, 25 bp, S. cerevisiae
gcgatgcagcagtcgttcctgaaga

SEQ ID NO: 26058 - DNA, 25 bp, S. cerevisiae
gcgttccaacggtctttcatgaaat

SEQ ID NO: 26059 - DNA, 25 bp, S. cerevisiae
gcgccaaggccaacatcgaagtttt

SEQ ID NO: 26060 - DNA, 25 bp, S. cerevisiae
gcgagaggccctgggttcaattccc

SEQ ID NO: 26061 - DNA, 25 bp, S. cerevisiae
gcggttctcgttatacgttcgacga

SEQ ID NO: 26062 - DNA, 25 bp, S. cerevisiae
gcgtgtaccgttctagattccagag

SEQ ID NO: 26063 - DNA, 25 bp, S. cerevisiae
gctcgaagacttgtaccggctcaaa

SEQ ID NO: 26064 - DNA, 25 bp, S. cerevisiae
gcccaaactttttgcaggtgccgat

SEQ ID NO: 26065 - DNA, 25 bp, S. cerevisiae
gcgtaacctgtgatgtatggtcctt

SEQ ID NO: 26066 - DNA, 25 bp, S. cerevisiae
gcgccgcattgcatttgggttacaa

SEQ ID NO: 26067 - DNA, 25 bp, S. cerevisiae
gcgtctaatcagttgggtttaccca

SEQ ID NO: 26068 - DNA, 25 bp, S. cerevisiae
gcgtttcagtttccactaatttaga

SEQ ID NO: 26069 - DNA, 25 bp, S. cerevisiae
gcgtttcgaggtctttgtagctaca

SEQ ID NO: 26070 - DNA, 25 bp, S. cerevisiae
gcgtaatcgagaagttttgttcaga

SEQ ID NO: 26071 - DNA, 25 bp, S. cerevisiae
gcgccaatattctgcttctaattct

SEQ ID NO: 26072 - DNA, 25 bp, S. cerevisiae
gcgacaatgtttctgcttctgaggc

SEQ ID NO: 26073 - DNA, 25 bp, S. cerevisiae
gcgcctattgcttttgctgattgaa

SEQ ID NO: 26074 - DNA, 25 bp, S. cerevisiae
gcgacatattgcaatcatctgctgt

SEQ ID NO: 26075 - DNA, 25 bp, S. cerevisiae
gcgttgtgatgattccaattccatg

SEQ ID NO: 26076 - DNA, 25 bp, S. cerevisiae
gcgtatgggaaccaagcctctaaat

SEQ ID NO: 26077 - DNA, 25 bp, S. cerevisiae
gcgcatttggatgatccggactcca

SEQ ID NO: 26078 - DNA, 25 bp, S. cerevisiae
gcgacaagaacgtgctatctgaatc

SEQ ID NO: 26079 - DNA, 25 bp, S. cerevisiae
gcgaagatcgggttagcacaactaa

SEQ ID NO: 26080 - DNA, 25 bp, S. cerevisiae
gcgagtatttggttgcacgaactac

SEQ ID NO: 26081 - DNA, 25 bp, S. cerevisiae
gcgaccctccaagtcgtcaaaggga

SEQ ID NO: 26082 - DNA, 25 bp, S. cerevisiae
gcgaaccccagagcagcgaagaagt

SEQ ID NO: 26083 - DNA, 25 bp, S. cerevisiae
gcggaacccatagtactcaaagcct

SEQ ID NO: 26084 - DNA, 25 bp, S. cerevisiae
gtactatcggtgatggcccacaggc

SEQ ID NO: 26085 - DNA, 25 bp, S. cerevisiae
gcgcatttcaactatttgccaccaa

SEQ ID NO: 26086 - DNA, 25 bp, S. cerevisiae
gcgttccgacttattaccaaggcta

SEQ ID NO: 26087 - DNA, 25 bp, S. cerevisiae
gcgaatcaagacatttttctccggt

SEQ ID NO: 26088 - DNA, 25 bp, S. cerevisiae
gcgactcaaacggtatatcttctgg

SEQ ID NO: 26089 - DNA, 25 bp, S. cerevisiae
gcgaccagaccatgctaactatttg

SEQ ID NO: 26090 - DNA, 25 bp, S. cerevisiae
gcaaccacaacaagctaaagtacct

SEQ ID NO: 26091 - DNA, 25 bp, S. cerevisiae
gaatcatccgtacatttggtaccta

SEQ ID NO: 26092 - DNA, 25 bp, S. cerevisiae
gcgtacgcttttttaactctatctt

SEQ ID NO: 26093 - DNA, 25 bp, S. cerevisiae
gatgttcaacggcatggttttttac

SEQ ID NO: 26094 - DNA, 25 bp, S. cerevisiae
gttagtacgtttggctccatttcca

SEQ ID NO: 26095 - DNA, 25 bp, S. cerevisiae
gcgtaggctacgactttttatctgt

SEQ ID NO: 26096 - DNA, 25 bp, S. cerevisiae
ggtcagtcttaacagaattccgtca

SEQ ID NO: 26097 - DNA, 25 bp, S. cerevisiae
gcgccactttaacaaatgtgccaga

SEQ ID NO: 26098 - DNA, 25 bp, S. cerevisiae
gcccatgctggtgctaaattcgcta

SEQ ID NO: 26099 - DNA, 25 bp, S. cerevisiae
gctgccagaggtgctcagtttggta

SEQ ID NO: 26100 - DNA, 25 bp, S. cerevisiae
gcgccagaggtggtttcaatggaca

SEQ ID NO: 26101 - DNA, 25 bp, S. cerevisiae
gcccatgatggtggcgtagacataa

SEQ ID NO: 26102 - DNA, 25 bp, S. cerevisiae
gcccatcctgagcttatccatgaaa

SEQ ID NO: 26103 - DNA, 25 bp, S. cerevisiae
gcccatttggcgcatattctagaat

SEQ ID NO: 26104 - DNA, 25 bp, S. cerevisiae
gcgctttacccatttgtgggctatt

SEQ ID NO: 26105 - DNA, 25 bp, S. cerevisiae
gcccactcctttatctttgttagaa

SEQ ID NO: 26106 - DNA, 25 bp, S. cerevisiae
gcccacatctgcttatttcttatat

SEQ ID NO: 26107 - DNA, 25 bp, S. cerevisiae
gcgaatgcctcatagcaagcctaaa

SEQ ID NO: 26108 - DNA, 25 bp, S. cerevisiae
gcgatatatccatacctgccgtaaa

SEQ ID NO: 26109 - DNA, 25 bp, S. cerevisiae
gcgcgagttagaccctgccaaaaag

SEQ ID NO: 26110 - DNA, 25 bp, S. cerevisiae
gcgcgttcaagctatcatattccga

SEQ ID NO: 26111 - DNA, 25 bp, S. cerevisiae
gctgtaccagcgctagtattcgatg

SEQ ID NO: 26112 - DNA, 25 bp, S. cerevisiae
gcgtatcacaggttttaccacagga

SEQ ID NO: 26113 - DNA, 25 bp, S. cerevisiae
gcggtcgccgtttctactaagaaat

SEQ ID NO: 26114 - DNA, 25 bp, S. cerevisiae
gcgacttcctgactaacaggaagac

SEQ ID NO: 26115 - DNA, 25 bp, S. cerevisiae
gcgaatttccacaaacgttagactg

SEQ ID NO: 26116 - DNA, 25 bp, S. cerevisiae
gcgagttcatgtccttttttcatag

SEQ ID NO: 26117 - DNA, 25 bp, S. cerevisiae
gcgaattccgatgtttcagtgcaat

SEQ ID NO: 26118 - DNA, 25 bp, S. cerevisiae
gcgactttcaatttgcctcagtgta

SEQ ID NO: 26119 - DNA, 25 bp, S. cerevisiae
gcgaggttcttcacccaggtagtga

SEQ ID NO: 26120 - DNA, 25 bp, S. cerevisiae
gcgaggattttagcccgttcagaaa

SEQ ID NO: 26121 - DNA, 25 bp, S. cerevisiae
gcgatggcattcttaagggcgttga

SEQ ID NO: 26122 - DNA, 25 bp, S. cerevisiae
gcgaggcgtgcatttaactagttac

SEQ ID NO: 26123 - DNA, 25 bp, S. cerevisiae
gcgagagcaatccatttcctaggtt

SEQ ID NO: 26124 - DNA, 25 bp, S. cerevisiae
gcgaatacctgccaatttgccgaag

SEQ ID NO: 26125 - DNA, 25 bp, S. cerevisiae
gcggcggatttattgaactagactc

SEQ ID NO: 26126 - DNA, 25 bp, S. cerevisiae
gcgatggtttaattgtacttatgct

SEQ ID NO: 26127 - DNA, 25 bp, S. cerevisiae
gcgaggttatgtatttcttgcccaa

SEQ ID NO: 26128 - DNA, 25 bp, S. cerevisiae
gcgggtcaaaaagttcttgcatcga

SEQ ID NO: 26129 - DNA, 25 bp, S. cerevisiae
gcgaggcgcaaaaacgtcttgacga

SEQ ID NO: 26130 - DNA, 25 bp, S. cerevisiae
gcgaccgactacaggctatatcaag

SEQ ID NO: 26131 - DNA, 25 bp, S. cerevisiae
gctgttccaacgcacttttttaaat

SEQ ID NO: 26132 - DNA, 25 bp, S. cerevisiae
gcgttccaatggttctaataggtaa

SEQ ID NO: 26133 - DNA, 25 bp, S. cerevisiae
gcggtcttttggtaatattagtcct

SEQ ID NO: 26134 - DNA, 25 bp, S. cerevisiae
gcgagtactattctactttcgaaca

SEQ ID NO: 26135 - DNA, 25 bp, S. cerevisiae
gcgcacgttgccagatacataccga

SEQ ID NO: 26136 - DNA, 25 bp, S. cerevisiae
gcgcttgttgccatgctgaggataa

SEQ ID NO: 26137 - DNA, 25 bp, S. cerevisiae
gatgtacccgacttcggcttaatta

SEQ ID NO: 26138 - DNA, 25 bp, S. cerevisiae
gaatgaccttcctcgagctaaattg

SEQ ID NO: 26139 - DNA, 25 bp, S. cerevisiae
gcgatgtctatgttgtagagcctga

SEQ ID NO: 26140 - DNA, 25 bp, S. cerevisiae
gcgattctttggtaagcctttgaaa

SEQ ID NO: 26141 - DNA, 25 bp, S. cerevisiae
gcgcctattatggaagtgctcgaga

SEQ ID NO: 26142 - DNA, 25 bp, S. cerevisiae
gcgccgtctctactagtgctggaaa

SEQ ID NO: 26143 - DNA, 25 bp, S. cerevisiae
gcgaatggctcgaactctgcggatg

SEQ ID NO: 26144 - DNA, 25 bp, S. cerevisiae
gcgcccaatggtttgattcctcaag

SEQ ID NO: 26145 - DNA, 25 bp, S. cerevisiae
gcgcagctccaggtggtttcccagg

SEQ ID NO: 26146 - DNA, 25 bp, S. cerevisiae
gcgcgcaattgtccggtggtcaaaa

SEQ ID NO: 26147 - DNA, 25 bp, S. cerevisiae
gcgaagattctttctggaccacgga

SEQ ID NO: 26148 - DNA, 25 bp, S. cerevisiae
gcgcccttggttatgcacagtattt

SEQ ID NO: 26149 - DNA, 25 bp, S. cerevisiae
gcgacctggcggttttacatatgaa

SEQ ID NO: 26150 - DNA, 25 bp, S. cerevisiae
gcgactatcgcttctgcaaattcag

SEQ ID NO: 26151 - DNA, 25 bp, S. cerevisiae
gcgcccagtccatttattttcaaga

SEQ ID NO: 26152 - DNA, 25 bp, S. cerevisiae
gcgcgccatgtggacatctattttg

SEQ ID NO: 26153 - DNA, 25 bp, S. cerevisiae
gcgggattgtcgtgcttatcaacca

SEQ ID NO: 26154 - DNA, 25 bp, S. cerevisiae
gcgctggtgttcaatggctcatcta

SEQ ID NO: 26155 - DNA, 25 bp, S. cerevisiae
gcactggcccctatttgtaatgaag

SEQ ID NO: 26156 - DNA, 25 bp, S. cerevisiae
gctgctttaccagcggatggtacca

SEQ ID NO: 26157 - DNA, 25 bp, S. cerevisiae
gcgaactacctagtgtgctggttaa

SEQ ID NO: 26158 - DNA, 25 bp, S. cerevisiae
gcgcaaaatccatccgtatttgata

SEQ ID NO: 26159 - DNA, 25 bp, S. cerevisiae
gcgaagcttctatccagtatcttat

SEQ ID NO: 26160 - DNA, 25 bp, S. cerevisiae
gcgacactccgttacatgttactgt

SEQ ID NO: 26161 - DNA, 25 bp, S. cerevisiae
gcgaccttttgctattgttcattgc

SEQ ID NO: 26162 - DNA, 25 bp, S. cerevisiae
gcgaaggtgttcaatgtgcatctca

SEQ ID NO: 26163 - DNA, 25 bp, S. cerevisiae
gcgccgctaacgagctgattcagaa

SEQ ID NO: 26164 - DNA, 25 bp, S. cerevisiae
gcgcctttcctgatcagcaatgtga

SEQ ID NO: 26165 - DNA, 25 bp, S. cerevisiae
gcgcacgtctactattccaattata

SEQ ID NO: 26166 - DNA, 25 bp, S. cerevisiae
gcgcacggcattttgtctgaattta

SEQ ID NO: 26167 - DNA, 25 bp, S. cerevisiae
gcgagcggcatgcttgatgcttatt

SEQ ID NO: 26168 - DNA, 25 bp, S. cerevisiae
gcgtattccgctttaatcaactgtc

SEQ ID NO: 26169 - DNA, 25 bp, S. cerevisiae
gcgtcaccaccaagtcaattactga

SEQ ID NO: 26170 - DNA, 25 bp, S. cerevisiae
gcgtcgaacgtaataacccacttag

SEQ ID NO: 26171 - DNA, 25 bp, S. cerevisiae
gcgaatccctcatcaacataaacga

SEQ ID NO: 26172 - DNA, 25 bp, S. cerevisiae
gctggaccgctctcaaaaaggtgaa

SEQ ID NO: 26173 - DNA, 25 bp, S. cerevisiae
gcgcgactcgccttcagaaaatgaa

SEQ ID NO: 26174 - DNA, 25 bp, S. cerevisiae
gcagggtctgactccaggcgttgaa

SEQ ID NO: 26175 - DNA, 25 bp, S. cerevisiae
gcggagtgcagctgacatcaacgtt

SEQ ID NO: 26176 - DNA, 25 bp, S. cerevisiae
gctggcagtgccaacagcttactgg

SEQ ID NO: 26177 - DNA, 25 bp, S. cerevisiae
gcgtcttccaaagttactcagcaac

SEQ ID NO: 26178 - DNA, 25 bp, S. cerevisiae
gcgaattccaaatttgagctctcta

SEQ ID NO: 26179 - DNA, 25 bp, S. cerevisiae
gcgatattactccagttgaccctat

SEQ ID NO: 26180 - DNA, 25 bp, S. cerevisiae
gcgatgtctatttcagctctaacca

SEQ ID NO: 26181 - DNA, 25 bp, S. cerevisiae
gcgtcacatatttcgaggcaagctc

SEQ ID NO: 26182 - DNA, 25 bp, S. cerevisiae
gcgatgacagaatctaccaagctac

SEQ ID NO: 26183 - DNA, 25 bp, S. cerevisiae
gcgagagcagtatctttctaccaca

SEQ ID NO: 26184 - DNA, 25 bp, S. cerevisiae
gcgcaggcgtatattttaatccatt

SEQ ID NO: 26185 - DNA, 25 bp, S. cerevisiae
gcgcgggtatcagtattacctcctt

SEQ ID NO: 26186 - DNA, 25 bp, S. cerevisiae
gcggtggtatgttccgtattttcca

SEQ ID NO: 26187 - DNA, 25 bp, S. cerevisiae
gcgcccaatttgtcgcaaactgaac

SEQ ID NO: 26188 - DNA, 25 bp, S. cerevisiae
gcgacgacactgacaagcctttgaa

SEQ ID NO: 26189 - DNA, 25 bp, S. cerevisiae
gcgtcctgagaagcattcggttcac

SEQ ID NO: 26190 - DNA, 25 bp, S. cerevisiae
gcgcagctcctgttatttatgggtt

SEQ ID NO: 26191 - DNA, 25 bp, S. cerevisiae
gcggtactggcgcacattgctaaat

SEQ ID NO: 26192 - DNA, 25 bp, S. cerevisiae
gcgaataccctgctctgtggaagaa

SEQ ID NO: 26193 - DNA, 25 bp, S. cerevisiae
gcgactcgccgtatattcagcaagt

SEQ ID NO: 26194 - DNA, 25 bp, S. cerevisiae
gcgaatcatttgaatccatcttaaa

SEQ ID NO: 26195 - DNA, 25 bp, S. cerevisiae
gcgaatcttttaagtttgaccaact

SEQ ID NO: 26196 - DNA, 25 bp, S. cerevisiae
gcgtatttcttatcttatggaccct

SEQ ID NO: 26197 - DNA, 25 bp, S. cerevisiae
gcgtgtgccgaaaacacttctcaat

SEQ ID NO: 26198 - DNA, 25 bp, S. cerevisiae
gcgtctctccaaagtagcaacacag

SEQ ID NO: 26199 - DNA, 25 bp, S. cerevisiae
gcgtggcaccagagcagaacaacta

SEQ ID NO: 26200 - DNA, 25 bp, S. cerevisiae
gcttggaccgaagtaacattcattt

SEQ ID NO: 26201 - DNA, 25 bp, S. cerevisiae
gctacctttagaaacaacttgccag

SEQ ID NO: 26202 - DNA, 25 bp, S. cerevisiae
gctgatacatttgttggaacgtcca

SEQ ID NO: 26203 - DNA, 25 bp, S. cerevisiae
gcgttctcctactggcaaggtcaaa

SEQ ID NO: 26204 - DNA, 25 bp, S. cerevisiae
gcgtgctcccattagaggtacggca

SEQ ID NO: 26205 - DNA, 25 bp, S. cerevisiae
gcgtgccacaatggtaggtactcca

SEQ ID NO: 26206 - DNA, 25 bp, S. cerevisiae
gcgtgactccatgcaccagatattt

SEQ ID NO: 26207 - DNA, 25 bp, S. cerevisiae
gcgtatttatgtctgagtccgtcac

SEQ ID NO: 26208 - DNA, 25 bp, S. cerevisiae
gcgtcttttatcgacaggccaacag

SEQ ID NO: 26209 - DNA, 25 bp, S. cerevisiae
gcgtctactattactcggccaaata

SEQ ID NO: 26210 - DNA, 25 bp, S. cerevisiae
gcgcttatctttaaggaccaacata

SEQ ID NO: 26211 - DNA, 25 bp, S. cerevisiae
gcgctgttgctgaatacgggctcaa

SEQ ID NO: 26212 - DNA, 25 bp, S. cerevisiae
gcgctgattgtgataaaggtcctat

SEQ ID NO: 26213 - DNA, 25 bp, S. cerevisiae
gcgttggtcaattcagtggctgcat

SEQ ID NO: 26214 - DNA, 25 bp, S. cerevisiae
gcgacgagtaattgttgcacctgca

SEQ ID NO: 26215 - DNA, 25 bp, S. cerevisiae
gcgctgcatggctaaattctaccga

SEQ ID NO: 26216 - DNA, 25 bp, S. cerevisiae
gcgctgcatactttattctgtctat

SEQ ID NO: 26217 - DNA, 25 bp, S. cerevisiae
gcgctgttgctcttattattattac

SEQ ID NO: 26218 - DNA, 25 bp, S. cerevisiae
gcgttatgtacagctattgcacaca

SEQ ID NO: 26219 - DNA, 25 bp, S. cerevisiae
gcgctacttattgatatctcgtcga

SEQ ID NO: 26220 - DNA, 25 bp, S. cerevisiae
gcgaaaaattcgaatctcttgctga

SEQ ID NO: 26221 - DNA, 25 bp, S. cerevisiae
gcgaagggaatcagacatttgcata

SEQ ID NO: 26222 - DNA, 25 bp, S. cerevisiae
gcgaaagattattttcagcccataa

SEQ ID NO: 26223 - DNA, 25 bp, S. cerevisiae
gcgaacctgaatttaactcctgaaa

SEQ ID NO: 26224 - DNA, 25 bp, S. cerevisiae
gttcttatactatcgacggacctga

SEQ ID NO: 26225 - DNA, 25 bp, S. cerevisiae
gcttttagacttcaacacggcgcta

SEQ ID NO: 26226 - DNA, 25 bp, S. cerevisiae
gcggtctccctttttggaatctata

SEQ ID NO: 26227 - DNA, 25 bp, S. cerevisiae
gctggtcaagactgccatgggtttt

SEQ ID NO: 26228 - DNA, 25 bp, S. cerevisiae
gctgtcccagtttcaaaggtttctt

SEQ ID NO: 26229 - DNA, 25 bp, S. cerevisiae
gcggcttccttatatggttctttaa

SEQ ID NO: 26230 - DNA, 25 bp, S. cerevisiae
gcggtatggcagttatcgttagttc

SEQ ID NO: 26231 - DNA, 25 bp, S. cerevisiae
gctggttgggtctccgagatttcaa

SEQ ID NO: 26232 - DNA, 25 bp, S. cerevisiae
gctggaataggttcggccaattggc

SEQ ID NO: 26233 - DNA, 25 bp, S. cerevisiae
gcggcactggtagcgttatgtgaca

SEQ ID NO: 26234 - DNA, 25 bp, S. cerevisiae
gcgagatctatattccactttggac

SEQ ID NO: 26235 - DNA, 25 bp, S. cerevisiae
gcgaaaatcattcctttgcataaca

SEQ ID NO: 26236 - DNA, 25 bp, S. cerevisiae
gcgactactccttagccaagaattt

SEQ ID NO: 26237 - DNA, 25 bp, S. cerevisiae
gcgatacccaatttcacaaggattt

SEQ ID NO: 26238 - DNA, 25 bp, S. cerevisiae
gcgaatgacgctgctataggtaatt

SEQ ID NO: 26239 - DNA, 25 bp, S. cerevisiae
gcggcaacgggcatgacactaggta

SEQ ID NO: 26240 - DNA, 25 bp, S. cerevisiae
gctgtcaacgttaatagccctggtt

SEQ ID NO: 26241 - DNA, 25 bp, S. cerevisiae
gcgtacttaatcaacaccggctgga

SEQ ID NO: 26242 - DNA, 25 bp, S. cerevisiae
gcgcatatttactgtcatcatttta

SEQ ID NO: 26243 - DNA, 25 bp, S. cerevisiae
gcgatatccttctcgattctttagt

SEQ ID NO: 26244 - DNA, 25 bp, S. cerevisiae
gcgttgcctttgagatactattgtt

SEQ ID NO: 26245 - DNA, 25 bp, S. cerevisiae
gcgagtacggtgctaaatgcaattt

SEQ ID NO: 26246 - DNA, 25 bp, S. cerevisiae
gcggtggaaacaatacagcgactat

SEQ ID NO: 26247 - DNA, 25 bp, S. cerevisiae
gcggtaactataacagcagcggtat

SEQ ID NO: 26248 - DNA, 25 bp, S. cerevisiae
gcagttgtacaaccttaacggccca

SEQ ID NO: 26249 - DNA, 25 bp, S. cerevisiae
gcggcttaaaggcaaacggattcaa

SEQ ID NO: 26250 - DNA, 25 bp, S. cerevisiae
gcgggacaaagacataccactgaat

SEQ ID NO: 26251 - DNA, 25 bp, S. cerevisiae
gcgtgggacaaacctataccgattt

SEQ ID NO: 26252 - DNA, 25 bp, S. cerevisiae
gcgttcttttattctctggtttcta

SEQ ID NO: 26253 - DNA, 25 bp, S. cerevisiae
gctgtacttacggatacgggaccat

SEQ ID NO: 26254 - DNA, 25 bp, S. cerevisiae
gcgttttatgcgaagattggtgaga

SEQ ID NO: 26255 - DNA, 25 bp, S. cerevisiae
ggcgaacaccggattttaatgacga

SEQ ID NO: 26256 - DNA, 25 bp, S. cerevisiae
gctggtcgcaccgatgggaacgata

SEQ ID NO: 26257 - DNA, 25 bp, S. cerevisiae
gctcttcgagcggaatgtacacatt

SEQ ID NO: 26258 - DNA, 25 bp, S. cerevisiae
gtttgcaaagcctggacgagttttt

SEQ ID NO: 26259 - DNA, 25 bp, S. cerevisiae
gttcgaaattttgaccgctggttct

SEQ ID NO: 26260 - DNA, 25 bp, S. cerevisiae
gctgccaaaattgctaatcccggtt

SEQ ID NO: 26261 - DNA, 25 bp, S. cerevisiae
gcgtgatgaaatatttggcccggtt

SEQ ID NO: 26262 - DNA, 25 bp, S. cerevisiae
gcgagtcaactcctttggatagcga

SEQ ID NO: 26263 - DNA, 25 bp, S. cerevisiae
gcgacagtagccttgacctcaatga

SEQ ID NO: 26264 - DNA, 25 bp, S. cerevisiae
gcgaatctacatttatgcccttatt

SEQ ID NO: 26265 - DNA, 25 bp, S. cerevisiae
gcgacactacttctgcacaatttga

SEQ ID NO: 26266 - DNA, 25 bp, S. cerevisiae
gcgaaatatcttctgactctatcta

SEQ ID NO: 26267 - DNA, 25 bp, S. cerevisiae
gctggaattcctttgacctcattag

SEQ ID NO: 26268 - DNA, 25 bp, S. cerevisiae
gcgaggtaacttcgacactttatat

SEQ ID NO: 26269 - DNA, 25 bp, S. cerevisiae
gcgggaaactttggcaatgttgtca

SEQ ID NO: 26270 - DNA, 25 bp, S. cerevisiae
gcgttgcacaaggataccggttctt

SEQ ID NO: 26271 - DNA, 25 bp, S. cerevisiae
gcggatctacatgataccggatttt

SEQ ID NO: 26272 - DNA, 25 bp, S. cerevisiae
gcgtgagtacatttaatcgagcatc

SEQ ID NO: 26273 - DNA, 25 bp, S. cerevisiae
gcgatagtgacttttacgagcataa

SEQ ID NO: 26274 - DNA, 25 bp, S. cerevisiae
gcgaagctggctattctggccaaat

SEQ ID NO: 26275 - DNA, 25 bp, S. cerevisiae
gcgtgactggctatagttgtcggat

SEQ ID NO: 26276 - DNA, 25 bp, S. cerevisiae
gcggagctacgttctgctttaggat

SEQ ID NO: 26277 - DNA, 25 bp, S. cerevisiae
gcgggtctcctagctttagaatact

SEQ ID NO: 26278 - DNA, 25 bp, S. cerevisiae
gcgtcgttacgaggaagccattgca

SEQ ID NO: 26279 - DNA, 25 bp, S. cerevisiae
gcgactttacgacggacatgctaat

SEQ ID NO: 26280 - DNA, 25 bp, S. cerevisiae
gcggcctctgacgttgaactcgaaa

SEQ ID NO: 26281 - DNA, 25 bp, S. cerevisiae
gcgtcatgttggcttcaagggatca

SEQ ID NO: 26282 - DNA, 25 bp, S. cerevisiae
gcgtcgatgttcatgtccataggct

SEQ ID NO: 26283 - DNA, 25 bp, S. cerevisiae
gcgtccatatgtactcttcaagctt

SEQ ID NO: 26284 - DNA, 25 bp, S. cerevisiae
gcgaccacatgtatgttcactgcag

SEQ ID NO: 26285 - DNA, 25 bp, S. cerevisiae
gcggccgcgtatttatgctaactga

SEQ ID NO: 26286 - DNA, 25 bp, S. cerevisiae
gcaccccggctgcaaaaggtagtac

SEQ ID NO: 26287 - DNA, 25 bp, S. cerevisiae
gctcttgccaaaacaaaaaaatcca

SEQ ID NO: 26288 - DNA, 25 bp, S. cerevisiae
gctctttgaacgaaattacaccctc

SEQ ID NO: 26289 - DNA, 25 bp, S. cerevisiae
gcattgttggtcgaggttaaatccc

SEQ ID NO: 26290 - DNA, 25 bp, S. cerevisiae
gctgttaaaatgcttacggtttcac

SEQ ID NO: 26291 - DNA, 25 bp, S. cerevisiae
gcgattcagaagctttacggatttt

SEQ ID NO: 26292 - DNA, 25 bp, S. cerevisiae
gcgaccgctctgattgctgaaagta

SEQ ID NO: 26293 - DNA, 25 bp, S. cerevisiae
gcgactcagtctatacccaatgtaa

SEQ ID NO: 26294 - DNA, 25 bp, S. cerevisiae
gcggaccaaaatcctccttgtaata

SEQ ID NO: 26295 - DNA, 25 bp, S. cerevisiae
gcgtggttcgcagcagtttttgact

SEQ ID NO: 26296 - DNA, 25 bp, S. cerevisiae
gcgtcgttgagccacattctttaaa

SEQ ID NO: 26297 - DNA, 25 bp, S. cerevisiae
gcgagcggacatcatcttggttaat

SEQ ID NO: 26298 - DNA, 25 bp, S. cerevisiae
gcgaggcgcttcgagcttggtataa

SEQ ID NO: 26299 - DNA, 25 bp, S. cerevisiae
gcgaccaatatgagcttttgtcaca

SEQ ID NO: 26300 - DNA, 25 bp, S. cerevisiae
gcggacaaaccgctttggacgctaa

SEQ ID NO: 26301 - DNA, 25 bp, S. cerevisiae
gcagaaaactctcgcttaaaccatt

SEQ ID NO: 26302 - DNA, 25 bp, S. cerevisiae
gcggaatgataaacacctaaccaat

SEQ ID NO: 26303 - DNA, 25 bp, S. cerevisiae
gcggcaaggacatcacctaagtcat

SEQ ID NO: 26304 - DNA, 25 bp, S. cerevisiae
gcgttgaggcattagcggcttgttt

SEQ ID NO: 26305 - DNA, 25 bp, S. cerevisiae
gctgtatgacgatagggccggtttc

SEQ ID NO: 26306 - DNA, 25 bp, S. cerevisiae
gctgaataaggatctgcccgaactt

SEQ ID NO: 26307 - DNA, 25 bp, S. cerevisiae
gcgagtctccctattaatgcttgaa

SEQ ID NO: 26308 - DNA, 25 bp, S. cerevisiae
gcggtagccgctattcaggttgcaa

SEQ ID NO: 26309 - DNA, 25 bp, S. cerevisiae
gctgaccccactacaaatggttcga

SEQ ID NO: 26310 - DNA, 25 bp, S. cerevisiae
gcggtcagtggtttcaggttccaac

SEQ ID NO: 26311 - DNA, 25 bp, S. cerevisiae
gcgtgttcggtgatattgcttccaa

SEQ ID NO: 26312 - DNA, 25 bp, S. cerevisiae
gcgatatagacgtccggatggccaa

SEQ ID NO: 26313 - DNA, 25 bp, S. cerevisiae
gaatacagaccaccgagggctacga

SEQ ID NO: 26314 - DNA, 25 bp, S. cerevisiae
gcagattccacctctgatggtgtca

SEQ ID NO: 26315 - DNA, 25 bp, S. cerevisiae
gcgttccattctacctaatgctcaa

SEQ ID NO: 26316 - DNA, 25 bp, S. cerevisiae
gcgagttattctcatccaacaacgg

SEQ ID NO: 26317 - DNA, 25 bp, S. cerevisiae
gcgggtatcgtgttccattcaaaaa

SEQ ID NO: 26318 - DNA, 25 bp, S. cerevisiae
gcgaggctacgatattttcttaaac

SEQ ID NO: 26319 - DNA, 25 bp, S. cerevisiae
gcggagatgccgtgatttacttaaa

SEQ ID NO: 26320 - DNA, 25 bp, S. cerevisiae
gcgtctcgtcattcatctactaaga

SEQ ID NO: 26321 - DNA, 25 bp, S. cerevisiae
gagctgacagccaggacatatgcta

SEQ ID NO: 26322 - DNA, 25 bp, S. cerevisiae
gcgtgaagcctattcagctgaccaa

SEQ ID NO: 26323 - DNA, 25 bp, S. cerevisiae
gcgatatacagcatgcacctgacta

SEQ ID NO: 26324 - DNA, 25 bp, S. cerevisiae
gcgatgatccatatgctgaatactt

SEQ ID NO: 26325 - DNA, 25 bp, S. cerevisiae
gctggacgatgatgctgcaagccat

SEQ ID NO: 26326 - DNA, 25 bp, S. cerevisiae
gcgatggccaagaagcattcgacaa

SEQ ID NO: 26327 - DNA, 25 bp, S. cerevisiae
gctgaggccaagcagaatcctatga

SEQ ID NO: 26328 - DNA, 25 bp, S. cerevisiae
gcgagacctatccaaggctctagat

SEQ ID NO: 26329 - DNA, 25 bp, S. cerevisiae
gcgagatgcagtactacaccacttt

SEQ ID NO: 26330 - DNA, 25 bp, S. cerevisiae
gcggttattacccttgaactggata

SEQ ID NO: 26331 - DNA, 25 bp, S. cerevisiae
tcgatggtaccacacacgcaattga

SEQ ID NO: 26332 - DNA, 25 bp, S. cerevisiae
gctgaggtaccacaaggaacttcaa

SEQ ID NO: 26333 - DNA, 25 bp, S. cerevisiae
gcggagcacccataagtagcacttc

SEQ ID NO: 26334 - DNA, 25 bp, S. cerevisiae
gaagtacgcaagtgaaactccgctg

SEQ ID NO: 26335 - DNA, 25 bp, S. cerevisiae
gtaaggcacaactgaaaaccgctga

SEQ ID NO: 26336 - DNA, 25 bp, S. cerevisiae
gcaggtacttccgaaagacgccatc

SEQ ID NO: 26337 - DNA, 25 bp, S. cerevisiae
gcggatactctacgaaactagctct

SEQ ID NO: 26338 - DNA, 25 bp, S. cerevisiae
gcggctaatccaatcaaactttgct

SEQ ID NO: 26339 - DNA, 25 bp, S. cerevisiae
gcgattacaccagatattctcttga

SEQ ID NO: 26340 - DNA, 25 bp, S. cerevisiae
gcgttcctccatggatagttcctta

SEQ ID NO: 26341 - DNA, 25 bp, S. cerevisiae
gcgatgtttgctggttactacttaa

SEQ ID NO: 26342 - DNA, 25 bp, S. cerevisiae
gcgattaacttttctgttgttcctt

SEQ ID NO: 26343 - DNA, 25 bp, S. cerevisiae
gtacctttcggagctaactactctt

SEQ ID NO: 26344 - DNA, 25 bp, S. cerevisiae
gctcctttatttgggttactcactt

SEQ ID NO: 26345 - DNA, 25 bp, S. cerevisiae
gctgacttttttgggtttcactggt

SEQ ID NO: 26346 - DNA, 25 bp, S. cerevisiae
gcgtaggcttatctaactccaacag

SEQ ID NO: 26347 - DNA, 25 bp, S. cerevisiae
gcgtggaggtacatcagagcttcga

SEQ ID NO: 26348 - DNA, 25 bp, S. cerevisiae
gcgagtttactgcatctgacgttaa

SEQ ID NO: 26349 - DNA, 25 bp, S. cerevisiae
gcgagtatattcttttactggtcaa

SEQ ID NO: 26350 - DNA, 25 bp, S. cerevisiae
gcgggtttctgcttttcaagtacac

SEQ ID NO: 26351 - DNA, 25 bp, S. cerevisiae
gcgattgaccacatctttaggcatt

SEQ ID NO: 26352 - DNA, 25 bp, S. cerevisiae
gcgattgtcccgttgcaatattgtt

SEQ ID NO: 26353 - DNA, 25 bp, S. cerevisiae
gcgatactcatcacactgtggctga

SEQ ID NO: 26354 - DNA, 25 bp, S. cerevisiae
gcgataccttgccacggtcagattt

SEQ ID NO: 26355 - DNA, 25 bp, S. cerevisiae
gctcgaacctggtcctaacgtacag

SEQ ID NO: 26356 - DNA, 25 bp, S. cerevisiae
gctaactccggaaattgactgtaca

SEQ ID NO: 26357 - DNA, 25 bp, S. cerevisiae
gcgatcacaacacctttagactgca

SEQ ID NO: 26358 - DNA, 25 bp, S. cerevisiae
gcgtccaccatctttgataactaca

SEQ ID NO: 26359 - DNA, 25 bp, S. cerevisiae
gcgattacttcaaaacgctctctaa

SEQ ID NO: 26360 - DNA, 25 bp, S. cerevisiae
gcgatgaggtatacgtcttattcta

SEQ ID NO: 26361 - DNA, 25 bp, S. cerevisiae
gcgaggcgcgtggttgattcatatc

SEQ ID NO: 26362 - DNA, 25 bp, S. cerevisiae
gcgtgctttccatttaatcggtctg

SEQ ID NO: 26363 - DNA, 25 bp, S. cerevisiae
gcgggattcgacctaatcggctgta

SEQ ID NO: 26364 - DNA, 25 bp, S. cerevisiae
gcgggatctcaaaggttcgactgca

SEQ ID NO: 26365 - DNA, 25 bp, S. cerevisiae
gcacgagcttaacgtattgcgccta

SEQ ID NO: 26366 - DNA, 25 bp, S. cerevisiae
gcggagcttgggttgatgctatcca

SEQ ID NO: 26367 - DNA, 25 bp, S. cerevisiae
gcgaggcagatgatgatttttccac

SEQ ID NO: 26368 - DNA, 25 bp, S. cerevisiae
gcgggcgataggttaatcacatcat

SEQ ID NO: 26369 - DNA, 25 bp, S. cerevisiae
gcgagtccaccgatacatcaatgtt

SEQ ID NO: 26370 - DNA, 25 bp, S. cerevisiae
gcgatatcaaatcatgctgccagaa

SEQ ID NO: 26371 - DNA, 25 bp, S. cerevisiae
gctggtggtgcttacactgtctcca

SEQ ID NO: 26372 - DNA, 25 bp, S. cerevisiae
gctgtctccgttttcggtttcagaa

SEQ ID NO: 26373 - DNA, 25 bp, S. cerevisiae
gctgtatccgttatcactttctgga

SEQ ID NO: 26374 - DNA, 25 bp, S. cerevisiae
gcgattctcgttgactttttgctga

SEQ ID NO: 26375 - DNA, 25 bp, S. cerevisiae
gcggatattttgactactgattctg

SEQ ID NO: 26376 - DNA, 25 bp, S. cerevisiae
gcggcgttgattccatagatgattc

SEQ ID NO: 26377 - DNA, 25 bp, S. cerevisiae
gcggatgatttctctgcagatgcaa

SEQ ID NO: 26378 - DNA, 25 bp, S. cerevisiae
gctgttgcttcctccagtgaaacta

SEQ ID NO: 26379 - DNA, 25 bp, S. cerevisiae
gcgttccgccgtcaggtaacaatat

SEQ ID NO: 26380 - DNA, 25 bp, S. cerevisiae
gaagtccgttcctgggatgaattta

SEQ ID NO: 26381 - DNA, 25 bp, S. cerevisiae
gagccccgttcctgaaaaatttcat

SEQ ID NO: 26382 - DNA, 25 bp, S. cerevisiae
gactctcgccggcttgaaaaatttc

SEQ ID NO: 26383 - DNA, 25 bp, S. cerevisiae
gcgtcttgccgtctttaacagaatt

SEQ ID NO: 26384 - DNA, 25 bp, S. cerevisiae
gcgtcagcttttgagcccatgacaa

SEQ ID NO: 26385 - DNA, 25 bp, S. cerevisiae
gcgtcaattaatgcatctctcgatg

SEQ ID NO: 26386 - DNA, 25 bp, S. cerevisiae
gcgtctatatttttctcagctgagc

SEQ ID NO: 26387 - DNA, 25 bp, S. cerevisiae
gcggtgtgccaggatgtatcttcat

SEQ ID NO: 26388 - DNA, 25 bp, S. cerevisiae
gcgggatacatgcatcttattcaat

SEQ ID NO: 26389 - DNA, 25 bp, S. cerevisiae
gcggctaagcgtgttcgacaatgac

SEQ ID NO: 26390 - DNA, 25 bp, S. cerevisiae
gcggttctgtgtattggccaattat

SEQ ID NO: 26391 - DNA, 25 bp, S. cerevisiae
gcggttgctgtctcttttgaattga

SEQ ID NO: 26392 - DNA, 25 bp, S. cerevisiae
gcgtttataccgcttcaggaacaaa

SEQ ID NO: 26393 - DNA, 25 bp, S. cerevisiae
gctgttttcaagtccttaggcgtca

SEQ ID NO: 26394 - DNA, 25 bp, S. cerevisiae
gcttggtacatatcctacggcgagt

SEQ ID NO: 26395 - DNA, 25 bp, S. cerevisiae
gcattaaagcagtaccgacccgata

SEQ ID NO: 26396 - DNA, 25 bp, S. cerevisiae
gcgtaaactgtcattgccaggacta

SEQ ID NO: 26397 - DNA, 25 bp, S. cerevisiae
gcggtaatgctaaggtgccaggatt

SEQ ID NO: 26398 - DNA, 25 bp, S. cerevisiae
gcagtgcaattttcggttcaggtgt

SEQ ID NO: 26399 - DNA, 25 bp, S. cerevisiae
gcggcatatgatctaggtttcctga

SEQ ID NO: 26400 - DNA, 25 bp, S. cerevisiae
gcgtccaaactgcagctttctgtga

SEQ ID NO: 26401 - DNA, 25 bp, S. cerevisiae
gcgtgataccaaagctcgtgagata

SEQ ID NO: 26402 - DNA, 25 bp, S. cerevisiae
gcggcaacagctactctcggaataa

SEQ ID NO: 26403 - DNA, 25 bp, S. cerevisiae
gctgatgaaactgtcgtcgcttgta

SEQ ID NO: 26404 - DNA, 25 bp, S. cerevisiae
gcgattgttttgaagctgccatctt

SEQ ID NO: 26405 - DNA, 25 bp, S. cerevisiae
gcggaattgccattgggatgctcca

SEQ ID NO: 26406 - DNA, 25 bp, S. cerevisiae
gcgttcacgccatgtggatactcat

SEQ ID NO: 26407 - DNA, 25 bp, S. cerevisiae
gcgtttcgctccaatgcaaatgcag

SEQ ID NO: 26408 - DNA, 25 bp, S. cerevisiae
gcgattgatctttttgttacagggc

SEQ ID NO: 26409 - DNA, 25 bp, S. cerevisiae
gcgtggctacttcattcttcaatag

SEQ ID NO: 26410 - DNA, 25 bp, S. cerevisiae
gcgttcataagcaaggatcatccta

SEQ ID NO: 26411 - DNA, 25 bp, S. cerevisiae
gcgttacaccaccaacgatcgtaat

SEQ ID NO: 26412 - DNA, 25 bp, S. cerevisiae
gcggaacatccccaatcgtggaatt

SEQ ID NO: 26413 - DNA, 25 bp, S. cerevisiae
gcgtatggcattagttgtgtgatta

SEQ ID NO: 26414 - DNA, 25 bp, S. cerevisiae
gcgtacaatatccattcgcttttga

SEQ ID NO: 26415 - DNA, 25 bp, S. cerevisiae
gcgtaaacctactcctgaagatcgt

SEQ ID NO: 26416 - DNA, 25 bp, S. cerevisiae
gcgattaatcaggtcgaccctcaag

SEQ ID NO: 26417 - DNA, 25 bp, S. cerevisiae
gcgattgcattaacttcactcctaa

SEQ ID NO: 26418 - DNA, 25 bp, S. cerevisiae
gcgttgctgtgctagatttgtcgat

SEQ ID NO: 26419 - DNA, 25 bp, S. cerevisiae
gcgtgagctctctgtcaaacatgaa

SEQ ID NO: 26420 - DNA, 25 bp, S. cerevisiae
gcggagcgaagatcctgcaggttta

SEQ ID NO: 26421 - DNA, 25 bp, S. cerevisiae
gcgtgggcgtatagctaagcaccat

SEQ ID NO: 26422 - DNA, 25 bp, S. cerevisiae
gcgtattactattgctagagctcaa

SEQ ID NO: 26423 - DNA, 25 bp, S. cerevisiae
gcgtcttcattttgctaccaagctg

SEQ ID NO: 26424 - DNA, 25 bp, S. cerevisiae
gcgtgctcgcatcaattaccaactg

SEQ ID NO: 26425 - DNA, 25 bp, S. cerevisiae
gcgtatccaaactagttccattcag

SEQ ID NO: 26426 - DNA, 25 bp, S. cerevisiae
gcggcggtctttctgacattggtaa

SEQ ID NO: 26427 - DNA, 25 bp, S. cerevisiae
gcggcggctttagggcatactgaat

SEQ ID NO: 26428 - DNA, 25 bp, S. cerevisiae
gcgtgatattattataggctccgaa

SEQ ID NO: 26429 - DNA, 25 bp, S. cerevisiae
gcgttcatccattgaagccttgcga

SEQ ID NO: 26430 - DNA, 25 bp, S. cerevisiae
gcgttgagccagcacagcttattat

SEQ ID NO: 26431 - DNA, 25 bp, S. cerevisiae
gcgttgattgacctagctgtatttc

SEQ ID NO: 26432 - DNA, 25 bp, S. cerevisiae
gcgtatcgtacctcaagtgcttgat

SEQ ID NO: 26433 - DNA, 25 bp, S. cerevisiae
gcgtccgatagttcacaaagcttta

SEQ ID NO: 26434 - DNA, 25 bp, S. cerevisiae
gctgtacgatactaccccattatta

SEQ ID NO: 26435 - DNA, 25 bp, S. cerevisiae
gcgtccgtggacatttctcatattt

SEQ ID NO: 26436 - DNA, 25 bp, S. cerevisiae
gcgtcctgggactttttatatgaaa

SEQ ID NO: 26437 - DNA, 25 bp, S. cerevisiae
gcgtttgagggctgatccaatcata

SEQ ID NO: 26438 - DNA, 25 bp, S. cerevisiae
gctggctccactcacgataaaaaat

SEQ ID NO: 26439 - DNA, 25 bp, S. cerevisiae
gcgtgttgccctttttcaagatgaa

SEQ ID NO: 26440 - DNA, 25 bp, S. cerevisiae
gcgtcattcgaccatcgttatctta

SEQ ID NO: 26441 - DNA, 25 bp, S. cerevisiae
gcgtggttcactattattggcaatc

SEQ ID NO: 26442 - DNA, 25 bp, S. cerevisiae
gcgggatcttatcattatttgccat

SEQ ID NO: 26443 - DNA, 25 bp, S. cerevisiae
gcgttcttccagcataatttcacat

SEQ ID NO: 26444 - DNA, 25 bp, S. cerevisiae
gcgtgctctgactcagtacatttca

SEQ ID NO: 26445 - DNA, 25 bp, S. cerevisiae
gcgtctgccagaaagtgagtctctt

SEQ ID NO: 26446 - DNA, 25 bp, S. cerevisiae
gcgggacgaatacaagctgtcaatt

SEQ ID NO: 26447 - DNA, 25 bp, S. cerevisiae
gcgtgttttagagacatttgacaaa

SEQ ID NO: 26448 - DNA, 25 bp, S. cerevisiae
gcgtgtattgtttttctgtttcaaa

SEQ ID NO: 26449 - DNA, 25 bp, S. cerevisiae
gcggttcagataaaggcctcttcaa

SEQ ID NO: 26450 - DNA, 25 bp, S. cerevisiae
gcggtctcagcccaaggctttaaga

SEQ ID NO: 26451 - DNA, 25 bp, S. cerevisiae
gcgtcattcctccaagtgctgattt

SEQ ID NO: 26452 - DNA, 25 bp, S. cerevisiae
gcggctaccgtggagctcgatgaaa

SEQ ID NO: 26453 - DNA, 25 bp, S. cerevisiae
gctggctgtcagaatggactggtta

SEQ ID NO: 26454 - DNA, 25 bp, S. cerevisiae
gcggcactaccgagcaattattgtc

SEQ ID NO: 26455 - DNA, 25 bp, S. cerevisiae
gcggactactggacgcatgcttata

SEQ ID NO: 26456 - DNA, 25 bp, S. cerevisiae
gcgtaccacattccagatttgataa

SEQ ID NO: 26457 - DNA, 25 bp, S. cerevisiae
gcgtctaccaatccgtttgctaata

SEQ ID NO: 26458 - DNA, 25 bp, S. cerevisiae
gcgggtggcaatatagtcacagaca

SEQ ID NO: 26459 - DNA, 25 bp, S. cerevisiae
gcgtttctcatgtttgcatcatatt

SEQ ID NO: 26460 - DNA, 25 bp, S. cerevisiae
gcgttattatactctcagccttgat

SEQ ID NO: 26461 - DNA, 25 bp, S. cerevisiae
gcgtagccataatttatcgccttat

SEQ ID NO: 26462 - DNA, 25 bp, S. cerevisiae
gcgtaccgcctccagtagatgaaga

SEQ ID NO: 26463 - DNA, 25 bp, S. cerevisiae
gctgcacacagctgtcattaagcgc

SEQ ID NO: 26464 - DNA, 25 bp, S. cerevisiae
gctacaccctgtagtaactcctaaa

SEQ ID NO: 26465 - DNA, 25 bp, S. cerevisiae
gctagccaatctcaaagtcccgaaa

SEQ ID NO: 26466 - DNA, 25 bp, S. cerevisiae
gcatggccaatcacaaaacgactaa

SEQ ID NO: 26467 - DNA, 25 bp, S. cerevisiae
gcttctaaatgggaacaaggttcga

SEQ ID NO: 26468 - DNA, 25 bp, S. cerevisiae
gcagggtttccatccaagacagtat

SEQ ID NO: 26469 - DNA, 25 bp, S. cerevisiae
gcacgggtgaacagccgacactgat

SEQ ID NO: 26470 - DNA, 25 bp, S. cerevisiae
gcgtggttgaacatcttggccattt

SEQ ID NO: 26471 - DNA, 25 bp, S. cerevisiae
gcggtaaccaatttgttctttgttg

SEQ ID NO: 26472 - DNA, 25 bp, S. cerevisiae
gcggttaactttttgacttttgctg

SEQ ID NO: 26473 - DNA, 25 bp, S. cerevisiae
gctggcctccttttttgcatattat

SEQ ID NO: 26474 - DNA, 25 bp, S. cerevisiae
gctggcccgccaacatggtaagatt

SEQ ID NO: 26475 - DNA, 25 bp, S. cerevisiae
gctgtgctcgggaccatttaacaac

SEQ ID NO: 26476 - DNA, 25 bp, S. cerevisiae
gcggaagtcattggcgtattgctaa

SEQ ID NO: 26477 - DNA, 25 bp, S. cerevisiae
gcgggctttgccatttctacaaata

SEQ ID NO: 26478 - DNA, 25 bp, S. cerevisiae
gcggcgtttccactggctatgaaaa

SEQ ID NO: 26479 - DNA, 25 bp, S. cerevisiae
gcggtgattccgatgccaatggcac

SEQ ID NO: 26480 - DNA, 25 bp, S. cerevisiae
gctagaatctttttgacgaagggca

SEQ ID NO: 26481 - DNA, 25 bp, S. cerevisiae
gctgaaatctcatctaataaaggaa

SEQ ID NO: 26482 - DNA, 25 bp, S. cerevisiae
gtgacaatgggcagaactcgagttc

SEQ ID NO: 26483 - DNA, 25 bp, S. cerevisiae
gctgacaccgagatggaagaagttg

SEQ ID NO: 26484 - DNA, 25 bp, S. cerevisiae
gctgtccaccaatgtcacgatttta

SEQ ID NO: 26485 - DNA, 25 bp, S. cerevisiae
gctgcttacgccagaaccattggta

SEQ ID NO: 26486 - DNA, 25 bp, S. cerevisiae
gctcgtgcgggaaataacgctattt

SEQ ID NO: 26487 - DNA, 25 bp, S. cerevisiae
gctcgtcaagctaaaataaccatgt

SEQ ID NO: 26488 - DNA, 25 bp, S. cerevisiae
gctggtaagccaaagaccgctcaat

SEQ ID NO: 26489 - DNA, 25 bp, S. cerevisiae
gcgtgctcaagttgaattgtgcttt

SEQ ID NO: 26490 - DNA, 25 bp, S. cerevisiae
gcgtcgctataccaccaagagttta

SEQ ID NO: 26491 - DNA, 25 bp, S. cerevisiae
gcgtcctctatccataataaccatt

SEQ ID NO: 26492 - DNA, 25 bp, S. cerevisiae
gcaggcagttttcactaacgttcat

SEQ ID NO: 26493 - DNA, 25 bp, S. cerevisiae
gcagcggttgggagtgctactttat

SEQ ID NO: 26494 - DNA, 25 bp, S. cerevisiae
gcgggttctggatctgctacggtta

SEQ ID NO: 26495 - DNA, 25 bp, S. cerevisiae
gctggtgtttcatacttgactcgtt

SEQ ID NO: 26496 - DNA, 25 bp, S. cerevisiae
gctgttgtcccaaagttacctgtta

SEQ ID NO: 26497 - DNA, 25 bp, S. cerevisiae
gcgtgcttctaaggctttgattgaa

SEQ ID NO: 26498 - DNA, 25 bp, S. cerevisiae
gcgtcatatccttcatctattggtg

SEQ ID NO: 26499 - DNA, 25 bp, S. cerevisiae
gctgtctcattacatcaactggtga

SEQ ID NO: 26500 - DNA, 25 bp, S. cerevisiae
gcgtcgtcgcttttgatgttagatt

SEQ ID NO: 26501 - DNA, 25 bp, S. cerevisiae
gcgtctgtacccatatggctggttg

SEQ ID NO: 26502 - DNA, 25 bp, S. cerevisiae
gcgtcgaacctcattctgtggatat

SEQ ID NO: 26503 - DNA, 25 bp, S. cerevisiae
gcggatcaacgccttgttgaccaag

SEQ ID NO: 26504 - DNA, 25 bp, S. cerevisiae
gcggagagatccctgctattgaaaa

SEQ ID NO: 26505 - DNA, 25 bp, S. cerevisiae
gcggtcagccaaacatatcagccat

SEQ ID NO: 26506 - DNA, 25 bp, S. cerevisiae
gcgtgctcaatggaacagtactcaa

SEQ ID NO: 26507 - DNA, 25 bp, S. cerevisiae
gcgtgctcagagacattatcgacat

SEQ ID NO: 26508 - DNA, 25 bp, S. cerevisiae
gctggcacgagtcctatcagatcaa

SEQ ID NO: 26509 - DNA, 25 bp, S. cerevisiae
gctggagcatatacacttcttgggc

SEQ ID NO: 26510 - DNA, 25 bp, S. cerevisiae
gcgtgtggtctagtggtatgattct

SEQ ID NO: 26511 - DNA, 25 bp, S. cerevisiae
gcggtgctatctgctgggagaacat

SEQ ID NO: 26512 - DNA, 25 bp, S. cerevisiae
gctggtgatagccatcttattatat

SEQ ID NO: 26513 - DNA, 25 bp, S. cerevisiae
gctgatgcaatagatcatgacaata

SEQ ID NO: 26514 - DNA, 25 bp, S. cerevisiae
gctgcagacataaagagacatccct

SEQ ID NO: 26515 - DNA, 25 bp, S. cerevisiae
gctggtatctgctataagctctcct

SEQ ID NO: 26516 - DNA, 25 bp, S. cerevisiae
gcggtgtctccactactttattaac

SEQ ID NO: 26517 - DNA, 25 bp, S. cerevisiae
gcggctttccttaagctttttcaca

SEQ ID NO: 26518 - DNA, 25 bp, S. cerevisiae
gctcgttctgccctagagtttttaa

SEQ ID NO: 26519 - DNA, 25 bp, S. cerevisiae
gctggtccagatccttctaatgtta

SEQ ID NO: 26520 - DNA, 25 bp, S. cerevisiae
gcggtccagttttcacatctattat

SEQ ID NO: 26521 - DNA, 25 bp, S. cerevisiae
gcggtgctgtttccataccatttat

SEQ ID NO: 26522 - DNA, 25 bp, S. cerevisiae
gcgggcagttcttcttcgaatataa

SEQ ID NO: 26523 - DNA, 25 bp, S. cerevisiae
gctggtctgtctcaaccattttgaa

SEQ ID NO: 26524 - DNA, 25 bp, S. cerevisiae
gctggtcttcgcagggctaaatgat

SEQ ID NO: 26525 - DNA, 25 bp, S. cerevisiae
gcggacctcgaacatctatcaataa

SEQ ID NO: 26526 - DNA, 25 bp, S. cerevisiae
gcgggaactcacagttttgcaaaat

SEQ ID NO: 26527 - DNA, 25 bp, S. cerevisiae
gcggcgtttgcaggcagtttatcaa

SEQ ID NO: 26528 - DNA, 25 bp, S. cerevisiae
gcggcctgatcattctcgtaaacaa

SEQ ID NO: 26529 - DNA, 25 bp, S. cerevisiae
gcgtcgacattggtgctatcagtaa

SEQ ID NO: 26530 - DNA, 25 bp, S. cerevisiae
gcggctagatagtttcgatgacgat

SEQ ID NO: 26531 - DNA, 25 bp, S. cerevisiae
gcggcatgcgcaaggtccaatacgt

SEQ ID NO: 26532 - DNA, 25 bp, S. cerevisiae
gctgaagccaagttccaatcggata

SEQ ID NO: 26533 - DNA, 25 bp, S. cerevisiae
gctctccctcagttccaaaagaaga

SEQ ID NO: 26534 - DNA, 25 bp, S. cerevisiae
gctggcggcaaattttttaaggcat

SEQ ID NO: 26535 - DNA, 25 bp, S. cerevisiae
gcatttggccgattggttgggaact

SEQ ID NO: 26536 - DNA, 25 bp, S. cerevisiae
ttggaaccgggaaagctccctctag

SEQ ID NO: 26537 - DNA, 25 bp, S. cerevisiae
gctagaaccggtgaagtccatctcc

SEQ ID NO: 26538 - DNA, 25 bp, S. cerevisiae
gctaaacacgtttactccgaatcct

SEQ ID NO: 26539 - DNA, 25 bp, S. cerevisiae
gctaaggcccctatcctgattaata

SEQ ID NO: 26540 - DNA, 25 bp, S. cerevisiae
gctgaaggtcgttttcggcatcgaa

SEQ ID NO: 26541 - DNA, 25 bp, S. cerevisiae
gcggctgatgggaaacttgtaactt

SEQ ID NO: 26542 - DNA, 25 bp, S. cerevisiae
gcggtatgcgaatcagtttcctttc

SEQ ID NO: 26543 - DNA, 25 bp, S. cerevisiae
gctgacttggaatcatctttgcgat

SEQ ID NO: 26544 - DNA, 25 bp, S. cerevisiae
gcggctcagacgaatgctacttttt

SEQ ID NO: 26545 - DNA, 25 bp, S. cerevisiae
gctggccaatatgcctcatttggtt

SEQ ID NO: 26546 - DNA, 25 bp, S. cerevisiae
tccggaaaccttgcttggactttga

SEQ ID NO: 26547 - DNA, 25 bp, S. cerevisiae
gcggaaccccgtggatcgaattgat

SEQ ID NO: 26548 - DNA, 25 bp, S. cerevisiae
gctgcgtcggttcctaagaaatctt

SEQ ID NO: 26549 - DNA, 25 bp, S. cerevisiae
gctcaagaaatacccatatggactc

SEQ ID NO: 26550 - DNA, 25 bp, S. cerevisiae
gcgggtaataagttccagctctctt

SEQ ID NO: 26551 - DNA, 25 bp, S. cerevisiae
gctggaccaaattctacgcacatac

SEQ ID NO: 26552 - DNA, 25 bp, S. cerevisiae
gctgaaagaagtaaactcactctat

SEQ ID NO: 26553 - DNA, 25 bp, S. cerevisiae
gctgaaaagagagacgctttgctaa

SEQ ID NO: 26554 - DNA, 25 bp, S. cerevisiae
gctaccctgggaacgaattgctcat

SEQ ID NO: 26555 - DNA, 25 bp, S. cerevisiae
gcatgcgcaacgtgtggcctttggt

SEQ ID NO: 26556 - DNA, 25 bp, S. cerevisiae
gcacgcccgcgactggtttttagtt

SEQ ID NO: 26557 - DNA, 25 bp, S. cerevisiae
gctcctcccacactggtttggtcag

SEQ ID NO: 26558 - DNA, 25 bp, S. cerevisiae
gcatttggagttgttgagaggtact

SEQ ID NO: 26559 - DNA, 25 bp, S. cerevisiae
gctccggaggaacttcagggtcaat

SEQ ID NO: 26560 - DNA, 25 bp, S. cerevisiae
gctccgggtgtattaatggcgccaa

SEQ ID NO: 26561 - DNA, 25 bp, S. cerevisiae
gctgccgtggttgtgttacctcaaa

SEQ ID NO: 26562 - DNA, 25 bp, S. cerevisiae
gctgtgcacgtttacggtacaccaa

SEQ ID NO: 26563 - DNA, 25 bp, S. cerevisiae
gcttcaggtccgagtgcaaacgcta

SEQ ID NO: 26564 - DNA, 25 bp, S. cerevisiae
gctaaggtccgtctggcatatccta

SEQ ID NO: 26565 - DNA, 25 bp, S. cerevisiae
gcgtgtattcagttattggccttat

SEQ ID NO: 26566 - DNA, 25 bp, S. cerevisiae
gctgctgactgtgaacctattgaaa

SEQ ID NO: 26567 - DNA, 25 bp, S. cerevisiae
gctggacgcctgtgtgcaattgata

SEQ ID NO: 26568 - DNA, 25 bp, S. cerevisiae
gctggacccagaatgcgctagtaag

SEQ ID NO: 26569 - DNA, 25 bp, S. cerevisiae
gctggatcctcatagcttatcaaag

SEQ ID NO: 26570 - DNA, 25 bp, S. cerevisiae
gctgacgccagcattgtgcacgtaa

SEQ ID NO: 26571 - DNA, 25 bp, S. cerevisiae
gctgacagaccaactgctacggaat

SEQ ID NO: 26572 - DNA, 25 bp, S. cerevisiae
gctgccgctgaaggtccaatgaagg

SEQ ID NO: 26573 - DNA, 25 bp, S. cerevisiae
gctcggcgctgatgcaaacatggat

SEQ ID NO: 26574 - DNA, 25 bp, S. cerevisiae
gcggctgctggaaaacaatctgtaa

SEQ ID NO: 26575 - DNA, 25 bp, S. cerevisiae
gctggagttagcatatctacaattg

SEQ ID NO: 26576 - DNA, 25 bp, S. cerevisiae
gctgttctatacatacttcgagggt

SEQ ID NO: 26577 - DNA, 25 bp, S. cerevisiae
gcggtctctttcacttacgatggat

SEQ ID NO: 26578 - DNA, 25 bp, S. cerevisiae
gctggttcttgcctaagcacacaat

SEQ ID NO: 26579 - DNA, 25 bp, S. cerevisiae
gctggtttcctcaaaggccttggta

SEQ ID NO: 26580 - DNA, 25 bp, S. cerevisiae
gctggttcactcttaaacctgggtt

SEQ ID NO: 26581 - DNA, 25 bp, S. cerevisiae
gctttacagaaccacaaacccgtat

SEQ ID NO: 26582 - DNA, 25 bp, S. cerevisiae
gctgtctaccaagcatccaagtttg

SEQ ID NO: 26583 - DNA, 25 bp, S. cerevisiae
gctgctgccccagccaccactactt

SEQ ID NO: 26584 - DNA, 25 bp, S. cerevisiae
gctgccaatggagacaacactttgt

SEQ ID NO: 26585 - DNA, 25 bp, S. cerevisiae
gcggataaaccgatgtcttcactat

SEQ ID NO: 26586 - DNA, 25 bp, S. cerevisiae
gcggttaaccttagccaggctgctg

SEQ ID NO: 26587 - DNA, 25 bp, S. cerevisiae
gcggttccctccaacatatgggtaa

SEQ ID NO: 26588 - DNA, 25 bp, S. cerevisiae
gcggttcatcgctaatcacagaggg

SEQ ID NO: 26589 - DNA, 25 bp, S. cerevisiae
gctgtgtacatagacgatccgtgga

SEQ ID NO: 26590 - DNA, 25 bp, S. cerevisiae
tgacccaagttacaagtttacgcct

SEQ ID NO: 26591 - DNA, 25 bp, S. cerevisiae
gttgccaagttacaagattccccag

SEQ ID NO: 26592 - DNA, 25 bp, S. cerevisiae
gttgccggtttatcttaccagctag

SEQ ID NO: 26593 - DNA, 25 bp, S. cerevisiae
gctgtactatttgaacttaccccag

SEQ ID NO: 26594 - DNA, 25 bp, S. cerevisiae
gctaggtttagccaagtctgtccac

SEQ ID NO: 26595 - DNA, 25 bp, S. cerevisiae
gcggcgaggccagttatggtcacta

SEQ ID NO: 26596 - DNA, 25 bp, S. cerevisiae
gcggaagtactggatgtgtgtcaca

SEQ ID NO: 26597 - DNA, 25 bp, S. cerevisiae
gctggtgtggttcttcgtcgactac

SEQ ID NO: 26598 - DNA, 25 bp, S. cerevisiae
gctggttctggtctattgtttgtac

SEQ ID NO: 26599 - DNA, 25 bp, S. cerevisiae
gctgagggccaagaaaatgctgctt

SEQ ID NO: 26600 - DNA, 25 bp, S. cerevisiae
gctgagtcctcaaaaactattcttg

SEQ ID NO: 26601 - DNA, 25 bp, S. cerevisiae
gctgaaccctggagaaacatcttct

SEQ ID NO: 26602 - DNA, 25 bp, S. cerevisiae
gctaacccggtccacgattttgaat

SEQ ID NO: 26603 - DNA, 25 bp, S. cerevisiae
gctcccaagggcaaatggtattgta

SEQ ID NO: 26604 - DNA, 25 bp, S. cerevisiae
gctgtccaagctgctaacgtttcta

SEQ ID NO: 26605 - DNA, 25 bp, S. cerevisiae
gctgttcaagctattacctcttcaa

SEQ ID NO: 26606 - DNA, 25 bp, S. cerevisiae
gcttagacttctcacaagtggcaca

SEQ ID NO: 26607 - DNA, 25 bp, S. cerevisiae
gcttgggttgtccagcaaggccaaa

SEQ ID NO: 26608 - DNA, 25 bp, S. cerevisiae
gcggcttcgaaattcatcggtgact

SEQ ID NO: 26609 - DNA, 25 bp, S. cerevisiae
gctggcctacaatgttcttctggat

SEQ ID NO: 26610 - DNA, 25 bp, S. cerevisiae
gctggttacaagttatatggcctca

SEQ ID NO: 26611 - DNA, 25 bp, S. cerevisiae
gctggtgtacttcgtatagtcctga

SEQ ID NO: 26612 - DNA, 25 bp, S. cerevisiae
gctggtctgatttgttcaagtacat

SEQ ID NO: 26613 - DNA, 25 bp, S. cerevisiae
gctggcctgttctgtaagcaactat

SEQ ID NO: 26614 - DNA, 25 bp, S. cerevisiae
gctgatgtcttaactgcgttcttga

SEQ ID NO: 26615 - DNA, 25 bp, S. cerevisiae
gctggtcgctaatcgttgagtgcat

SEQ ID NO: 26616 - DNA, 25 bp, S. cerevisiae
gctggccattccatatgacgagttt

SEQ ID NO: 26617 - DNA, 25 bp, S. cerevisiae
gctgcccaaccaattgccggtttaa

SEQ ID NO: 26618 - DNA, 25 bp, S. cerevisiae
gctgccgcaaatggtacacggttta

SEQ ID NO: 26619 - DNA, 25 bp, S. cerevisiae
gctgacgaagatactacaactggtt

SEQ ID NO: 26620 - DNA, 25 bp, S. cerevisiae
gctggcgctaattctttgatctgtt

SEQ ID NO: 26621 - DNA, 25 bp, S. cerevisiae
gcggcggattcatttgatatcgtct

SEQ ID NO: 26622 - DNA, 25 bp, S. cerevisiae
gctggaacttcatacgcatgacata

SEQ ID NO: 26623 - DNA, 25 bp, S. cerevisiae
gcggatgtttatcatagcgagcaca

SEQ ID NO: 26624 - DNA, 25 bp, S. cerevisiae
gctggtttgtctccatacgaaagaa

SEQ ID NO: 26625 - DNA, 25 bp, S. cerevisiae
gctggtattacctaccgtgagaata

SEQ ID NO: 26626 - DNA, 25 bp, S. cerevisiae
gctccacaaaatgccggtaatactt

SEQ ID NO: 26627 - DNA, 25 bp, S. cerevisiae
gcttcggaaggttcgcgataaactt

SEQ ID NO: 26628 - DNA, 25 bp, S. cerevisiae
gcttcccaaggcgaccgtacaaaag

SEQ ID NO: 26629 - DNA, 25 bp, S. cerevisiae
gctccaaaaggtaccccacaaattg

SEQ ID NO: 26630 - DNA, 25 bp, S. cerevisiae
gctgctcaaaatagaaccgctcaaa

SEQ ID NO: 26631 - DNA, 25 bp, S. cerevisiae
gctgtagccaagacacatcctgata

SEQ ID NO: 26632 - DNA, 25 bp, S. cerevisiae
gcggctacaacaaatttattcaata

SEQ ID NO: 26633 - DNA, 25 bp, S. cerevisiae
gctggcctatcggatgttcctgaaa

SEQ ID NO: 26634 - DNA, 25 bp, S. cerevisiae
gcggaaatgcaggagttgcttacaa

SEQ ID NO: 26635 - DNA, 25 bp, S. cerevisiae
gcggcatcaagatcgatcgttacaa

SEQ ID NO: 26636 - DNA, 25 bp, S. cerevisiae
gctggcagcacctcaattggtacaa

SEQ ID NO: 26637 - DNA, 25 bp, S. cerevisiae
gctgcttcttcatccctgggagaca

SEQ ID NO: 26638 - DNA, 25 bp, S. cerevisiae
gctttgttgaccgattacttggaca

SEQ ID NO: 26639 - DNA, 25 bp, S. cerevisiae
gcattttcgacccttactactgtgg

SEQ ID NO: 26640 - DNA, 25 bp, S. cerevisiae
gctggaacccgggatgcgatacatt

SEQ ID NO: 26641 - DNA, 25 bp, S. cerevisiae
gcggagattatcatggatgcccttt

SEQ ID NO: 26642 - DNA, 25 bp, S. cerevisiae
gcggcaagatgtttgtgtcaccttc

SEQ ID NO: 26643 - DNA, 25 bp, S. cerevisiae
gcggttgagctgttgatggatcctt

SEQ ID NO: 26644 - DNA, 25 bp, S. cerevisiae
gctggatgtaccctctggatagcat

SEQ ID NO: 26645 - DNA, 25 bp, S. cerevisiae
gctgaaaagactcatgcgcaccctg

SEQ ID NO: 26646 - DNA, 25 bp, S. cerevisiae
gctgatctatttgacggcataacct

SEQ ID NO: 26647 - DNA, 25 bp, S. cerevisiae
gctgttttccccatagacactataa

SEQ ID NO: 26648 - DNA, 25 bp, S. cerevisiae
gctgctgctatgaaggccgttgtcg

SEQ ID NO: 26649 - DNA, 25 bp, S. cerevisiae
gctcctgatcatgtgtctgttgacg

SEQ ID NO: 26650 - DNA, 25 bp, S. cerevisiae
gcggcgatctgtatgttttcgttca

SEQ ID NO: 26651 - DNA, 25 bp, S. cerevisiae
gcggcatctataatttacgttacca

SEQ ID NO: 26652 - DNA, 25 bp, S. cerevisiae
gctgcatctgctactgaagacactc

SEQ ID NO: 26653 - DNA, 25 bp, S. cerevisiae
gctgtcgattagtctggcctttcaa

SEQ ID NO: 26654 - DNA, 25 bp, S. cerevisiae
gctggtattcactagaggctttcaa

SEQ ID NO: 26655 - DNA, 25 bp, S. cerevisiae
gctcgtcaaatgtagtggcgttacc

SEQ ID NO: 26656 - DNA, 25 bp, S. cerevisiae
gactacaacttagggcgtgctttcc

SEQ ID NO: 26657 - DNA, 25 bp, S. cerevisiae
gcggactagctttaagcgagccttt

SEQ ID NO: 26658 - DNA, 25 bp, S. cerevisiae
gctgttcagcaattgcgaacgtttt

SEQ ID NO: 26659 - DNA, 25 bp, S. cerevisiae
gctggagctgctacgaaagcggctt

SEQ ID NO: 26660 - DNA, 25 bp, S. cerevisiae
gctgaagctacccaagacgatgatt

SEQ ID NO: 26661 - DNA, 25 bp, S. cerevisiae
gctgtcgctcaagctgaatctatga

SEQ ID NO: 26662 - DNA, 25 bp, S. cerevisiae
gctgtcgtgaagcacttctccaaag

SEQ ID NO: 26663 - DNA, 25 bp, S. cerevisiae
gctgttgttcagcacaatgtccaaa

SEQ ID NO: 26664 - DNA, 25 bp, S. cerevisiae
gctgttgcagatgtttggtccgact

SEQ ID NO: 26665 - DNA, 25 bp, S. cerevisiae
gctgtagcgcaggatgtcattaaca

SEQ ID NO: 26666 - DNA, 25 bp, S. cerevisiae
gctcattcgtaagggccaattcggc

SEQ ID NO: 26667 - DNA, 25 bp, S. cerevisiae
gctgaacgctttgacaacactgaag

SEQ ID NO: 26668 - DNA, 25 bp, S. cerevisiae
gctggttcagatggaccggcctaaa

SEQ ID NO: 26669 - DNA, 25 bp, S. cerevisiae
gctggcttcaagaactttgcctgga

SEQ ID NO: 26670 - DNA, 25 bp, S. cerevisiae
gctgttgtagaaaccattccggcga

SEQ ID NO: 26671 - DNA, 25 bp, S. cerevisiae
gctgttcacaaaatctcttctcgag

SEQ ID NO: 26672 - DNA, 25 bp, S. cerevisiae
gctgatactaaagatgtcgtccctg

SEQ ID NO: 26673 - DNA, 25 bp, S. cerevisiae
gctaatcaaaatattcctcccgaat

SEQ ID NO: 26674 - DNA, 25 bp, S. cerevisiae
gctgaaatttttcttgcatcccaga

SEQ ID NO: 26675 - DNA, 25 bp, S. cerevisiae
gctatgggctattttttcaccgtga

SEQ ID NO: 26676 - DNA, 25 bp, S. cerevisiae
gctgccgtatttagtggccgctaat

SEQ ID NO: 26677 - DNA, 25 bp, S. cerevisiae
gctgcactatatatgaaggcgctaa

SEQ ID NO: 26678 - DNA, 25 bp, S. cerevisiae
gctgcattattgatacggtggctga

SEQ ID NO: 26679 - DNA, 25 bp, S. cerevisiae
gctggatttatttagcggcgccgca

SEQ ID NO: 26680 - DNA, 25 bp, S. cerevisiae
gctggttcattttgggctgtcctga

SEQ ID NO: 26681 - DNA, 25 bp, S. cerevisiae
gctggcgaactgttgtgcgagtaca

SEQ ID NO: 26682 - DNA, 25 bp, S. cerevisiae
gctggtacgctgttgatggacttca

SEQ ID NO: 26683 - DNA, 25 bp, S. cerevisiae
gctgggtgcctttatgattccacaa

SEQ ID NO: 26684 - DNA, 25 bp, S. cerevisiae
gctgtcgggctaacgatatcgtcaa

SEQ ID NO: 26685 - DNA, 25 bp, S. cerevisiae
gctgctgccgccaccgttagatcta

SEQ ID NO: 26686 - DNA, 25 bp, S. cerevisiae
gctgatccgccacaagttattctat

SEQ ID NO: 26687 - DNA, 25 bp, S. cerevisiae
gctgatgccgccaagaaggctttat

SEQ ID NO: 26688 - DNA, 25 bp, S. cerevisiae
gctgggtcatgagtctatcgtttaa

SEQ ID NO: 26689 - DNA, 25 bp, S. cerevisiae
gctggtgcttttgatctgttgacga

SEQ ID NO: 26690 - DNA, 25 bp, S. cerevisiae
gctggctattccaagcatcttacta

SEQ ID NO: 26691 - DNA, 25 bp, S. cerevisiae
gctggtatatcatatgctgcatatt

SEQ ID NO: 26692 - DNA, 25 bp, S. cerevisiae
gctgctgcccatagagatgcttact

SEQ ID NO: 26693 - DNA, 25 bp, S. cerevisiae
gctgcccatgcaatggttccatttt

SEQ ID NO: 26694 - DNA, 25 bp, S. cerevisiae
gctgcccatcgaaatacttttgttg

SEQ ID NO: 26695 - DNA, 25 bp, S. cerevisiae
gctggaaaaactactctctggtggt

SEQ ID NO: 26696 - DNA, 25 bp, S. cerevisiae
gctggatttcccatcatttttggta

SEQ ID NO: 26697 - DNA, 25 bp, S. cerevisiae
gctggttatacacccttttacgata

SEQ ID NO: 26698 - DNA, 25 bp, S. cerevisiae
gctcgtgtggttgccgttaaagctg

SEQ ID NO: 26699 - DNA, 25 bp, S. cerevisiae
gctgtcattgcactcattaaccatt

SEQ ID NO: 26700 - DNA, 25 bp, S. cerevisiae
gctggatgcttcacatatgttgcta

SEQ ID NO: 26701 - DNA, 25 bp, S. cerevisiae
gctgtgcaacgctttgaacgctcta

SEQ ID NO: 26702 - DNA, 25 bp, S. cerevisiae
gctccaaagtctgacaatgtctact

SEQ ID NO: 26703 - DNA, 25 bp, S. cerevisiae
gctggacttcttggacaatgttgcc

SEQ ID NO: 26704 - DNA, 25 bp, S. cerevisiae
gctggttctaatggattgttcgctt

SEQ ID NO: 26705 - DNA, 25 bp, S. cerevisiae
gctggttaagtgcatcgttcctgat

SEQ ID NO: 26706 - DNA, 25 bp, S. cerevisiae
gctgatttgacaccttcttacttat

SEQ ID NO: 26707 - DNA, 25 bp, S. cerevisiae
gctgtttccgatactgtcaaggtga

SEQ ID NO: 26708 - DNA, 25 bp, S. cerevisiae
gctgatattcgtaactgtgcaactg

SEQ ID NO: 26709 - DNA, 25 bp, S. cerevisiae
gctcttatgatgtatggtgctccga

SEQ ID NO: 26710 - DNA, 25 bp, S. cerevisiae
gctgtacgattgttggatcacgcaa

SEQ ID NO: 26711 - DNA, 25 bp, S. cerevisiae
gctggcctttgattgccatcaacaa

SEQ ID NO: 26712 - DNA, 25 bp, S. cerevisiae
gctggctttttcttatgcagagaac

SEQ ID NO: 26713 - DNA, 25 bp, S. cerevisiae
gctcctttttattaacacaccatgg

SEQ ID NO: 26714 - DNA, 25 bp, S. cerevisiae
gcagccgtagctgtggaaagttcga

SEQ ID NO: 26715 - DNA, 25 bp, S. cerevisiae
gctgcacataacgtaactgaacctg

SEQ ID NO: 26716 - DNA, 25 bp, S. cerevisiae
gctgccaacgctgaagctaaaggtt

SEQ ID NO: 26717 - DNA, 25 bp, S. cerevisiae
gctctcgttcccaagctgaaagttt

SEQ ID NO: 26718 - DNA, 25 bp, S. cerevisiae
gctgccggtcaacatcgagaatcta

SEQ ID NO: 26719 - DNA, 25 bp, S. cerevisiae
gctggcgcgtattttctgagcagaa

SEQ ID NO: 26720 - DNA, 25 bp, S. cerevisiae
gctgtctgcgtttatatccgactac

SEQ ID NO: 26721 - DNA, 25 bp, S. cerevisiae
gctgtcagttcattgccgaagttct

SEQ ID NO: 26722 - DNA, 25 bp, S. cerevisiae
gctgtacatctgctgctcaaaattt

SEQ ID NO: 26723 - DNA, 25 bp, S. cerevisiae
gctactaaggcatccaagaatcatg

SEQ ID NO: 26724 - DNA, 25 bp, S. cerevisiae
gctgcagccggcgaattagttgaac

SEQ ID NO: 26725 - DNA, 25 bp, S. cerevisiae
gctgcaggcaacgttattgtccatg

SEQ ID NO: 26726 - DNA, 25 bp, S. cerevisiae
gctgagaaactcattttggctaaaa

SEQ ID NO: 26727 - DNA, 25 bp, S. cerevisiae
gctggtgttttcttggctaaccaca

SEQ ID NO: 26728 - DNA, 25 bp, S. cerevisiae
gcttgggttctctggcaatccaata

SEQ ID NO: 26729 - DNA, 25 bp, S. cerevisiae
gctgtacctctctttggacaacaat

SEQ ID NO: 26730 - DNA, 25 bp, S. cerevisiae
gctaggatcctacgtacgttcctaa

SEQ ID NO: 26731 - DNA, 25 bp, S. cerevisiae
gctaagactcttcttcgttaccaaa

SEQ ID NO: 26732 - DNA, 25 bp, S. cerevisiae
gctaactttgttgccgctgaatccg

SEQ ID NO: 26733 - DNA, 25 bp, S. cerevisiae
gctaacactagattggccagataca

SEQ ID NO: 26734 - DNA, 25 bp, S. cerevisiae
gctgattatcctaacgctacttcgc

SEQ ID NO: 26735 - DNA, 25 bp, S. cerevisiae
gctagtttagttttgacacccgtgg

SEQ ID NO: 26736 - DNA, 25 bp, S. cerevisiae
gctacttctggtaaggacgcctggg

SEQ ID NO: 26737 - DNA, 25 bp, S. cerevisiae
gctgaagttgttacgttcacaagta

SEQ ID NO: 26738 - DNA, 25 bp, S. cerevisiae
gctgattggactcaccacattgaaa

SEQ ID NO: 26739 - DNA, 25 bp, S. cerevisiae
gctggtgccttgtcattactatttg

SEQ ID NO: 26740 - DNA, 25 bp, S. cerevisiae
gctggatgctggttcattctggaat

SEQ ID NO: 26741 - DNA, 25 bp, S. cerevisiae
gctggattcactctcagcacgaatt

SEQ ID NO: 26742 - DNA, 25 bp, S. cerevisiae
gctgtcactattcgtaccagaaagg

SEQ ID NO: 26743 - DNA, 25 bp, S. cerevisiae
gctccgatttattgacccgtggtat

SEQ ID NO: 26744 - DNA, 25 bp, S. cerevisiae
gcttcggtaactgccaatgtggtag

SEQ ID NO: 26745 - DNA, 25 bp, S. cerevisiae
gctcacggtaactccttgagaggtt

SEQ ID NO: 26746 - DNA, 25 bp, S. cerevisiae
gctcgttgccaatatcgctatggga

SEQ ID NO: 26747 - DNA, 25 bp, S. cerevisiae
gctgcggcaacgagtcctattgata

SEQ ID NO: 26748 - DNA, 25 bp, S. cerevisiae
gctggatctattttcaatgccgttg

SEQ ID NO: 26749 - DNA, 25 bp, S. cerevisiae
gctgtccatgtttctaatccgttta

SEQ ID NO: 26750 - DNA, 25 bp, S. cerevisiae
gctgttgattttctttgcttcagta

SEQ ID NO: 26751 - DNA, 25 bp, S. cerevisiae
gctgaactccgttgtcgtgcaaaga

SEQ ID NO: 26752 - DNA, 25 bp, S. cerevisiae
gctctaaccgcttttgctgacgata

SEQ ID NO: 26753 - DNA, 25 bp, S. cerevisiae
gctgtcgacagcgtttttgaacaaa

SEQ ID NO: 26754 - DNA, 25 bp, S. cerevisiae
gctgcgatagcacctccgaagaatg

SEQ ID NO: 26755 - DNA, 25 bp, S. cerevisiae
gctgcatgcccattctcaaagatga

SEQ ID NO: 26756 - DNA, 25 bp, S. cerevisiae
gctgatggactgttcttagtaactc

SEQ ID NO: 26757 - DNA, 25 bp, S. cerevisiae
gctgctggagtttcatatggtacct

SEQ ID NO: 26758 - DNA, 25 bp, S. cerevisiae
gctgcgttatcttcatcaggtaatg

SEQ ID NO: 26759 - DNA, 25 bp, S. cerevisiae
gctgttaattctcgtgctatgtggt

SEQ ID NO: 26760 - DNA, 25 bp, S. cerevisiae
gctgcatttagttagatcattgggt

SEQ ID NO: 26761 - DNA, 25 bp, S. cerevisiae
gctccttggagcgtaaagatcgtaa

SEQ ID NO: 26762 - DNA, 25 bp, S. cerevisiae
gctctcttgccagcttagagtctta

SEQ ID NO: 26763 - DNA, 25 bp, S. cerevisiae
gctcctgatgtgctaatgggttcta

SEQ ID NO: 26764 - DNA, 25 bp, S. cerevisiae
gctcgcctgtggagggtttctaaat

SEQ ID NO: 26765 - DNA, 25 bp, S. cerevisiae
gctcactcgatgtagttagctttca

SEQ ID NO: 26766 - DNA, 25 bp, S. cerevisiae
gctcctacttgcttgttattccaaa

SEQ ID NO: 26767 - DNA, 25 bp, S. cerevisiae
gctgttgccttatttctactacaca

SEQ ID NO: 26768 - DNA, 25 bp, S. cerevisiae
gctggtgcctttgttgactttcata

SEQ ID NO: 26769 - DNA, 25 bp, S. cerevisiae
gctgggcctttgatattctttttgt

SEQ ID NO: 26770 - DNA, 25 bp, S. cerevisiae
gctggtgttgctatgttattcttat

SEQ ID NO: 26771 - DNA, 25 bp, S. cerevisiae
gctgaagccttctttgaatactgtt

SEQ ID NO: 26772 - DNA, 25 bp, S. cerevisiae
gctgaagcttctatcgacaacctaa

SEQ ID NO: 26773 - DNA, 25 bp, S. cerevisiae
gctgcaagcatgactattccgaggt

SEQ ID NO: 26774 - DNA, 25 bp, S. cerevisiae
gctgctcactgatgatcgatgtagt

SEQ ID NO: 26775 - DNA, 25 bp, S. cerevisiae
gctgccactgctaccggtattaagg

SEQ ID NO: 26776 - DNA, 25 bp, S. cerevisiae
gctgatttgcacgataggtcttcac

SEQ ID NO: 26777 - DNA, 25 bp, S. cerevisiae
gctgcagtgtcagaagttgcccaat

SEQ ID NO: 26778 - DNA, 25 bp, S. cerevisiae
gctgaattccaagcattatccatat

SEQ ID NO: 26779 - DNA, 25 bp, S. cerevisiae
gctgatatctcttctgttgaccaaa

SEQ ID NO: 26780 - DNA, 25 bp, S. cerevisiae
ggtccagtacgttctgagacagcac

SEQ ID NO: 26781 - DNA, 25 bp, S. cerevisiae
gctgaccagccagcttctgataata

SEQ ID NO: 26782 - DNA, 25 bp, S. cerevisiae
gctgacgccatagaccatgacgata

SEQ ID NO: 26783 - DNA, 25 bp, S. cerevisiae
gctgccggtgaaactacatctgtat

SEQ ID NO: 26784 - DNA, 25 bp, S. cerevisiae
gctgccggtgcatactttctaagta

SEQ ID NO: 26785 - DNA, 25 bp, S. cerevisiae
gctgttgcgtggttttttgtatact

SEQ ID NO: 26786 - DNA, 25 bp, S. cerevisiae
gctgattgaattcccttatttacca

SEQ ID NO: 26787 - DNA, 25 bp, S. cerevisiae
gggtacattttcattctttgccggt

SEQ ID NO: 26788 - DNA, 25 bp, S. cerevisiae
gctactacctttctctaggatctgg

SEQ ID NO: 26789 - DNA, 25 bp, S. cerevisiae
gctgaaaccggatttgacattattt

SEQ ID NO: 26790 - DNA, 25 bp, S. cerevisiae
gctccgatcggcttttagtttgttg

SEQ ID NO: 26791 - DNA, 25 bp, S. cerevisiae
gctgtctagcgggtttatgtttatg

SEQ ID NO: 26792 - DNA, 25 bp, S. cerevisiae
gctgttggccagatgcttattcaat

SEQ ID NO: 26793 - DNA, 25 bp, S. cerevisiae
gctgcttcagggtcagttttcagat

SEQ ID NO: 26794 - DNA, 25 bp, S. cerevisiae
gctgattcagggtgattccgcattt

SEQ ID NO: 26795 - DNA, 25 bp, S. cerevisiae
gctcctaacgggtcttcaatattca

SEQ ID NO: 26796 - DNA, 25 bp, S. cerevisiae
gctacgaagtggtctctgtggcaac

SEQ ID NO: 26797 - DNA, 25 bp, S. cerevisiae
gctgacgacccgattgttgagacca

SEQ ID NO: 26798 - DNA, 25 bp, S. cerevisiae
gctccaatccgcctttcaagagaaa

SEQ ID NO: 26799 - DNA, 25 bp, S. cerevisiae
gctgacctatcactactagccaagg

SEQ ID NO: 26800 - DNA, 25 bp, S. cerevisiae
gctgcagtgacatctaccctaaagg

SEQ ID NO: 26801 - DNA, 25 bp, S. cerevisiae
gctgaagacgaatccttggcgaaat

SEQ ID NO: 26802 - DNA, 25 bp, S. cerevisiae
gctctaactctatcgaaggtcctat

SEQ ID NO: 26803 - DNA, 25 bp, S. cerevisiae
gctccagaattagcggacctcttga

SEQ ID NO: 26804 - DNA, 25 bp, S. cerevisiae
gctccaaaacccaatcaagcgttgt

SEQ ID NO: 26805 - DNA, 25 bp, S. cerevisiae
gctccaaaatccgataacgtctatt

SEQ ID NO: 26806 - DNA, 25 bp, S. cerevisiae
gctgctttgagaaccgtcaagtctt

SEQ ID NO: 26807 - DNA, 25 bp, S. cerevisiae
gctgcttgtcaaggtccaaattctt

SEQ ID NO: 26808 - DNA, 25 bp, S. cerevisiae
gctgttgacaactgtgctatttgca

SEQ ID NO: 26809 - DNA, 25 bp, S. cerevisiae
gctaaggctcaaggtgttgctgttc

SEQ ID NO: 26810 - DNA, 25 bp, S. cerevisiae
gctgacgtgccattagaatctgctg

SEQ ID NO: 26811 - DNA, 25 bp, S. cerevisiae
gctacggctcttcaatcattggttg

SEQ ID NO: 26812 - DNA, 25 bp, S. cerevisiae
gctccgttgtgtggatttggtcaaa

SEQ ID NO: 26813 - DNA, 25 bp, S. cerevisiae
gctgtcatcgggttctattccaaaa

SEQ ID NO: 26814 - DNA, 25 bp, S. cerevisiae
gctgtcatagtgcagttattaccat

SEQ ID NO: 26815 - DNA, 25 bp, S. cerevisiae
gctgttagctctattatcacaccat

SEQ ID NO: 26816 - DNA, 25 bp, S. cerevisiae
gctgttgtcgctttattactgctat

SEQ ID NO: 26817 - DNA, 25 bp, S. cerevisiae
gctgttattgctgcattgtccgaaa

SEQ ID NO: 26818 - DNA, 25 bp, S. cerevisiae
gctgttgttgcactatctaccgaaa

SEQ ID NO: 26819 - DNA, 25 bp, S. cerevisiae
gctctatatgtggacgcttaccgaa

SEQ ID NO: 26820 - DNA, 25 bp, S. cerevisiae
gctgatgccgcataacatgttttca

SEQ ID NO: 26821 - DNA, 25 bp, S. cerevisiae
gctgtatccacaaactgcaacttca

SEQ ID NO: 26822 - DNA, 25 bp, S. cerevisiae
gctgaatcccatagactatacgtta

SEQ ID NO: 26823 - DNA, 25 bp, S. cerevisiae
gctgaatcccatagattgtacgtca

SEQ ID NO: 26824 - DNA, 25 bp, S. cerevisiae
gctgaaccaggtattatcgctcaat

SEQ ID NO: 26825 - DNA, 25 bp, S. cerevisiae
gctcaagctcagtaagttcacggga

SEQ ID NO: 26826 - DNA, 25 bp, S. cerevisiae
gctgcagtcgaaatatgttccgggc

SEQ ID NO: 26827 - DNA, 25 bp, S. cerevisiae
gctagtctagcaattttaaggtcca

SEQ ID NO: 26828 - DNA, 25 bp, S. cerevisiae
gctgctgctgaaaatgacttgaaaa

SEQ ID NO: 26829 - DNA, 25 bp, S. cerevisiae
gctgccccattgcaattgaaatcaa

SEQ ID NO: 26830 - DNA, 25 bp, S. cerevisiae
gctgccggttggtccattactgaag

SEQ ID NO: 26831 - DNA, 25 bp, S. cerevisiae
gctcccgtaccacatgtatctagag

SEQ ID NO: 26832 - DNA, 25 bp, S. cerevisiae
gctccgctgctaccgttaattgaaa

SEQ ID NO: 26833 - DNA, 25 bp, S. cerevisiae
gctaccgattcgtgggacatgtgtt

SEQ ID NO: 26834 - DNA, 25 bp, S. cerevisiae
gctgaccttaccgtagggcaatttg

SEQ ID NO: 26835 - DNA, 25 bp, S. cerevisiae
gctaccttacagaaacgtcaattgg

SEQ ID NO: 26836 - DNA, 25 bp, S. cerevisiae
gctgccctttcacaattgacgtata

SEQ ID NO: 26837 - DNA, 25 bp, S. cerevisiae
gctcctgttcactctattggattgt

SEQ ID NO: 26838 - DNA, 25 bp, S. cerevisiae
gctactttggcgattgagctcacca

SEQ ID NO: 26839 - DNA, 25 bp, S. cerevisiae
gctcatgccttacaatctagggcta

SEQ ID NO: 26840 - DNA, 25 bp, S. cerevisiae
gctacaagttggatgcacgtgttca

SEQ ID NO: 26841 - DNA, 25 bp, S. cerevisiae
gctgcaccagctaccaccactttat

SEQ ID NO: 26842 - DNA, 25 bp, S. cerevisiae
gctgctcaagcaagactccgtaaat

SEQ ID NO: 26843 - DNA, 25 bp, S. cerevisiae
gctgatcaacaagctttggcacgtg

SEQ ID NO: 26844 - DNA, 25 bp, S. cerevisiae
gctcatcataaacattaatcattgg

SEQ ID NO: 26845 - DNA, 25 bp, S. cerevisiae
gctgctgtagttcaccaagctaact

SEQ ID NO: 26846 - DNA, 25 bp, S. cerevisiae
gctccacttttttcgcatataggtc

SEQ ID NO: 26847 - DNA, 25 bp, S. cerevisiae
gctgacacttttcctcgttgggaag

SEQ ID NO: 26848 - DNA, 25 bp, S. cerevisiae
gctgacactgataatttctttggta

SEQ ID NO: 26849 - DNA, 25 bp, S. cerevisiae
gctactaatcctttgggcagtgcac

SEQ ID NO: 26850 - DNA, 25 bp, S. cerevisiae
gctgcaatagccacctacttgaaca

SEQ ID NO: 26851 - DNA, 25 bp, S. cerevisiae
gctaaaggtttagttgcttaccatc

SEQ ID NO: 26852 - DNA, 25 bp, S. cerevisiae
gctaaaggtttagttgcttaccatc

SEQ ID NO: 26853 - DNA, 25 bp, S. cerevisiae
gctaaggcgatttggttctggaact

SEQ ID NO: 26854 - DNA, 25 bp, S. cerevisiae
gctgaagtccatatcaatgccttgt

SEQ ID NO: 26855 - DNA, 25 bp, S. cerevisiae
gctgaacttcataaactgcatccaa

SEQ ID NO: 26856 - DNA, 25 bp, S. cerevisiae
gctaccttcgcttcttgagttgaag

SEQ ID NO: 26857 - DNA, 25 bp, S. cerevisiae
gctgacctttcttctaacacgaagg

SEQ ID NO: 26858 - DNA, 25 bp, S. cerevisiae
gctcccgttcgtcaaccaatgaaag

SEQ ID NO: 26859 - DNA, 25 bp, S. cerevisiae
gctccagtaccgttaaccagtaaat

SEQ ID NO: 26860 - DNA, 25 bp, S. cerevisiae
gctgcttcaatattattcgaccact

SEQ ID NO: 26861 - DNA, 25 bp, S. cerevisiae
gctgcttcacttttgggcatgtcca

SEQ ID NO: 26862 - DNA, 25 bp, S. cerevisiae
gctgcttccgaactgagcgattcta

SEQ ID NO: 26863 - DNA, 25 bp, S. cerevisiae
gctgaagtaaagcatcctcttgagt

SEQ ID NO: 26864 - DNA, 25 bp, S. cerevisiae
gctagtcttaaaatccttctgcaat

SEQ ID NO: 26865 - DNA, 25 bp, S. cerevisiae
gcttccattttgtctaacgccgaaa

SEQ ID NO: 26866 - DNA, 25 bp, S. cerevisiae
gctctactccaatcactagatgcga

SEQ ID NO: 26867 - DNA, 25 bp, S. cerevisiae
gctgcttgcctattagcgttgataa

SEQ ID NO: 26868 - DNA, 25 bp, S. cerevisiae
gctgctgcgcagttttatgcaatga

SEQ ID NO: 26869 - DNA, 25 bp, S. cerevisiae
gctccgctgatggtgcagacagtga

SEQ ID NO: 26870 - DNA, 25 bp, S. cerevisiae
gctccgcatatgttgatatcaccag

SEQ ID NO: 26871 - DNA, 25 bp, S. cerevisiae
gctcgtgtagtcatcaactcggtaa

SEQ ID NO: 26872 - DNA, 25 bp, S. cerevisiae
gctagttactatactccacgtagaa

SEQ ID NO: 26873 - DNA, 25 bp, S. cerevisiae
gctcaaaatttgtcgctgctatcta

SEQ ID NO: 26874 - DNA, 25 bp, S. cerevisiae
gctgagaccctacaacggcaaaatt

SEQ ID NO: 26875 - DNA, 25 bp, S. cerevisiae
gctgaaggtatacacgcggctgaaa

SEQ ID NO: 26876 - DNA, 25 bp, S. cerevisiae
gctcgggctaaatccagtctacaac

SEQ ID NO: 26877 - DNA, 25 bp, S. cerevisiae
gctctggtggaaaccgcgcgtgaaa

SEQ ID NO: 26878 - DNA, 25 bp, S. cerevisiae
gcatccaaggaagctcgccaagaaa

SEQ ID NO: 26879 - DNA, 25 bp, S. cerevisiae
gctgcagagatgatcaactcccaaa

SEQ ID NO: 26880 - DNA, 25 bp, S. cerevisiae
gcatcagatgaactggtcactcagg

SEQ ID NO: 26881 - DNA, 25 bp, S. cerevisiae
gctgcttcgactacatcattggtga

SEQ ID NO: 26882 - DNA, 25 bp, S. cerevisiae
gctgacagagatgaatcttctccat

SEQ ID NO: 26883 - DNA, 25 bp, S. cerevisiae
gctgaagctcgtgctgccgaagaaa

SEQ ID NO: 26884 - DNA, 25 bp, S. cerevisiae
gctgagcttcctgcactagaggtat

SEQ ID NO: 26885 - DNA, 25 bp, S. cerevisiae
gctgagctattcgttctaagttctt

SEQ ID NO: 26886 - DNA, 25 bp, S. cerevisiae
gctctctgccagtattagtgggaaa

SEQ ID NO: 26887 - DNA, 25 bp, S. cerevisiae
gctcttccatgtctcagtagtcaat

SEQ ID NO: 26888 - DNA, 25 bp, S. cerevisiae
gctcgcccgggcaattgacaagaga

SEQ ID NO: 26889 - DNA, 25 bp, S. cerevisiae
gctgctctcatccactatgtattga

SEQ ID NO: 26890 - DNA, 25 bp, S. cerevisiae
gctgctgcaatcctctatcataaat

SEQ ID NO: 26891 - DNA, 25 bp, S. cerevisiae
gctgcatatttgaatgtggccgctc

SEQ ID NO: 26892 - DNA, 25 bp, S. cerevisiae
gctgcggtacagtctgaaattctaa

SEQ ID NO: 26893 - DNA, 25 bp, S. cerevisiae
gctgcttgtaaaactattgcccctg

SEQ ID NO: 26894 - DNA, 25 bp, S. cerevisiae
gctccgacaacaactatatgaccca

SEQ ID NO: 26895 - DNA, 25 bp, S. cerevisiae
gctgccggaatcgtctgatcaagtg

SEQ ID NO: 26896 - DNA, 25 bp, S. cerevisiae
gctgcacagaaacttctcgatccaa

SEQ ID NO: 26897 - DNA, 25 bp, S. cerevisiae
gctgaatcagctttcgctcgaatat

SEQ ID NO: 26898 - DNA, 25 bp, S. cerevisiae
gctgaatatgctcatcctgctgaaa

SEQ ID NO: 26899 - DNA, 25 bp, S. cerevisiae
gctgccttgtgggttgagcgataca

SEQ ID NO: 26900 - DNA, 25 bp, S. cerevisiae
gctgcctgtcttgtctggtatagaa

SEQ ID NO: 26901 - DNA, 25 bp, S. cerevisiae
gctgcggatccatgtttgctatcaa

SEQ ID NO: 26902 - DNA, 25 bp, S. cerevisiae
gctaattcatagtttgccacgtaaa

SEQ ID NO: 26903 - DNA, 25 bp, S. cerevisiae
gctgccttagagctatgccacgata

SEQ ID NO: 26904 - DNA, 25 bp, S. cerevisiae
gctgccttacagtttcattctgatg

SEQ ID NO: 26905 - DNA, 25 bp, S. cerevisiae
gctgcatttgatacacatcccgtat

SEQ ID NO: 26906 - DNA, 25 bp, S. cerevisiae
gctcattgcaattacagcgcggtgt

SEQ ID NO: 26907 - DNA, 25 bp, S. cerevisiae
gctccatgagatccaaggccgacag

SEQ ID NO: 26908 - DNA, 25 bp, S. cerevisiae
gctccatcagcaacaagcacacatt

SEQ ID NO: 26909 - DNA, 25 bp, S. cerevisiae
gctgcccctgctgggcaagtatata

SEQ ID NO: 26910 - DNA, 25 bp, S. cerevisiae
gctgcgctcaaattgccatactgga

SEQ ID NO: 26911 - DNA, 25 bp, S. cerevisiae
gctctgtcattgttcactacggtac

SEQ ID NO: 26912 - DNA, 25 bp, S. cerevisiae
gctcatgttccaaactacgctgtta

SEQ ID NO: 26913 - DNA, 25 bp, S. cerevisiae
gctcgagcactaccgcagatatgaa

SEQ ID NO: 26914 - DNA, 25 bp, S. cerevisiae
gctccttctgagacgtcaacacaag

SEQ ID NO: 26915 - DNA, 25 bp, S. cerevisiae
gctgctcttcaaatcacggacgcaa

SEQ ID NO: 26916 - DNA, 25 bp, S. cerevisiae
gctgctttcatcttaagtgtgccaa

SEQ ID NO: 26917 - DNA, 25 bp, S. cerevisiae
gctgcgcaacatttttgtgcctgaa

SEQ ID NO: 26918 - DNA, 25 bp, S. cerevisiae
gctgcatcaccgtttgttgatacat

SEQ ID NO: 26919 - DNA, 25 bp, S. cerevisiae
gctaccggtgccaagcgtgctcaat

SEQ ID NO: 26920 - DNA, 25 bp, S. cerevisiae
gctaacgacgtcaaattctctgatg

SEQ ID NO: 26921 - DNA, 25 bp, S. cerevisiae
gctcaagtacggcacgtccatatgt

SEQ ID NO: 26922 - DNA, 25 bp, S. cerevisiae
gctcggagctggttaaccctattga

SEQ ID NO: 26923 - DNA, 25 bp, S. cerevisiae
gctcttcacatcaaaaattcccact

SEQ ID NO: 26924 - DNA, 25 bp, S. cerevisiae
gctgctacacaacaaattctccatt

SEQ ID NO: 26925 - DNA, 25 bp, S. cerevisiae
gctcttacagataaattcccgcttg

SEQ ID NO: 26926 - DNA, 25 bp, S. cerevisiae
gctctaacaagcatactggtcgtcc

SEQ ID NO: 26927 - DNA, 25 bp, S. cerevisiae
gctcaaatcaacttgggtgaccctc

SEQ ID NO: 26928 - DNA, 25 bp, S. cerevisiae
gctccattgctatctgtggtaccga

SEQ ID NO: 26929 - DNA, 25 bp, S. cerevisiae
gctgccaccactgatttgacttata

SEQ ID NO: 26930 - DNA, 25 bp, S. cerevisiae
gctgccatttatttgactgctgtgt

SEQ ID NO: 26931 - DNA, 25 bp, S. cerevisiae
gctgcttacctattattgaacgctg

SEQ ID NO: 26932 - DNA, 25 bp, S. cerevisiae
gctgcgggcgtctggttgaaatata

SEQ ID NO: 26933 - DNA, 25 bp, S. cerevisiae
gggtccctggttctgaaaataagag

SEQ ID NO: 26934 - DNA, 25 bp, S. cerevisiae
tggttcccggttcttggttcaagag

SEQ ID NO: 26935 - DNA, 25 bp, S. cerevisiae
ggtttccgggagcaattattcaaag

SEQ ID NO: 26936 - DNA, 25 bp, S. cerevisiae
gttttcccaggtgatactctaaagg

SEQ ID NO: 26937 - DNA, 25 bp, S. cerevisiae
gctacttcgccggatttcgctaaat

SEQ ID NO: 26938 - DNA, 25 bp, S. cerevisiae
gctaacttcgctgacaaatacgatg

SEQ ID NO: 26939 - DNA, 25 bp, S. cerevisiae
gctcacccgtttccagtagtgaatt

SEQ ID NO: 26940 - DNA, 25 bp, S. cerevisiae
gctgcagttctccttgacattatgt

SEQ ID NO: 26941 - DNA, 25 bp, S. cerevisiae
gctgccggagatacgaataattcat

SEQ ID NO: 26942 - DNA, 25 bp, S. cerevisiae
gctgccgaagttggtaatttcccta

SEQ ID NO: 26943 - DNA, 25 bp, S. cerevisiae
gctgctcaacacaacacttctgtat

SEQ ID NO: 26944 - DNA, 25 bp, S. cerevisiae
gctctggcgttattctttttcgtat

SEQ ID NO: 26945 - DNA, 25 bp, S. cerevisiae
gctgcctctaatcctgtatctaata

SEQ ID NO: 26946 - DNA, 25 bp, S. cerevisiae
gctgcttctttcatccactagaatt

SEQ ID NO: 26947 - DNA, 25 bp, S. cerevisiae
gctgcgttcttcatcgatgcgagaa

SEQ ID NO: 26948 - DNA, 25 bp, S. cerevisiae
gctgcttgatgcgtcatatcctgaa

SEQ ID NO: 26949 - DNA, 25 bp, S. cerevisiae
gctgctgcatcctcaacttggatta

SEQ ID NO: 26950 - DNA, 25 bp, S. cerevisiae
gctgcggccttttatgacaatctaa

SEQ ID NO: 26951 - DNA, 25 bp, S. cerevisiae
gctcctggtcagaatactttcacaa

SEQ ID NO: 26952 - DNA, 25 bp, S. cerevisiae
gctcctagtaggtatttccattgat

SEQ ID NO: 26953 - DNA, 25 bp, S. cerevisiae
gctccattaacgaagcttgctaaaa

SEQ ID NO: 26954 - DNA, 25 bp, S. cerevisiae
gctcgattaacacagcttggccaat

SEQ ID NO: 26955 - DNA, 25 bp, S. cerevisiae
gctgcttctgaatccgatgttgcta

SEQ ID NO: 26956 - DNA, 25 bp, S. cerevisiae
gctgctttagctaacgtctatgagt

SEQ ID NO: 26957 - DNA, 25 bp, S. cerevisiae
gcagtactagctctcaatcacagga

SEQ ID NO: 26958 - DNA, 25 bp, S. cerevisiae
gctaagctactgcaagtccgtaagt

SEQ ID NO: 26959 - DNA, 25 bp, S. cerevisiae
gctaattgtgctccagattcggtaa

SEQ ID NO: 26960 - DNA, 25 bp, S. cerevisiae
gctgccagattcctcatttgataaa

SEQ ID NO: 26961 - DNA, 25 bp, S. cerevisiae
gctgccgctttgactgattgtacaa

SEQ ID NO: 26962 - DNA, 25 bp, S. cerevisiae
gctgcctctttgttcttggacaagt

SEQ ID NO: 26963 - DNA, 25 bp, S. cerevisiae
gctccatctggttctgtcatggaca

SEQ ID NO: 26964 - DNA, 25 bp, S. cerevisiae
gctgccatctggtttcaatgccaaa

SEQ ID NO: 26965 - DNA, 25 bp, S. cerevisiae
gctcgcttgagcttggcagaacaat

SEQ ID NO: 26966 - DNA, 25 bp, S. cerevisiae
gcattggtaccataaaagcttctat

SEQ ID NO: 26967 - DNA, 25 bp, S. cerevisiae
gctcagtagaccgtaaaatcttcgt

SEQ ID NO: 26968 - DNA, 25 bp, S. cerevisiae
gctctgagcctcatgatacggaact

SEQ ID NO: 26969 - DNA, 25 bp, S. cerevisiae
gctcatgcagcgttcttgaaggcaa

SEQ ID NO: 26970 - DNA, 25 bp, S. cerevisiae
gctctccaggtgatgatggcgccat

SEQ ID NO: 26971 - DNA, 25 bp, S. cerevisiae
gctcctcatttggatatggctcttg

SEQ ID NO: 26972 - DNA, 25 bp, S. cerevisiae
gctgctttggcaaatctatgttcaa

SEQ ID NO: 26973 - DNA, 25 bp, S. cerevisiae
gctctctgggctggattggtgctaa

SEQ ID NO: 26974 - DNA, 25 bp, S. cerevisiae
gctcctgccgaacatactcatttat

SEQ ID NO: 26975 - DNA, 25 bp, S. cerevisiae
gctcctgctcccttatataatacat

SEQ ID NO: 26976 - DNA, 25 bp, S. cerevisiae
gctgcccctggattcaataacgatt

SEQ ID NO: 26977 - DNA, 25 bp, S. cerevisiae
gctccaactggccacacattaagat

SEQ ID NO: 26978 - DNA, 25 bp, S. cerevisiae
gctcacatccgctacataagacatt

SEQ ID NO: 26979 - DNA, 25 bp, S. cerevisiae
gctcggcacagcgactggatgataa

SEQ ID NO: 26980 - DNA, 25 bp, S. cerevisiae
gctcaaacgacactggtatacttca

SEQ ID NO: 26981 - DNA, 25 bp, S. cerevisiae
gcataaacccacctgtaatcttgat

SEQ ID NO: 26982 - DNA, 25 bp, S. cerevisiae
gctcccattacagccaattgaaatt

SEQ ID NO: 26983 - DNA, 25 bp, S. cerevisiae
gcagtagcttaccacgattaacgat

SEQ ID NO: 26984 - DNA, 25 bp, S. cerevisiae
gcttggtataccagagttacagata

SEQ ID NO: 26985 - DNA, 25 bp, S. cerevisiae
gcaaaaacagatacaggaatacgaa

SEQ ID NO: 26986 - DNA, 25 bp, S. cerevisiae
gctaaagccgtcaacgagctaccaa

SEQ ID NO: 26987 - DNA, 25 bp, S. cerevisiae
gctaaaccttttgcaacactcgagt

SEQ ID NO: 26988 - DNA, 25 bp, S. cerevisiae
gctagaatctttgttcaactccgga

SEQ ID NO: 26989 - DNA, 25 bp, S. cerevisiae
gctaatatttttaatcctccgccga

SEQ ID NO: 26990 - DNA, 25 bp, S. cerevisiae
gcatcaacaggctccctattatttt

SEQ ID NO: 26991 - DNA, 25 bp, S. cerevisiae
gctaaaatgcttggcgtacttctgt

SEQ ID NO: 26992 - DNA, 25 bp, S. cerevisiae
gctaatcctgatgcgaaagctttta

SEQ ID NO: 26993 - DNA, 25 bp, S. cerevisiae
gctagtctctaagcagaaactttcc

SEQ ID NO: 26994 - DNA, 25 bp, S. cerevisiae
gcaagtccaaaacgctaccttacag

SEQ ID NO: 26995 - DNA, 25 bp, S. cerevisiae
gcaaaccaattatgccaccggtgtg

SEQ ID NO: 26996 - DNA, 25 bp, S. cerevisiae
gctaagggtgatattccaggtgtta

SEQ ID NO: 26997 - DNA, 25 bp, S. cerevisiae
gctatagcgttccatttcctaggta

SEQ ID NO: 26998 - DNA, 25 bp, S. cerevisiae
gctagaatcgtacgcgtttactttg

SEQ ID NO: 26999 - DNA, 25 bp, S. cerevisiae
gctaaactagatcctaaaaccgcgg

SEQ ID NO: 27000 - DNA, 25 bp, S. cerevisiae
gctaaatttataccaaaggcgcggg

SEQ ID NO: 27001 - DNA, 25 bp, S. cerevisiae
gctaaattattacccttaccagatg

SEQ ID NO: 27002 - DNA, 25 bp, S. cerevisiae
gctacatggtatcattccgcgggag

SEQ ID NO: 27003 - DNA, 25 bp, S. cerevisiae
gcatcaattggaatctaccgccgga

SEQ ID NO: 27004 - DNA, 25 bp, S. cerevisiae
gctccaaccgatgcatatatctcgt

SEQ ID NO: 27005 - DNA, 25 bp, S. cerevisiae
gctgccttccgtgaaattgcttcta

SEQ ID NO: 27006 - DNA, 25 bp, S. cerevisiae
gcttttgttaggcaatgttactctt

SEQ ID NO: 27007 - DNA, 25 bp, S. cerevisiae
gctttatcacgacagaatcttcctc

SEQ ID NO: 27008 - DNA, 25 bp, S. cerevisiae
gctagtactcgtttacctacagcaa

SEQ ID NO: 27009 - DNA, 25 bp, S. cerevisiae
gctaaatggtgtacttcgctactaa

SEQ ID NO: 27010 - DNA, 25 bp, S. cerevisiae
gctcccgctttgtcaccagaagaaa

SEQ ID NO: 27011 - DNA, 25 bp, S. cerevisiae
gcaccaacttggcagtcctagaaga

SEQ ID NO: 27012 - DNA, 25 bp, S. cerevisiae
gctgcgatgatttcaccgacgttaa

SEQ ID NO: 27013 - DNA, 25 bp, S. cerevisiae
gctcagctgcatatcccgagaatta

SEQ ID NO: 27014 - DNA, 25 bp, S. cerevisiae
gttgacgaagtccaaggtaagaatt

SEQ ID NO: 27015 - DNA, 25 bp, S. cerevisiae
gactccaaggttgttaacttccacg

SEQ ID NO: 27016 - DNA, 25 bp, S. cerevisiae
tgtttggtggagtactgtccgttcc

SEQ ID NO: 27017 - DNA, 25 bp, S. cerevisiae
gctcttttgggctgtaacgtttcat

SEQ ID NO: 27018 - DNA, 25 bp, S. cerevisiae
gctcttttggcatctttacgtttta

SEQ ID NO: 27019 - DNA, 25 bp, S. cerevisiae
gctcttttggtatgcatgttgcgtc

SEQ ID NO: 27020 - DNA, 25 bp, S. cerevisiae
gctctttgctgccaagccatttgtt

SEQ ID NO: 27021 - DNA, 25 bp, S. cerevisiae
gctcctatcgcctatgtcattgtgg

SEQ ID NO: 27022 - DNA, 25 bp, S. cerevisiae
gctcgctatacaccagtcatgattt

SEQ ID NO: 27023 - DNA, 25 bp, S. cerevisiae
gctccttatccggtgtattctatga

SEQ ID NO: 27024 - DNA, 25 bp, S. cerevisiae
gctccttgggtggttattgtgctga

SEQ ID NO: 27025 - DNA, 25 bp, S. cerevisiae
gatccttggactctttattcgactt

SEQ ID NO: 27026 - DNA, 25 bp, S. cerevisiae
gctcgtcaaagacctctgtattcgt

SEQ ID NO: 27027 - DNA, 25 bp, S. cerevisiae
gctcgacctttctatttgacacatt

SEQ ID NO: 27028 - DNA, 25 bp, S. cerevisiae
gctccttcatacaacaatgcttctg

SEQ ID NO: 27029 - DNA, 25 bp, S. cerevisiae
gctccgagttcatagatgtgacgat

SEQ ID NO: 27030 - DNA, 25 bp, S. cerevisiae
gctccaggacagacctgtctgctga

SEQ ID NO: 27031 - DNA, 25 bp, S. cerevisiae
gctctcactggcgaagcttcagagt

SEQ ID NO: 27032 - DNA, 25 bp, S. cerevisiae
gctcgaggatgcatatcttccagta

SEQ ID NO: 27033 - DNA, 25 bp, S. cerevisiae
gctagttgtagccacgtcacataaa

SEQ ID NO: 27034 - DNA, 25 bp, S. cerevisiae
gctactcatggattgacggcctaag

SEQ ID NO: 27035 - DNA, 25 bp, S. cerevisiae
gctatctgcggttctattgcgggtg

SEQ ID NO: 27036 - DNA, 25 bp, S. cerevisiae
gctccatctttcttaatgcaacgtc

SEQ ID NO: 27037 - DNA, 25 bp, S. cerevisiae
gctccacttcaaactcatgacgata

SEQ ID NO: 27038 - DNA, 25 bp, S. cerevisiae
gctccagttcaaagtcagccgttaa

SEQ ID NO: 27039 - DNA, 25 bp, S. cerevisiae
gctgccagtgaagctgaacctgcaa

SEQ ID NO: 27040 - DNA, 25 bp, S. cerevisiae
gctcaaggctataggtttctcaaat

SEQ ID NO: 27041 - DNA, 25 bp, S. cerevisiae
gctacaggctgtgggtgatttgaac

SEQ ID NO: 27042 - DNA, 25 bp, S. cerevisiae
gctcgccaatgttcgtgcattttac

SEQ ID NO: 27043 - DNA, 25 bp, S. cerevisiae
gctcccacgtctctgattattgaag

SEQ ID NO: 27044 - DNA, 25 bp, S. cerevisiae
gctcccaactctggtcttggattaa

SEQ ID NO: 27045 - DNA, 25 bp, S. cerevisiae
gctagattactttttcgcaggttta

SEQ ID NO: 27046 - DNA, 25 bp, S. cerevisiae
gctcgccccttttatttttgattat

SEQ ID NO: 27047 - DNA, 25 bp, S. cerevisiae
gctcgctccactatcgatggtttaa

SEQ ID NO: 27048 - DNA, 25 bp, S. cerevisiae
gctcgctgccgttatctttttgtaa

SEQ ID NO: 27049 - DNA, 25 bp, S. cerevisiae
gctacctccaagcttttgtcagtaa

SEQ ID NO: 27050 - DNA, 25 bp, S. cerevisiae
gtacgtaacggctgtccaacgacta

SEQ ID NO: 27051 - DNA, 25 bp, S. cerevisiae
gctcttgcatgctgggttctaaaat

SEQ ID NO: 27052 - DNA, 25 bp, S. cerevisiae
gcaaaacgacgttcttggagacatt

SEQ ID NO: 27053 - DNA, 25 bp, S. cerevisiae
gctaggactaagagattggttcaat

SEQ ID NO: 27054 - DNA, 25 bp, S. cerevisiae
gctaaacttgaatgttgccttggat

SEQ ID NO: 27055 - DNA, 25 bp, S. cerevisiae
gctaagaagtctgctaccgttgtta

SEQ ID NO: 27056 - DNA, 25 bp, S. cerevisiae
gcatcgaacgttacggctggcctta

SEQ ID NO: 27057 - DNA, 25 bp, S. cerevisiae
gctttggagttctttaacacccaca

SEQ ID NO: 27058 - DNA, 25 bp, S. cerevisiae
gcattgtacaaaggtttcgtcccca

SEQ ID NO: 27059 - DNA, 25 bp, S. cerevisiae
gctcttacaatatgagttcgtcaga

SEQ ID NO: 27060 - DNA, 25 bp, S. cerevisiae
gctacctaacggcacacttaatgaa

SEQ ID NO: 27061 - DNA, 25 bp, S. cerevisiae
gcaaggacaactgcttcgggaaaga

SEQ ID NO: 27062 - DNA, 25 bp, S. cerevisiae
gctcaaactagtgctgtcggacaaa

SEQ ID NO: 27063 - DNA, 25 bp, S. cerevisiae
gctctcaacggctccatatggacag

SEQ ID NO: 27064 - DNA, 25 bp, S. cerevisiae
gctctatcgggctcataatgcttaa

SEQ ID NO: 27065 - DNA, 25 bp, S. cerevisiae
gctctttggaagaaatcatcgctga

SEQ ID NO: 27066 - DNA, 25 bp, S. cerevisiae
gctctgtaagatctctgctgaaagt

SEQ ID NO: 27067 - DNA, 25 bp, S. cerevisiae
gctctggagaccgtcctgattaaga

SEQ ID NO: 27068 - DNA, 25 bp, S. cerevisiae
gctagacaatcctctcaagatccaa

SEQ ID NO: 27069 - DNA, 25 bp, S. cerevisiae
gctcagagcaaaagcctacggctaa

SEQ ID NO: 27070 - DNA, 25 bp, S. cerevisiae
gctaataatatacctttgcctcaat

SEQ ID NO: 27071 - DNA, 25 bp, S. cerevisiae
gctcgtcactgaaattgctacttta

SEQ ID NO: 27072 - DNA, 25 bp, S. cerevisiae
gctcgctggtgagtggtatgcccaa

SEQ ID NO: 27073 - DNA, 25 bp, S. cerevisiae
gctctctactgctgctgttgaacaa

SEQ ID NO: 27074 - DNA, 25 bp, S. cerevisiae
gctcctgatggatctgtgattacta

SEQ ID NO: 27075 - DNA, 25 bp, S. cerevisiae
gctaacgattcagcaatcccagaaa

SEQ ID NO: 27076 - DNA, 25 bp, S. cerevisiae
gctaacgtagctgatatcctggtcg

SEQ ID NO: 27077 - DNA, 25 bp, S. cerevisiae
gctcgccggatttctatatctacaa

SEQ ID NO: 27078 - DNA, 25 bp, S. cerevisiae
gctcatccggataattatggcccca

SEQ ID NO: 27079 - DNA, 25 bp, S. cerevisiae
gctaccgatgaaatggttcccattg

SEQ ID NO: 27080 - DNA, 25 bp, S. cerevisiae
gctcaacgtgactactttggtgctc

SEQ ID NO: 27081 - DNA, 25 bp, S. cerevisiae
gctaacgatgatgtgctattggatt

SEQ ID NO: 27082 - DNA, 25 bp, S. cerevisiae
gctacagactatcaccatggtatat

SEQ ID NO: 27083 - DNA, 25 bp, S. cerevisiae
gctacaggcattctacggaaacgtt

SEQ ID NO: 27084 - DNA, 25 bp, S. cerevisiae
gctacagacgtccattgccgaaggt

SEQ ID NO: 27085 - DNA, 25 bp, S. cerevisiae
gctcaagttgcccaccaagaaggtg

SEQ ID NO: 27086 - DNA, 25 bp, S. cerevisiae
gctagattcgtctccaagttggctg

SEQ ID NO: 27087 - DNA, 25 bp, S. cerevisiae
gctcaattcgtctcggatgctttag

SEQ ID NO: 27088 - DNA, 25 bp, S. cerevisiae
gctcgtgttatgactgcacaggatt

SEQ ID NO: 27089 - DNA, 25 bp, S. cerevisiae
gctcgttcttttcatcatctttatt

SEQ ID NO: 27090 - DNA, 25 bp, S. cerevisiae
gctcttcggtactatcgcagtttga

SEQ ID NO: 27091 - DNA, 25 bp, S. cerevisiae
gctctgaaatccatcacttcggtga

SEQ ID NO: 27092 - DNA, 25 bp, S. cerevisiae
gctctgtatatcattgtgctatccg

SEQ ID NO: 27093 - DNA, 25 bp, S. cerevisiae
gctcgttccaatagtgggtccaatt

SEQ ID NO: 27094 - DNA, 25 bp, S. cerevisiae
gctttttcctttgtgtcttatgtat

SEQ ID NO: 27095 - DNA, 25 bp, S. cerevisiae
gttgggaactttatgcctgacagta

SEQ ID NO: 27096 - DNA, 25 bp, S. cerevisiae
gctatgggatactccctactacttt

SEQ ID NO: 27097 - DNA, 25 bp, S. cerevisiae
gctacctgtagtcaattttgctgct

SEQ ID NO: 27098 - DNA, 25 bp, S. cerevisiae
gctacagttttcttatttatcatct

SEQ ID NO: 27099 - DNA, 25 bp, S. cerevisiae
gctcaagctgctttggtagtttttg

SEQ ID NO: 27100 - DNA, 25 bp, S. cerevisiae
gctatagcagtgttggtcacgtcct

SEQ ID NO: 27101 - DNA, 25 bp, S. cerevisiae
gctaagaggctctgacacaccagta

SEQ ID NO: 27102 - DNA, 25 bp, S. cerevisiae
gctaacggacaagcagatccagcta

SEQ ID NO: 27103 - DNA, 25 bp, S. cerevisiae
gctaatctccctttaaacgacggtg

SEQ ID NO: 27104 - DNA, 25 bp, S. cerevisiae
gcattttcaacgcaagcactcggga

SEQ ID NO: 27105 - DNA, 25 bp, S. cerevisiae
gcttttaatggccacgctttgggta

SEQ ID NO: 27106 - DNA, 25 bp, S. cerevisiae
gttcgtaacctagctttcgtggaat

SEQ ID NO: 27107 - DNA, 25 bp, S. cerevisiae
tttcgtcaaaactctaacagggaag

SEQ ID NO: 27108 - DNA, 25 bp, S. cerevisiae
gctctcgtaaaaatagccctcctgc

SEQ ID NO: 27109 - DNA, 25 bp, S. cerevisiae
gcatctttaagagaacctttggtct

SEQ ID NO: 27110 - DNA, 25 bp, S. cerevisiae
gctactgttactagacggtttcccg

SEQ ID NO: 27111 - DNA, 25 bp, S. cerevisiae
gctactaaattgtacgtttctcata

SEQ ID NO: 27112 - DNA, 25 bp, S. cerevisiae
gctactgggatttagggcgcgaatt

SEQ ID NO: 27113 - DNA, 25 bp, S. cerevisiae
gctacttgtttaagagacgctccct

SEQ ID NO: 27114 - DNA, 25 bp, S. cerevisiae
gctcgtgccaccatgctattatata

SEQ ID NO: 27115 - DNA, 25 bp, S. cerevisiae
gctctgcagctccaagtattatctt

SEQ ID NO: 27116 - DNA, 25 bp, S. cerevisiae
gctagcagctcaaggaagatgtttc

SEQ ID NO: 27117 - DNA, 25 bp, S. cerevisiae
tgataggcaagtcgcaacatggatt

SEQ ID NO: 27118 - DNA, 25 bp, S. cerevisiae
gctacaggagctcgaaagtgaatta

SEQ ID NO: 27119 - DNA, 25 bp, S. cerevisiae
gctacaatacgctgaagcttttatt

SEQ ID NO: 27120 - DNA, 25 bp, S. cerevisiae
gctaggtcctaacttccatcaaata

SEQ ID NO: 27121 - DNA, 25 bp, S. cerevisiae
gcacagtggtaacattcaattggat

SEQ ID NO: 27122 - DNA, 25 bp, S. cerevisiae
gcatagcggtaacatccaattggat

SEQ ID NO: 27123 - DNA, 25 bp, S. cerevisiae
gctatacccctttgctaacttagga

SEQ ID NO: 27124 - DNA, 25 bp, S. cerevisiae
gctctattgaggtccttgctcaagg

SEQ ID NO: 27125 - DNA, 25 bp, S. cerevisiae
gctcatcaagcaggtcttactcaag

SEQ ID NO: 27126 - DNA, 25 bp, S. cerevisiae
gctaaagcagcaccagattcaacag

SEQ ID NO: 27127 - DNA, 25 bp, S. cerevisiae
gctagaggtatcgatgtccaacaag

SEQ ID NO: 27128 - DNA, 25 bp, S. cerevisiae
gctactttgtgcaatccttgggatc

SEQ ID NO: 27129 - DNA, 25 bp, S. cerevisiae
gctctatccgagcacgatgaagaac

SEQ ID NO: 27130 - DNA, 25 bp, S. cerevisiae
gctcatatgagcgagcccgaaatga

SEQ ID NO: 27131 - DNA, 25 bp, S. cerevisiae
gctctagcagcagcgtcgtcaagaa

SEQ ID NO: 27132 - DNA, 25 bp, S. cerevisiae
gctcgtggtggcctttatgatatta

SEQ ID NO: 27133 - DNA, 25 bp, S. cerevisiae
gctcttgttggcctcatagatgcag

SEQ ID NO: 27134 - DNA, 25 bp, S. cerevisiae
gctctgaatcgaacattcctacttt

SEQ ID NO: 27135 - DNA, 25 bp, S. cerevisiae
gctctattcatgaatcctgccttta

SEQ ID NO: 27136 - DNA, 25 bp, S. cerevisiae
gctaaggctattgcggctattgaaa

SEQ ID NO: 27137 - DNA, 25 bp, S. cerevisiae
gctcatctgagcacgaaaacctaac

SEQ ID NO: 27138 - DNA, 25 bp, S. cerevisiae
gctcatctgcagctgccaaaaaatt

SEQ ID NO: 27139 - DNA, 25 bp, S. cerevisiae
gctcatccagctccgcatgataaga

SEQ ID NO: 27140 - DNA, 25 bp, S. cerevisiae
gctctgccagcctcaatcaagaaga

SEQ ID NO: 27141 - DNA, 25 bp, S. cerevisiae
gctactatgccaattttcaacctgt

SEQ ID NO: 27142 - DNA, 25 bp, S. cerevisiae
gctactatcacaaatcctcatcaag

SEQ ID NO: 27143 - DNA, 25 bp, S. cerevisiae
gctatattttcaccgcactaatggg

SEQ ID NO: 27144 - DNA, 25 bp, S. cerevisiae
gctaagtttgtgttgcatgctaagc

SEQ ID NO: 27145 - DNA, 25 bp, S. cerevisiae
gctactttatggcagcagctacact

SEQ ID NO: 27146 - DNA, 25 bp, S. cerevisiae
gctacctttgaacacattgcgctat

SEQ ID NO: 27147 - DNA, 25 bp, S. cerevisiae
gctagcgatttaactatactgcagt

SEQ ID NO: 27148 - DNA, 25 bp, S. cerevisiae
gctctcttgagagaagctctttgca

SEQ ID NO: 27149 - DNA, 25 bp, S. cerevisiae
gctcttgttggtaaagctccacata

SEQ ID NO: 27150 - DNA, 25 bp, S. cerevisiae
gctctcagtatcgatctaacgccag

SEQ ID NO: 27151 - DNA, 25 bp, S. cerevisiae
gctctctaatggcattcttcacaat

SEQ ID NO: 27152 - DNA, 25 bp, S. cerevisiae
gctctctccaaacttttctcaggaa

SEQ ID NO: 27153 - DNA, 25 bp, S. cerevisiae
gctctcctggacatgcatttatatt

SEQ ID NO: 27154 - DNA, 25 bp, S. cerevisiae
gctctccaggtttctacgctaagat

SEQ ID NO: 27155 - DNA, 25 bp, S. cerevisiae
gcttgcaaggtacctacgaggcgat

SEQ ID NO: 27156 - DNA, 25 bp, S. cerevisiae
gcagatatcctgatggaagtaacca

SEQ ID NO: 27157 - DNA, 25 bp, S. cerevisiae
gcttcagctcaattcgtcggaaact

SEQ ID NO: 27158 - DNA, 25 bp, S. cerevisiae
gctatacctaatctctggccaatgg

SEQ ID NO: 27159 - DNA, 25 bp, S. cerevisiae
gctctatctgaaacatttggcgcaa

SEQ ID NO: 27160 - DNA, 25 bp, S. cerevisiae
gctcatagcctcatatatttgttca

SEQ ID NO: 27161 - DNA, 25 bp, S. cerevisiae
gctctaagtgtcaagtctggtctca

SEQ ID NO: 27162 - DNA, 25 bp, S. cerevisiae
gctctaacagtaatcacgcactcca

SEQ ID NO: 27163 - DNA, 25 bp, S. cerevisiae
gctcaagctcaaagaatgctgccca

SEQ ID NO: 27164 - DNA, 25 bp, S. cerevisiae
gctaatgcacaaaattctgccgaat

SEQ ID NO: 27165 - DNA, 25 bp, S. cerevisiae
gctacagcaattgaagcggtcttta

SEQ ID NO: 27166 - DNA, 25 bp, S. cerevisiae
gctcattttagcattcttatccaga

SEQ ID NO: 27167 - DNA, 25 bp, S. cerevisiae
gctactcaattcgatgccactgatt

SEQ ID NO: 27168 - DNA, 25 bp, S. cerevisiae
gctcacgagccattgataccatttt

SEQ ID NO: 27169 - DNA, 25 bp, S. cerevisiae
gctagataagccctcagttttactg

SEQ ID NO: 27170 - DNA, 25 bp, S. cerevisiae
gctactgtgtatcttttggttcgtc

SEQ ID NO: 27171 - DNA, 25 bp, S. cerevisiae
gctaccgcgatgcacttaagttcaa

SEQ ID NO: 27172 - DNA, 25 bp, S. cerevisiae
gcaagtcggtgttggtaagttgaac

SEQ ID NO: 27173 - DNA, 25 bp, S. cerevisiae
gctttcggtgtcagtaattctgaaa

SEQ ID NO: 27174 - DNA, 25 bp, S. cerevisiae
gctttacgcgctattaccttatatc

SEQ ID NO: 27175 - DNA, 25 bp, S. cerevisiae
gcttccagcgccagtcaaagcgaaa

SEQ ID NO: 27176 - DNA, 25 bp, S. cerevisiae
gctaccgccgctccaaaagaaaaga

SEQ ID NO: 27177 - DNA, 25 bp, S. cerevisiae
gctaccgcgcgatgcacaacaagaa

SEQ ID NO: 27178 - DNA, 25 bp, S. cerevisiae
gctaacgactcttctgcgacaagaa

SEQ ID NO: 27179 - DNA, 25 bp, S. cerevisiae
gctagtactactcaatgtcgcagaa

SEQ ID NO: 27180 - DNA, 25 bp, S. cerevisiae
gcttgcacctgcgtagagttaccaa

SEQ ID NO: 27181 - DNA, 25 bp, S. cerevisiae
gctcacatcggccttttgatattac

SEQ ID NO: 27182 - DNA, 25 bp, S. cerevisiae
gcatgaaacctccaatttcttcaag

SEQ ID NO: 27183 - DNA, 25 bp, S. cerevisiae
gctcaattttcccttttgtcatcag

SEQ ID NO: 27184 - DNA, 25 bp, S. cerevisiae
gcataactttacttggttacccact

SEQ ID NO: 27185 - DNA, 25 bp, S. cerevisiae
gctattgtttcctggcttgaagcct

SEQ ID NO: 27186 - DNA, 25 bp, S. cerevisiae
gctactttcaccgatgtcttatatg

SEQ ID NO: 27187 - DNA, 25 bp, S. cerevisiae
gctttccaggaacatgcatggttgt

SEQ ID NO: 27188 - DNA, 25 bp, S. cerevisiae
gctttgggtgcatcatcatcatttc

SEQ ID NO: 27189 - DNA, 25 bp, S. cerevisiae
gctttagctgtcatcaactttggga

SEQ ID NO: 27190 - DNA, 25 bp, S. cerevisiae
gctagctcgttgttattcttcattt

SEQ ID NO: 27191 - DNA, 25 bp, S. cerevisiae
gcattcccgggattatttcaggtat

SEQ ID NO: 27192 - DNA, 25 bp, S. cerevisiae
gctatgtctcataggtaccaccttg

SEQ ID NO: 27193 - DNA, 25 bp, S. cerevisiae
gctagtaagctgatcaacgccattg

SEQ ID NO: 27194 - DNA, 25 bp, S. cerevisiae
gcacttctgagattggataccacat

SEQ ID NO: 27195 - DNA, 25 bp, S. cerevisiae
gctttgcatgctcaggatgacccaa

SEQ ID NO: 27196 - DNA, 25 bp, S. cerevisiae
gctaatgctctttacattgcttcaa

SEQ ID NO: 27197 - DNA, 25 bp, S. cerevisiae
gctaagtgtatttcttctccacatt

SEQ ID NO: 27198 - DNA, 25 bp, S. cerevisiae
gctacatctttattgttctgccaca

SEQ ID NO: 27199 - DNA, 25 bp, S. cerevisiae
gctacttttttgaagctggcagcac

SEQ ID NO: 27200 - DNA, 25 bp, S. cerevisiae
gcattccatggagggctcagtgtta

SEQ ID NO: 27201 - DNA, 25 bp, S. cerevisiae
gcttactggccggtagtggtttaag

SEQ ID NO: 27202 - DNA, 25 bp, S. cerevisiae
gctacggattctatttctcatttat

SEQ ID NO: 27203 - DNA, 25 bp, S. cerevisiae
gcttaccaccaaaagtacgttgacg

SEQ ID NO: 27204 - DNA, 25 bp, S. cerevisiae
gctatatcccagaaggtgtttcctt

SEQ ID NO: 27205 - DNA, 25 bp, S. cerevisiae
gctatatccgtgacatgcgatccaa

SEQ ID NO: 27206 - DNA, 25 bp, S. cerevisiae
gcattcccgatttacccattaattt

SEQ ID NO: 27207 - DNA, 25 bp, S. cerevisiae
gctttatattggacacacatggagt

SEQ ID NO: 27208 - DNA, 25 bp, S. cerevisiae
gctactatctagctgcaccaggaga

SEQ ID NO: 27209 - DNA, 25 bp, S. cerevisiae
gctacgtcaacaaacctggcgagat

SEQ ID NO: 27210 - DNA, 25 bp, S. cerevisiae
gctcacccagctaaatttgccgatg

SEQ ID NO: 27211 - DNA, 25 bp, S. cerevisiae
gctttgctcactcctataacgaaga

SEQ ID NO: 27212 - DNA, 25 bp, S. cerevisiae
gctaaaacttctgaacagccagcag

SEQ ID NO: 27213 - DNA, 25 bp, S. cerevisiae
gctagtaccgctccttaagctagag

SEQ ID NO: 27214 - DNA, 25 bp, S. cerevisiae
gcacagtttccttgggttttgggca

SEQ ID NO: 27215 - DNA, 25 bp, S. cerevisiae
gctattcctcatgaaggtgccttga

SEQ ID NO: 27216 - DNA, 25 bp, S. cerevisiae
gcttactgtcagctaggtgttctaa

SEQ ID NO: 27217 - DNA, 25 bp, S. cerevisiae
gcttccctgaagaatggatacccca

SEQ ID NO: 27218 - DNA, 25 bp, S. cerevisiae
gcttccggcaattttgaacccagag

SEQ ID NO: 27219 - DNA, 25 bp, S. cerevisiae
gcttcctccgggatctatgacggga

SEQ ID NO: 27220 - DNA, 25 bp, S. cerevisiae
gcttacccattaccctttttgagat

SEQ ID NO: 27221 - DNA, 25 bp, S. cerevisiae
gctacttttaccacctcttttgaga

SEQ ID NO: 27222 - DNA, 25 bp, S. cerevisiae
gctattagagtattcaccccatttt

SEQ ID NO: 27223 - DNA, 25 bp, S. cerevisiae
gtaattgaaaaacccatggccattg

SEQ ID NO: 27224 - DNA, 25 bp, S. cerevisiae
gctttccaaaatactggtgccttga

SEQ ID NO: 27225 - DNA, 25 bp, S. cerevisiae
gctactacactactctgcaatatca

SEQ ID NO: 27226 - DNA, 25 bp, S. cerevisiae
gctaccacctatgctgataaaccag

SEQ ID NO: 27227 - DNA, 25 bp, S. cerevisiae
gttggtcctatcagtaacactcggg

SEQ ID NO: 27228 - DNA, 25 bp, S. cerevisiae
gcttgtttcgaaccgggcaatcaaa

SEQ ID NO: 27229 - DNA, 25 bp, S. cerevisiae
gcttttacttctcttgtaggtttgt

SEQ ID NO: 27230 - DNA, 25 bp, S. cerevisiae
gctttctagtttcaatttggtgccc

SEQ ID NO: 27231 - DNA, 25 bp, S. cerevisiae
gctacttcgcctactaatgttggta

SEQ ID NO: 27232 - DNA, 25 bp, S. cerevisiae
gcttgttttgctatcgtcgggagaa

SEQ ID NO: 27233 - DNA, 25 bp, S. cerevisiae
gctactttagtaaacgttcacatca

SEQ ID NO: 27234 - DNA, 25 bp, S. cerevisiae
gctatgtctttgtacaactttccaa

SEQ ID NO: 27235 - DNA, 25 bp, S. cerevisiae
gctagttttccaattgcctcttcaa

SEQ ID NO: 27236 - DNA, 25 bp, S. cerevisiae
gcaactttttactcctcttcaatta

SEQ ID NO: 27237 - DNA, 25 bp, S. cerevisiae
gctactccgtctacgaagatgctca

SEQ ID NO: 27238 - DNA, 25 bp, S. cerevisiae
gctacacacgtcatcgacatctaaa

SEQ ID NO: 27239 - DNA, 25 bp, S. cerevisiae
gcttaacggtcgcagattacaatat

SEQ ID NO: 27240 - DNA, 25 bp, S. cerevisiae
gcttaccgggcgatcacatcaaatt

SEQ ID NO: 27241 - DNA, 25 bp, S. cerevisiae
gctttagatgaagccctaccttctg

SEQ ID NO: 27242 - DNA, 25 bp, S. cerevisiae
gcatttttaaagattcccaagcttg

SEQ ID NO: 27243 - DNA, 25 bp, S. cerevisiae
gctttacgtcggaagttgtctgagt

SEQ ID NO: 27244 - DNA, 25 bp, S. cerevisiae
gctattatatgtggtgggtctggta

SEQ ID NO: 27245 - DNA, 25 bp, S. cerevisiae
gctactgatggcaagaggcttttca

SEQ ID NO: 27246 - DNA, 25 bp, S. cerevisiae
gctattattcaagctttggcacatc

SEQ ID NO: 27247 - DNA, 25 bp, S. cerevisiae
gcattgggcggaacgttcgaccaca

SEQ ID NO: 27248 - DNA, 25 bp, S. cerevisiae
gctttaagcttactttaccacttgt

SEQ ID NO: 27249 - DNA, 25 bp, S. cerevisiae
gcatttgcttaccaaactggccgat

SEQ ID NO: 27250 - DNA, 25 bp, S. cerevisiae
gctacatctagggaagccacacctt

SEQ ID NO: 27251 - DNA, 25 bp, S. cerevisiae
gctacatgaagctgaggacaccact

SEQ ID NO: 27252 - DNA, 25 bp, S. cerevisiae
gctactgaagcattgacgttacact

SEQ ID NO: 27253 - DNA, 25 bp, S. cerevisiae
gctactggagcatgcactgtgcgat

SEQ ID NO: 27254 - DNA, 25 bp, S. cerevisiae
gctactgtcccagctgtaattagtt

SEQ ID NO: 27255 - DNA, 25 bp, S. cerevisiae
gctacttgtcatccatgctttgtta

SEQ ID NO: 27256 - DNA, 25 bp, S. cerevisiae
gctttcagcttctacttttgtacca

SEQ ID NO: 27257 - DNA, 25 bp, S. cerevisiae
gctttcagatgaaccagatggcttc

SEQ ID NO: 27258 - DNA, 25 bp, S. cerevisiae
gctttagaccctctgcaagcaaaag

SEQ ID NO: 27259 - DNA, 25 bp, S. cerevisiae
gcttccggttctatcaacagaaagg

SEQ ID NO: 27260 - DNA, 25 bp, S. cerevisiae
gctatcctcctccttacaaagaaaa

SEQ ID NO: 27261 - DNA, 25 bp, S. cerevisiae
gctacaccctctgatgaccatgaaa

SEQ ID NO: 27262 - DNA, 25 bp, S. cerevisiae
gctacctcttctgctgatgtcagcg

SEQ ID NO: 27263 - DNA, 25 bp, S. cerevisiae
gcttatatccttctgcctgttggaa

SEQ ID NO: 27264 - DNA, 25 bp, S. cerevisiae
gctaaaagccagttcttgaagctaa

SEQ ID NO: 27265 - DNA, 25 bp, S. cerevisiae
gctaaatagctggacttctgaatta

SEQ ID NO: 27266 - DNA, 25 bp, S. cerevisiae
gctaacaaatgttctatggcctcta

SEQ ID NO: 27267 - DNA, 25 bp, S. cerevisiae
gcttccactttttcatttggaggcc

SEQ ID NO: 27268 - DNA, 25 bp, S. cerevisiae
gcttcccacttttcatttacggtgt

SEQ ID NO: 27269 - DNA, 25 bp, S. cerevisiae
gctacactatatttcactttcatcg

SEQ ID NO: 27270 - DNA, 25 bp, S. cerevisiae
gctaaactcagtatctatttctcta

SEQ ID NO: 27271 - DNA, 25 bp, S. cerevisiae
gctagatcatccactcttttttcta

SEQ ID NO: 27272 - DNA, 25 bp, S. cerevisiae
gtgaccaaggttatttcgaccctga

SEQ ID NO: 27273 - DNA, 25 bp, S. cerevisiae
gctatccaaggcaattttgacgact

SEQ ID NO: 27274 - DNA, 25 bp, S. cerevisiae
gcatcactaggagacaagggcttac

SEQ ID NO: 27275 - DNA, 25 bp, S. cerevisiae
gcattgcccttacagttgtgtttat

SEQ ID NO: 27276 - DNA, 25 bp, S. cerevisiae
gctttcatttgacttgtggtttcta

SEQ ID NO: 27277 - DNA, 25 bp, S. cerevisiae
gctttgcattttgaatacccgccag

SEQ ID NO: 27278 - DNA, 25 bp, S. cerevisiae
gctttcttcaatcaattgtttgcca

SEQ ID NO: 27279 - DNA, 25 bp, S. cerevisiae
gcttaggtgacgttattcatgcttt

SEQ ID NO: 27280 - DNA, 25 bp, S. cerevisiae
gcatgacgcctaccgctttaaaaga

SEQ ID NO: 27281 - DNA, 25 bp, S. cerevisiae
gctaccaccatgaccatcataataa

SEQ ID NO: 27282 - DNA, 25 bp, S. cerevisiae
gcttaacgaacgaagtcatgctgtt

SEQ ID NO: 27283 - DNA, 25 bp, S. cerevisiae
gcttcgtgttgacctattagctcac

SEQ ID NO: 27284 - DNA, 25 bp, S. cerevisiae
gctttggtgagcctgatctaacgaa

SEQ ID NO: 27285 - DNA, 25 bp, S. cerevisiae
gctagtgagaatctgccccgatgaa

SEQ ID NO: 27286 - DNA, 25 bp, S. cerevisiae
gctactgaatcatttgttgccactt

SEQ ID NO: 27287 - DNA, 25 bp, S. cerevisiae
gctactgcattctatttggctattt

SEQ ID NO: 27288 - DNA, 25 bp, S. cerevisiae
gctactatcatttcatctggcaggt

SEQ ID NO: 27289 - DNA, 25 bp, S. cerevisiae
gctagaattgctaccgccatcgaaa

SEQ ID NO: 27290 - DNA, 25 bp, S. cerevisiae
gctagaattattgctgccattccaa

SEQ ID NO: 27291 - DNA, 25 bp, S. cerevisiae
gcacgtgtcgaattgtcaacactaa

SEQ ID NO: 27292 - DNA, 25 bp, S. cerevisiae
gctactctcaaactatgattccacc

SEQ ID NO: 27293 - DNA, 25 bp, S. cerevisiae
gctacgtcattctatagttccacac

SEQ ID NO: 27294 - DNA, 25 bp, S. cerevisiae
gctacattcaagtattgggctccac

SEQ ID NO: 27295 - DNA, 25 bp, S. cerevisiae
gctactgctgctgaatctgatgttg

SEQ ID NO: 27296 - DNA, 25 bp, S. cerevisiae
gctagcccaaattctgactctgaag

SEQ ID NO: 27297 - DNA, 25 bp, S. cerevisiae
gctagcaggcaaggtttcttcggat

SEQ ID NO: 27298 - DNA, 25 bp, S. cerevisiae
gcttgccggagtttctcatttaaaa

SEQ ID NO: 27299 - DNA, 25 bp, S. cerevisiae
gctattccggccactatcgataagt

SEQ ID NO: 27300 - DNA, 25 bp, S. cerevisiae
gctactgagggccaactgactgata

SEQ ID NO: 27301 - DNA, 25 bp, S. cerevisiae
gctatcaaggatacaacatggcaat

SEQ ID NO: 27302 - DNA, 25 bp, S. cerevisiae
gctatgaagtcttgaccgctgctga

SEQ ID NO: 27303 - DNA, 25 bp, S. cerevisiae
gctagagttcattgtatcgcgggta

SEQ ID NO: 27304 - DNA, 25 bp, S. cerevisiae
gcttagtgctattattgttcgtatc

SEQ ID NO: 27305 - DNA, 25 bp, S. cerevisiae
gcttgttattacgttaggaccccag

SEQ ID NO: 27306 - DNA, 25 bp, S. cerevisiae
gcttttttaactacgaaccagcaag

SEQ ID NO: 27307 - DNA, 25 bp, S. cerevisiae
gcttttttccagagtgtagccactg

SEQ ID NO: 27308 - DNA, 25 bp, S. cerevisiae
gcttttaccgagcaatgtagccaag

SEQ ID NO: 27309 - DNA, 25 bp, S. cerevisiae
gctatttatccgcactttgtcgaat

SEQ ID NO: 27310 - DNA, 25 bp, S. cerevisiae
gctttgcatagccagagcacttctg

SEQ ID NO: 27311 - DNA, 25 bp, S. cerevisiae
gctttgaccaattgcctgtgttgac

SEQ ID NO: 27312 - DNA, 25 bp, S. cerevisiae
gctattagccaatgacggtgccaca

SEQ ID NO: 27313 - DNA, 25 bp, S. cerevisiae
gctattatgtctttatcggtcaacg

SEQ ID NO: 27314 - DNA, 25 bp, S. cerevisiae
gctattatgcccctgtacgtaaagt

SEQ ID NO: 27315 - DNA, 25 bp, S. cerevisiae
gttcttcgacgtcccagtagataat

SEQ ID NO: 27316 - DNA, 25 bp, S. cerevisiae
gcttccctagaaccttcttatgttt

SEQ ID NO: 27317 - DNA, 25 bp, S. cerevisiae
gctattgtcttcaagatcctttccc

SEQ ID NO: 27318 - DNA, 25 bp, S. cerevisiae
gctatgtcccaaaacacggctgaag

SEQ ID NO: 27319 - DNA, 25 bp, S. cerevisiae
gctagctccgactataatccatttt

SEQ ID NO: 27320 - DNA, 25 bp, S. cerevisiae
gctattccacacgaatccactagga

SEQ ID NO: 27321 - DNA, 25 bp, S. cerevisiae
gctatcttgcataaacatcacggga

SEQ ID NO: 27322 - DNA, 25 bp, S. cerevisiae
gctatcgtacaaacaatggcggtca

SEQ ID NO: 27323 - DNA, 25 bp, S. cerevisiae
gctatcgttcaaagtatcgccaatg

SEQ ID NO: 27324 - DNA, 25 bp, S. cerevisiae
gctagcagttcgtagattctccaat

SEQ ID NO: 27325 - DNA, 25 bp, S. cerevisiae
gctaggttagtacttgctgccattc

SEQ ID NO: 27326 - DNA, 25 bp, S. cerevisiae
gctatgccttcacaagtgctgcaat

SEQ ID NO: 27327 - DNA, 25 bp, S. cerevisiae
gctacggaattgctggacgatccat

SEQ ID NO: 27328 - DNA, 25 bp, S. cerevisiae
gctatcgttaatcttttaccttcgt

SEQ ID NO: 27329 - DNA, 25 bp, S. cerevisiae
gctttcattttcgttttctactttg

SEQ ID NO: 27330 - DNA, 25 bp, S. cerevisiae
gcttatctttctcttgtagtattgt

SEQ ID NO: 27331 - DNA, 25 bp, S. cerevisiae
gctttgccgacatatctattggaca

SEQ ID NO: 27332 - DNA, 25 bp, S. cerevisiae
gcttccaaggcgcattgttttgaca

SEQ ID NO: 27333 - DNA, 25 bp, S. cerevisiae
gcttccaaggaagtcagaggttcca

SEQ ID NO: 27334 - DNA, 25 bp, S. cerevisiae
gctatcgcaagctgaacacggtatt

SEQ ID NO: 27335 - DNA, 25 bp, S. cerevisiae
gcttcgccgatacgagaccgtttga

SEQ ID NO: 27336 - DNA, 25 bp, S. cerevisiae
gcttgggcattacatgaggccattt

SEQ ID NO: 27337 - DNA, 25 bp, S. cerevisiae
gctatgaagcttctcgccaaattat

SEQ ID NO: 27338 - DNA, 25 bp, S. cerevisiae
gctttcccaccaaaatctatattcg

SEQ ID NO: 27339 - DNA, 25 bp, S. cerevisiae
gctttttcacaaaccatctattatg

SEQ ID NO: 27340 - DNA, 25 bp, S. cerevisiae
gcttctttccaaccaaccgtatagt

SEQ ID NO: 27341 - DNA, 25 bp, S. cerevisiae
gcttttgctattcagctaccagagc

SEQ ID NO: 27342 - DNA, 25 bp, S. cerevisiae
gctaccgtctcgttgatccatgaat

SEQ ID NO: 27343 - DNA, 25 bp, S. cerevisiae
gctatcgttcttgcttccatgaata

SEQ ID NO: 27344 - DNA, 25 bp, S. cerevisiae
gctatcgatagcagctctaccattt

SEQ ID NO: 27345 - DNA, 25 bp, S. cerevisiae
gctagtatagcaacatatccgcacg

SEQ ID NO: 27346 - DNA, 25 bp, S. cerevisiae
gctagggcagcaagttcatcaacag

SEQ ID NO: 27347 - DNA, 25 bp, S. cerevisiae
gcttatcccactgttcaggttgata

SEQ ID NO: 27348 - DNA, 25 bp, S. cerevisiae
gctatataccctgtgctaagtgaat

SEQ ID NO: 27349 - DNA, 25 bp, S. cerevisiae
gcttatcccgcgatgatatcagtga

SEQ ID NO: 27350 - DNA, 25 bp, S. cerevisiae
gctagtgcccagctactatgcagag

SEQ ID NO: 27351 - DNA, 25 bp, S. cerevisiae
gcatgacgccagcttgaatctagtg

SEQ ID NO: 27352 - DNA, 25 bp, S. cerevisiae
gctagatcctcttttgactattcag

SEQ ID NO: 27353 - DNA, 25 bp, S. cerevisiae
gcttactccttcagcagttctaatg

SEQ ID NO: 27354 - DNA, 25 bp, S. cerevisiae
gcttactgcaattccgatgttttca

SEQ ID NO: 27355 - DNA, 25 bp, S. cerevisiae
gcttggctgacttacagggttctga

SEQ ID NO: 27356 - DNA, 25 bp, S. cerevisiae
gctagctttcatccaacacttttta

SEQ ID NO: 27357 - DNA, 25 bp, S. cerevisiae
gcttcgcctatgtcttctaaggttg

SEQ ID NO: 27358 - DNA, 25 bp, S. cerevisiae
gctatccgcgatatcacttacaatg

SEQ ID NO: 27359 - DNA, 25 bp, S. cerevisiae
gcatcttttgtacccaacttaataa

SEQ ID NO: 27360 - DNA, 25 bp, S. cerevisiae
gcaggtcttgtaagccaaatttcat

SEQ ID NO: 27361 - DNA, 25 bp, S. cerevisiae
gcatggttgttcttccaaacgtcag

SEQ ID NO: 27362 - DNA, 25 bp, S. cerevisiae
gctttgtgttttcaatacgcatcag

SEQ ID NO: 27363 - DNA, 25 bp, S. cerevisiae
gcagtccagtgataaatcttggcca

SEQ ID NO: 27364 - DNA, 25 bp, S. cerevisiae
gcttctggtcaattcagggctttaa

SEQ ID NO: 27365 - DNA, 25 bp, S. cerevisiae
gcagctgaagactagaatcccggac

SEQ ID NO: 27366 - DNA, 25 bp, S. cerevisiae
gagctaaagggtattccaatccgta

SEQ ID NO: 27367 - DNA, 25 bp, S. cerevisiae
gcactaatgagggttttcgtcccaa

SEQ ID NO: 27368 - DNA, 25 bp, S. cerevisiae
gcttctaacgccctatcaagagtga

SEQ ID NO: 27369 - DNA, 25 bp, S. cerevisiae
gcttctaactcacctgctttaggag

SEQ ID NO: 27370 - DNA, 25 bp, S. cerevisiae
gcatgagtgccaacaaggacgccaa

SEQ ID NO: 27371 - DNA, 25 bp, S. cerevisiae
gcattccacacaagcggtaaggtcg

SEQ ID NO: 27372 - DNA, 25 bp, S. cerevisiae
gcttgcaccccgcattataagtggt

SEQ ID NO: 27373 - DNA, 25 bp, S. cerevisiae
gctatcagcagcatacgctcttgta

SEQ ID NO: 27374 - DNA, 25 bp, S. cerevisiae
gcttacttctcttcatctttgtaca

SEQ ID NO: 27375 - DNA, 25 bp, S. cerevisiae
gcttatggcgctggaacatttggat

SEQ ID NO: 27376 - DNA, 25 bp, S. cerevisiae
gctttgtatcgttagtgcattctca

SEQ ID NO: 27377 - DNA, 25 bp, S. cerevisiae
gcttttagccattgatgcgtcacca

SEQ ID NO: 27378 - DNA, 25 bp, S. cerevisiae
gcttgtggacgcattttgaaactac

SEQ ID NO: 27379 - DNA, 25 bp, S. cerevisiae
gtattgcccttgtcggaccaaatgg

SEQ ID NO: 27380 - DNA, 25 bp, S. cerevisiae
gcatgttgacgataagctggcttac

SEQ ID NO: 27381 - DNA, 25 bp, S. cerevisiae
gctatttgaaacaacctccggtctt

SEQ ID NO: 27382 - DNA, 25 bp, S. cerevisiae
gctatcttcactactggtcatacgt

SEQ ID NO: 27383 - DNA, 25 bp, S. cerevisiae
gctatcacatcattccatacattat

SEQ ID NO: 27384 - DNA, 25 bp, S. cerevisiae
gctatgacatcaacacaaggccttt

SEQ ID NO: 27385 - DNA, 25 bp, S. cerevisiae
gcttatcaaacaggatgggactcta

SEQ ID NO: 27386 - DNA, 25 bp, S. cerevisiae
gcttacagaaccctatcgacatcaa

SEQ ID NO: 27387 - DNA, 25 bp, S. cerevisiae
gctatccaaactttattgcctgcat

SEQ ID NO: 27388 - DNA, 25 bp, S. cerevisiae
gctattgatgcactttggttatgga

SEQ ID NO: 27389 - DNA, 25 bp, S. cerevisiae
gctatgccaactttgcttctattca

SEQ ID NO: 27390 - DNA, 25 bp, S. cerevisiae
gctatgtaactcttgtggtcttcga

SEQ ID NO: 27391 - DNA, 25 bp, S. cerevisiae
gcttgtttaccaccattcatgttga

SEQ ID NO: 27392 - DNA, 25 bp, S. cerevisiae
gcttttgtcgtacctgctattctaa

SEQ ID NO: 27393 - DNA, 25 bp, S. cerevisiae
gcttttagagccttattgcctttag

SEQ ID NO: 27394 - DNA, 25 bp, S. cerevisiae
gctttagacactctatgtgcacgtt

SEQ ID NO: 27395 - DNA, 25 bp, S. cerevisiae
gcttacctcgctacttgtggaaaaa

SEQ ID NO: 27396 - DNA, 25 bp, S. cerevisiae
gctttccatactgcatacttcgaga

SEQ ID NO: 27397 - DNA, 25 bp, S. cerevisiae
gcttactcaccagcaatttacatga

SEQ ID NO: 27398 - DNA, 25 bp, S. cerevisiae
gctatcatgggacctgtggcacata

SEQ ID NO: 27399 - DNA, 25 bp, S. cerevisiae
gcatgactacagtccgtggcactga

SEQ ID NO: 27400 - DNA, 25 bp, S. cerevisiae
gcttccatttcccttgtggtagaaa

SEQ ID NO: 27401 - DNA, 25 bp, S. cerevisiae
gctttctcttactcgctggagataa

SEQ ID NO: 27402 - DNA, 25 bp, S. cerevisiae
gctttcatcctagctgatgctggtt

SEQ ID NO: 27403 - DNA, 25 bp, S. cerevisiae
gcttatgcaacttcactttggatgt

SEQ ID NO: 27404 - DNA, 25 bp, S. cerevisiae
gctttgcgccttatttggcatcatt

SEQ ID NO: 27405 - DNA, 25 bp, S. cerevisiae
gctttgcagcattttactactccta

SEQ ID NO: 27406 - DNA, 25 bp, S. cerevisiae
gctatatgccttgtacattgtccta

SEQ ID NO: 27407 - DNA, 25 bp, S. cerevisiae
gcttgtccttaaatttgctccatta

SEQ ID NO: 27408 - DNA, 25 bp, S. cerevisiae
gctttcgtatctgcgtctcatcctt

SEQ ID NO: 27409 - DNA, 25 bp, S. cerevisiae
gctattgattttgctatcccattgt

SEQ ID NO: 27410 - DNA, 25 bp, S. cerevisiae
gcttggacggtctggtgagttatca

SEQ ID NO: 27411 - DNA, 25 bp, S. cerevisiae
gcatttggctggtggactggttaac

SEQ ID NO: 27412 - DNA, 25 bp, S. cerevisiae
gcttaagatgcaatacgacaccaag

SEQ ID NO: 27413 - DNA, 25 bp, S. cerevisiae
gcttgaaattcaacaacatgccaga

SEQ ID NO: 27414 - DNA, 25 bp, S. cerevisiae
gcagtgatttcccatgcgaatgcgg

SEQ ID NO: 27415 - DNA, 25 bp, S. cerevisiae
tcatggatttggctgctgcaaagct

SEQ ID NO: 27416 - DNA, 25 bp, S. cerevisiae
gcatgagtttgatggccaggtcacc

SEQ ID NO: 27417 - DNA, 25 bp, S. cerevisiae
gcatatttctgatcgacaaacccat

SEQ ID NO: 27418 - DNA, 25 bp, S. cerevisiae
gcttattggcaaactagactcctat

SEQ ID NO: 27419 - DNA, 25 bp, S. cerevisiae
gctttatgagctgatcggacttgtt

SEQ ID NO: 27420 - DNA, 25 bp, S. cerevisiae
gcttgttatcactaagttacacttg

SEQ ID NO: 27421 - DNA, 25 bp, S. cerevisiae
gctatttccaaatgctgtcaggctg

SEQ ID NO: 27422 - DNA, 25 bp, S. cerevisiae
gcattgtccagcatgtagccctaaa

SEQ ID NO: 27423 - DNA, 25 bp, S. cerevisiae
gctttaagagtcaccgctagagatt

SEQ ID NO: 27424 - DNA, 25 bp, S. cerevisiae
gctttcatcgagcatccctgaagaa

SEQ ID NO: 27425 - DNA, 25 bp, S. cerevisiae
gctttctcggttactctgcagatga

SEQ ID NO: 27426 - DNA, 25 bp, S. cerevisiae
gctattgaattataccagcgccata

SEQ ID NO: 27427 - DNA, 25 bp, S. cerevisiae
gcattgaatgccagccaaaggccat

SEQ ID NO: 27428 - DNA, 25 bp, S. cerevisiae
gcatcctcaagggaagactgggcaa

SEQ ID NO: 27429 - DNA, 25 bp, S. cerevisiae
gcatgcctcaacttaatgacggtaa

SEQ ID NO: 27430 - DNA, 25 bp, S. cerevisiae
gcatctccatggcttagggttcaat

SEQ ID NO: 27431 - DNA, 25 bp, S. cerevisiae
gcttctgcagttactaaggcccaat

SEQ ID NO: 27432 - DNA, 25 bp, S. cerevisiae
gcatccagagtttctaaaccaccta

SEQ ID NO: 27433 - DNA, 25 bp, S. cerevisiae
gcagttgagtcatcccaaacagggt

SEQ ID NO: 27434 - DNA, 25 bp, S. cerevisiae
gcagttttacggtccaagcgggcca

SEQ ID NO: 27435 - DNA, 25 bp, S. cerevisiae
gaggttttttgagaatgccgcccgg

SEQ ID NO: 27436 - DNA, 25 bp, S. cerevisiae
gcttatttggtgcattttccgggac

SEQ ID NO: 27437 - DNA, 25 bp, S. cerevisiae
gctttcccattgatattcccagaga

SEQ ID NO: 27438 - DNA, 25 bp, S. cerevisiae
gctttatccaggctttagcgggcga

SEQ ID NO: 27439 - DNA, 25 bp, S. cerevisiae
gcttgctaccatgtcttttgtttta

SEQ ID NO: 27440 - DNA, 25 bp, S. cerevisiae
gcattaacctcttttttgtattaca

SEQ ID NO: 27441 - DNA, 25 bp, S. cerevisiae
gcttccactttcacggctattaaaa

SEQ ID NO: 27442 - DNA, 25 bp, S. cerevisiae
gcatacctcattactctcgaattta

SEQ ID NO: 27443 - DNA, 25 bp, S. cerevisiae
gcattcacaccttatccgattttaa

SEQ ID NO: 27444 - DNA, 25 bp, S. cerevisiae
gcttaattcgggagccaaagtgttt

SEQ ID NO: 27445 - DNA, 25 bp, S. cerevisiae
gctttgccattattgcggttagttg

SEQ ID NO: 27446 - DNA, 25 bp, S. cerevisiae
gcttctgtctctaagcgtcaagaat

SEQ ID NO: 27447 - DNA, 25 bp, S. cerevisiae
gctattgtctcattggcttccgaat

SEQ ID NO: 27448 - DNA, 25 bp, S. cerevisiae
gcttttagagcgctcctggacaaaa

SEQ ID NO: 27449 - DNA, 25 bp, S. cerevisiae
gcttaggcgttccatttgctgaaaa

SEQ ID NO: 27450 - DNA, 25 bp, S. cerevisiae
gcttttcagttgtttcttcttggtc

SEQ ID NO: 27451 - DNA, 25 bp, S. cerevisiae
gctttttcttattggttgctgtcat

SEQ ID NO: 27452 - DNA, 25 bp, S. cerevisiae
gctttactaatctgacggatccctt

SEQ ID NO: 27453 - DNA, 25 bp, S. cerevisiae
gcttgtatcgaatttacggcccaat

SEQ ID NO: 27454 - DNA, 25 bp, S. cerevisiae
gctttaagtatcaaactgacaccag

SEQ ID NO: 27455 - DNA, 25 bp, S. cerevisiae
gcaaataattttcgacctcttcaaa

SEQ ID NO: 27456 - DNA, 25 bp, S. cerevisiae
gcattaaattacctcctccttctta

SEQ ID NO: 27457 - DNA, 25 bp, S. cerevisiae
gcattaactttcctactgttgtcta

SEQ ID NO: 27458 - DNA, 25 bp, S. cerevisiae
gcttctcaattggttgacttgaaaa

SEQ ID NO: 27459 - DNA, 25 bp, S. cerevisiae
gcttatagggccatttctcacaatc

SEQ ID NO: 27460 - DNA, 25 bp, S. cerevisiae
gcttataatacccttgattcaaact

SEQ ID NO: 27461 - DNA, 25 bp, S. cerevisiae
gctttcaaatccgttgtttctactg

SEQ ID NO: 27462 - DNA, 25 bp, S. cerevisiae
gcttcgtcaagctgtttccaataca

SEQ ID NO: 27463 - DNA, 25 bp, S. cerevisiae
gctttcgagaaggttggctggctac

SEQ ID NO: 27464 - DNA, 25 bp, S. cerevisiae
gcttaagatctactggtgtgggcaa

SEQ ID NO: 27465 - DNA, 25 bp, S. cerevisiae
gcttctagatatgtggtgggacccc

SEQ ID NO: 27466 - DNA, 25 bp, S. cerevisiae
gcagttggtcagagcttggactaca

SEQ ID NO: 27467 - DNA, 25 bp, S. cerevisiae
gcttggttcgatcgcgttacaacat

SEQ ID NO: 27468 - DNA, 25 bp, S. cerevisiae
gcttccactgtcattgtaaatcctg

SEQ ID NO: 27469 - DNA, 25 bp, S. cerevisiae
gcttaactgcctttgataacatcct

SEQ ID NO: 27470 - DNA, 25 bp, S. cerevisiae
gcatcttatcccgtggtaaatccat

SEQ ID NO: 27471 - DNA, 25 bp, S. cerevisiae
gcatatttcaagattcaacccatta

SEQ ID NO: 27472 - DNA, 25 bp, S. cerevisiae
gcttttcacagggttcttcgatcga

SEQ ID NO: 27473 - DNA, 25 bp, S. cerevisiae
gcatatctttggtcggtatttacat

SEQ ID NO: 27474 - DNA, 25 bp, S. cerevisiae
gcttatatcattctgactcttcacc

SEQ ID NO: 27475 - DNA, 25 bp, S. cerevisiae
gcatctcaagtaggtggtgttcaaa

SEQ ID NO: 27476 - DNA, 25 bp, S. cerevisiae
gcttcagagttgatgcctggctcaa

SEQ ID NO: 27477 - DNA, 25 bp, S. cerevisiae
gcatattgatccgacatcgtccgaa

SEQ ID NO: 27478 - DNA, 25 bp, S. cerevisiae
gcattatattcacctcagatccgta

SEQ ID NO: 27479 - DNA, 25 bp, S. cerevisiae
gcatttttatcttcgatggctttcc

SEQ ID NO: 27480 - DNA, 25 bp, S. cerevisiae
gcatatttctactgctggtactgaa

SEQ ID NO: 27481 - DNA, 25 bp, S. cerevisiae
gcattgatccgtccacttatttgaa

SEQ ID NO: 27482 - DNA, 25 bp, S. cerevisiae
gcttgtcttggtatagtatcattta

SEQ ID NO: 27483 - DNA, 25 bp, S. cerevisiae
gcaaatcccaggttgtttagtaagt

SEQ ID NO: 27484 - DNA, 25 bp, S. cerevisiae
gcttctccgagatttatagtattcc

SEQ ID NO: 27485 - DNA, 25 bp, S. cerevisiae
gcttgcctcaaattttatgtctacc

SEQ ID NO: 27486 - DNA, 25 bp, S. cerevisiae
gcattggtaatatcttgtcggagta

SEQ ID NO: 27487 - DNA, 25 bp, S. cerevisiae
gcattaattatgtaccccacgcaag

SEQ ID NO: 27488 - DNA, 25 bp, S. cerevisiae
gcatttacttttgaacagcgacagg

SEQ ID NO: 27489 - DNA, 25 bp, S. cerevisiae
gcatttaaatcgtgaagccctaggg

SEQ ID NO: 27490 - DNA, 25 bp, S. cerevisiae
gcatccaaaatcgtcaatcctctaa

SEQ ID NO: 27491 - DNA, 25 bp, S. cerevisiae
gcatctaaaactaccagtggcgcta

SEQ ID NO: 27492 - DNA, 25 bp, S. cerevisiae
gcacaggaacctccacaggaagcta

SEQ ID NO: 27493 - DNA, 25 bp, S. cerevisiae
gttgacgagcaactaatgcaccaat

SEQ ID NO: 27494 - DNA, 25 bp, S. cerevisiae
gcttgtcgcaattctaaacatctgt

SEQ ID NO: 27495 - DNA, 25 bp, S. cerevisiae
gcattggccatgtacgttgccggta

SEQ ID NO: 27496 - DNA, 25 bp, S. cerevisiae
gcatttgcgagagcttttacggata

SEQ ID NO: 27497 - DNA, 25 bp, S. cerevisiae
gcttcctctgatatatttacgtgtt

SEQ ID NO: 27498 - DNA, 25 bp, S. cerevisiae
gcttccatcgatttacttgccaagg

SEQ ID NO: 27499 - DNA, 25 bp, S. cerevisiae
gcttccacgctgaatatatacgaat

SEQ ID NO: 27500 - DNA, 25 bp, S. cerevisiae
gcttatcacttactgtcgccagctc

SEQ ID NO: 27501 - DNA, 25 bp, S. cerevisiae
gcttacacttattgctcatccagaa

SEQ ID NO: 27502 - DNA, 25 bp, S. cerevisiae
gcttcatactgaatggttcctcaaa

SEQ ID NO: 27503 - DNA, 25 bp, S. cerevisiae
gcttcagactcaatttaccgctcaa

SEQ ID NO: 27504 - DNA, 25 bp, S. cerevisiae
gcataaggtgtctccactcatggaa

SEQ ID NO: 27505 - DNA, 25 bp, S. cerevisiae
gcatacaggccaaatacctctggaa

SEQ ID NO: 27506 - DNA, 25 bp, S. cerevisiae
gcatagtgtctaaaaccttcggaaa

SEQ ID NO: 27507 - DNA, 25 bp, S. cerevisiae
gcttggttccaaatcaggagctgca

SEQ ID NO: 27508 - DNA, 25 bp, S. cerevisiae
gcatcgttctcgacatgaaggtcta

SEQ ID NO: 27509 - DNA, 25 bp, S. cerevisiae
gcattcttcctgttacggtatacca

SEQ ID NO: 27510 - DNA, 25 bp, S. cerevisiae
gcatggtgggtctaacggtctcaac

SEQ ID NO: 27511 - DNA, 25 bp, S. cerevisiae
gcacgaggtctacaacatcactgaa

SEQ ID NO: 27512 - DNA, 25 bp, S. cerevisiae
gcatctggttatctaagccctgaaa

SEQ ID NO: 27513 - DNA, 25 bp, S. cerevisiae
gcatctttataacgagggccccatg

SEQ ID NO: 27514 - DNA, 25 bp, S. cerevisiae
gcatttttagtcgtggcccgcgata

SEQ ID NO: 27515 - DNA, 25 bp, S. cerevisiae
gcttctgcttacttcacatctggag

SEQ ID NO: 27516 - DNA, 25 bp, S. cerevisiae
gcattgcccgccatcagattggaat

SEQ ID NO: 27517 - DNA, 25 bp, S. cerevisiae
gcactgccacaacatcgacgtaaaa

SEQ ID NO: 27518 - DNA, 25 bp, S. cerevisiae
gcttccatacgaacggctcatacaa

SEQ ID NO: 27519 - DNA, 25 bp, S. cerevisiae
gcatagcattacgaggccttccaaa

SEQ ID NO: 27520 - DNA, 25 bp, S. cerevisiae
gcttgtggcaagacctctttactat

SEQ ID NO: 27521 - DNA, 25 bp, S. cerevisiae
gcttcggcggtatctacaacatatt

SEQ ID NO: 27522 - DNA, 25 bp, S. cerevisiae
gcttacctagagacatcactgctgt

SEQ ID NO: 27523 - DNA, 25 bp, S. cerevisiae
gcttacactgtctccactgctgctg

SEQ ID NO: 27524 - DNA, 25 bp, S. cerevisiae
gcttacgctgtccttatgatggtgt

SEQ ID NO: 27525 - DNA, 25 bp, S. cerevisiae
gcttgacacttgctatccatggaat

SEQ ID NO: 27526 - DNA, 25 bp, S. cerevisiae
gcttattatgctctgatctggtgaa

SEQ ID NO: 27527 - DNA, 25 bp, S. cerevisiae
gcttcttcttcatcaatgtcggcta

SEQ ID NO: 27528 - DNA, 25 bp, S. cerevisiae
gcattattactatccccgagcaaac

SEQ ID NO: 27529 - DNA, 25 bp, S. cerevisiae
gcttgagaacgttgccctggaaaat

SEQ ID NO: 27530 - DNA, 25 bp, S. cerevisiae
gcataaatcgcgtcaccagggatga

SEQ ID NO: 27531 - DNA, 25 bp, S. cerevisiae
gcattatatcgctaccaacaggtgt

SEQ ID NO: 27532 - DNA, 25 bp, S. cerevisiae
gcttccaagatagtgttgcgttcat

SEQ ID NO: 27533 - DNA, 25 bp, S. cerevisiae
gcttacatatgtatcttgcgttgct

SEQ ID NO: 27534 - DNA, 25 bp, S. cerevisiae
gcatggacttttgtagcctcgaaaa

SEQ ID NO: 27535 - DNA, 25 bp, S. cerevisiae
gcatggttacattggcgaattcgaa

SEQ ID NO: 27536 - DNA, 25 bp, S. cerevisiae
gcttacttgcattacattccaaagt

SEQ ID NO: 27537 - DNA, 25 bp, S. cerevisiae
gcttacctcatttgatctcgaacgt

SEQ ID NO: 27538 - DNA, 25 bp, S. cerevisiae
gcttatgctccgaatttaatgttat

SEQ ID NO: 27539 - DNA, 25 bp, S. cerevisiae
gcttcatgttcagcaggacctgtag

SEQ ID NO: 27540 - DNA, 25 bp, S. cerevisiae
gcatatcggtgctcagaacactgga

SEQ ID NO: 27541 - DNA, 25 bp, S. cerevisiae
gcattggaggcattacacaccgtgg

SEQ ID NO: 27542 - DNA, 25 bp, S. cerevisiae
gcatccagtgataaacttgactcca

SEQ ID NO: 27543 - DNA, 25 bp, S. cerevisiae
gcttcaaaagccctggagtgtctat

SEQ ID NO: 27544 - DNA, 25 bp, S. cerevisiae
gcttccaactctggtgttgttgttt

SEQ ID NO: 27545 - DNA, 25 bp, S. cerevisiae
gcttcccactctttgaaaactgtct

SEQ ID NO: 27546 - DNA, 25 bp, S. cerevisiae
gcttcctcacattcggatacaactg

SEQ ID NO: 27547 - DNA, 25 bp, S. cerevisiae
gcattcatatctatcgtcgacagcg

SEQ ID NO: 27548 - DNA, 25 bp, S. cerevisiae
gcatagatcattctccatccaaagc

SEQ ID NO: 27549 - DNA, 25 bp, S. cerevisiae
gcttggtggttgcttttaatgaata

SEQ ID NO: 27550 - DNA, 25 bp, S. cerevisiae
gcttcctgttgtgttgtctaaaatg

SEQ ID NO: 27551 - DNA, 25 bp, S. cerevisiae
gcttctgcctctgcattttcgaaaa

SEQ ID NO: 27552 - DNA, 25 bp, S. cerevisiae
gcttctgcggttactcctaaactag

SEQ ID NO: 27553 - DNA, 25 bp, S. cerevisiae
gcttctaaggacatcgctcaaacat

SEQ ID NO: 27554 - DNA, 25 bp, S. cerevisiae
gcttacagaatgatagcgccgttaa

SEQ ID NO: 27555 - DNA, 25 bp, S. cerevisiae
gcataatactggcaagagatactca

SEQ ID NO: 27556 - DNA, 25 bp, S. cerevisiae
gcattgaattgccagtcgtatacca

SEQ ID NO: 27557 - DNA, 25 bp, S. cerevisiae
gcaagatattggttccgatcccact

SEQ ID NO: 27558 - DNA, 25 bp, S. cerevisiae
gcttgttcgtgttcttttggatcta

SEQ ID NO: 27559 - DNA, 25 bp, S. cerevisiae
gcatagcttcgctgatggtaagttc

SEQ ID NO: 27560 - DNA, 25 bp, S. cerevisiae
gcatcggtcacaggtttattcactc

SEQ ID NO: 27561 - DNA, 25 bp, S. cerevisiae
gcataatcacatccttcttcttaat

SEQ ID NO: 27562 - DNA, 25 bp, S. cerevisiae
gagtccctaagcagatctcccaagg

SEQ ID NO: 27563 - DNA, 25 bp, S. cerevisiae
gcagctcccgtagaggttaccatga

SEQ ID NO: 27564 - DNA, 25 bp, S. cerevisiae
gcattacgcggtgacattgcattaa

SEQ ID NO: 27565 - DNA, 25 bp, S. cerevisiae
gcttcctcgcttcttggtgtgagaa

SEQ ID NO: 27566 - DNA, 25 bp, S. cerevisiae
gcttgaccactgtttttgcttcgaa

SEQ ID NO: 27567 - DNA, 25 bp, S. cerevisiae
gcaggcccctgaatatagtaatcgt

SEQ ID NO: 27568 - DNA, 25 bp, S. cerevisiae
gcacgggcatttttagaacaggttt

SEQ ID NO: 27569 - DNA, 25 bp, S. cerevisiae
gcacgttgaattcaagtaccctgag

SEQ ID NO: 27570 - DNA, 25 bp, S. cerevisiae
gcattgtcgactttacgaaccctaa

SEQ ID NO: 27571 - DNA, 25 bp, S. cerevisiae
gaagtagtgtctgtcgataacggta

SEQ ID NO: 27572 - DNA, 25 bp, S. cerevisiae
gcatttcaggcgctatcaagacaat

SEQ ID NO: 27573 - DNA, 25 bp, S. cerevisiae
gcttctatatttcctcatgctaaca

SEQ ID NO: 27574 - DNA, 25 bp, S. cerevisiae
gcattgctaatgttgttcactttta

SEQ ID NO: 27575 - DNA, 25 bp, S. cerevisiae
gcttgtgaagatttggtggctgcct

SEQ ID NO: 27576 - DNA, 25 bp, S. cerevisiae
gcattctcaaagtttgaagtcccaa

SEQ ID NO: 27577 - DNA, 25 bp, S. cerevisiae
gcttccagtacttttgtgtcgacaa

SEQ ID NO: 27578 - DNA, 25 bp, S. cerevisiae
gcattcgacttctaagggtgtttct

SEQ ID NO: 27579 - DNA, 25 bp, S. cerevisiae
gcagttcgaatgcatcgattccaga

SEQ ID NO: 27580 - DNA, 25 bp, S. cerevisiae
gcactccaagtgctaattccagcat

SEQ ID NO: 27581 - DNA, 25 bp, S. cerevisiae
gcaacttgaccctgttttgttacca

SEQ ID NO: 27582 - DNA, 25 bp, S. cerevisiae
gcatatttaacttcttacaacagca

SEQ ID NO: 27583 - DNA, 25 bp, S. cerevisiae
gcttctgtcaactctgttcaatggg

SEQ ID NO: 27584 - DNA, 25 bp, S. cerevisiae
gcagttaaagccactagttcctcta

SEQ ID NO: 27585 - DNA, 25 bp, S. cerevisiae
gcaggacacggatctgaatgccatt

SEQ ID NO: 27586 - DNA, 25 bp, S. cerevisiae
gcaggacacaatcaataagcttttg

SEQ ID NO: 27587 - DNA, 25 bp, S. cerevisiae
gcttccgcggaggaaatatttccat

SEQ ID NO: 27588 - DNA, 25 bp, S. cerevisiae
gcttccctgtcagacgatgacttga

SEQ ID NO: 27589 - DNA, 25 bp, S. cerevisiae
gcttctgttattttgagcaccccaa

SEQ ID NO: 27590 - DNA, 25 bp, S. cerevisiae
gcagttgctattgaaggatgacacc

SEQ ID NO: 27591 - DNA, 25 bp, S. cerevisiae
gcagctagcatatttggacagacaa

SEQ ID NO: 27592 - DNA, 25 bp, S. cerevisiae
gcagatttgcatatgggcgactcat

SEQ ID NO: 27593 - DNA, 25 bp, S. cerevisiae
gcattgttgcaatttcgaccagcgc

SEQ ID NO: 27594 - DNA, 25 bp, S. cerevisiae
gcattccatgcttttcaattacgcg

SEQ ID NO: 27595 - DNA, 25 bp, S. cerevisiae
gcattgcagatatgacgcatctaga

SEQ ID NO: 27596 - DNA, 25 bp, S. cerevisiae
gcatgcgatggctaacgatttgact

SEQ ID NO: 27597 - DNA, 25 bp, S. cerevisiae
gcttcccaagtgtttttccatgatg

SEQ ID NO: 27598 - DNA, 25 bp, S. cerevisiae
gcatcggaacctttgactttcgaga

SEQ ID NO: 27599 - DNA, 25 bp, S. cerevisiae
gcatcttcgaccattgtttccaagt

SEQ ID NO: 27600 - DNA, 25 bp, S. cerevisiae
gcatttgatgtacactttgggccca

SEQ ID NO: 27601 - DNA, 25 bp, S. cerevisiae
gcattttccactatttggtgtccaa

SEQ ID NO: 27602 - DNA, 25 bp, S. cerevisiae
gcatttcctcctatgattggctact

SEQ ID NO: 27603 - DNA, 25 bp, S. cerevisiae
gcatcgttacctattgtgttcacat

SEQ ID NO: 27604 - DNA, 25 bp, S. cerevisiae
gcaggattacgaccaattgtaccat

SEQ ID NO: 27605 - DNA, 25 bp, S. cerevisiae
gcagttgtccaacgttgtcttttcg

SEQ ID NO: 27606 - DNA, 25 bp, S. cerevisiae
gcagatgtgacctttgagcgtttac

SEQ ID NO: 27607 - DNA, 25 bp, S. cerevisiae
gcatccgatgcctttagagtccata

SEQ ID NO: 27608 - DNA, 25 bp, S. cerevisiae
gcattggcgtcagtctttctgataa

SEQ ID NO: 27609 - DNA, 25 bp, S. cerevisiae
gcttgtttacatcatcatttggagg

SEQ ID NO: 27610 - DNA, 25 bp, S. cerevisiae
gcatcagatttgttggttgtcctag

SEQ ID NO: 27611 - DNA, 25 bp, S. cerevisiae
gcacagctactgttggttggtaaca

SEQ ID NO: 27612 - DNA, 25 bp, S. cerevisiae
gcatctgatgaatctgttcgcgata

SEQ ID NO: 27613 - DNA, 25 bp, S. cerevisiae
gcattgaaactgtcggaaggcttaa

SEQ ID NO: 27614 - DNA, 25 bp, S. cerevisiae
gcttgtgatgcttatccgagcgtta

SEQ ID NO: 27615 - DNA, 25 bp, S. cerevisiae
gcatcaggccactggttctacataa

SEQ ID NO: 27616 - DNA, 25 bp, S. cerevisiae
gcattgggcagctgtctatatgaat

SEQ ID NO: 27617 - DNA, 25 bp, S. cerevisiae
gcattgttggcaatcttatgtggat

SEQ ID NO: 27618 - DNA, 25 bp, S. cerevisiae
gcatctgtttgccttaagctgaact

SEQ ID NO: 27619 - DNA, 25 bp, S. cerevisiae
gcagattgttgctggaatggccgct

SEQ ID NO: 27620 - DNA, 25 bp, S. cerevisiae
gcatcatttatgttttccccagttt

SEQ ID NO: 27621 - DNA, 25 bp, S. cerevisiae
gcattcgtacacaacccaagcaagg

SEQ ID NO: 27622 - DNA, 25 bp, S. cerevisiae
gcattacgatattgtcctgacgcac

SEQ ID NO: 27623 - DNA, 25 bp, S. cerevisiae
gcattgaaatcattgtcttacgacc

SEQ ID NO: 27624 - DNA, 25 bp, S. cerevisiae
gcatgctctcattcagttcgctaat

SEQ ID NO: 27625 - DNA, 25 bp, S. cerevisiae
gcttgtgctaacatcgcgatatcct

SEQ ID NO: 27626 - DNA, 25 bp, S. cerevisiae
gcagatgatctggaaagcggactcg

SEQ ID NO: 27627 - DNA, 25 bp, S. cerevisiae
gcatggttgaagcagcggcacttaa

SEQ ID NO: 27628 - DNA, 25 bp, S. cerevisiae
gcatgactgctatagagtgacctta

SEQ ID NO: 27629 - DNA, 25 bp, S. cerevisiae
gcatgactcagaaaggctatcgcac

SEQ ID NO: 27630 - DNA, 25 bp, S. cerevisiae
gcatcacacaattggcgtacgcaag

SEQ ID NO: 27631 - DNA, 25 bp, S. cerevisiae
gcataccatctaacttgctcgaaga

SEQ ID NO: 27632 - DNA, 25 bp, S. cerevisiae
gcatatgtgctcatctattgggatt

SEQ ID NO: 27633 - DNA, 25 bp, S. cerevisiae
gcatttagaggatacgctttcgcat

SEQ ID NO: 27634 - DNA, 25 bp, S. cerevisiae
gcattattaggatacgctgtcccag

SEQ ID NO: 27635 - DNA, 25 bp, S. cerevisiae
gcttgtcaagactatggcacctgta

SEQ ID NO: 27636 - DNA, 25 bp, S. cerevisiae
gcttgtaatggcttaacgagctgca

SEQ ID NO: 27637 - DNA, 25 bp, S. cerevisiae
gcatttagctagttactcgccagag

SEQ ID NO: 27638 - DNA, 25 bp, S. cerevisiae
gcattgtttctactggatatttttt

SEQ ID NO: 27639 - DNA, 25 bp, S. cerevisiae
gcagtgcctcatctttaatttcttt

SEQ ID NO: 27640 - DNA, 25 bp, S. cerevisiae
gcatcatcccatcccaataattact

SEQ ID NO: 27641 - DNA, 25 bp, S. cerevisiae
gcatcgctcgatctcaaacatcata

SEQ ID NO: 27642 - DNA, 25 bp, S. cerevisiae
gcatcgcctgttgaaaagcttgaac

SEQ ID NO: 27643 - DNA, 25 bp, S. cerevisiae
gaactttccgaactagaccaaagag

SEQ ID NO: 27644 - DNA, 25 bp, S. cerevisiae
gaattaaccgttcaatccgagagag

SEQ ID NO: 27645 - DNA, 25 bp, S. cerevisiae
gcagcgaacgttgtgttacctgaca

SEQ ID NO: 27646 - DNA, 25 bp, S. cerevisiae
gcattgagcgcgttttgttcaccaa

SEQ ID NO: 27647 - DNA, 25 bp, S. cerevisiae
gcatgtaaggttatttccatcgtgg

SEQ ID NO: 27648 - DNA, 25 bp, S. cerevisiae
gcatttattctgtttctggcttgta

SEQ ID NO: 27649 - DNA, 25 bp, S. cerevisiae
gcatgtttatggttctgtggttcca

SEQ ID NO: 27650 - DNA, 25 bp, S. cerevisiae
gcatcttctgaggttccgtggttga

SEQ ID NO: 27651 - DNA, 25 bp, S. cerevisiae
gcaaggatctggcaaaacggtactt

SEQ ID NO: 27652 - DNA, 25 bp, S. cerevisiae
gaacaagaatgtcccggcggttgcc

SEQ ID NO: 27653 - DNA, 25 bp, S. cerevisiae
gcatttagatgccaccgtttgaatt

SEQ ID NO: 27654 - DNA, 25 bp, S. cerevisiae
gcatcagtgagcatgacctggtcca

SEQ ID NO: 27655 - DNA, 25 bp, S. cerevisiae
gcatcagagctgctacagggtccaa

SEQ ID NO: 27656 - DNA, 25 bp, S. cerevisiae
gcataggctcgctaatcttgttcaa

SEQ ID NO: 27657 - DNA, 25 bp, S. cerevisiae
gcattcgctgctgagttatttgtac

SEQ ID NO: 27658 - DNA, 25 bp, S. cerevisiae
gcatttggattctctgccatggaaa

SEQ ID NO: 27659 - DNA, 25 bp, S. cerevisiae
gcattatgggctggacttgccacga

SEQ ID NO: 27660 - DNA, 25 bp, S. cerevisiae
gcattgcagtttgccttctacgaaa

SEQ ID NO: 27661 - DNA, 25 bp, S. cerevisiae
gcatttgcattccacctttttgaaa

SEQ ID NO: 27662 - DNA, 25 bp, S. cerevisiae
gcatttcgacgagattttcatttga

SEQ ID NO: 27663 - DNA, 25 bp, S. cerevisiae
gcatgtgttcccttttttggtgtat

SEQ ID NO: 27664 - DNA, 25 bp, S. cerevisiae
gcagatgtttctattgttgggttat

SEQ ID NO: 27665 - DNA, 25 bp, S. cerevisiae
gcatggttatcaatctcgtgggttt

SEQ ID NO: 27666 - DNA, 25 bp, S. cerevisiae
gcaggccttacaatagcgagggtat

SEQ ID NO: 27667 - DNA, 25 bp, S. cerevisiae
gcaggcgctagtattgggtcagata

SEQ ID NO: 27668 - DNA, 25 bp, S. cerevisiae
gcatggtactccttcttattcaaat

SEQ ID NO: 27669 - DNA, 25 bp, S. cerevisiae
gcttgtagctccattatcttcattt

SEQ ID NO: 27670 - DNA, 25 bp, S. cerevisiae
gcttgtattgccattattgctacca

SEQ ID NO: 27671 - DNA, 25 bp, S. cerevisiae
gcagctacagtttgcgtataacctt

SEQ ID NO: 27672 - DNA, 25 bp, S. cerevisiae
gcagataacgttcgttcgcactctt

SEQ ID NO: 27673 - DNA, 25 bp, S. cerevisiae
gcatattcagcggattgttccctta

SEQ ID NO: 27674 - DNA, 25 bp, S. cerevisiae
gcatgttacctaatttcacaagcta

SEQ ID NO: 27675 - DNA, 25 bp, S. cerevisiae
gcaggcggtgatcttatcgaatcca

SEQ ID NO: 27676 - DNA, 25 bp, S. cerevisiae
gcaggaaggcatttgaagcgttcta

SEQ ID NO: 27677 - DNA, 25 bp, S. cerevisiae
gcatgtgctaagaaccttgtcctca

SEQ ID NO: 27678 - DNA, 25 bp, S. cerevisiae
gcttggccaattgttttcgagttac

SEQ ID NO: 27679 - DNA, 25 bp, S. cerevisiae
gcatgttcgatgtccttttttcttt

SEQ ID NO: 27680 - DNA, 25 bp, S. cerevisiae
gcatagatgccattagcgacctcga

SEQ ID NO: 27681 - DNA, 25 bp, S. cerevisiae
gcatctactaccacatcttcttgga

SEQ ID NO: 27682 - DNA, 25 bp, S. cerevisiae
gcatatgctatctttttgtccagta

SEQ ID NO: 27683 - DNA, 25 bp, S. cerevisiae
gcattgcccaacttctataagctag

SEQ ID NO: 27684 - DNA, 25 bp, S. cerevisiae
gcattgagatgccagccggtttgat

SEQ ID NO: 27685 - DNA, 25 bp, S. cerevisiae
gcattaatgggtggttcttcttttg

SEQ ID NO: 27686 - DNA, 25 bp, S. cerevisiae
gcattggcccgatttgatggttata

SEQ ID NO: 27687 - DNA, 25 bp, S. cerevisiae
gcaggtaacacttttttcccgatct

SEQ ID NO: 27688 - DNA, 25 bp, S. cerevisiae
gcagaggtaccttgtttgtccgtgg

SEQ ID NO: 27689 - DNA, 25 bp, S. cerevisiae
gcatgaagggtttggtcttgcctga

SEQ ID NO: 27690 - DNA, 25 bp, S. cerevisiae
gcatacggtgctcaggcagttgtta

SEQ ID NO: 27691 - DNA, 25 bp, S. cerevisiae
gcatacgatgtcctaggcttgataa

SEQ ID NO: 27692 - DNA, 25 bp, S. cerevisiae
gcatcttattcggtgcagtcgataa

SEQ ID NO: 27693 - DNA, 25 bp, S. cerevisiae
gcattgtacgagtcatggcccgata

SEQ ID NO: 27694 - DNA, 25 bp, S. cerevisiae
gcattttcgccatctggtgggctac

SEQ ID NO: 27695 - DNA, 25 bp, S. cerevisiae
gcatattcgggcactggagctttga

SEQ ID NO: 27696 - DNA, 25 bp, S. cerevisiae
gcattgatgcggctctttatgaaat

SEQ ID NO: 27697 - DNA, 25 bp, S. cerevisiae
gcatcatatctacgtctttgggcac

SEQ ID NO: 27698 - DNA, 25 bp, S. cerevisiae
gcatgagtttcgatgttggcacacg

SEQ ID NO: 27699 - DNA, 25 bp, S. cerevisiae
gcattgtttatttttggcagcactg

SEQ ID NO: 27700 - DNA, 25 bp, S. cerevisiae
gcatctcttattagaacgtttctga

SEQ ID NO: 27701 - DNA, 25 bp, S. cerevisiae
gcatccatgggtacaacgtctacat

SEQ ID NO: 27702 - DNA, 25 bp, S. cerevisiae
gcatacattgctagtaatctaccaa

SEQ ID NO: 27703 - DNA, 25 bp, S. cerevisiae
gcatcaatcgctcgtcgttacaaac

SEQ ID NO: 27704 - DNA, 25 bp, S. cerevisiae
gcattacgaacattctccacatcaa

SEQ ID NO: 27705 - DNA, 25 bp, S. cerevisiae
gcatgctgagcatcgtgaacatttg

SEQ ID NO: 27706 - DNA, 25 bp, S. cerevisiae
gcatattttgaagcatatcaagcca

SEQ ID NO: 27707 - DNA, 25 bp, S. cerevisiae
gcatattttgaagcatatcaagcca

SEQ ID NO: 27708 - DNA, 25 bp, S. cerevisiae
gcatttactgaaactgagcacggct

SEQ ID NO: 27709 - DNA, 25 bp, S. cerevisiae
gcagatggacttcgacggcgaccaa

SEQ ID NO: 27710 - DNA, 25 bp, S. cerevisiae
gcatatggaccatgagcatcagcta

SEQ ID NO: 27711 - DNA, 25 bp, S. cerevisiae
gcatgatgggctcattgtcacagaa

SEQ ID NO: 27712 - DNA, 25 bp, S. cerevisiae
gcattgctctatatgatcccatttg

SEQ ID NO: 27713 - DNA, 25 bp, S. cerevisiae
gcattcctatggcaccaagttcgtt

SEQ ID NO: 27714 - DNA, 25 bp, S. cerevisiae
gcacccattgcgcatcgaaaacgtt

SEQ ID NO: 27715 - DNA, 25 bp, S. cerevisiae
gcaccgctatcctatgtttaacagt

SEQ ID NO: 27716 - DNA, 25 bp, S. cerevisiae
gcacccaatggcaagattcgagcta

SEQ ID NO: 27717 - DNA, 25 bp, S. cerevisiae
gcatcatcaagaccctttggcattt

SEQ ID NO: 27718 - DNA, 25 bp, S. cerevisiae
gcattccattgctgctgtatcaaca

SEQ ID NO: 27719 - DNA, 25 bp, S. cerevisiae
gcattccaccaatatcattctttag

SEQ ID NO: 27720 - DNA, 25 bp, S. cerevisiae
gcatgcccgctgtgagcaaattgtt

SEQ ID NO: 27721 - DNA, 25 bp, S. cerevisiae
gcatccgcggaatcagcagcttcat

SEQ ID NO: 27722 - DNA, 25 bp, S. cerevisiae
gcagacctactttcgactgttggga

SEQ ID NO: 27723 - DNA, 25 bp, S. cerevisiae
gcaggcctactattttcagtgggac

SEQ ID NO: 27724 - DNA, 25 bp, S. cerevisiae
tcacggttctactttcggcggtaat

SEQ ID NO: 27725 - DNA, 25 bp, S. cerevisiae
gcatctggattgcacgttcgtggac

SEQ ID NO: 27726 - DNA, 25 bp, S. cerevisiae
gcattcttgcagtttgacgatggat

SEQ ID NO: 27727 - DNA, 25 bp, S. cerevisiae
gcaggcgggacttcgtggttcactt

SEQ ID NO: 27728 - DNA, 25 bp, S. cerevisiae
gcatggcaggaatactcatctattt

SEQ ID NO: 27729 - DNA, 25 bp, S. cerevisiae
gcacctggccaaaccttttgataga

SEQ ID NO: 27730 - DNA, 25 bp, S. cerevisiae
gcaggaagcccaaccttttgaacaa

SEQ ID NO: 27731 - DNA, 25 bp, S. cerevisiae
gcatagattgctccaagacgtttga

SEQ ID NO: 27732 - DNA, 25 bp, S. cerevisiae
gcatctgttttgttagctgtcggac

SEQ ID NO: 27733 - DNA, 25 bp, S. cerevisiae
gcattattgttattcatctctggtg

SEQ ID NO: 27734 - DNA, 25 bp, S. cerevisiae
gcattttacactcgtttgagacctg

SEQ ID NO: 27735 - DNA, 25 bp, S. cerevisiae
gcatttcttagcatcttcgggagat

SEQ ID NO: 27736 - DNA, 25 bp, S. cerevisiae
gcattatcgtggatctcttggagac

SEQ ID NO: 27737 - DNA, 25 bp, S. cerevisiae
gcaacaaaaggctatctgaggcata

SEQ ID NO: 27738 - DNA, 25 bp, S. cerevisiae
gcatacagagtggttcaatgtgcct

SEQ ID NO: 27739 - DNA, 25 bp, S. cerevisiae
gcattcagtcatggtactttctcct

SEQ ID NO: 27740 - DNA, 25 bp, S. cerevisiae
gcatctattcctgtatgcagcttca

SEQ ID NO: 27741 - DNA, 25 bp, S. cerevisiae
gcatctatctattcattcacaccta

SEQ ID NO: 27742 - DNA, 25 bp, S. cerevisiae
gcatggtcaggtcgttagctcagaa

SEQ ID NO: 27743 - DNA, 25 bp, S. cerevisiae
gcatggtgcactatgtcatcgagga

SEQ ID NO: 27744 - DNA, 25 bp, S. cerevisiae
gcatggatggccttccagagagtaa

SEQ ID NO: 27745 - DNA, 25 bp, S. cerevisiae
gcaggattcttactacacgggcaac

SEQ ID NO: 27746 - DNA, 25 bp, S. cerevisiae
gcaggtattatcacacacatcggcg

SEQ ID NO: 27747 - DNA, 25 bp, S. cerevisiae
gcaggaatatacaccgcaaatcact

SEQ ID NO: 27748 - DNA, 25 bp, S. cerevisiae
gcataagattccagtcctcatacac

SEQ ID NO: 27749 - DNA, 25 bp, S. cerevisiae
gcatgactccattgaacgctagcat

SEQ ID NO: 27750 - DNA, 25 bp, S. cerevisiae
gcatcgcatgtctgaaattcggtat

SEQ ID NO: 27751 - DNA, 25 bp, S. cerevisiae
gcagcaagttgcgaacatatcggat

SEQ ID NO: 27752 - DNA, 25 bp, S. cerevisiae
gcaggttatttcgatgacttcacaa

SEQ ID NO: 27753 - DNA, 25 bp, S. cerevisiae
gcacgttgacctggatataacctca

SEQ ID NO: 27754 - DNA, 25 bp, S. cerevisiae
gcatcctcgaccacagcaaggaata

SEQ ID NO: 27755 - DNA, 25 bp, S. cerevisiae
gcagccaccatatatacaagaacgt

SEQ ID NO: 27756 - DNA, 25 bp, S. cerevisiae
gcagcttccactggcccaggaaggt

SEQ ID NO: 27757 - DNA, 25 bp, S. cerevisiae
gcagatactctctccagacgaatgg

SEQ ID NO: 27758 - DNA, 25 bp, S. cerevisiae
gcaggcagctcctcaagcggttgag

SEQ ID NO: 27759 - DNA, 25 bp, S. cerevisiae
gcaggtgccgctgcaaatgcgttag

SEQ ID NO: 27760 - DNA, 25 bp, S. cerevisiae
gcaggttccctaactaatttatcta

SEQ ID NO: 27761 - DNA, 25 bp, S. cerevisiae
gcatatcacagtacaaggccttttt

SEQ ID NO: 27762 - DNA, 25 bp, S. cerevisiae
gcatatccatcatcctgcaatgttg

SEQ ID NO: 27763 - DNA, 25 bp, S. cerevisiae
gcaccatcagaacctgctgcagcag

SEQ ID NO: 27764 - DNA, 25 bp, S. cerevisiae
gcaggcaaatgttatctcgacgtga

SEQ ID NO: 27765 - DNA, 25 bp, S. cerevisiae
gcaggaggttatttctcacgctaac

SEQ ID NO: 27766 - DNA, 25 bp, S. cerevisiae
gcaagacgttaaactacgcacgccc

SEQ ID NO: 27767 - DNA, 25 bp, S. cerevisiae
gcagaaaatctatagcttcgcccac

SEQ ID NO: 27768 - DNA, 25 bp, S. cerevisiae
gcagaaaaatttccgcaggtcacct

SEQ ID NO: 27769 - DNA, 25 bp, S. cerevisiae
gcaggaacaatgatgacggcgagct

SEQ ID NO: 27770 - DNA, 25 bp, S. cerevisiae
gcatagacagctatcgacccgatat

SEQ ID NO: 27771 - DNA, 25 bp, S. cerevisiae
gcatacatccattgacagacgcgaa

SEQ ID NO: 27772 - DNA, 25 bp, S. cerevisiae
gactttttcgcaaaaacattaacat

SEQ ID NO: 27773 - DNA, 25 bp, S. cerevisiae
gaactatttggaaacacagttaaat

SEQ ID NO: 27774 - DNA, 25 bp, S. cerevisiae
gtacagtttgtaagcccgttaatcg

SEQ ID NO: 27775 - DNA, 25 bp, S. cerevisiae
gcataaattttccacaccgttaatg

SEQ ID NO: 27776 - DNA, 25 bp, S. cerevisiae
gcatatggctataccgagtcacgtt

SEQ ID NO: 27777 - DNA, 25 bp, S. cerevisiae
gcataactttgctgtgcgcacgagg

SEQ ID NO: 27778 - DNA, 25 bp, S. cerevisiae
gcagcttcctgtctgataacggcag

SEQ ID NO: 27779 - DNA, 25 bp, S. cerevisiae
gcaggtgtcttgttagcccgcaggt

SEQ ID NO: 27780 - DNA, 25 bp, S. cerevisiae
gcagggttcttcaaatggccagatt

SEQ ID NO: 27781 - DNA, 25 bp, S. cerevisiae
gcagtggtatgcatctaagcggcta

SEQ ID NO: 27782 - DNA, 25 bp, S. cerevisiae
gcatgcttggtatcttattggctaa

SEQ ID NO: 27783 - DNA, 25 bp, S. cerevisiae
gcatattagtcatgtttcaggctat

SEQ ID NO: 27784 - DNA, 25 bp, S. cerevisiae
gcatgcttcccattgtttgcaggat

SEQ ID NO: 27785 - DNA, 25 bp, S. cerevisiae
gcatttgcttattgaaagcgtcttc

SEQ ID NO: 27786 - DNA, 25 bp, S. cerevisiae
gcatcatacacgcagctacgactaa

SEQ ID NO: 27787 - DNA, 25 bp, S. cerevisiae
gcatcaacatctcttccagaatcat

SEQ ID NO: 27788 - DNA, 25 bp, S. cerevisiae
gcagatgacgacaagctagttaata

SEQ ID NO: 27789 - DNA, 25 bp, S. cerevisiae
gcagggcgaccaatacttcaatgaa

SEQ ID NO: 27790 - DNA, 25 bp, S. cerevisiae
gacgacgctaatgatgaaaacctat

SEQ ID NO: 27791 - DNA, 25 bp, S. cerevisiae
gcacggtctagtgagagaatacctt

SEQ ID NO: 27792 - DNA, 25 bp, S. cerevisiae
gcagctgtagatagcggtgtccatt

SEQ ID NO: 27793 - DNA, 25 bp, S. cerevisiae
gcatgacaccaagcctatcggagaa

SEQ ID NO: 27794 - DNA, 25 bp, S. cerevisiae
gcaggatgccgttcaactttacggt

SEQ ID NO: 27795 - DNA, 25 bp, S. cerevisiae
gcatgggcagtttacctttacggtt

SEQ ID NO: 27796 - DNA, 25 bp, S. cerevisiae
gcatcttactttaccacgaaaccaa

SEQ ID NO: 27797 - DNA, 25 bp, S. cerevisiae
gcaggtgctactttatcaggccaac

SEQ ID NO: 27798 - DNA, 25 bp, S. cerevisiae
gcagacgttcgcatttgtgacatat

SEQ ID NO: 27799 - DNA, 25 bp, S. cerevisiae
gcatacagtttgcagatttacatga

SEQ ID NO: 27800 - DNA, 25 bp, S. cerevisiae
gcatacgttttgttttatcaccgcg

SEQ ID NO: 27801 - DNA, 25 bp, S. cerevisiae
gcatagaggatttcttgttctttaa

SEQ ID NO: 27802 - DNA, 25 bp, S. cerevisiae
tctaccgaaaatctgggtaaacatt

SEQ ID NO: 27803 - DNA, 25 bp, S. cerevisiae
gtagcggaaacatgggtggatacct

SEQ ID NO: 27804 - DNA, 25 bp, S. cerevisiae
gcatacgccagagctcgtggttata

SEQ ID NO: 27805 - DNA, 25 bp, S. cerevisiae
gcatatgacacagctgcgggtttat

SEQ ID NO: 27806 - DNA, 25 bp, S. cerevisiae
gcacgcagggattgccgtaactcaa

SEQ ID NO: 27807 - DNA, 25 bp, S. cerevisiae
gcaagttaacccacacactggtgta

SEQ ID NO: 27808 - DNA, 25 bp, S. cerevisiae
gaattagcaacccagacgcctttat

SEQ ID NO: 27809 - DNA, 25 bp, S. cerevisiae
gcagaaaccaagtcacaagcggagt

SEQ ID NO: 27810 - DNA, 25 bp, S. cerevisiae
gcaggaacactatcaaccataactt

SEQ ID NO: 27811 - DNA, 25 bp, S. cerevisiae
gcatcttccgccagtaaaaatgata

SEQ ID NO: 27812 - DNA, 25 bp, S. cerevisiae
gcacaagcccaaagtaaaatagatt

SEQ ID NO: 27813 - DNA, 25 bp, S. cerevisiae
gcagctatttcatatgccacaggaa

SEQ ID NO: 27814 - DNA, 25 bp, S. cerevisiae
gcagtgacattcttaccgccgaaaa

SEQ ID NO: 27815 - DNA, 25 bp, S. cerevisiae
gcatgttcttctacctcgtcaaaaa

SEQ ID NO: 27816 - DNA, 25 bp, S. cerevisiae
gcagtttccgttcccacagaaaagg

SEQ ID NO: 27817 - DNA, 25 bp, S. cerevisiae
gcatgtgacaattgcgaacgagtta

SEQ ID NO: 27818 - DNA, 25 bp, S. cerevisiae
gcagatgactgcaatcaaacggtta

SEQ ID NO: 27819 - DNA, 25 bp, S. cerevisiae
gcagatgatgacactacgcttgatg

SEQ ID NO: 27820 - DNA, 25 bp, S. cerevisiae
gcatgtctggctgcattatgtatat

SEQ ID NO: 27821 - DNA, 25 bp, S. cerevisiae
gcatgcttgggctatttgtattcac

SEQ ID NO: 27822 - DNA, 25 bp, S. cerevisiae
gcatgtattgcaaatctgttttcca

SEQ ID NO: 27823 - DNA, 25 bp, S. cerevisiae
gcatctcttcagtatgcttacttca

SEQ ID NO: 27824 - DNA, 25 bp, S. cerevisiae
gcatgccaattgatgagttcctcat

SEQ ID NO: 27825 - DNA, 25 bp, S. cerevisiae
gcatgctcaataagcgcctttatct

SEQ ID NO: 27826 - DNA, 25 bp, S. cerevisiae
gcatgatcaatatcatccctctggc

SEQ ID NO: 27827 - DNA, 25 bp, S. cerevisiae
gcatcagttgattattcgtccattc

SEQ ID NO: 27828 - DNA, 25 bp, S. cerevisiae
gcatacggtttatcaatctcactgt

SEQ ID NO: 27829 - DNA, 25 bp, S. cerevisiae
gcaaaggctaactctatcatcaatg

SEQ ID NO: 27830 - DNA, 25 bp, S. cerevisiae
gcaacaggccaatcgttatcaatta

SEQ ID NO: 27831 - DNA, 25 bp, S. cerevisiae
gcatcacacgcaccatttgaatctt

SEQ ID NO: 27832 - DNA, 25 bp, S. cerevisiae
gcatcatcatcttcctctaatttat

SEQ ID NO: 27833 - DNA, 25 bp, S. cerevisiae
gcatccacctcaatctattttgcat

SEQ ID NO: 27834 - DNA, 25 bp, S. cerevisiae
gcatacttctcttcaatttttacct

SEQ ID NO: 27835 - DNA, 25 bp, S. cerevisiae
gcagcctttcccaagttttacaagt

SEQ ID NO: 27836 - DNA, 25 bp, S. cerevisiae
gcatcgttcccgcaattttacaaaa

SEQ ID NO: 27837 - DNA, 25 bp, S. cerevisiae
gcacgtatcccacaactaatcaaga

SEQ ID NO: 27838 - DNA, 25 bp, S. cerevisiae
gcaggttccctgtcagatttggaaa

SEQ ID NO: 27839 - DNA, 25 bp, S. cerevisiae
gcaggtgctgcctcaagatgttgac

SEQ ID NO: 27840 - DNA, 25 bp, S. cerevisiae
gcagatgtgtggtctatcgctatta

SEQ ID NO: 27841 - DNA, 25 bp, S. cerevisiae
gcaagggcagactatcgatggctaa

SEQ ID NO: 27842 - DNA, 25 bp, S. cerevisiae
gcacgggcaccaacaaggtcatcaa

SEQ ID NO: 27843 - DNA, 25 bp, S. cerevisiae
gcagcgcctgaacaaatggtcaaca

SEQ ID NO: 27844 - DNA, 25 bp, S. cerevisiae
gcaggcacgtacatcaattcatcaa

SEQ ID NO: 27845 - DNA, 25 bp, S. cerevisiae
gcagccgactgcaatttctaatcca

SEQ ID NO: 27846 - DNA, 25 bp, S. cerevisiae
gcaccagttgctatcagtttaccag

SEQ ID NO: 27847 - DNA, 25 bp, S. cerevisiae
gcatgttcaatctctatcgactgat

SEQ ID NO: 27848 - DNA, 25 bp, S. cerevisiae
gcaggatttcaccagagactctatt

SEQ ID NO: 27849 - DNA, 25 bp, S. cerevisiae
gcaggaatatcagcgtcactcttat

SEQ ID NO: 27850 - DNA, 25 bp, S. cerevisiae
gcatgggacactgcagtttcataat

SEQ ID NO: 27851 - DNA, 25 bp, S. cerevisiae
gcaggtacgattttcatgctcgcac

SEQ ID NO: 27852 - DNA, 25 bp, S. cerevisiae
gcagtttcgcttctaccaagacagt

SEQ ID NO: 27853 - DNA, 25 bp, S. cerevisiae
gcatccagaggtttattcgcagcaa

SEQ ID NO: 27854 - DNA, 25 bp, S. cerevisiae
gcatcccagggattgatcatcgaaa

SEQ ID NO: 27855 - DNA, 25 bp, S. cerevisiae
gcatcctccggaatactccaataaa

SEQ ID NO: 27856 - DNA, 25 bp, S. cerevisiae
gcatgcgaacgtaaactcaccagaa

SEQ ID NO: 27857 - DNA, 25 bp, S. cerevisiae
gcatgaatccacaacaacgaccaaa

SEQ ID NO: 27858 - DNA, 25 bp, S. cerevisiae
gcagatgactatgacttcgaaccaa

SEQ ID NO: 27859 - DNA, 25 bp, S. cerevisiae
gcagacacttgatctttggcaaccc

SEQ ID NO: 27860 - DNA, 25 bp, S. cerevisiae
gcatgagcacggtgtcttgagagac

SEQ ID NO: 27861 - DNA, 25 bp, S. cerevisiae
gcatgaccgagtatgtggccacacg

SEQ ID NO: 27862 - DNA, 25 bp, S. cerevisiae
gcatccattactactgtaccacaag

SEQ ID NO: 27863 - DNA, 25 bp, S. cerevisiae
gcatctctttctacatttgcaagct

SEQ ID NO: 27864 - DNA, 25 bp, S. cerevisiae
gcatctacatttactagccaaccgg

SEQ ID NO: 27865 - DNA, 25 bp, S. cerevisiae
gcacttctaagttggccgctgatgt

SEQ ID NO: 27866 - DNA, 25 bp, S. cerevisiae
gcacgctgtttctggacacgattga

SEQ ID NO: 27867 - DNA, 25 bp, S. cerevisiae
gcatctgctttcctttcacaaaatg

SEQ ID NO: 27868 - DNA, 25 bp, S. cerevisiae
gcagtcatgttgcaattcgttgata

SEQ ID NO: 27869 - DNA, 25 bp, S. cerevisiae
gcaggcttagcgaatacctctgcta

SEQ ID NO: 27870 - DNA, 25 bp, S. cerevisiae
gcagctgcctgacaatactactgta

SEQ ID NO: 27871 - DNA, 25 bp, S. cerevisiae
gcactcgtacgttactagtctttga

SEQ ID NO: 27872 - DNA, 25 bp, S. cerevisiae
gcagcccgaagctttgctaggtgat

SEQ ID NO: 27873 - DNA, 25 bp, S. cerevisiae
gcaggccgccgcagatgctagaaga

SEQ ID NO: 27874 - DNA, 25 bp, S. cerevisiae
gcagccagcgacaacgacagcatag

SEQ ID NO: 27875 - DNA, 25 bp, S. cerevisiae
gcagccagtacaacagcaacagtct

SEQ ID NO: 27876 - DNA, 25 bp, S. cerevisiae
gcagccagtgcaaatcgtacgtcac

SEQ ID NO: 27877 - DNA, 25 bp, S. cerevisiae
gcagaacatgcgatatccactacca

SEQ ID NO: 27878 - DNA, 25 bp, S. cerevisiae
gcatgaacggtggtggcctactcaa

SEQ ID NO: 27879 - DNA, 25 bp, S. cerevisiae
gcatgaattcgccatattcgctcta

SEQ ID NO: 27880 - DNA, 25 bp, S. cerevisiae
gcagagtatactcaacactgatgtt

SEQ ID NO: 27881 - DNA, 25 bp, S. cerevisiae
gcaggtatacctacaaccgtctttt

SEQ ID NO: 27882 - DNA, 25 bp, S. cerevisiae
gcaggtgaacaaagacccgtttact

SEQ ID NO: 27883 - DNA, 25 bp, S. cerevisiae
gcatgagcggaactagatcccgtat

SEQ ID NO: 27884 - DNA, 25 bp, S. cerevisiae
gcacgtggaagatgacgcctgccat

SEQ ID NO: 27885 - DNA, 25 bp, S. cerevisiae
gcagtttaagaagctccgcgagccg

SEQ ID NO: 27886 - DNA, 25 bp, S. cerevisiae
gcagctttaaacgatctaccagtga

SEQ ID NO: 27887 - DNA, 25 bp, S. cerevisiae
gcagctttaacagagcatccttggt

SEQ ID NO: 27888 - DNA, 25 bp, S. cerevisiae
gcacttgtacaaaagcctcgtcttc

SEQ ID NO: 27889 - DNA, 25 bp, S. cerevisiae
gcaccatgtacataggccttgactt

SEQ ID NO: 27890 - DNA, 25 bp, S. cerevisiae
gcagctgccagtatatcgcaacttt

SEQ ID NO: 27891 - DNA, 25 bp, S. cerevisiae
gcatgctgctttgtcaccaagattt

SEQ ID NO: 27892 - DNA, 25 bp, S. cerevisiae
gcatgtctttgagagagccacttat

SEQ ID NO: 27893 - DNA, 25 bp, S. cerevisiae
gcatccaactgtacactgattacaa

SEQ ID NO: 27894 - DNA, 25 bp, S. cerevisiae
gcagactaacgccagctgatttaca

SEQ ID NO: 27895 - DNA, 25 bp, S. cerevisiae
gcagtttacttggttgcctcaggta

SEQ ID NO: 27896 - DNA, 25 bp, S. cerevisiae
gcacctctaccatctatttctttat

SEQ ID NO: 27897 - DNA, 25 bp, S. cerevisiae
gcatccacttgtaattctccagaga

SEQ ID NO: 27898 - DNA, 25 bp, S. cerevisiae
gcaccagtcgataccacggcaggaa

SEQ ID NO: 27899 - DNA, 25 bp, S. cerevisiae
gcaaattctgccacgggaggaccaa

SEQ ID NO: 27900 - DNA, 25 bp, S. cerevisiae
gcaatagttggtgccacgggatcta

SEQ ID NO: 27901 - DNA, 25 bp, S. cerevisiae
taatttgaagtacagcggcgttagc

SEQ ID NO: 27902 - DNA, 25 bp, S. cerevisiae
gaagttggttgataggtagttacat

SEQ ID NO: 27903 - DNA, 25 bp, S. cerevisiae
gcatgggcgctaattgcacttcttt

SEQ ID NO: 27904 - DNA, 25 bp, S. cerevisiae
gcagtggcagtaacgtgctttcaaa

SEQ ID NO: 27905 - DNA, 25 bp, S. cerevisiae
gcagtttctaagtttcctgcagaaa

SEQ ID NO: 27906 - DNA, 25 bp, S. cerevisiae
gcagattctaacttcttgcctaata

SEQ ID NO: 27907 - DNA, 25 bp, S. cerevisiae
gcatggtttttgaccttcgcattaa

SEQ ID NO: 27908 - DNA, 25 bp, S. cerevisiae
gcaggcgtcatacattcgatgcttt

SEQ ID NO: 27909 - DNA, 25 bp, S. cerevisiae
gcaggcagtgcatcttcatcaatta

SEQ ID NO: 27910 - DNA, 25 bp, S. cerevisiae
gcatggcttggcttttagcgtcaaa

SEQ ID NO: 27911 - DNA, 25 bp, S. cerevisiae
gcaggttgtgccattatttcttcat

SEQ ID NO: 27912 - DNA, 25 bp, S. cerevisiae
gcagtttgctgcttatttttcaaca

SEQ ID NO: 27913 - DNA, 25 bp, S. cerevisiae
gcatgaaagctatcttttcgtgtat

SEQ ID NO: 27914 - DNA, 25 bp, S. cerevisiae
gcatgacgagtctgatattccgatt

SEQ ID NO: 27915 - DNA, 25 bp, S. cerevisiae
gcatgtcacaggtactttcactatt

SEQ ID NO: 27916 - DNA, 25 bp, S. cerevisiae
gcagtcacagagattttctgcgact

SEQ ID NO: 27917 - DNA, 25 bp, S. cerevisiae
gcagagagcacttacatttttccaa

SEQ ID NO: 27918 - DNA, 25 bp, S. cerevisiae
gcagaggaatagcaatgtatcccat

SEQ ID NO: 27919 - DNA, 25 bp, S. cerevisiae
gcagtaattcattcatgcgtgccat

SEQ ID NO: 27920 - DNA, 25 bp, S. cerevisiae
gcagtattttgccatgctattcata

SEQ ID NO: 27921 - DNA, 25 bp, S. cerevisiae
gcatgactctgctgccagtttagaa

SEQ ID NO: 27922 - DNA, 25 bp, S. cerevisiae
gcagagtacttgtcttaggagcaac

SEQ ID NO: 27923 - DNA, 25 bp, S. cerevisiae
gcatgattactcacattcgggataa

SEQ ID NO: 27924 - DNA, 25 bp, S. cerevisiae
gcagatatagccacagatcacgata

SEQ ID NO: 27925 - DNA, 25 bp, S. cerevisiae
gcagtgacagacttgcctcgttcag

SEQ ID NO: 27926 - DNA, 25 bp, S. cerevisiae
gcagtacagaactcatctctcttgg

SEQ ID NO: 27927 - DNA, 25 bp, S. cerevisiae
gcatgcttaatcgaacactgtcaga

SEQ ID NO: 27928 - DNA, 25 bp, S. cerevisiae
gactggacatcaaaacttctgaacg

SEQ ID NO: 27929 - DNA, 25 bp, S. cerevisiae
gcagccatggcatatgttgacaagt

SEQ ID NO: 27930 - DNA, 25 bp, S. cerevisiae
gcagtgcgctcctttggacacaaag

SEQ ID NO: 27931 - DNA, 25 bp, S. cerevisiae
gcaccaatcctgctgggactagata

SEQ ID NO: 27932 - DNA, 25 bp, S. cerevisiae
gcactatcgttcaggtttgagccgc

SEQ ID NO: 27933 - DNA, 25 bp, S. cerevisiae
gcaggacccaaaacgttattagcta

SEQ ID NO: 27934 - DNA, 25 bp, S. cerevisiae
gcatgagttcctcttctttaactaa

SEQ ID NO: 27935 - DNA, 25 bp, S. cerevisiae
gcagggtatccctattgtcttggaa

SEQ ID NO: 27936 - DNA, 25 bp, S. cerevisiae
gcaggagttactcaagttgttagaa

SEQ ID NO: 27937 - DNA, 25 bp, S. cerevisiae
gcagcagcagttgctcacaagtgtt

SEQ ID NO: 27938 - DNA, 25 bp, S. cerevisiae
gcagatcttctcacaagcattgttg

SEQ ID NO: 27939 - DNA, 25 bp, S. cerevisiae
gcagccattctacgcattcatttta

SEQ ID NO: 27940 - DNA, 25 bp, S. cerevisiae
gcagcttgttacgttgcattcaaaa

SEQ ID NO: 27941 - DNA, 25 bp, S. cerevisiae
gcagctgtattatcgcatgcacaaa

SEQ ID NO: 27942 - DNA, 25 bp, S. cerevisiae
gcagttgtactccaatcgattcagt

SEQ ID NO: 27943 - DNA, 25 bp, S. cerevisiae
gcagtgttcgccacatggattggta

SEQ ID NO: 27944 - DNA, 25 bp, S. cerevisiae
gcagatttgcctgccgaaatgttga

SEQ ID NO: 27945 - DNA, 25 bp, S. cerevisiae
gcatgatcatggtatcgctcattgt

SEQ ID NO: 27946 - DNA, 25 bp, S. cerevisiae
gcatgatcatggtatagcacactgt

SEQ ID NO: 27947 - DNA, 25 bp, S. cerevisiae
gcagatctaggttcatccgaagcag

SEQ ID NO: 27948 - DNA, 25 bp, S. cerevisiae
gcagatcatatcgatgtccctgaaa

SEQ ID NO: 27949 - DNA, 25 bp, S. cerevisiae
gcagtggacgagctccgcaagtaat

SEQ ID NO: 27950 - DNA, 25 bp, S. cerevisiae
gcagggagtgtattccggagctatt

SEQ ID NO: 27951 - DNA, 25 bp, S. cerevisiae
gcagagtattataaccgggcttctt

SEQ ID NO: 27952 - DNA, 25 bp, S. cerevisiae
gcagtattgtagcaccacagtggtt

SEQ ID NO: 27953 - DNA, 25 bp, S. cerevisiae
gcagttcgtgtttcagtatccagta

SEQ ID NO: 27954 - DNA, 25 bp, S. cerevisiae
gcagcttgcatgactgttcgtatcc

SEQ ID NO: 27955 - DNA, 25 bp, S. cerevisiae
gcatgtatgcgttgatgtcgacgtt

SEQ ID NO: 27956 - DNA, 25 bp, S. cerevisiae
gcatgattcctttgcatctgacgac

SEQ ID NO: 27957 - DNA, 25 bp, S. cerevisiae
gcagattgcgttggacttgccatca

SEQ ID NO: 27958 - DNA, 25 bp, S. cerevisiae
gcacatacgattgcagttgcctcaa

SEQ ID NO: 27959 - DNA, 25 bp, S. cerevisiae
gcacaagaaatgacagtgagcttaa

SEQ ID NO: 27960 - DNA, 25 bp, S. cerevisiae
gcacgaaccttgcatcgacaatgtt

SEQ ID NO: 27961 - DNA, 25 bp, S. cerevisiae
gcaatggccaaccttgaacgtcggg

SEQ ID NO: 27962 - DNA, 25 bp, S. cerevisiae
gcagatggccaatctctaaccgaga

SEQ ID NO: 27963 - DNA, 25 bp, S. cerevisiae
gcagacgccgtagccagactaataa

SEQ ID NO: 27964 - DNA, 25 bp, S. cerevisiae
gcatggagcctcaatacattcatat

SEQ ID NO: 27965 - DNA, 25 bp, S. cerevisiae
gcatgtgaggccaagctgcttcaat

SEQ ID NO: 27966 - DNA, 25 bp, S. cerevisiae
gcatggcaccaaagagtacagatca

SEQ ID NO: 27967 - DNA, 25 bp, S. cerevisiae
gcaggcagtagcagttcacagatga

SEQ ID NO: 27968 - DNA, 25 bp, S. cerevisiae
gcagcgcatgtcaatggtctcggta

SEQ ID NO: 27969 - DNA, 25 bp, S. cerevisiae
gcacgccttaggattcgagaactat

SEQ ID NO: 27970 - DNA, 25 bp, S. cerevisiae
gcaccctattagatacgcaaccatg

SEQ ID NO: 27971 - DNA, 25 bp, S. cerevisiae
gcaccagaatgtttgttccaacctg

SEQ ID NO: 27972 - DNA, 25 bp, S. cerevisiae
gcaccagccattttgttactgatcc

SEQ ID NO: 27973 - DNA, 25 bp, S. cerevisiae
gcagacaggctgaggattacttaag

SEQ ID NO: 27974 - DNA, 25 bp, S. cerevisiae
gaatcagactgaacggtgacttgga

SEQ ID NO: 27975 - DNA, 25 bp, S. cerevisiae
gcacatacacaaatggcggacctcg

SEQ ID NO: 27976 - DNA, 25 bp, S. cerevisiae
gcacgatggtgcacgaagaacagtt

SEQ ID NO: 27977 - DNA, 25 bp, S. cerevisiae
gcagctcatgtcctccaaattaatt

SEQ ID NO: 27978 - DNA, 25 bp, S. cerevisiae
gcagtccctaagtcaatgtctttga

SEQ ID NO: 27979 - DNA, 25 bp, S. cerevisiae
gcagctgccgcaaagaaagctttgt

SEQ ID NO: 27980 - DNA, 25 bp, S. cerevisiae
gcactgcccatgttgacgagtacat

SEQ ID NO: 27981 - DNA, 25 bp, S. cerevisiae
gcacctagtgcattcttatagcgac

SEQ ID NO: 27982 - DNA, 25 bp, S. cerevisiae
gcacgcacatggttccaagacggtt

SEQ ID NO: 27983 - DNA, 25 bp, S. cerevisiae
gcagtgacggttcaagatctccttc

SEQ ID NO: 27984 - DNA, 25 bp, S. cerevisiae
gcagtcggcggcaatgataattctt

SEQ ID NO: 27985 - DNA, 25 bp, S. cerevisiae
gcagttgaatgcaccctttctagaa

SEQ ID NO: 27986 - DNA, 25 bp, S. cerevisiae
gcagtctgccatctggtgttttaga

SEQ ID NO: 27987 - DNA, 25 bp, S. cerevisiae
gcaggaatcctttgaccggattgtt

SEQ ID NO: 27988 - DNA, 25 bp, S. cerevisiae
gcaggaaattcttacgcggttttga

SEQ ID NO: 27989 - DNA, 25 bp, S. cerevisiae
gaagaaagtcttgttgagcccggta

SEQ ID NO: 27990 - DNA, 25 bp, S. cerevisiae
gcaggaaaccttgttggacattcgt

SEQ ID NO: 27991 - DNA, 25 bp, S. cerevisiae
gcagaaacaacttctttcggttggg

SEQ ID NO: 27992 - DNA, 25 bp, S. cerevisiae
gcagaaatccttgtttcctgtgttg

SEQ ID NO: 27993 - DNA, 25 bp, S. cerevisiae
gcaaaaccttcctctcaattagtga

SEQ ID NO: 27994 - DNA, 25 bp, S. cerevisiae
gcaaaccgtgctgacaaaatcgaaa

SEQ ID NO: 27995 - DNA, 25 bp, S. cerevisiae
gcaaactggcctctaacaatctgga

SEQ ID NO: 27996 - DNA, 25 bp, S. cerevisiae
gcagtgcttgctcttagatgataac

SEQ ID NO: 27997 - DNA, 25 bp, S. cerevisiae
gcagatcagggccagatagcacaaa

SEQ ID NO: 27998 - DNA, 25 bp, S. cerevisiae
gcaggtaacatccattgagccccaa

SEQ ID NO: 27999 - DNA, 25 bp, S. cerevisiae
gcaggtccaaagttcgcagccacaa

SEQ ID NO: 28000 - DNA, 25 bp, S. cerevisiae
gcagtatctacattgattcctccaa

SEQ ID NO: 28001 - DNA, 25 bp, S. cerevisiae
gcagatgagcatcttgggccgctta

SEQ ID NO: 28002 - DNA, 25 bp, S. cerevisiae
gcagaaacctcttaagcgggctaaa

SEQ ID NO: 28003 - DNA, 25 bp, S. cerevisiae
gcaggatgtagttaactctgataca

SEQ ID NO: 28004 - DNA, 25 bp, S. cerevisiae
gcaggtaatgttccacacgatgaca

SEQ ID NO: 28005 - DNA, 25 bp, S. cerevisiae
gcacacccaatgcatcatcggtaat

SEQ ID NO: 28006 - DNA, 25 bp, S. cerevisiae
gacagtcaaatgctccaagtttaag

SEQ ID NO: 28007 - DNA, 25 bp, S. cerevisiae
gcacatttaaagtctagagctctaa

SEQ ID NO: 28008 - DNA, 25 bp, S. cerevisiae
gcagcatttcaagcactttgttaca

SEQ ID NO: 28009 - DNA, 25 bp, S. cerevisiae
gcagcattttgagcttaccgtcaca

SEQ ID NO: 28010 - DNA, 25 bp, S. cerevisiae
gcagcaaattgggactattcactga

SEQ ID NO: 28011 - DNA, 25 bp, S. cerevisiae
gcagtagattgcaaactcctcaaga

SEQ ID NO: 28012 - DNA, 25 bp, S. cerevisiae
gcacgaattgcttcccttagaactt

SEQ ID NO: 28013 - DNA, 25 bp, S. cerevisiae
gcagggattgcttcgctcattaaac

SEQ ID NO: 28014 - DNA, 25 bp, S. cerevisiae
gcacggatgggaggccttatagtaa

SEQ ID NO: 28015 - DNA, 25 bp, S. cerevisiae
gcagcgatgcgcttaggctttaagt

SEQ ID NO: 28016 - DNA, 25 bp, S. cerevisiae
gcacactggttctgctcatgtgaag

SEQ ID NO: 28017 - DNA, 25 bp, S. cerevisiae
tgccgtcgtctttcctaaacgtgaa

SEQ ID NO: 28018 - DNA, 25 bp, S. cerevisiae
gcacgttcctcttcctgaaaatgag

SEQ ID NO: 28019 - DNA, 25 bp, S. cerevisiae
gcacgaactccgacctaaatcagaa

SEQ ID NO: 28020 - DNA, 25 bp, S. cerevisiae
gcaaagaccaatcactggtgcttct

SEQ ID NO: 28021 - DNA, 25 bp, S. cerevisiae
gaagagcccaaagcggttctcgtta

SEQ ID NO: 28022 - DNA, 25 bp, S. cerevisiae
gaatcatccaaaaacctttctttcg

SEQ ID NO: 28023 - DNA, 25 bp, S. cerevisiae
gaagtctcaagacaagcttaccctt

SEQ ID NO: 28024 - DNA, 25 bp, S. cerevisiae
gcagcaattacaatcacctcaacta

SEQ ID NO: 28025 - DNA, 25 bp, S. cerevisiae
gcagcaacaacgacaactaccatca

SEQ ID NO: 28026 - DNA, 25 bp, S. cerevisiae
gcaaaacccttcaaattcgccttat

SEQ ID NO: 28027 - DNA, 25 bp, S. cerevisiae
gcagaaaagtcgttcaagccaccaa

SEQ ID NO: 28028 - DNA, 25 bp, S. cerevisiae
gcagaaatagttccaaggccctcta

SEQ ID NO: 28029 - DNA, 25 bp, S. cerevisiae
gcagaaatgtttcatccccatcatt

SEQ ID NO: 28030 - DNA, 25 bp, S. cerevisiae
gcagtccgatgtcataccagacaca

SEQ ID NO: 28031 - DNA, 25 bp, S. cerevisiae
gcaagccttgatcgatgcccaaaag

SEQ ID NO: 28032 - DNA, 25 bp, S. cerevisiae
gcagattgcacacagtgactccaaa

SEQ ID NO: 28033 - DNA, 25 bp, S. cerevisiae
gcagcgtcttcgtcgttggaaaaca

SEQ ID NO: 28034 - DNA, 25 bp, S. cerevisiae
gcacttcttgcgagtccgataacga

SEQ ID NO: 28035 - DNA, 25 bp, S. cerevisiae
gcactccttcattaactctagattc

SEQ ID NO: 28036 - DNA, 25 bp, S. cerevisiae
gcactccttatacttctgttttcaa

SEQ ID NO: 28037 - DNA, 25 bp, S. cerevisiae
gcactaggttaaaacttgactacag

SEQ ID NO: 28038 - DNA, 25 bp, S. cerevisiae
gcagagactttcaagcagcatccaa

SEQ ID NO: 28039 - DNA, 25 bp, S. cerevisiae
gcagaaccttctggtgctacaagca

SEQ ID NO: 28040 - DNA, 25 bp, S. cerevisiae
gcacgccgttttggctgaacgtatg

SEQ ID NO: 28041 - DNA, 25 bp, S. cerevisiae
gcaccccttatttcaacgttatgga

SEQ ID NO: 28042 - DNA, 25 bp, S. cerevisiae
gcagcctcaaccacagtacaatatg

SEQ ID NO: 28043 - DNA, 25 bp, S. cerevisiae
gcaccgaattatccaggcacaacgt

SEQ ID NO: 28044 - DNA, 25 bp, S. cerevisiae
gcagcaggagctattacgacaacag

SEQ ID NO: 28045 - DNA, 25 bp, S. cerevisiae
gcacgtcgtatgcaggagcagccat

SEQ ID NO: 28046 - DNA, 25 bp, S. cerevisiae
gcacccgtaaatggagctgctattt

SEQ ID NO: 28047 - DNA, 25 bp, S. cerevisiae
gcagcagtagcatttacagcgaata

SEQ ID NO: 28048 - DNA, 25 bp, S. cerevisiae
gcactgatcattttggcgtactgtt

SEQ ID NO: 28049 - DNA, 25 bp, S. cerevisiae
gcagcatgagccttacaacgaactt

SEQ ID NO: 28050 - DNA, 25 bp, S. cerevisiae
gcagctcaatcgaaatacgtgcagt

SEQ ID NO: 28051 - DNA, 25 bp, S. cerevisiae
gcacgcgactctattggacatacca

SEQ ID NO: 28052 - DNA, 25 bp, S. cerevisiae
gcactggtcaattcaattcttctca

SEQ ID NO: 28053 - DNA, 25 bp, S. cerevisiae
gcagggtttggccaatttccactac

SEQ ID NO: 28054 - DNA, 25 bp, S. cerevisiae
gcagtggtttgtatatcgatctcga

SEQ ID NO: 28055 - DNA, 25 bp, S. cerevisiae
gcaactgcctttcatacccaaaaaa

SEQ ID NO: 28056 - DNA, 25 bp, S. cerevisiae
gcacctttggtatttggctgataga

SEQ ID NO: 28057 - DNA, 25 bp, S. cerevisiae
gcaccggtagcttatagatccaaca

SEQ ID NO: 28058 - DNA, 25 bp, S. cerevisiae
gcaacggaactaactattctacagt

SEQ ID NO: 28059 - DNA, 25 bp, S. cerevisiae
tgcccgttaaatccgttggtgttat

SEQ ID NO: 28060 - DNA, 25 bp, S. cerevisiae
gcaccggcgacacaactagtttcaa

SEQ ID NO: 28061 - DNA, 25 bp, S. cerevisiae
gcactctacgcaggaatgactcatg

SEQ ID NO: 28062 - DNA, 25 bp, S. cerevisiae
gcagcgttgcataccaatatcatcg

SEQ ID NO: 28063 - DNA, 25 bp, S. cerevisiae
gcagcagtatcagcaacaacctcaa

SEQ ID NO: 28064 - DNA, 25 bp, S. cerevisiae
gcagacttccgatgaatccacaata

SEQ ID NO: 28065 - DNA, 25 bp, S. cerevisiae
gcagatctgtatcgattattccggg

SEQ ID NO: 28066 - DNA, 25 bp, S. cerevisiae
gcagcagctgcgatgtttatgtcga

SEQ ID NO: 28067 - DNA, 25 bp, S. cerevisiae
gcagatggtgtttttcagttttgga

SEQ ID NO: 28068 - DNA, 25 bp, S. cerevisiae
gcagctatggacatgggcttcttct

SEQ ID NO: 28069 - DNA, 25 bp, S. cerevisiae
gcacataagccctttggttctacaa

SEQ ID NO: 28070 - DNA, 25 bp, S. cerevisiae
gcaaaggacgctctggaccatgaat

SEQ ID NO: 28071 - DNA, 25 bp, S. cerevisiae
gcaacaggcacgttttgagctcggt

SEQ ID NO: 28072 - DNA, 25 bp, S. cerevisiae
gaaagcgaaattgcgcgtcggaact

SEQ ID NO: 28073 - DNA, 25 bp, S. cerevisiae
tgtagggaatttaccctccgacgct

SEQ ID NO: 28074 - DNA, 25 bp, S. cerevisiae
gtacagggtttcacctttgacttat

SEQ ID NO: 28075 - DNA, 25 bp, S. cerevisiae
gaaaaaggtgtctcccttacttgat

SEQ ID NO: 28076 - DNA, 25 bp, S. cerevisiae
gaattatgggtcaagctccgattag

SEQ ID NO: 28077 - DNA, 25 bp, S. cerevisiae
gcacatggacggttagctcgcgaac

SEQ ID NO: 28078 - DNA, 25 bp, S. cerevisiae
gcaagccctggatagccaagtacga

SEQ ID NO: 28079 - DNA, 25 bp, S. cerevisiae
gcaaacaaaagggtagagcacggat

SEQ ID NO: 28080 - DNA, 25 bp, S. cerevisiae
gagaattaaatgagtcggccgcttt

SEQ ID NO: 28081 - DNA, 25 bp, S. cerevisiae
gcaaattcagtcaaaaccgccaagg

SEQ ID NO: 28082 - DNA, 25 bp, S. cerevisiae
gcactaagcgcgaaatacccactat

SEQ ID NO: 28083 - DNA, 25 bp, S. cerevisiae
gcagcaatattcactaaccacactt

SEQ ID NO: 28084 - DNA, 25 bp, S. cerevisiae
gcagaattccatatcgacaacgttg

SEQ ID NO: 28085 - DNA, 25 bp, S. cerevisiae
gcagcaaaacccttaacacaattat

SEQ ID NO: 28086 - DNA, 25 bp, S. cerevisiae
gcacgctaccgcttcatatgtatat

SEQ ID NO: 28087 - DNA, 25 bp, S. cerevisiae
gcagaggccccttgttgaagatgaa

SEQ ID NO: 28088 - DNA, 25 bp, S. cerevisiae
gcacatgtgcccgttgtggaagcat

SEQ ID NO: 28089 - DNA, 25 bp, S. cerevisiae
gcagattgcgcctattgtcagtaca

SEQ ID NO: 28090 - DNA, 25 bp, S. cerevisiae
gcagatgttggtttgccgtacaata

SEQ ID NO: 28091 - DNA, 25 bp, S. cerevisiae
gcagttctgccgcatcaaatactaa

SEQ ID NO: 28092 - DNA, 25 bp, S. cerevisiae
gcagcgatcccgtacaagaacaaaa

SEQ ID NO: 28093 - DNA, 25 bp, S. cerevisiae
gcagagtccgcgcaaacattgaaaa

SEQ ID NO: 28094 - DNA, 25 bp, S. cerevisiae
gcagattgtttcttcaagcagctta

SEQ ID NO: 28095 - DNA, 25 bp, S. cerevisiae
gcagatatggattttcgcgcatcat

SEQ ID NO: 28096 - DNA, 25 bp, S. cerevisiae
gcagttgctgcatttgtggtgttga

SEQ ID NO: 28097 - DNA, 25 bp, S. cerevisiae
gcagcttttgcacgacaggttgacc

SEQ ID NO: 28098 - DNA, 25 bp, S. cerevisiae
gcacattatgcatcagtcggtcaac

SEQ ID NO: 28099 - DNA, 25 bp, S. cerevisiae
gcaatgtcgcaacgagggaaaccgt

SEQ ID NO: 28100 - DNA, 25 bp, S. cerevisiae
gcagcagtactaccagcagcagcag

SEQ ID NO: 28101 - DNA, 25 bp, S. cerevisiae
gcacagatcatttcacagacgagga

SEQ ID NO: 28102 - DNA, 25 bp, S. cerevisiae
gcacaagatgggtcaagcgcactac

SEQ ID NO: 28103 - DNA, 25 bp, S. cerevisiae
gcaactgagtgggatttactactat

SEQ ID NO: 28104 - DNA, 25 bp, S. cerevisiae
gcaacgggacgtggatactctaata

SEQ ID NO: 28105 - DNA, 25 bp, S. cerevisiae
gcaatccactcctgttttactaaat

SEQ ID NO: 28106 - DNA, 25 bp, S. cerevisiae
gcaagttccgcagagttgagaccac

SEQ ID NO: 28107 - DNA, 25 bp, S. cerevisiae
gcacgttccggccatgattgatgac

SEQ ID NO: 28108 - DNA, 25 bp, S. cerevisiae
gcagagctgtcctatacgatttact

SEQ ID NO: 28109 - DNA, 25 bp, S. cerevisiae
gcacggatcagttcacgatgttcat

SEQ ID NO: 28110 - DNA, 25 bp, S. cerevisiae
gcagcgccagaatatccgatcacaa

SEQ ID NO: 28111 - DNA, 25 bp, S. cerevisiae
gcagcagccttttatactgtcaaga

SEQ ID NO: 28112 - DNA, 25 bp, S. cerevisiae
gcagaccttttaccaaattcatttg

SEQ ID NO: 28113 - DNA, 25 bp, S. cerevisiae
gcagatttgatcattccttctacaa

SEQ ID NO: 28114 - DNA, 25 bp, S. cerevisiae
gcagatttgatcctaggttccccaa

SEQ ID NO: 28115 - DNA, 25 bp, S. cerevisiae
gcagacgaaagattggccacatttg

SEQ ID NO: 28116 - DNA, 25 bp, S. cerevisiae
gcagacaaattcattgccaacattg

SEQ ID NO: 28117 - DNA, 25 bp, S. cerevisiae
gcagcacaaaccctacttcaaatgg

SEQ ID NO: 28118 - DNA, 25 bp, S. cerevisiae
gcagcaacagctcccgaaaatgaag

SEQ ID NO: 28119 - DNA, 25 bp, S. cerevisiae
gcagcaaagcagatcgcatcgttga

SEQ ID NO: 28120 - DNA, 25 bp, S. cerevisiae
gcagaatacgctattggctctatca

SEQ ID NO: 28121 - DNA, 25 bp, S. cerevisiae
gcagagattattagtgatgtccgga

SEQ ID NO: 28122 - DNA, 25 bp, S. cerevisiae
gcacggacaacgattccatcagtaa

SEQ ID NO: 28123 - DNA, 25 bp, S. cerevisiae
gaacaacaattgaagggccttggga

SEQ ID NO: 28124 - DNA, 25 bp, S. cerevisiae
gcagccaacccattagtaagcctgg

SEQ ID NO: 28125 - DNA, 25 bp, S. cerevisiae
gcaagctacttctggtactactcga

SEQ ID NO: 28126 - DNA, 25 bp, S. cerevisiae
gcaagattcaatcaggtcctaacca

SEQ ID NO: 28127 - DNA, 25 bp, S. cerevisiae
gcacgatttcatcatggctacttat

SEQ ID NO: 28128 - DNA, 25 bp, S. cerevisiae
gcagcgttttctttgtatctcttca

SEQ ID NO: 28129 - DNA, 25 bp, S. cerevisiae
gcacttctttggagcttattgatga

SEQ ID NO: 28130 - DNA, 25 bp, S. cerevisiae
gcacctttaggttcaatttcatctt

SEQ ID NO: 28131 - DNA, 25 bp, S. cerevisiae
gcaacggtcgcgaacagacttttga

SEQ ID NO: 28132 - DNA, 25 bp, S. cerevisiae
gcagccagtgccatatatcaagttt

SEQ ID NO: 28133 - DNA, 25 bp, S. cerevisiae
gcagccaccgcagcaattgcaatat

SEQ ID NO: 28134 - DNA, 25 bp, S. cerevisiae
gcagatgatgctgctccagctaaaa

SEQ ID NO: 28135 - DNA, 25 bp, S. cerevisiae
gcagcatattggtcaaggcccatat

SEQ ID NO: 28136 - DNA, 25 bp, S. cerevisiae
gcaaatgtggtccatgtggtcatta

SEQ ID NO: 28137 - DNA, 25 bp, S. cerevisiae
gcagaagctggttcagatgctgata

SEQ ID NO: 28138 - DNA, 25 bp, S. cerevisiae
gcaacagcagccttcagatgtggat

SEQ ID NO: 28139 - DNA, 25 bp, S. cerevisiae
gcaagcaatttagcggccatcgtac

SEQ ID NO: 28140 - DNA, 25 bp, S. cerevisiae
gcacagatacccaatagcgaccttt

SEQ ID NO: 28141 - DNA, 25 bp, S. cerevisiae
gcaagggcacctgggatggcaactt

SEQ ID NO: 28142 - DNA, 25 bp, S. cerevisiae
gcaagggcaggttcgactccgctat

SEQ ID NO: 28143 - DNA, 25 bp, S. cerevisiae
gcaaacgcaagagccagtcaagcta

SEQ ID NO: 28144 - DNA, 25 bp, S. cerevisiae
gcaaatgcgaaaccacgtgcacttg

SEQ ID NO: 28145 - DNA, 25 bp, S. cerevisiae
gcaaattgacaacctgcaggatatt

SEQ ID NO: 28146 - DNA, 25 bp, S. cerevisiae
gcaaattccgatacccatgatacta

SEQ ID NO: 28147 - DNA, 25 bp, S. cerevisiae
gcactaatgaaaacgcgcccatata

SEQ ID NO: 28148 - DNA, 25 bp, S. cerevisiae
gcaaatttctttggacgaagtcatt

SEQ ID NO: 28149 - DNA, 25 bp, S. cerevisiae
gcacatggatgcaaccggaccggaa

SEQ ID NO: 28150 - DNA, 25 bp, S. cerevisiae
gcacagtttacgctactgcgtgata

SEQ ID NO: 28151 - DNA, 25 bp, S. cerevisiae
gcagagcattctacgtttaaccaaa

SEQ ID NO: 28152 - DNA, 25 bp, S. cerevisiae
gcacaccatttcctactggttacaa

SEQ ID NO: 28153 - DNA, 25 bp, S. cerevisiae
gcaccaactactcacgctttaataa

SEQ ID NO: 28154 - DNA, 25 bp, S. cerevisiae
gcaccaggctcaattacgcgttagt

SEQ ID NO: 28155 - DNA, 25 bp, S. cerevisiae
gcagcactgctggtttttgcaaata

SEQ ID NO: 28156 - DNA, 25 bp, S. cerevisiae
gcacccattggaagctttaggaaag

SEQ ID NO: 28157 - DNA, 25 bp, S. cerevisiae
gcacccctggattgctttagacata

SEQ ID NO: 28158 - DNA, 25 bp, S. cerevisiae
gcagaacttacttttattcctcaaa

SEQ ID NO: 28159 - DNA, 25 bp, S. cerevisiae
gcaaggctcggttgtcgtttttcaa

SEQ ID NO: 28160 - DNA, 25 bp, S. cerevisiae
gcagacagccgggtgaagttttcaa

SEQ ID NO: 28161 - DNA, 25 bp, S. cerevisiae
gcagcatgctcggtagaggtttcga

SEQ ID NO: 28162 - DNA, 25 bp, S. cerevisiae
gcacaacgtggattggccttagaga

SEQ ID NO: 28163 - DNA, 25 bp, S. cerevisiae
gcacgacctggatttggctagcaca

SEQ ID NO: 28164 - DNA, 25 bp, S. cerevisiae
gcactattgtgaatttggcacgcga

SEQ ID NO: 28165 - DNA, 25 bp, S. cerevisiae
gcagctgatggatttatcgccggag

SEQ ID NO: 28166 - DNA, 25 bp, S. cerevisiae
gcagcttcatattttccctcaaata

SEQ ID NO: 28167 - DNA, 25 bp, S. cerevisiae
gcagctgccgctactgttagatcta

SEQ ID NO: 28168 - DNA, 25 bp, S. cerevisiae
gcagctgcaggtacttctcaagcta

SEQ ID NO: 28169 - DNA, 25 bp, S. cerevisiae
gcagcattatctccttttaccaata

SEQ ID NO: 28170 - DNA, 25 bp, S. cerevisiae
gcacttgaactactttactgcggta

SEQ ID NO: 28171 - DNA, 25 bp, S. cerevisiae
gcacacagacgtctcttacgagtta

SEQ ID NO: 28172 - DNA, 25 bp, S. cerevisiae
gcaaagccgctgatattccggtagt

SEQ ID NO: 28173 - DNA, 25 bp, S. cerevisiae
gcaaacaacgagatccgcgcgatga

SEQ ID NO: 28174 - DNA, 25 bp, S. cerevisiae
gcaacacaaaagatccggtcataga

SEQ ID NO: 28175 - DNA, 25 bp, S. cerevisiae
gcagccacaatttggtcacgagctt

SEQ ID NO: 28176 - DNA, 25 bp, S. cerevisiae
gcaccaagttggttactgacagctt

SEQ ID NO: 28177 - DNA, 25 bp, S. cerevisiae
gcacaaaagcaaacctgttaagcca

SEQ ID NO: 28178 - DNA, 25 bp, S. cerevisiae
gcactacaatctatctcgtcgttaa

SEQ ID NO: 28179 - DNA, 25 bp, S. cerevisiae
gcactactgtgtctcctgtgctatt

SEQ ID NO: 28180 - DNA, 25 bp, S. cerevisiae
gcaccgatgttcttcaccaagtata

SEQ ID NO: 28181 - DNA, 25 bp, S. cerevisiae
gcagcaaccttctcacacaaattat

SEQ ID NO: 28182 - DNA, 25 bp, S. cerevisiae
gcagccaacactatccacataataa

SEQ ID NO: 28183 - DNA, 25 bp, S. cerevisiae
gcagcaaccactacattatctcaat

SEQ ID NO: 28184 - DNA, 25 bp, S. cerevisiae
gcagctaggctggatatgtactact

SEQ ID NO: 28185 - DNA, 25 bp, S. cerevisiae
gcagcaagaggtgtgtgagcaacta

SEQ ID NO: 28186 - DNA, 25 bp, S. cerevisiae
gcagcaacagcagtttgcccaacat

SEQ ID NO: 28187 - DNA, 25 bp, S. cerevisiae
gcagcaacaggcaatgtccaacaat

SEQ ID NO: 28188 - DNA, 25 bp, S. cerevisiae
gcactgacaggactgctgatccgat

SEQ ID NO: 28189 - DNA, 25 bp, S. cerevisiae
gcagctacagcaccagttatcgaag

SEQ ID NO: 28190 - DNA, 25 bp, S. cerevisiae
gcactagagcatccatatttgtcaa

SEQ ID NO: 28191 - DNA, 25 bp, S. cerevisiae
gcagctctaatttcttcatttgggt

SEQ ID NO: 28192 - DNA, 25 bp, S. cerevisiae
gcacaggtcatgaatgctcctctta

SEQ ID NO: 28193 - DNA, 25 bp, S. cerevisiae
gcagcaggttgagttcgccaattat

SEQ ID NO: 28194 - DNA, 25 bp, S. cerevisiae
gaaggcttctggtgaaattgtttcc

SEQ ID NO: 28195 - DNA, 25 bp, S. cerevisiae
gcaaatcttcgttaagactttgact

SEQ ID NO: 28196 - DNA, 25 bp, S. cerevisiae
gcaagatttagttcaggtacttcct

SEQ ID NO: 28197 - DNA, 25 bp, S. cerevisiae
gcaatgggtagcatgggccgttcac

SEQ ID NO: 28198 - DNA, 25 bp, S. cerevisiae
gcaaagagctttaaatcgacccggg

SEQ ID NO: 28199 - DNA, 25 bp, S. cerevisiae
gcaaagtgcggttcccgtaaccatt

SEQ ID NO: 28200 - DNA, 25 bp, S. cerevisiae
gcaaggcccagtttcgttgcaaagg

SEQ ID NO: 28201 - DNA, 25 bp, S. cerevisiae
gcaaactccgattacgtgtctcaag

SEQ ID NO: 28202 - DNA, 25 bp, S. cerevisiae
gcaaagttcagtcatcttgtcacga

SEQ ID NO: 28203 - DNA, 25 bp, S. cerevisiae
gcaaagttcttctcagatcccgatg

SEQ ID NO: 28204 - DNA, 25 bp, S. cerevisiae
gcactttccttcaaccttttatgat

SEQ ID NO: 28205 - DNA, 25 bp, S. cerevisiae
gcaccatcttttgacgattcttcga

SEQ ID NO: 28206 - DNA, 25 bp, S. cerevisiae
gcaccatctgtactgtatgcttgaa

SEQ ID NO: 28207 - DNA, 25 bp, S. cerevisiae
gcaaaagtttctgcctccagagggt

SEQ ID NO: 28208 - DNA, 25 bp, S. cerevisiae
gcaaaaggctattggcgctccagcg

SEQ ID NO: 28209 - DNA, 25 bp, S. cerevisiae
gcaaaggtcctctcgttctagaata

SEQ ID NO: 28210 - DNA, 25 bp, S. cerevisiae
gcagcatctcgttccaattgcatga

SEQ ID NO: 28211 - DNA, 25 bp, S. cerevisiae
gcacatccctagcacatctgatgag

SEQ ID NO: 28212 - DNA, 25 bp, S. cerevisiae
gcaacaatctgctgaccatgatgat

SEQ ID NO: 28213 - DNA, 25 bp, S. cerevisiae
gcaacgattgcgcttcattgataga

SEQ ID NO: 28214 - DNA, 25 bp, S. cerevisiae
gcaaaattggttccatgcgaaggta

SEQ ID NO: 28215 - DNA, 25 bp, S. cerevisiae
gcaaaaatgcgttccgtggtatgta

SEQ ID NO: 28216 - DNA, 25 bp, S. cerevisiae
gcacatctatcatcgaagacgtttg

SEQ ID NO: 28217 - DNA, 25 bp, S. cerevisiae
gcacgccattgcgaaagctttggtt

SEQ ID NO: 28218 - DNA, 25 bp, S. cerevisiae
gcacatctcttctcaagttgggttg

SEQ ID NO: 28219 - DNA, 25 bp, S. cerevisiae
gcagcgatcctactctcgaagggaa

SEQ ID NO: 28220 - DNA, 25 bp, S. cerevisiae
gcacgtcgtgcaactcatgctgaaa

SEQ ID NO: 28221 - DNA, 25 bp, S. cerevisiae
gcagctgtgatggttactcgtgtaa

SEQ ID NO: 28222 - DNA, 25 bp, S. cerevisiae
gcaccaactcctactgctagaagat

SEQ ID NO: 28223 - DNA, 25 bp, S. cerevisiae
gcaccaacgccgtctacaaggtaat

SEQ ID NO: 28224 - DNA, 25 bp, S. cerevisiae
gcactctctccggacttaaggtatt

SEQ ID NO: 28225 - DNA, 25 bp, S. cerevisiae
gcaatctcacaaggacattaacgga

SEQ ID NO: 28226 - DNA, 25 bp, S. cerevisiae
gcaaccatactgtcctcaaacgagt

SEQ ID NO: 28227 - DNA, 25 bp, S. cerevisiae
gcaaccattggacttcacatccgaa

SEQ ID NO: 28228 - DNA, 25 bp, S. cerevisiae
gcaaaggctggcactcaattagata

SEQ ID NO: 28229 - DNA, 25 bp, S. cerevisiae
gcacgataatcatctcttacatcca

SEQ ID NO: 28230 - DNA, 25 bp, S. cerevisiae
gcacgcacaccatgcttatgagcaa

SEQ ID NO: 28231 - DNA, 25 bp, S. cerevisiae
gcaacagcactcacattgaactttt

SEQ ID NO: 28232 - DNA, 25 bp, S. cerevisiae
gcaagcacttggtcatcgaatgcat

SEQ ID NO: 28233 - DNA, 25 bp, S. cerevisiae
gcaccatcttttgtaagtagccctc

SEQ ID NO: 28234 - DNA, 25 bp, S. cerevisiae
gcaacttttcggtaggtgcagctcc

SEQ ID NO: 28235 - DNA, 25 bp, S. cerevisiae
gaaaggagttgagccgccttgacgt

SEQ ID NO: 28236 - DNA, 25 bp, S. cerevisiae
gcaaaccttacgaagcaccattgat

SEQ ID NO: 28237 - DNA, 25 bp, S. cerevisiae
gcaaacagcgttcgattccactttc

SEQ ID NO: 28238 - DNA, 25 bp, S. cerevisiae
gcacattgtatatttcttagtcctt

SEQ ID NO: 28239 - DNA, 25 bp, S. cerevisiae
gatttaccggacactcttgagttta

SEQ ID NO: 28240 - DNA, 25 bp, S. cerevisiae
gcacctaccgtaatatcgaaggaag

SEQ ID NO: 28241 - DNA, 25 bp, S. cerevisiae
gcagccagcgttcaaccactaaaaa

SEQ ID NO: 28242 - DNA, 25 bp, S. cerevisiae
gcaaacctgttaagccaacaaataa

SEQ ID NO: 28243 - DNA, 25 bp, S. cerevisiae
gaaaggtgttgatccaaagtttaga

SEQ ID NO: 28244 - DNA, 25 bp, S. cerevisiae
gcaaggttattatcaacaaggtcca

SEQ ID NO: 28245 - DNA, 25 bp, S. cerevisiae
gcaacagcctttccacaaatcattg

SEQ ID NO: 28246 - DNA, 25 bp, S. cerevisiae
gcactagcttttccattaattattt

SEQ ID NO: 28247 - DNA, 25 bp, S. cerevisiae
gcacctgttgctgtaatgtactata

SEQ ID NO: 28248 - DNA, 25 bp, S. cerevisiae
gcactgtttgccgtgttatgacgaa

SEQ ID NO: 28249 - DNA, 25 bp, S. cerevisiae
gcacttttggccttttgaatactct

SEQ ID NO: 28250 - DNA, 25 bp, S. cerevisiae
gcacgatcattttttgtctttactt

SEQ ID NO: 28251 - DNA, 25 bp, S. cerevisiae
gaaaattttctgatccgttattggc

SEQ ID NO: 28252 - DNA, 25 bp, S. cerevisiae
gcaaaacacttattactttcaatga

SEQ ID NO: 28253 - DNA, 25 bp, S. cerevisiae
gcaaaatttctttacttatcgggat

SEQ ID NO: 28254 - DNA, 25 bp, S. cerevisiae
gcacaaattttactcattctaccgg

SEQ ID NO: 28255 - DNA, 25 bp, S. cerevisiae
gcaaacaggttttctacaacttcag

SEQ ID NO: 28256 - DNA, 25 bp, S. cerevisiae
gcaaacgtcactcatccggaattag

SEQ ID NO: 28257 - DNA, 25 bp, S. cerevisiae
gcaaagcgtgctttcgatgggcaat

SEQ ID NO: 28258 - DNA, 25 bp, S. cerevisiae
gagctactagccacaggaacaggta

SEQ ID NO: 28259 - DNA, 25 bp, S. cerevisiae
gcactaccgtcatcaggttctgtga

SEQ ID NO: 28260 - DNA, 25 bp, S. cerevisiae
gcaaatgatttcgatgcagtcgcaa

SEQ ID NO: 28261 - DNA, 25 bp, S. cerevisiae
gcaactggctatcatgaggcgtcct

SEQ ID NO: 28262 - DNA, 25 bp, S. cerevisiae
gcaacatggtagaggctgcccaaaa

SEQ ID NO: 28263 - DNA, 25 bp, S. cerevisiae
gcacaaaccgctttgggtactctaa

SEQ ID NO: 28264 - DNA, 25 bp, S. cerevisiae
ggcaatgacggcactaggtctcgga

SEQ ID NO: 28265 - DNA, 25 bp, S. cerevisiae
gcaagatacagtgacgacgttcgaa

SEQ ID NO: 28266 - DNA, 25 bp, S. cerevisiae
gcaagcatatatggcccgagtttcc

SEQ ID NO: 28267 - DNA, 25 bp, S. cerevisiae
gcaaccaaggcagagaggcttcttt

SEQ ID NO: 28268 - DNA, 25 bp, S. cerevisiae
gcacgggtggccaacaagttatcat

SEQ ID NO: 28269 - DNA, 25 bp, S. cerevisiae
gcaagcggtgacgataacggtacat

SEQ ID NO: 28270 - DNA, 25 bp, S. cerevisiae
gcaagaaagggtgcactggttcaat

SEQ ID NO: 28271 - DNA, 25 bp, S. cerevisiae
gcaagaaacgccgtcatcgaataaa

SEQ ID NO: 28272 - DNA, 25 bp, S. cerevisiae
gcaagaactggccactactcaagac

SEQ ID NO: 28273 - DNA, 25 bp, S. cerevisiae
gcaaaaggtcgcaatatctcaacat

SEQ ID NO: 28274 - DNA, 25 bp, S. cerevisiae
gactcagatgcctcttttaaacggg

SEQ ID NO: 28275 - DNA, 25 bp, S. cerevisiae
gcacatcagtgcgttcttttgcaga

SEQ ID NO: 28276 - DNA, 25 bp, S. cerevisiae
gcacgattctctttctgttgtcaaa

SEQ ID NO: 28277 - DNA, 25 bp, S. cerevisiae
gcacgttacctcatatggctatcga

SEQ ID NO: 28278 - DNA, 25 bp, S. cerevisiae
gaaggccagttacttagttttgatt

SEQ ID NO: 28279 - DNA, 25 bp, S. cerevisiae
gacaaaaaatttcaactcttcgcta

SEQ ID NO: 28280 - DNA, 25 bp, S. cerevisiae
gaaccaaagaagaggaccaccagga

SEQ ID NO: 28281 - DNA, 25 bp, S. cerevisiae
gaaccgaaacgcctagacgactggg

SEQ ID NO: 28282 - DNA, 25 bp, S. cerevisiae
gcaacctaaaccctctactaatgta

SEQ ID NO: 28283 - DNA, 25 bp, S. cerevisiae
gcaacctaactctgctatcagaaag

SEQ ID NO: 28284 - DNA, 25 bp, S. cerevisiae
gcaagagctagcttcggctgaaaaa

SEQ ID NO: 28285 - DNA, 25 bp, S. cerevisiae
gcaaacgagcacagtggccagacta

SEQ ID NO: 28286 - DNA, 25 bp, S. cerevisiae
gcaaacacagcaccatgtaccagat

SEQ ID NO: 28287 - DNA, 25 bp, S. cerevisiae
gcaacatcgcgaaagctacagcaca

SEQ ID NO: 28288 - DNA, 25 bp, S. cerevisiae
gcaaacttaacgttgaccgcgtcaa

SEQ ID NO: 28289 - DNA, 25 bp, S. cerevisiae
gcaaatttctctggagggcctacaa

SEQ ID NO: 28290 - DNA, 25 bp, S. cerevisiae
gcaaattttaggtcgcccatgcgaa

SEQ ID NO: 28291 - DNA, 25 bp, S. cerevisiae
gcacacatttgtttgtctgcggtcc

SEQ ID NO: 28292 - DNA, 25 bp, S. cerevisiae
gaattttacctaccagaagctcctc

SEQ ID NO: 28293 - DNA, 25 bp, S. cerevisiae
gaattcgtttctaccaagggcccag

SEQ ID NO: 28294 - DNA, 25 bp, S. cerevisiae
gcaaatcttcgagtatttaaaagca

SEQ ID NO: 28295 - DNA, 25 bp, S. cerevisiae
gcaaacatttaccaatcgccaacaa

SEQ ID NO: 28296 - DNA, 25 bp, S. cerevisiae
gcacaaaacgacaacatcttccaca

SEQ ID NO: 28297 - DNA, 25 bp, S. cerevisiae
gcaccgactctgctagtatttctga

SEQ ID NO: 28298 - DNA, 25 bp, S. cerevisiae
gcactggcctctaaattttacggca

SEQ ID NO: 28299 - DNA, 25 bp, S. cerevisiae
gcaaaccttgccgatcatgtaacac

SEQ ID NO: 28300 - DNA, 25 bp, S. cerevisiae
gcacacacccttttgatgtcggtaa

SEQ ID NO: 28301 - DNA, 25 bp, S. cerevisiae
gcaccttctttcaattctcaaacta

SEQ ID NO: 28302 - DNA, 25 bp, S. cerevisiae
gcactggctgtcattctcttagaaa

SEQ ID NO: 28303 - DNA, 25 bp, S. cerevisiae
gcactatctgctatgtctgcgatga

SEQ ID NO: 28304 - DNA, 25 bp, S. cerevisiae
gcacattctctacccatggatgttg

SEQ ID NO: 28305 - DNA, 25 bp, S. cerevisiae
gcacatcagttagcattgggtcaga

SEQ ID NO: 28306 - DNA, 25 bp, S. cerevisiae
gcaagctctccaaacttgggtggta

SEQ ID NO: 28307 - DNA, 25 bp, S. cerevisiae
gcaactgctacaaactgggctggtt

SEQ ID NO: 28308 - DNA, 25 bp, S. cerevisiae
gcaactgacaactgctccatttgtt

SEQ ID NO: 28309 - DNA, 25 bp, S. cerevisiae
gcaatcaaactattgaccagcttgg

SEQ ID NO: 28310 - DNA, 25 bp, S. cerevisiae
gcaacacatgacgaaaagagcactt

SEQ ID NO: 28311 - DNA, 25 bp, S. cerevisiae
gcacaagtttggctgataattctaa

SEQ ID NO: 28312 - DNA, 25 bp, S. cerevisiae
gcacgctgtctagctttcaaactga

SEQ ID NO: 28313 - DNA, 25 bp, S. cerevisiae
gcacctgctctaactttcattatgg

SEQ ID NO: 28314 - DNA, 25 bp, S. cerevisiae
gcacttatcttcacattcatctaca

SEQ ID NO: 28315 - DNA, 25 bp, S. cerevisiae
gcacatcgcgatattacaccttcaa

SEQ ID NO: 28316 - DNA, 25 bp, S. cerevisiae
gcaaagggttctctccatggcaaaa

SEQ ID NO: 28317 - DNA, 25 bp, S. cerevisiae
gcaacagggttatcctcagcagcaa

SEQ ID NO: 28318 - DNA, 25 bp, S. cerevisiae
gcaactaggcccgactataaatcta

SEQ ID NO: 28319 - DNA, 25 bp, S. cerevisiae
gcaactagtgcttctccaaagtcat

SEQ ID NO: 28320 - DNA, 25 bp, S. cerevisiae
gcaacatatgttccaccaaggtatt

SEQ ID NO: 28321 - DNA, 25 bp, S. cerevisiae
gaccggtaaacgtcaggttctattg

SEQ ID NO: 28322 - DNA, 25 bp, S. cerevisiae
gcaccggtaagatatctgttcctga

SEQ ID NO: 28323 - DNA, 25 bp, S. cerevisiae
gcacatactggtcctataaccgaga

SEQ ID NO: 28324 - DNA, 25 bp, S. cerevisiae
gaatcagtgtggacgcatttcagcg

SEQ ID NO: 28325 - DNA, 25 bp, S. cerevisiae
gcacatcgtgtgaagagtaatccac

SEQ ID NO: 28326 - DNA, 25 bp, S. cerevisiae
gcacacttgattgagctgaaccagc

SEQ ID NO: 28327 - DNA, 25 bp, S. cerevisiae
gcaactggttgtggcaatttttgat

SEQ ID NO: 28328 - DNA, 25 bp, S. cerevisiae
gcaacaaccacttatttatctcgat

SEQ ID NO: 28329 - DNA, 25 bp, S. cerevisiae
gcaaaaggcaggtcttccaccgaac

SEQ ID NO: 28330 - DNA, 25 bp, S. cerevisiae
gcaacaatccctatactcgagtatt

SEQ ID NO: 28331 - DNA, 25 bp, S. cerevisiae
gcaattaaggagtgcccgatttgtt

SEQ ID NO: 28332 - DNA, 25 bp, S. cerevisiae
gaaagaagagaactagaagacttaa

SEQ ID NO: 28333 - DNA, 25 bp, S. cerevisiae
gcaaagacgaaacaaagctggaata

SEQ ID NO: 28334 - DNA, 25 bp, S. cerevisiae
gcaacaacagtagtaacggcggatt

SEQ ID NO: 28335 - DNA, 25 bp, S. cerevisiae
gcaaattggataaatacggccgtgt

SEQ ID NO: 28336 - DNA, 25 bp, S. cerevisiae
gcaaaactgagaaaaccgcacctgt

SEQ ID NO: 28337 - DNA, 25 bp, S. cerevisiae
gcaacaactaaattaccaccctatg

SEQ ID NO: 28338 - DNA, 25 bp, S. cerevisiae
gcacaaagacgcaccatatctgata

SEQ ID NO: 28339 - DNA, 25 bp, S. cerevisiae
gcaagttacagattggttccatcat

SEQ ID NO: 28340 - DNA, 25 bp, S. cerevisiae
gcacattggcggatttctatctgat

SEQ ID NO: 28341 - DNA, 25 bp, S. cerevisiae
gcactctcatgggttgttcttcaat

SEQ ID NO: 28342 - DNA, 25 bp, S. cerevisiae
gcacacaatggacgttctttcacaa

SEQ ID NO: 28343 - DNA, 25 bp, S. cerevisiae
gcaactaccgaaaagcaagaagcta

SEQ ID NO: 28344 - DNA, 25 bp, S. cerevisiae
gcacatccaatagtagccctttgac

SEQ ID NO: 28345 - DNA, 25 bp, S. cerevisiae
gcacacctgagcgtggcggattgaa

SEQ ID NO: 28346 - DNA, 25 bp, S. cerevisiae
gcactcctggcaactgggatcatat

SEQ ID NO: 28347 - DNA, 25 bp, S. cerevisiae
gcacttttcgccatgcagaatgatg

SEQ ID NO: 28348 - DNA, 25 bp, S. cerevisiae
gcacagtatcttggaggcgtagcat

SEQ ID NO: 28349 - DNA, 25 bp, S. cerevisiae
gcaagttcttggagctgcagagata

SEQ ID NO: 28350 - DNA, 25 bp, S. cerevisiae
gcaaattctaatgccgaagatgatc

SEQ ID NO: 28351 - DNA, 25 bp, S. cerevisiae
gcaaatgtcgatgccgctgttgatt

SEQ ID NO: 28352 - DNA, 25 bp, S. cerevisiae
gcaaattcgggcagtgtctcgcttc

SEQ ID NO: 28353 - DNA, 25 bp, S. cerevisiae
gcaaatacccgcatatgtcttgatt

SEQ ID NO: 28354 - DNA, 25 bp, S. cerevisiae
gcaaatacctccttgttctaactga

SEQ ID NO: 28355 - DNA, 25 bp, S. cerevisiae
gcaaaagcgcttatctttaaggacc

SEQ ID NO: 28356 - DNA, 25 bp, S. cerevisiae
gcaaaacgactctgctttggaggca

SEQ ID NO: 28357 - DNA, 25 bp, S. cerevisiae
gcaagcatttgaagccagctcagat

SEQ ID NO: 28358 - DNA, 25 bp, S. cerevisiae
gcaagcatttaagcgccataacgtt

SEQ ID NO: 28359 - DNA, 25 bp, S. cerevisiae
gcaaatttcttggagccacaagctt

SEQ ID NO: 28360 - DNA, 25 bp, S. cerevisiae
gcacaatatgtttccagcactcaca

SEQ ID NO: 28361 - DNA, 25 bp, S. cerevisiae
gcaacatcagtttcagcatcaccaa

SEQ ID NO: 28362 - DNA, 25 bp, S. cerevisiae
gcaatcgcagttacagtcacagtca

SEQ ID NO: 28363 - DNA, 25 bp, S. cerevisiae
gcaacgcacttgacgccagaggatc

SEQ ID NO: 28364 - DNA, 25 bp, S. cerevisiae
gcaagcagccatcctctgaagttaa

SEQ ID NO: 28365 - DNA, 25 bp, S. cerevisiae
gcaagcgaagcgtatctggtaggat

SEQ ID NO: 28366 - DNA, 25 bp, S. cerevisiae
gcaacacaagagatctggtcacaga

SEQ ID NO: 28367 - DNA, 25 bp, S. cerevisiae
gcaaagcattgccttcatcgacaag

SEQ ID NO: 28368 - DNA, 25 bp, S. cerevisiae
gcaaacatttctaccgaaaatctgg

SEQ ID NO: 28369 - DNA, 25 bp, S. cerevisiae
gcaaatctatttactgttcaacctg

SEQ ID NO: 28370 - DNA, 25 bp, S. cerevisiae
gcaaactgttttgggtcgtcctgag

SEQ ID NO: 28371 - DNA, 25 bp, S. cerevisiae
gcaaactccagtgtgtatcctaaaa

SEQ ID NO: 28372 - DNA, 25 bp, S. cerevisiae
gcaaactcaaatggtgattcccgca

SEQ ID NO: 28373 - DNA, 25 bp, S. cerevisiae
gcaagatgacaaccctgttcctgtt

SEQ ID NO: 28374 - DNA, 25 bp, S. cerevisiae
gcaaatgatcaagcttccaacgagt

SEQ ID NO: 28375 - DNA, 25 bp, S. cerevisiae
gcaacaaaccgctcttatctattaa

SEQ ID NO: 28376 - DNA, 25 bp, S. cerevisiae
gcaaccaaccctatttcaatcaaga

SEQ ID NO: 28377 - DNA, 25 bp, S. cerevisiae
gcaatcgaacccttcatttgggcaa

SEQ ID NO: 28378 - DNA, 25 bp, S. cerevisiae
gcaaaaacctcttctgttgtgccaa

SEQ ID NO: 28379 - DNA, 25 bp, S. cerevisiae
gcaagcaaagttccagcctttctaa

SEQ ID NO: 28380 - DNA, 25 bp, S. cerevisiae
gcaagcttgctgtcgagattccagt

SEQ ID NO: 28381 - DNA, 25 bp, S. cerevisiae
gcaactcatctattgtgacccatgc

SEQ ID NO: 28382 - DNA, 25 bp, S. cerevisiae
gcaagaaccatgttgacccagcagc

SEQ ID NO: 28383 - DNA, 25 bp, S. cerevisiae
gcaaaacaatttcttgagccaactt

SEQ ID NO: 28384 - DNA, 25 bp, S. cerevisiae
gcaaacagatgctttttatacccaa

SEQ ID NO: 28385 - DNA, 25 bp, S. cerevisiae
gcaatcaaaactacgctcgagctct

SEQ ID NO: 28386 - DNA, 25 bp, S. cerevisiae
gcaacgaatctttgagaggcaatac

SEQ ID NO: 28387 - DNA, 25 bp, S. cerevisiae
gcaacctactgcaagtgacaacata

SEQ ID NO: 28388 - DNA, 25 bp, S. cerevisiae
gcaagaccctgctatggttactaga

SEQ ID NO: 28389 - DNA, 25 bp, S. cerevisiae
gcaatggccctaagtgatattctaa

SEQ ID NO: 28390 - DNA, 25 bp, S. cerevisiae
gcaacccacttacttacatctgaaa

SEQ ID NO: 28391 - DNA, 25 bp, S. cerevisiae
gcaaccctatgaatctaaggctcaa

SEQ ID NO: 28392 - DNA, 25 bp, S. cerevisiae
gcaaccactggatcacaggagtctt

SEQ ID NO: 28393 - DNA, 25 bp, S. cerevisiae
gcaactagtagatcacgtggctctt

SEQ ID NO: 28394 - DNA, 25 bp, S. cerevisiae
gcaaggccgtgaatccgcaagcgaa

SEQ ID NO: 28395 - DNA, 25 bp, S. cerevisiae
gcaagggccttgacattgaaccata

SEQ ID NO: 28396 - DNA, 25 bp, S. cerevisiae
gcacagccggtgatcatggaaccta

SEQ ID NO: 28397 - DNA, 25 bp, S. cerevisiae
gcacagttgttgatcgttgacatcg

SEQ ID NO: 28398 - DNA, 25 bp, S. cerevisiae
gcaactgcgtgattattcttgtgct

SEQ ID NO: 28399 - DNA, 25 bp, S. cerevisiae
gcaactgtgctgttcattcaatggt

SEQ ID NO: 28400 - DNA, 25 bp, S. cerevisiae
gcaagggtgaaccattcatcagata

SEQ ID NO: 28401 - DNA, 25 bp, S. cerevisiae
gcaaggattgcatgtcgtcatcaca

SEQ ID NO: 28402 - DNA, 25 bp, S. cerevisiae
gcaacgcaccaactgctgatacaga

SEQ ID NO: 28403 - DNA, 25 bp, S. cerevisiae
gcacagcctccagcatatgatgaag

SEQ ID NO: 28404 - DNA, 25 bp, S. cerevisiae
gcaagcgtcaccgatattgtcagta

SEQ ID NO: 28405 - DNA, 25 bp, S. cerevisiae
gcaaagctgcataccggaagaccat

SEQ ID NO: 28406 - DNA, 25 bp, S. cerevisiae
gcacacgttgccgaagagacaccaa

SEQ ID NO: 28407 - DNA, 25 bp, S. cerevisiae
gcaacagttcgaattgacgcgccaa

SEQ ID NO: 28408 - DNA, 25 bp, S. cerevisiae
gcaacagctacgtgcaacaggccaa

SEQ ID NO: 28409 - DNA, 25 bp, S. cerevisiae
gcaatttaccacctacggactcaag

SEQ ID NO: 28410 - DNA, 25 bp, S. cerevisiae
gcaaatgttagacttaggtacccaa

SEQ ID NO: 28411 - DNA, 25 bp, S. cerevisiae
gaagtacgaacaacaagtgacccaa

SEQ ID NO: 28412 - DNA, 25 bp, S. cerevisiae
gcaaaaggacaacccacgaccaaag

SEQ ID NO: 28413 - DNA, 25 bp, S. cerevisiae
gcaaaagtcaaatccccatcaacaa

SEQ ID NO: 28414 - DNA, 25 bp, S. cerevisiae
gaatctttgcaaaacaagggccaag

SEQ ID NO: 28415 - DNA, 25 bp, S. cerevisiae
gcaaagtattgtcggctgcttggca

SEQ ID NO: 28416 - DNA, 25 bp, S. cerevisiae
gcaaagttcttgctgcagctttaaa

SEQ ID NO: 28417 - DNA, 25 bp, S. cerevisiae
gcacacgaacttagagagcttcaaa

SEQ ID NO: 28418 - DNA, 25 bp, S. cerevisiae
gcacattcagacaatggcgagctat

SEQ ID NO: 28419 - DNA, 25 bp, S. cerevisiae
gcaattgcaggccatgggtccacaa

SEQ ID NO: 28420 - DNA, 25 bp, S. cerevisiae
gcaaatcacgtcttgagtgcaaaga

SEQ ID NO: 28421 - DNA, 25 bp, S. cerevisiae
gcacatctgcttagtgactctactg

SEQ ID NO: 28422 - DNA, 25 bp, S. cerevisiae
gcacaaaactgcactgcttggagtt

SEQ ID NO: 28423 - DNA, 25 bp, S. cerevisiae
gcaaatcgagtcagtccatgggttt

SEQ ID NO: 28424 - DNA, 25 bp, S. cerevisiae
gcaaacgatccttcacctagtgtaa

SEQ ID NO: 28425 - DNA, 25 bp, S. cerevisiae
gcaagtctatcctccaaatgtttat

SEQ ID NO: 28426 - DNA, 25 bp, S. cerevisiae
gcaagctttggaaaaaatcggtatt

SEQ ID NO: 28427 - DNA, 25 bp, S. cerevisiae
gcaagctttggaaaagattggtatc

SEQ ID NO: 28428 - DNA, 25 bp, S. cerevisiae
gcaaactcgcattctaagcatggtt

SEQ ID NO: 28429 - DNA, 25 bp, S. cerevisiae
gggatacccgatgccgttaaattat

SEQ ID NO: 28430 - DNA, 25 bp, S. cerevisiae
gcaaacgctcggattcagaataaaa

SEQ ID NO: 28431 - DNA, 25 bp, S. cerevisiae
gcaaccgcttggattaactcaaact

SEQ ID NO: 28432 - DNA, 25 bp, S. cerevisiae
gcaagcacgctattgttggcattga

SEQ ID NO: 28433 - DNA, 25 bp, S. cerevisiae
gcaatggcgctaattctgcgtctga

SEQ ID NO: 28434 - DNA, 25 bp, S. cerevisiae
gcaagtcactacttctgctgaatat

SEQ ID NO: 28435 - DNA, 25 bp, S. cerevisiae
gcaaaaatatgcttctctgacagat

SEQ ID NO: 28436 - DNA, 25 bp, S. cerevisiae
gcaacaacttcttctccatgagatg

SEQ ID NO: 28437 - DNA, 25 bp, S. cerevisiae
gcacatggattgacctctgccagta

SEQ ID NO: 28438 - DNA, 25 bp, S. cerevisiae
gcaagctacaagatgttttcaacct

SEQ ID NO: 28439 - DNA, 25 bp, S. cerevisiae
gcaacaacgatgattcttcccctta

SEQ ID NO: 28440 - DNA, 25 bp, S. cerevisiae
gcacactgcatcctatttacgttta

SEQ ID NO: 28441 - DNA, 25 bp, S. cerevisiae
gcaaattaaagccttcgagcgtccc

SEQ ID NO: 28442 - DNA, 25 bp, S. cerevisiae
gcaagatttgaagtttcgttaccgt

SEQ ID NO: 28443 - DNA, 25 bp, S. cerevisiae
gcaagtatcccgcaagttgtaccgt

SEQ ID NO: 28444 - DNA, 25 bp, S. cerevisiae
gaattatggcccacgacttacgttc

SEQ ID NO: 28445 - DNA, 25 bp, S. cerevisiae
gcaaaggagtgcgtactttttccct

SEQ ID NO: 28446 - DNA, 25 bp, S. cerevisiae
gcaaagggcttctactaattgtatc

SEQ ID NO: 28447 - DNA, 25 bp, S. cerevisiae
gcaaaggacggctattatttataca

SEQ ID NO: 28448 - DNA, 25 bp, S. cerevisiae
gcaagaggcacgtactattttaggt

SEQ ID NO: 28449 - DNA, 25 bp, S. cerevisiae
gcaagaagctaaaaactttgaagta

SEQ ID NO: 28450 - DNA, 25 bp, S. cerevisiae
gcaaaagctttgaaccagtctaggt

SEQ ID NO: 28451 - DNA, 25 bp, S. cerevisiae
gcaaagtgtaagacctaccaccgtt

SEQ ID NO: 28452 - DNA, 25 bp, S. cerevisiae
gcaaacgttagtcatgatccttcag

SEQ ID NO: 28453 - DNA, 25 bp, S. cerevisiae
gcaagacgtcaagtccagctatctt

SEQ ID NO: 28454 - DNA, 25 bp, S. cerevisiae
gcaaaggacctgttcaatgacgttt

SEQ ID NO: 28455 - DNA, 25 bp, S. cerevisiae
gcaagagtcttattttataccccta

SEQ ID NO: 28456 - DNA, 25 bp, S. cerevisiae
gcaagatctgctcacttctttggag

SEQ ID NO: 28457 - DNA, 25 bp, S. cerevisiae
gcacactcttcttcacattttagta

SEQ ID NO: 28458 - DNA, 25 bp, S. cerevisiae
gcaaggttctgaagaccattctttc

SEQ ID NO: 28459 - DNA, 25 bp, S. cerevisiae
gcaacgtattggattcttcatttta

SEQ ID NO: 28460 - DNA, 25 bp, S. cerevisiae
gcaacgttcgctatttacttcaata

SEQ ID NO: 28461 - DNA, 25 bp, S. cerevisiae
gcaacaggtcctccataatggtatc

SEQ ID NO: 28462 - DNA, 25 bp, S. cerevisiae
gcaacggttgatcatggcatcgtcc

SEQ ID NO: 28463 - DNA, 25 bp, S. cerevisiae
gcaacatgggtcttcattacactcc

SEQ ID NO: 28464 - DNA, 25 bp, S. cerevisiae
gcaagctgacgaattcctaatctcc

SEQ ID NO: 28465 - DNA, 25 bp, S. cerevisiae
gcaactttgaattcgctaatctccc

SEQ ID NO: 28466 - DNA, 25 bp, S. cerevisiae
gaagttggaattgttcccataccaa

SEQ ID NO: 28467 - DNA, 25 bp, S. cerevisiae
gcaaagtttctgtctggtgttccga

SEQ ID NO: 28468 - DNA, 25 bp, S. cerevisiae
gcaagagttttctggatttcctgat

SEQ ID NO: 28469 - DNA, 25 bp, S. cerevisiae
gcaatagtgccctcttgtaacgaaa

SEQ ID NO: 28470 - DNA, 25 bp, S. cerevisiae
gcaacaagacattcttcgctgggaa

SEQ ID NO: 28471 - DNA, 25 bp, S. cerevisiae
gcaaaagatttcatagctccggaag

SEQ ID NO: 28472 - DNA, 25 bp, S. cerevisiae
gcaaagagttccattgtccgacaat

SEQ ID NO: 28473 - DNA, 25 bp, S. cerevisiae
gcaaatcacttggattctcatccag

SEQ ID NO: 28474 - DNA, 25 bp, S. cerevisiae
gcaaggagctgtggcatttcaatca

SEQ ID NO: 28475 - DNA, 25 bp, S. cerevisiae
gcaaaggctgcttctgattctgaat

SEQ ID NO: 28476 - DNA, 25 bp, S. cerevisiae
gcaacaacgctgacgctttgagtag

SEQ ID NO: 28477 - DNA, 25 bp, S. cerevisiae
gcaaattctactaccacgtttatct

SEQ ID NO: 28478 - DNA, 25 bp, S. cerevisiae
gcaactactagccaaaccattttct

SEQ ID NO: 28479 - DNA, 25 bp, S. cerevisiae
gaatcacaaacacaagccggttctg

SEQ ID NO: 28480 - DNA, 25 bp, S. cerevisiae
gcaagtcttggatatggcagtcata

SEQ ID NO: 28481 - DNA, 25 bp, S. cerevisiae
gcaaccgcaggatgtgatggatata

SEQ ID NO: 28482 - DNA, 25 bp, S. cerevisiae
gcaaacaaggcttctcatggtaaat

SEQ ID NO: 28483 - DNA, 25 bp, S. cerevisiae
gcaatacacctttcttgacactgga

SEQ ID NO: 28484 - DNA, 25 bp, S. cerevisiae
gcaatcgacgttgaatcacagggaa

SEQ ID NO: 28485 - DNA, 25 bp, S. cerevisiae
gcaactttttgccaccaagggatga

SEQ ID NO: 28486 - DNA, 25 bp, S. cerevisiae
gcaactatcattaaccccggagaaa

SEQ ID NO: 28487 - DNA, 25 bp, S. cerevisiae
gaaatttacccctacggatcaagag

SEQ ID NO: 28488 - DNA, 25 bp, S. cerevisiae
gcaaagttaccgcacagctcgaaaa

SEQ ID NO: 28489 - DNA, 25 bp, S. cerevisiae
gcaagaatgctaggcgttcgtctaa

SEQ ID NO: 28490 - DNA, 25 bp, S. cerevisiae
gcaagacctatcgtttctgtattgg

SEQ ID NO: 28491 - DNA, 25 bp, S. cerevisiae
gcaaatctgttttccattgctcaat

SEQ ID NO: 28492 - DNA, 25 bp, S. cerevisiae
gaattggtttctcacttcgtttccg

SEQ ID NO: 28493 - DNA, 25 bp, S. cerevisiae
gaatttttgccacgtttgagttcct

SEQ ID NO: 28494 - DNA, 25 bp, S. cerevisiae
gaattttttacctctatggtcctgg

SEQ ID NO: 28495 - DNA, 25 bp, S. cerevisiae
gcaatgtgtagtcaccggtctggtt

SEQ ID NO: 28496 - DNA, 25 bp, S. cerevisiae
gcaaggatcagtctccaggtcgctt

SEQ ID NO: 28497 - DNA, 25 bp, S. cerevisiae
gaatccatttagctaggctcggtca

SEQ ID NO: 28498 - DNA, 25 bp, S. cerevisiae
gcaaccaaatggctacgactgtgga

SEQ ID NO: 28499 - DNA, 25 bp, S. cerevisiae
gcaatccaaatggttgaccctgctt

SEQ ID NO: 28500 - DNA, 25 bp, S. cerevisiae
gcaaatgccgatattcttctagatt

SEQ ID NO: 28501 - DNA, 25 bp, S. cerevisiae
gcaactgcctgtgtctctagagaat

SEQ ID NO: 28502 - DNA, 25 bp, S. cerevisiae
gcaacactgctggagttcttggagt

SEQ ID NO: 28503 - DNA, 25 bp, S. cerevisiae
gcaatcactggacgctgttttagta

SEQ ID NO: 28504 - DNA, 25 bp, S. cerevisiae
gcaacagcaggactggtctcttgaa

SEQ ID NO: 28505 - DNA, 25 bp, S. cerevisiae
gcaagagcaatgttggttccatcaa

SEQ ID NO: 28506 - DNA, 25 bp, S. cerevisiae
gaaggcaagtacgatatctccaata

SEQ ID NO: 28507 - DNA, 25 bp, S. cerevisiae
gaaccaagtttgcatccactgtacg

SEQ ID NO: 28508 - DNA, 25 bp, S. cerevisiae
gcaacaaatgtcacagcatcctcga

SEQ ID NO: 28509 - DNA, 25 bp, S. cerevisiae
gcaacaagattactagcacccacag

SEQ ID NO: 28510 - DNA, 25 bp, S. cerevisiae
gcaagcttgatggtctttcactcga

SEQ ID NO: 28511 - DNA, 25 bp, S. cerevisiae
gcaagtcgatgctttacaaatccaa

SEQ ID NO: 28512 - DNA, 25 bp, S. cerevisiae
gcaaggatgcactctacaaatacaa

SEQ ID NO: 28513 - DNA, 25 bp, S. cerevisiae
gcaatgctgtaacgcaaacaaacat

SEQ ID NO: 28514 - DNA, 25 bp, S. cerevisiae
gcaatcttcgttcaagtgccatctg

SEQ ID NO: 28515 - DNA, 25 bp, S. cerevisiae
gcaattcgaagatttggacaccagt

SEQ ID NO: 28516 - DNA, 25 bp, S. cerevisiae
gcaatttggtggctggacatacgtt

SEQ ID NO: 28517 - DNA, 25 bp, S. cerevisiae
gaacttcgtgctcttttgggttaca

SEQ ID NO: 28518 - DNA, 25 bp, S. cerevisiae
gcaaactctgttgtactctgatttc

SEQ ID NO: 28519 - DNA, 25 bp, S. cerevisiae
gaatgcgcagggttggatgtcttcc

SEQ ID NO: 28520 - DNA, 25 bp, S. cerevisiae
gcaatggcagattgtgctaaggcaa

SEQ ID NO: 28521 - DNA, 25 bp, S. cerevisiae
gcaatggcatgctatgatcgaactg

SEQ ID NO: 28522 - DNA, 25 bp, S. cerevisiae
gcaaacagcaagaaagtccactggt

SEQ ID NO: 28523 - DNA, 25 bp, S. cerevisiae
gcaacaccataatacccatcgagat

SEQ ID NO: 28524 - DNA, 25 bp, S. cerevisiae
gcaacccttgattgtcgctaaagca

SEQ ID NO: 28525 - DNA, 25 bp, S. cerevisiae
gcaaggcttgatgcagatgctctaa

SEQ ID NO: 28526 - DNA, 25 bp, S. cerevisiae
gcaacatcggtttcattcgtcgcaa

SEQ ID NO: 28527 - DNA, 25 bp, S. cerevisiae
gcaaaccagttttacgcaccaagaa

SEQ ID NO: 28528 - DNA, 25 bp, S. cerevisiae
gcaaagttttattacaagcctcgaa

SEQ ID NO: 28529 - DNA, 25 bp, S. cerevisiae
gtagactcctttcaaggccacgaaa

SEQ ID NO: 28530 - DNA, 25 bp, S. cerevisiae
gattccggagcctggcgtgaacgta

SEQ ID NO: 28531 - DNA, 25 bp, S. cerevisiae
gattaaacacctctggttcgtctac

SEQ ID NO: 28532 - DNA, 25 bp, S. cerevisiae
gaaggaacaccaggtcgttacccag

SEQ ID NO: 28533 - DNA, 25 bp, S. cerevisiae
gaaggttaccataacttccaccacg

SEQ ID NO: 28534 - DNA, 25 bp, S. cerevisiae
gaaggttataccgactacccaacat

SEQ ID NO: 28535 - DNA, 25 bp, S. cerevisiae
gcaagcctttcgcataaacctcaaa

SEQ ID NO: 28536 - DNA, 25 bp, S. cerevisiae
gtcactcgagttctttaattcacgc

SEQ ID NO: 28537 - DNA, 25 bp, S. cerevisiae
ttccggacatttcctgtagacgacg

SEQ ID NO: 28538 - DNA, 25 bp, S. cerevisiae
gaccggtattatctgtcaggacctg

SEQ ID NO: 28539 - DNA, 25 bp, S. cerevisiae
gcaaccgtttgacattcatggagca

SEQ ID NO: 28540 - DNA, 25 bp, S. cerevisiae
gaagggttatggcttcgaagttcca

SEQ ID NO: 28541 - DNA, 25 bp, S. cerevisiae
gaaggacaactatattatcaaaggt

SEQ ID NO: 28542 - DNA, 25 bp, S. cerevisiae
gaattcgtacaacattaaacgtgtg

SEQ ID NO: 28543 - DNA, 25 bp, S. cerevisiae
gaagttaggctactgtccgtacggt

SEQ ID NO: 28544 - DNA, 25 bp, S. cerevisiae
gaattcctgagcaacgacacttacg

SEQ ID NO: 28545 - DNA, 25 bp, S. cerevisiae
gaatacggcactgttaccatttgtt

SEQ ID NO: 28546 - DNA, 25 bp, S. cerevisiae
gcaagacgttttttcaccatgtgtt

SEQ ID NO: 28547 - DNA, 25 bp, S. cerevisiae
gcaagttggcaaaactccgtgcaat

SEQ ID NO: 28548 - DNA, 25 bp, S. cerevisiae
gcaacattgacagatctgcccgaaa

SEQ ID NO: 28549 - DNA, 25 bp, S. cerevisiae
gcaaccgccagagcttacagaagca

SEQ ID NO: 28550 - DNA, 25 bp, S. cerevisiae
gcaaccgctagtggatacgcaggac

SEQ ID NO: 28551 - DNA, 25 bp, S. cerevisiae
gcaaccaatatttgatcacgcccac

SEQ ID NO: 28552 - DNA, 25 bp, S. cerevisiae
gcaacacttaacgaggccgctgaaa

SEQ ID NO: 28553 - DNA, 25 bp, S. cerevisiae
gcaaccttttgtcgaagcgctgaaa

SEQ ID NO: 28554 - DNA, 25 bp, S. cerevisiae
gcaacatgttttccacggcagctaa

SEQ ID NO: 28555 - DNA, 25 bp, S. cerevisiae
gcaacatgttatactcctgtggtga

SEQ ID NO: 28556 - DNA, 25 bp, S. cerevisiae
gcaattccgcaagtacagagtccta

SEQ ID NO: 28557 - DNA, 25 bp, S. cerevisiae
gaattcccagactacggtttgactt

SEQ ID NO: 28558 - DNA, 25 bp, S. cerevisiae
gaattgcccgacagcgttatcccaa

SEQ ID NO: 28559 - DNA, 25 bp, S. cerevisiae
gaattcctaatctccttgggtcata

SEQ ID NO: 28560 - DNA, 25 bp, S. cerevisiae
gcaagtagtaccaatttaccgcctg

SEQ ID NO: 28561 - DNA, 25 bp, S. cerevisiae
gcaattacgtcgcaaatagcctaca

SEQ ID NO: 28562 - DNA, 25 bp, S. cerevisiae
gcaataacgctggtgaaactccgaa

SEQ ID NO: 28563 - DNA, 25 bp, S. cerevisiae
gcaatagactggatagacatttcga

SEQ ID NO: 28564 - DNA, 25 bp, S. cerevisiae
gcaatcctgccggtcatattaaacg

SEQ ID NO: 28565 - DNA, 25 bp, S. cerevisiae
gcaacctgattgcttccgagggtga

SEQ ID NO: 28566 - DNA, 25 bp, S. cerevisiae
gcaacacgatttcctgctatcagag

SEQ ID NO: 28567 - DNA, 25 bp, S. cerevisiae
gcaaaacatcttcttcatcacaggt

SEQ ID NO: 28568 - DNA, 25 bp, S. cerevisiae
gcaaggacttatcccctgcaataaa

SEQ ID NO: 28569 - DNA, 25 bp, S. cerevisiae
gcaagtctccccagctattgtaaaa

SEQ ID NO: 28570 - DNA, 25 bp, S. cerevisiae
gcaactgggctccactagtgttagg

SEQ ID NO: 28571 - DNA, 25 bp, S. cerevisiae
gcaacagcggccaacttattgtggg

SEQ ID NO: 28572 - DNA, 25 bp, S. cerevisiae
gcaacaggcgccattatcttttcag

SEQ ID NO: 28573 - DNA, 25 bp, S. cerevisiae
gcaactggcacacaatttcttgact

SEQ ID NO: 28574 - DNA, 25 bp, S. cerevisiae
gcaacctgccacaaatgctacattg

SEQ ID NO: 28575 - DNA, 25 bp, S. cerevisiae
gcaaccactacattatctcaatctg

SEQ ID NO: 28576 - DNA, 25 bp, S. cerevisiae
gcaaccacaatcttcagcattcaaa

SEQ ID NO: 28577 - DNA, 25 bp, S. cerevisiae
gcaacctttgcaacagcatctcaaa

SEQ ID NO: 28578 - DNA, 25 bp, S. cerevisiae
gaatcacttgggaagcactcaacaa

SEQ ID NO: 28579 - DNA, 25 bp, S. cerevisiae
gcaaccttggctttggtattcaaca

SEQ ID NO: 28580 - DNA, 25 bp, S. cerevisiae
gcaatcgctcacttcttgttattat

SEQ ID NO: 28581 - DNA, 25 bp, S. cerevisiae
gcaactttgatgacctttttcttaa

SEQ ID NO: 28582 - DNA, 25 bp, S. cerevisiae
gcaatcttgttgacgaggtttacga

SEQ ID NO: 28583 - DNA, 25 bp, S. cerevisiae
gaatttgtcgctgacggtctattac

SEQ ID NO: 28584 - DNA, 25 bp, S. cerevisiae
gaattggttgtctttttgccagctt

SEQ ID NO: 28585 - DNA, 25 bp, S. cerevisiae
gcaagtttttgtctatctaactgct

SEQ ID NO: 28586 - DNA, 25 bp, S. cerevisiae
gaattggttcgatttccaccgtttg

SEQ ID NO: 28587 - DNA, 25 bp, S. cerevisiae
gaatttgcgttcaatcccaaggttt

SEQ ID NO: 28588 - DNA, 25 bp, S. cerevisiae
gcaactttttactagtcccatggct

SEQ ID NO: 28589 - DNA, 25 bp, S. cerevisiae
gcaagtattagtagcctcatcggag

SEQ ID NO: 28590 - DNA, 25 bp, S. cerevisiae
gcaactatttcttagctttctgtgt

SEQ ID NO: 28591 - DNA, 25 bp, S. cerevisiae
gcaattacttcctattcgtctatgg

SEQ ID NO: 28592 - DNA, 25 bp, S. cerevisiae
gcaagctcttgacctattcttacag

SEQ ID NO: 28593 - DNA, 25 bp, S. cerevisiae
gcaacaattaccatctcagcaacaa

SEQ ID NO: 28594 - DNA, 25 bp, S. cerevisiae
gcaactattaccattcatttctcac

SEQ ID NO: 28595 - DNA, 25 bp, S. cerevisiae
gcaactacccgacgtcattggatat

SEQ ID NO: 28596 - DNA, 25 bp, S. cerevisiae
gacttgcagtcaccccatggattat

SEQ ID NO: 28597 - DNA, 25 bp, S. cerevisiae
gaattggccagggaacatactgaaa

SEQ ID NO: 28598 - DNA, 25 bp, S. cerevisiae
gaattggccagacaaacagcgtcaa

SEQ ID NO: 28599 - DNA, 25 bp, S. cerevisiae
gaatagtggaaacaacaatggcaaa

SEQ ID NO: 28600 - DNA, 25 bp, S. cerevisiae
gaatcggaaaatcatgcccttaaac

SEQ ID NO: 28601 - DNA, 25 bp, S. cerevisiae
gcaacgtataaacagcgcttctcaa

SEQ ID NO: 28602 - DNA, 25 bp, S. cerevisiae
gaattccaaactcatctaccgaaag

SEQ ID NO: 28603 - DNA, 25 bp, S. cerevisiae
gaattacccttcatttctcaaactg

SEQ ID NO: 28604 - DNA, 25 bp, S. cerevisiae
gaatttttgggcgtgttgcctaatt

SEQ ID NO: 28605 - DNA, 25 bp, S. cerevisiae
gaatttttggaagggctgcccggca

SEQ ID NO: 28606 - DNA, 25 bp, S. cerevisiae
gcaagttccttaagggctgtgccgt

SEQ ID NO: 28607 - DNA, 25 bp, S. cerevisiae
gcaatgatatcactttagctgtata

SEQ ID NO: 28608 - DNA, 25 bp, S. cerevisiae
gcaatatgatagctctgggaatgaa

SEQ ID NO: 28609 - DNA, 25 bp, S. cerevisiae
gcaagcatgtcctgctggtcaagaa

SEQ ID NO: 28610 - DNA, 25 bp, S. cerevisiae
gcaactcgcgcagtggcgtcaaaaa

SEQ ID NO: 28611 - DNA, 25 bp, S. cerevisiae
gcaactgcgcgctgtggtaaagcta

SEQ ID NO: 28612 - DNA, 25 bp, S. cerevisiae
gcaacgcggaggagctcattagcat

SEQ ID NO: 28613 - DNA, 25 bp, S. cerevisiae
gcaacgggcaggttctccataatag

SEQ ID NO: 28614 - DNA, 25 bp, S. cerevisiae
gcaacgaagcttttcatcctaacga

SEQ ID NO: 28615 - DNA, 25 bp, S. cerevisiae
gcaagctggactattctacggacga

SEQ ID NO: 28616 - DNA, 25 bp, S. cerevisiae
gcaagctggacgttgttcaaaccta

SEQ ID NO: 28617 - DNA, 25 bp, S. cerevisiae
gaattgaacgttcccaaatccaagg

SEQ ID NO: 28618 - DNA, 25 bp, S. cerevisiae
gaattaactgttgacgacctgacaa

SEQ ID NO: 28619 - DNA, 25 bp, S. cerevisiae
gaataacctgaagaaacggccacca

SEQ ID NO: 28620 - DNA, 25 bp, S. cerevisiae
gaaaaactaagtcccctggcctcag

SEQ ID NO: 28621 - DNA, 25 bp, S. cerevisiae
gcaataacaataacgggcctacctc

SEQ ID NO: 28622 - DNA, 25 bp, S. cerevisiae
gcaaggtattactcgcaatgtggtt

SEQ ID NO: 28623 - DNA, 25 bp, S. cerevisiae
gcaacttgctatccttactaagaga

SEQ ID NO: 28624 - DNA, 25 bp, S. cerevisiae
gcaagccttgattgattttgacagc

SEQ ID NO: 28625 - DNA, 25 bp, S. cerevisiae
gcaaccttcaaaattacagcagcag

SEQ ID NO: 28626 - DNA, 25 bp, S. cerevisiae
gcaatcattccatcactgtacaaga

SEQ ID NO: 28627 - DNA, 25 bp, S. cerevisiae
gaataatactccttttccaggttat

SEQ ID NO: 28628 - DNA, 25 bp, S. cerevisiae
gcaatggaacgctttttcctttgtg

SEQ ID NO: 28629 - DNA, 25 bp, S. cerevisiae
gcaaggatccaagaattgaccattt

SEQ ID NO: 28630 - DNA, 25 bp, S. cerevisiae
gcaacttcgcctggagaatttttct

SEQ ID NO: 28631 - DNA, 25 bp, S. cerevisiae
gcaacctccttccaacgttgaattt

SEQ ID NO: 28632 - DNA, 25 bp, S. cerevisiae
gcaacgtctgttggatgaagctcgt

SEQ ID NO: 28633 - DNA, 25 bp, S. cerevisiae
gcaattgcccgtcaacagaccaaga

SEQ ID NO: 28634 - DNA, 25 bp, S. cerevisiae
gaattcaaacctttagtcgacagta

SEQ ID NO: 28635 - DNA, 25 bp, S. cerevisiae
gcaagtgccaagctattgagtggaa

SEQ ID NO: 28636 - DNA, 25 bp, S. cerevisiae
gcaattccaggcctcatcgaataaa

SEQ ID NO: 28637 - DNA, 25 bp, S. cerevisiae
gcaagtgcgattttctcgttttcta

SEQ ID NO: 28638 - DNA, 25 bp, S. cerevisiae
gcaattggcttctttcggttactaa

SEQ ID NO: 28639 - DNA, 25 bp, S. cerevisiae
gcaagcgtgttatttttcgtcacca

SEQ ID NO: 28640 - DNA, 25 bp, S. cerevisiae
gcaacgtgattattttggcgctcat

SEQ ID NO: 28641 - DNA, 25 bp, S. cerevisiae
gcaactcctgatattgttccagctt

SEQ ID NO: 28642 - DNA, 25 bp, S. cerevisiae
gcaatggcctattttggacctgatt

SEQ ID NO: 28643 - DNA, 25 bp, S. cerevisiae
gcaagcctctattatgggtccttca

SEQ ID NO: 28644 - DNA, 25 bp, S. cerevisiae
gcaaggttcctctactagcgtgaag

SEQ ID NO: 28645 - DNA, 25 bp, S. cerevisiae
gcaagattaccatgacgacgagcaa

SEQ ID NO: 28646 - DNA, 25 bp, S. cerevisiae
gcaaggacacaatatcggcgatgat

SEQ ID NO: 28647 - DNA, 25 bp, S. cerevisiae
gcaagaaactgtatcgccagatgag

SEQ ID NO: 28648 - DNA, 25 bp, S. cerevisiae
gcaagtatggctcttctccaatgat

SEQ ID NO: 28649 - DNA, 25 bp, S. cerevisiae
gaattattgctgcttgccatcgaag

SEQ ID NO: 28650 - DNA, 25 bp, S. cerevisiae
gcaactggacacttacattagcaaa

SEQ ID NO: 28651 - DNA, 25 bp, S. cerevisiae
gcaactgttatattcttcgtcatga

SEQ ID NO: 28652 - DNA, 25 bp, S. cerevisiae
gcaattatcctgcagtgaggagtcc

SEQ ID NO: 28653 - DNA, 25 bp, S. cerevisiae
gcaatagatcatgacaatagaccaa

SEQ ID NO: 28654 - DNA, 25 bp, S. cerevisiae
gcaatcgaggtctttgaaggccatg

SEQ ID NO: 28655 - DNA, 25 bp, S. cerevisiae
gaatagcaatgtatcccatcaccta

SEQ ID NO: 28656 - DNA, 25 bp, S. cerevisiae
gaattgcaagcagaccctacaaatg

SEQ ID NO: 28657 - DNA, 25 bp, S. cerevisiae
gaatatccggaccacggtgctgatg

SEQ ID NO: 28658 - DNA, 25 bp, S. cerevisiae
gaattccagtatcgcgtggtggttt

SEQ ID NO: 28659 - DNA, 25 bp, S. cerevisiae
gaatttgcgtttaggaatcgtcggc

SEQ ID NO: 28660 - DNA, 25 bp, S. cerevisiae
gaatttggtgtctggaacctcttca

SEQ ID NO: 28661 - DNA, 25 bp, S. cerevisiae
gaattgtcatgctcctctagttgcg

SEQ ID NO: 28662 - DNA, 25 bp, S. cerevisiae
gaattgtggcttcctgatcatagag

SEQ ID NO: 28663 - DNA, 25 bp, S. cerevisiae
gaattgagcgtttctgacatcacaa

SEQ ID NO: 28664 - DNA, 25 bp, S. cerevisiae
gcaatgctgtgcctggtatgaatcc

SEQ ID NO: 28665 - DNA, 25 bp, S. cerevisiae
gcaagagttgctttaaccgcgggcc

SEQ ID NO: 28666 - DNA, 25 bp, S. cerevisiae
gcaagagtcactttccaagcaggat

SEQ ID NO: 28667 - DNA, 25 bp, S. cerevisiae
gcaagagttacttcgcagatgggat

SEQ ID NO: 28668 - DNA, 25 bp, S. cerevisiae
gcaagtttcactacagcgatgttga

SEQ ID NO: 28669 - DNA, 25 bp, S. cerevisiae
gcaagtatgtaccagaagcacgtga

SEQ ID NO: 28670 - DNA, 25 bp, S. cerevisiae
gcaagtattgacgagacagcctgta

SEQ ID NO: 28671 - DNA, 25 bp, S. cerevisiae
gcaacctatgatgcagcaaccgtat

SEQ ID NO: 28672 - DNA, 25 bp, S. cerevisiae
gcaatcctatgaatacacggcgcaa

SEQ ID NO: 28673 - DNA, 25 bp, S. cerevisiae
gaattcaaactaaccagcgccaaat

SEQ ID NO: 28674 - DNA, 25 bp, S. cerevisiae
gaattaaagctgtatccgggcgcaa

SEQ ID NO: 28675 - DNA, 25 bp, S. cerevisiae
gaattaaatcagttacgtgcccgta

SEQ ID NO: 28676 - DNA, 25 bp, S. cerevisiae
gaatatttacaatacctggccgaaa

SEQ ID NO: 28677 - DNA, 25 bp, S. cerevisiae
gaataatttccatatccgttcgaaa

SEQ ID NO: 28678 - DNA, 25 bp, S. cerevisiae
gaatcaatttcgaagaaccccacta

SEQ ID NO: 28679 - DNA, 25 bp, S. cerevisiae
gcaaggttttgcctctagggattaa

SEQ ID NO: 28680 - DNA, 25 bp, S. cerevisiae
gcaatgtttattgatccgtcgttaa

SEQ ID NO: 28681 - DNA, 25 bp, S. cerevisiae
gcaagatttcttgagcacgcttcat

SEQ ID NO: 28682 - DNA, 25 bp, S. cerevisiae
gcaagctattgcttccaacgtatag

SEQ ID NO: 28683 - DNA, 25 bp, S. cerevisiae
gcaacccgcttattatcagcagaaa

SEQ ID NO: 28684 - DNA, 25 bp, S. cerevisiae
gcaagagctgctggttactcaaaaa

SEQ ID NO: 28685 - DNA, 25 bp, S. cerevisiae
gcaagccttattgcactggaagaag

SEQ ID NO: 28686 - DNA, 25 bp, S. cerevisiae
gcaatcattgatcgtggaggcactt

SEQ ID NO: 28687 - DNA, 25 bp, S. cerevisiae
gcaattatagtcattctggcgcaaa

SEQ ID NO: 28688 - DNA, 25 bp, S. cerevisiae
gcaagagctggtggttctggcccaa

SEQ ID NO: 28689 - DNA, 25 bp, S. cerevisiae
gcaagagttggatctgttgcccaga

SEQ ID NO: 28690 - DNA, 25 bp, S. cerevisiae
gcaagactgtggtacgttttctgaa

SEQ ID NO: 28691 - DNA, 25 bp, S. cerevisiae
gcaagtcatgggtgcctttgagtaa

SEQ ID NO: 28692 - DNA, 25 bp, S. cerevisiae
gcaagtctgtggtatttctctgaat

SEQ ID NO: 28693 - DNA, 25 bp, S. cerevisiae
gcaagtctgtcttttcacttcaaga

SEQ ID NO: 28694 - DNA, 25 bp, S. cerevisiae
gcaagcgcgtttatacttccagaag

SEQ ID NO: 28695 - DNA, 25 bp, S. cerevisiae
gcaattcctcattggacagggtcgt

SEQ ID NO: 28696 - DNA, 25 bp, S. cerevisiae
gcaaggcgatcgtaaagttcaggaa

SEQ ID NO: 28697 - DNA, 25 bp, S. cerevisiae
gcaagctcccgctaaaggtgatgat

SEQ ID NO: 28698 - DNA, 25 bp, S. cerevisiae
gaattcacccattcgaggtattacc

SEQ ID NO: 28699 - DNA, 25 bp, S. cerevisiae
gaataccagaggctgaaattctatt

SEQ ID NO: 28700 - DNA, 25 bp, S. cerevisiae
gaatacgggcgctgtaggttataat

SEQ ID NO: 28701 - DNA, 25 bp, S. cerevisiae
gaattggttctggtgctccagtcta

SEQ ID NO: 28702 - DNA, 25 bp, S. cerevisiae
gcaatatcgtctagagctggcacag

SEQ ID NO: 28703 - DNA, 25 bp, S. cerevisiae
gcaataatgttcaatggcggagctt

SEQ ID NO: 28704 - DNA, 25 bp, S. cerevisiae
gcaatatttccaagagccgagccaa

SEQ ID NO: 28705 - DNA, 25 bp, S. cerevisiae
gcaatgtccatgtatatcgccagaa

SEQ ID NO: 28706 - DNA, 25 bp, S. cerevisiae
gcaagctctcatttagacccaagtc

SEQ ID NO: 28707 - DNA, 25 bp, S. cerevisiae
gcaattacgtaaagccctctcagga

SEQ ID NO: 28708 - DNA, 25 bp, S. cerevisiae
gcaatttttaggatcgatttcaccc

SEQ ID NO: 28709 - DNA, 25 bp, S. cerevisiae
gcaatttgtacaggttattccggca

SEQ ID NO: 28710 - DNA, 25 bp, S. cerevisiae
gaatgttggccgctattacggtcaa

SEQ ID NO: 28711 - DNA, 25 bp, S. cerevisiae
gaatttggaccagattcagcaggtt

SEQ ID NO: 28712 - DNA, 25 bp, S. cerevisiae
gaattgttacaagtttctcaggaat

SEQ ID NO: 28713 - DNA, 25 bp, S. cerevisiae
gcaattgtttacatggtcatcggga

SEQ ID NO: 28714 - DNA, 25 bp, S. cerevisiae
gaattgtgccggatgacttattaat

SEQ ID NO: 28715 - DNA, 25 bp, S. cerevisiae
gaataacgttgcaaggcccgacctt

SEQ ID NO: 28716 - DNA, 25 bp, S. cerevisiae
gacttttgatagacctaccgaccgt

SEQ ID NO: 28717 - DNA, 25 bp, S. cerevisiae
gcaagtcctgtcattgtttccaaaa

SEQ ID NO: 28718 - DNA, 25 bp, S. cerevisiae
gcaagtcgtcccctatttagaggaa

SEQ ID NO: 28719 - DNA, 25 bp, S. cerevisiae
gaattcgtccacctttagagaccat

SEQ ID NO: 28720 - DNA, 25 bp, S. cerevisiae
gaattgccttaccatttattgtttt

SEQ ID NO: 28721 - DNA, 25 bp, S. cerevisiae
gaattggttcgtcaaactatttcaa

SEQ ID NO: 28722 - DNA, 25 bp, S. cerevisiae
gaattcgtccgtcacaacgatcaac

SEQ ID NO: 28723 - DNA, 25 bp, S. cerevisiae
gaattgtgtgactactccgactaca

SEQ ID NO: 28724 - DNA, 25 bp, S. cerevisiae
gaatcagttaggctccacttacaag

SEQ ID NO: 28725 - DNA, 25 bp, S. cerevisiae
gaattggtgattccttagcatctat

SEQ ID NO: 28726 - DNA, 25 bp, S. cerevisiae
gaattgttattccttcccttctaca

SEQ ID NO: 28727 - DNA, 25 bp, S. cerevisiae
gaataaacaacagatccgcctaaaa

SEQ ID NO: 28728 - DNA, 25 bp, S. cerevisiae
gaagaactagtctctcccagtaaat

SEQ ID NO: 28729 - DNA, 25 bp, S. cerevisiae
gaataacgagaaaacccagtaccat

SEQ ID NO: 28730 - DNA, 25 bp, S. cerevisiae
gaataacggtacgatccctgtttgt

SEQ ID NO: 28731 - DNA, 25 bp, S. cerevisiae
gcaatcattcccatcgttttgtttt

SEQ ID NO: 28732 - DNA, 25 bp, S. cerevisiae
gcaattcttccccacttttatattt

SEQ ID NO: 28733 - DNA, 25 bp, S. cerevisiae
gaattggtcaacactctgagcgata

SEQ ID NO: 28734 - DNA, 25 bp, S. cerevisiae
gaattggctcaagaactaacgatgt

SEQ ID NO: 28735 - DNA, 25 bp, S. cerevisiae
gaattgtccaatcatttaacggtgc

SEQ ID NO: 28736 - DNA, 25 bp, S. cerevisiae
gaattcactgaacatacttctgcta

SEQ ID NO: 28737 - DNA, 25 bp, S. cerevisiae
gaattcgtatctcattcaccagtga

SEQ ID NO: 28738 - DNA, 25 bp, S. cerevisiae
gcaataggctacatgtttccagcaa

SEQ ID NO: 28739 - DNA, 25 bp, S. cerevisiae
gcaagacaactcaagtcattccaga

SEQ ID NO: 28740 - DNA, 25 bp, S. cerevisiae
gcaagtatatctcttattcctgaat

SEQ ID NO: 28741 - DNA, 25 bp, S. cerevisiae
gcaattgatcgtctttaccatgaat

SEQ ID NO: 28742 - DNA, 25 bp, S. cerevisiae
gcaagtgcgcctgtttggatgagat

SEQ ID NO: 28743 - DNA, 25 bp, S. cerevisiae
gaagtgaagtttctgcggctttaag

SEQ ID NO: 28744 - DNA, 25 bp, S. cerevisiae
gaaagtcagtttctcccattaaaga

SEQ ID NO: 28745 - DNA, 25 bp, S. cerevisiae
gaatttatggtgaataccctcccac

SEQ ID NO: 28746 - DNA, 25 bp, S. cerevisiae
gaattcgtgcagaaaagcccgaccc

SEQ ID NO: 28747 - DNA, 25 bp, S. cerevisiae
gaattgcgctagaaagagccaaaca

SEQ ID NO: 28748 - DNA, 25 bp, S. cerevisiae
gaattccatcggatgcaacacaaga

SEQ ID NO: 28749 - DNA, 25 bp, S. cerevisiae
gcaatactcatccaattcaagcacc

SEQ ID NO: 28750 - DNA, 25 bp, S. cerevisiae
gcaatggctttactgatcggcacat

SEQ ID NO: 28751 - DNA, 25 bp, S. cerevisiae
gcaatgtcaatttcgactgcattca

SEQ ID NO: 28752 - DNA, 25 bp, S. cerevisiae
gaatgatggccagacctttgaccat

SEQ ID NO: 28753 - DNA, 25 bp, S. cerevisiae
gaattggccaattcctattgttgtt

SEQ ID NO: 28754 - DNA, 25 bp, S. cerevisiae
gaatgggcccaagttacgtcagtgc

SEQ ID NO: 28755 - DNA, 25 bp, S. cerevisiae
gaattttccagccaaacttgtacaa

SEQ ID NO: 28756 - DNA, 25 bp, S. cerevisiae
gaattttatcgagacccctagaagg

SEQ ID NO: 28757 - DNA, 25 bp, S. cerevisiae
gaataatctccaccgtcgtgttttg

SEQ ID NO: 28758 - DNA, 25 bp, S. cerevisiae
gaatcttacctcagagtgctcttgg

SEQ ID NO: 28759 - DNA, 25 bp, S. cerevisiae
gaattctacttttgtcttggaccct

SEQ ID NO: 28760 - DNA, 25 bp, S. cerevisiae
gaatttacggtctttgcttggcctc

SEQ ID NO: 28761 - DNA, 25 bp, S. cerevisiae
gaattatcccgtaagttcttgccca

SEQ ID NO: 28762 - DNA, 25 bp, S. cerevisiae
gaatgtaccgtcatgggtgtcccat

SEQ ID NO: 28763 - DNA, 25 bp, S. cerevisiae
gaattcaaagtcaaggtgtcggcct

SEQ ID NO: 28764 - DNA, 25 bp, S. cerevisiae
gaattcaaaccgtgtgatccccggt

SEQ ID NO: 28765 - DNA, 25 bp, S. cerevisiae
gaattcaaatcctttgggtctacag

SEQ ID NO: 28766 - DNA, 25 bp, S. cerevisiae
gaattgccaacgtttgggtgctccc

SEQ ID NO: 28767 - DNA, 25 bp, S. cerevisiae
gcaattgccaattcactatgtcggt

SEQ ID NO: 28768 - DNA, 25 bp, S. cerevisiae
gcaatggctgataggtgtctgtaca

SEQ ID NO: 28769 - DNA, 25 bp, S. cerevisiae
gcaaggatactgttgatctctacaa

SEQ ID NO: 28770 - DNA, 25 bp, S. cerevisiae
gaattgatacagttcatatggaata

SEQ ID NO: 28771 - DNA, 25 bp, S. cerevisiae
gaatattagcagtccattaggcaag

SEQ ID NO: 28772 - DNA, 25 bp, S. cerevisiae
gcaatgttccatgatttgcccacga

SEQ ID NO: 28773 - DNA, 25 bp, S. cerevisiae
gcaatttcattcgtagtcccactga

SEQ ID NO: 28774 - DNA, 25 bp, S. cerevisiae
gaatctggtcggaattatgctgcac

SEQ ID NO: 28775 - DNA, 25 bp, S. cerevisiae
gaattgttccatgaggtcaccttcc

SEQ ID NO: 28776 - DNA, 25 bp, S. cerevisiae
gaatctttggatgatgtgcaagcct

SEQ ID NO: 28777 - DNA, 25 bp, S. cerevisiae
gaatttgtggaggtcaccagcctac

SEQ ID NO: 28778 - DNA, 25 bp, S. cerevisiae
gaattctttcggtgtctacgtctag

SEQ ID NO: 28779 - DNA, 25 bp, S. cerevisiae
gaatcttatacggtggttccgctaa

SEQ ID NO: 28780 - DNA, 25 bp, S. cerevisiae
gaatttcacctttagtgttccgcta

SEQ ID NO: 28781 - DNA, 25 bp, S. cerevisiae
gaattaggtgtttatgtttccgata

SEQ ID NO: 28782 - DNA, 25 bp, S. cerevisiae
gaattcgtggattacatttttcctg

SEQ ID NO: 28783 - DNA, 25 bp, S. cerevisiae
gaattcactggattccttcctaccg

SEQ ID NO: 28784 - DNA, 25 bp, S. cerevisiae
gaattcaaaagtactgtcccaccac

SEQ ID NO: 28785 - DNA, 25 bp, S. cerevisiae
gaattactattggatcttgccgacg

SEQ ID NO: 28786 - DNA, 25 bp, S. cerevisiae
gaattgacaattactctgaggaacc

SEQ ID NO: 28787 - DNA, 25 bp, S. cerevisiae
gatattccggacacagctagcgacg

SEQ ID NO: 28788 - DNA, 25 bp, S. cerevisiae
gaatatccttacacatctacgacca

SEQ ID NO: 28789 - DNA, 25 bp, S. cerevisiae
gcaattccctttcctatactgtaat

SEQ ID NO: 28790 - DNA, 25 bp, S. cerevisiae
gaattgcagcttcgaaatgtagaca

SEQ ID NO: 28791 - DNA, 25 bp, S. cerevisiae
gaattgtgccactgacggacgctga

SEQ ID NO: 28792 - DNA, 25 bp, S. cerevisiae
gcaattggccattagaggtgacgat

SEQ ID NO: 28793 - DNA, 25 bp, S. cerevisiae
gcaattatcaatttcagggcaccat

SEQ ID NO: 28794 - DNA, 25 bp, S. cerevisiae
gaattacctattcagtgagtcacta

SEQ ID NO: 28795 - DNA, 25 bp, S. cerevisiae
gaattactctaatacggatcctgaa

SEQ ID NO: 28796 - DNA, 25 bp, S. cerevisiae
gaattacgccataaacgagactcag

SEQ ID NO: 28797 - DNA, 25 bp, S. cerevisiae
gaattccgcgaatgatacagactca

SEQ ID NO: 28798 - DNA, 25 bp, S. cerevisiae
gcaattacaggcagttggtaccgat

SEQ ID NO: 28799 - DNA, 25 bp, S. cerevisiae
gcaatgagaataatccttcccaagt

SEQ ID NO: 28800 - DNA, 25 bp, S. cerevisiae
gaatagcttaccgttcaaaagtgct

SEQ ID NO: 28801 - DNA, 25 bp, S. cerevisiae
gtacccttgccggaaacaatggtca

SEQ ID NO: 28802 - DNA, 25 bp, S. cerevisiae
gtaccgcaaccagaaaaatccctat

SEQ ID NO: 28803 - DNA, 25 bp, S. cerevisiae
gattccgaccttgtgaaaaactctt

SEQ ID NO: 28804 - DNA, 25 bp, S. cerevisiae
gagcaccgttttcttaaagcgtttg

SEQ ID NO: 28805 - DNA, 25 bp, S. cerevisiae
gaaagagttattcttaacgccgttg

SEQ ID NO: 28806 - DNA, 25 bp, S. cerevisiae
gaatgggttcatcttggacggtttc

SEQ ID NO: 28807 - DNA, 25 bp, S. cerevisiae
gaattgatctctggtggtctagctg

SEQ ID NO: 28808 - DNA, 25 bp, S. cerevisiae
gaattgtctttcaagtctcctaccg

SEQ ID NO: 28809 - DNA, 25 bp, S. cerevisiae
gaattttgagctacagtctgccaat

SEQ ID NO: 28810 - DNA, 25 bp, S. cerevisiae
gaattctgtatttactccctttgtg

SEQ ID NO: 28811 - DNA, 25 bp, S. cerevisiae
gaattcaagctgatcagacccctga

SEQ ID NO: 28812 - DNA, 25 bp, S. cerevisiae
gaattgggagttaccacagcgccta

SEQ ID NO: 28813 - DNA, 25 bp, S. cerevisiae
gaatacgaactttgcccgaactaca

SEQ ID NO: 28814 - DNA, 25 bp, S. cerevisiae
gaataccaagcactacaacgacact

SEQ ID NO: 28815 - DNA, 25 bp, S. cerevisiae
gaattcttgggccacaacgaagctg

SEQ ID NO: 28816 - DNA, 25 bp, S. cerevisiae
gaattcgtgatcagacagtctagcc

SEQ ID NO: 28817 - DNA, 25 bp, S. cerevisiae
gaattggtataccatggcccacctt

SEQ ID NO: 28818 - DNA, 25 bp, S. cerevisiae
gcaatgttttgctctcgtgcggaga

SEQ ID NO: 28819 - DNA, 25 bp, S. cerevisiae
gcaatcattctttttcggcgacaat

SEQ ID NO: 28820 - DNA, 25 bp, S. cerevisiae
gcaattaccaacaccactggtcgat

SEQ ID NO: 28821 - DNA, 25 bp, S. cerevisiae
gaattcccaaagaccactgttgctg

SEQ ID NO: 28822 - DNA, 25 bp, S. cerevisiae
gaattgaagacctatttttgctcga

SEQ ID NO: 28823 - DNA, 25 bp, S. cerevisiae
gaatttcaggcgtcactattttcta

SEQ ID NO: 28824 - DNA, 25 bp, S. cerevisiae
gaattagcaggtccatttgtctcac

SEQ ID NO: 28825 - DNA, 25 bp, S. cerevisiae
gaattatggcgttacattcccaatt

SEQ ID NO: 28826 - DNA, 25 bp, S. cerevisiae
gaattagggttcttgtcctctagct

SEQ ID NO: 28827 - DNA, 25 bp, S. cerevisiae
gaattggttgttttcctaccagctt

SEQ ID NO: 28828 - DNA, 25 bp, S. cerevisiae
gaattgcggctcctaaataaccagt

SEQ ID NO: 28829 - DNA, 25 bp, S. cerevisiae
gaattcatcgccctatacaaaagag

SEQ ID NO: 28830 - DNA, 25 bp, S. cerevisiae
gcaatttcgtccaaacatgccaaaa

SEQ ID NO: 28831 - DNA, 25 bp, S. cerevisiae
gagtacccgcccaagaccaagaaag

SEQ ID NO: 28832 - DNA, 25 bp, S. cerevisiae
gagtacgttccctacatcgaaaagt

SEQ ID NO: 28833 - DNA, 25 bp, S. cerevisiae
gaattgttccaatctttaccaagag

SEQ ID NO: 28834 - DNA, 25 bp, S. cerevisiae
gcaatatttgcttttacttctcttg

SEQ ID NO: 28835 - DNA, 25 bp, S. cerevisiae
gcaatttgtgcaggttatctttcag

SEQ ID NO: 28836 - DNA, 25 bp, S. cerevisiae
gcaattggtgcatctttcttgttca

SEQ ID NO: 28837 - DNA, 25 bp, S. cerevisiae
gcaatcaattgcattccatccttta

SEQ ID NO: 28838 - DNA, 25 bp, S. cerevisiae
gcaatatattatggataccctgtta

SEQ ID NO: 28839 - DNA, 25 bp, S. cerevisiae
gaattcgcatctttacactctttta

SEQ ID NO: 28840 - DNA, 25 bp, S. cerevisiae
gcaattctctggactatgagctctt

SEQ ID NO: 28841 - DNA, 25 bp, S. cerevisiae
gcaatattgatccttctcagtttga

SEQ ID NO: 28842 - DNA, 25 bp, S. cerevisiae
gaattggctaagcatgctgtctctg

SEQ ID NO: 28843 - DNA, 25 bp, S. cerevisiae
gaattcctttgatcggtccttctat

SEQ ID NO: 28844 - DNA, 25 bp, S. cerevisiae
gaatttcgagacacgacgccctaca

SEQ ID NO: 28845 - DNA, 25 bp, S. cerevisiae
gaatctaagggcactaccaccaaag

SEQ ID NO: 28846 - DNA, 25 bp, S. cerevisiae
gaattaagtggcattccgcctgctc

SEQ ID NO: 28847 - DNA, 25 bp, S. cerevisiae
gaattccaaggtttctctactgata

SEQ ID NO: 28848 - DNA, 25 bp, S. cerevisiae
gaattacttgttatcttagcgctaa

SEQ ID NO: 28849 - DNA, 25 bp, S. cerevisiae
gaattaatcttgtttctcctccgga

SEQ ID NO: 28850 - DNA, 25 bp, S. cerevisiae
gaattttcgctggtttcctaagata

SEQ ID NO: 28851 - DNA, 25 bp, S. cerevisiae
gaatattacctcgttacctggcaat

SEQ ID NO: 28852 - DNA, 25 bp, S. cerevisiae
gaattcagtctgctttaaacggctt

SEQ ID NO: 28853 - DNA, 25 bp, S. cerevisiae
gaattggtcccattatctagtcggt

SEQ ID NO: 28854 - DNA, 25 bp, S. cerevisiae
gaattcgaacccaatagacctgttt

SEQ ID NO: 28855 - DNA, 25 bp, S. cerevisiae
gaatctttacgccaataccacgata

SEQ ID NO: 28856 - DNA, 25 bp, S. cerevisiae
gaattcttatctcagaatcccggat

SEQ ID NO: 28857 - DNA, 25 bp, S. cerevisiae
gaattgttatcacacttctcgtggg

SEQ ID NO: 28858 - DNA, 25 bp, S. cerevisiae
gaattgttatcagtgcctatacgta

SEQ ID NO: 28859 - DNA, 25 bp, S. cerevisiae
gaattgattcactttctgaactgaa

SEQ ID NO: 28860 - DNA, 25 bp, S. cerevisiae
gaattgtctcaatctctataccaga

SEQ ID NO: 28861 - DNA, 25 bp, S. cerevisiae
gcaatttccagatatcaactccgca

SEQ ID NO: 28862 - DNA, 25 bp, S. cerevisiae
gaattccatgcgcaaactgctgtag

SEQ ID NO: 28863 - DNA, 25 bp, S. cerevisiae
gaatctcatactgggatctcttgtc

SEQ ID NO: 28864 - DNA, 25 bp, S. cerevisiae
gaattcacatttcgacgctttaagg

SEQ ID NO: 28865 - DNA, 25 bp, S. cerevisiae
gaattgttatctatgcactgcgtga

SEQ ID NO: 28866 - DNA, 25 bp, S. cerevisiae
gcaatttcctagaagagcgcctgat

SEQ ID NO: 28867 - DNA, 25 bp, S. cerevisiae
gcaattctggtagcaatgacacgtt

SEQ ID NO: 28868 - DNA, 25 bp, S. cerevisiae
gaatttctccataagcatgttagat

SEQ ID NO: 28869 - DNA, 25 bp, S. cerevisiae
gaattctctactaacgtaaaggacg

SEQ ID NO: 28870 - DNA, 25 bp, S. cerevisiae
gaatcctctacttccagtgaaaaac

SEQ ID NO: 28871 - DNA, 25 bp, S. cerevisiae
gaattcttaccccaccaaatatgaa

SEQ ID NO: 28872 - DNA, 25 bp, S. cerevisiae
gaattcttccacagaataacgagaa

SEQ ID NO: 28873 - DNA, 25 bp, S. cerevisiae
gaattttacaattaccaacggatgt

SEQ ID NO: 28874 - DNA, 25 bp, S. cerevisiae
gaatttttcggtactgacgccgact

SEQ ID NO: 28875 - DNA, 25 bp, S. cerevisiae
gaatttcttccggacgtgtacgagt

SEQ ID NO: 28876 - DNA, 25 bp, S. cerevisiae
gaatttcttttgagcgctatgacga

SEQ ID NO: 28877 - DNA, 25 bp, S. cerevisiae
gaatttttattctgcagttccgaag

SEQ ID NO: 28878 - DNA, 25 bp, S. cerevisiae
gaatttttggctctgatgtctcgtc

SEQ ID NO: 28879 - DNA, 25 bp, S. cerevisiae
gaattatttgttctggctggccttt

SEQ ID NO: 28880 - DNA, 25 bp, S. cerevisiae
gaattttgtttactcgggctgttca

SEQ ID NO: 28881 - DNA, 25 bp, S. cerevisiae
gaattgtcagttaacctgtgcgctt

SEQ ID NO: 28882 - DNA, 25 bp, S. cerevisiae
gcaattatcccgcagtgaggtgctc

SEQ ID NO: 28883 - DNA, 25 bp, S. cerevisiae
gaatttccccaggtgatggtgccac

SEQ ID NO: 28884 - DNA, 25 bp, S. cerevisiae
gaatttctggaatggtggctgcccc

SEQ ID NO: 28885 - DNA, 25 bp, S. cerevisiae
gcaattctttatttcctgcaaccaa

SEQ ID NO: 28886 - DNA, 25 bp, S. cerevisiae
gaattccattaacgaagcctgtgtt

SEQ ID NO: 28887 - DNA, 25 bp, S. cerevisiae
gaatatacagagaagcacggccttg

SEQ ID NO: 28888 - DNA, 25 bp, S. cerevisiae
gaattcacagattggccagatacta

SEQ ID NO: 28889 - DNA, 25 bp, S. cerevisiae
gcaattgcagcactacttcgaagta

SEQ ID NO: 28890 - DNA, 25 bp, S. cerevisiae
gaaggagcactaattccaaccggta

SEQ ID NO: 28891 - DNA, 25 bp, S. cerevisiae
gaagctactttgcacaagattcggg

SEQ ID NO: 28892 - DNA, 25 bp, S. cerevisiae
gaattactgcttcaaatgcatgtct

SEQ ID NO: 28893 - DNA, 25 bp, S. cerevisiae
gcaattcacattacgtatcgcattt

SEQ ID NO: 28894 - DNA, 25 bp, S. cerevisiae
gaattccatttcttacgtagcaaag

SEQ ID NO: 28895 - DNA, 25 bp, S. cerevisiae
gaattcctgtagtatttagtgccga

SEQ ID NO: 28896 - DNA, 25 bp, S. cerevisiae
gaattccatcgacattggtagccga

SEQ ID NO: 28897 - DNA, 25 bp, S. cerevisiae
gcaattcaacagctttgttcactct

SEQ ID NO: 28898 - DNA, 25 bp, S. cerevisiae
gaatttgacagttttatggactcta

SEQ ID NO: 28899 - DNA, 25 bp, S. cerevisiae
gagttccctgttttactgggtgaca

SEQ ID NO: 28900 - DNA, 25 bp, S. cerevisiae
gaattgaacgctgcaactggctcta

SEQ ID NO: 28901 - DNA, 25 bp, S. cerevisiae
gaatatcctccattggccatggttt

SEQ ID NO: 28902 - DNA, 25 bp, S. cerevisiae
gaattcctcgctgatatcatgttgt

SEQ ID NO: 28903 - DNA, 25 bp, S. cerevisiae
gaattcctcatcacagatacttggc

SEQ ID NO: 28904 - DNA, 25 bp, S. cerevisiae
gaatcaacacatatgaagccttggt

SEQ ID NO: 28905 - DNA, 25 bp, S. cerevisiae
gaatcaacatttggaggccctcttt

SEQ ID NO: 28906 - DNA, 25 bp, S. cerevisiae
gaattctctgttgagcagacccact

SEQ ID NO: 28907 - DNA, 25 bp, S. cerevisiae
gaattgttcactgcaagaccaccat

SEQ ID NO: 28908 - DNA, 25 bp, S. cerevisiae
gaatatggaactcgcactgacccaa

SEQ ID NO: 28909 - DNA, 25 bp, S. cerevisiae
gaattggaattgtccgaagcgaatt

SEQ ID NO: 28910 - DNA, 25 bp, S. cerevisiae
gaattctgtgctgttcgtgaacttc

SEQ ID NO: 28911 - DNA, 25 bp, S. cerevisiae
gaattgctccccttcggaatttaga

SEQ ID NO: 28912 - DNA, 25 bp, S. cerevisiae
gaatttcccacatgaggacgttgaa

SEQ ID NO: 28913 - DNA, 25 bp, S. cerevisiae
gaattttctcactttggaatgcttg

SEQ ID NO: 28914 - DNA, 25 bp, S. cerevisiae
gaatatttcacctaatggacgctct

SEQ ID NO: 28915 - DNA, 25 bp, S. cerevisiae
gaattttcatcctaggtgcacgtgc

SEQ ID NO: 28916 - DNA, 25 bp, S. cerevisiae
gaattggccgatctcgcagaggaaa

SEQ ID NO: 28917 - DNA, 25 bp, S. cerevisiae
gaattttccttgaccactttgacga

SEQ ID NO: 28918 - DNA, 25 bp, S. cerevisiae
gaattttccttagacgatttctcat

SEQ ID NO: 28919 - DNA, 25 bp, S. cerevisiae
gaattgtatgccaagatttctgcaa

SEQ ID NO: 28920 - DNA, 25 bp, S. cerevisiae
gaattgtatggtccttccaagacaa

SEQ ID NO: 28921 - DNA, 25 bp, S. cerevisiae
gaatttgaggctaactggacatcca

SEQ ID NO: 28922 - DNA, 25 bp, S. cerevisiae
gaatttatcacacccagtgcatatg

SEQ ID NO: 28923 - DNA, 25 bp, S. cerevisiae
gaattactgttgattatgccttcaa

SEQ ID NO: 28924 - DNA, 25 bp, S. cerevisiae
gaattagcgataatcctaccttcaa

SEQ ID NO: 28925 - DNA, 25 bp, S. cerevisiae
gaatacaccacgtctggatgcagta

SEQ ID NO: 28926 - DNA, 25 bp, S. cerevisiae
gaattgatatcgcttctccgtgcaa

SEQ ID NO: 28927 - DNA, 25 bp, S. cerevisiae
gaattgacagtgcactctccagata

SEQ ID NO: 28928 - DNA, 25 bp, S. cerevisiae
gaattgtcaaggactctccagttga

SEQ ID NO: 28929 - DNA, 25 bp, S. cerevisiae
gaattccagagcgttatcgggacta

SEQ ID NO: 28930 - DNA, 25 bp, S. cerevisiae
gaataccggtgtgcttgcgtggcta

SEQ ID NO: 28931 - DNA, 25 bp, S. cerevisiae
gaataatcgcgtgtgctgtcttggc

SEQ ID NO: 28932 - DNA, 25 bp, S. cerevisiae
gaattttgcttcttgcttcttttca

SEQ ID NO: 28933 - DNA, 25 bp, S. cerevisiae
gaattgggtacggtattcatctata

SEQ ID NO: 28934 - DNA, 25 bp, S. cerevisiae
gaatttcaattcaacgcctatgcct

SEQ ID NO: 28935 - DNA, 25 bp, S. cerevisiae
gaattacaatgtcatcggcttgccc

SEQ ID NO: 28936 - DNA, 25 bp, S. cerevisiae
gcaattgaaagtttcgttaccacca

SEQ ID NO: 28937 - DNA, 25 bp, S. cerevisiae
gaattgaaagctttgccattatcca

SEQ ID NO: 28938 - DNA, 25 bp, S. cerevisiae
gaattgtgtagaattgcagattccc

SEQ ID NO: 28939 - DNA, 25 bp, S. cerevisiae
gaattgtgtggtatcgttgctatct

SEQ ID NO: 28940 - DNA, 25 bp, S. cerevisiae
gaattttcaagtacagcctgcggat

SEQ ID NO: 28941 - DNA, 25 bp, S. cerevisiae
gaatttgccactttccatgttggaa

SEQ ID NO: 28942 - DNA, 25 bp, S. cerevisiae
gaattattattatctcgccccatct

SEQ ID NO: 28943 - DNA, 25 bp, S. cerevisiae
gaatttaacggcaacgccgccagtg

SEQ ID NO: 28944 - DNA, 25 bp, S. cerevisiae
gaacagtagctgcttaccggtggaa

SEQ ID NO: 28945 - DNA, 25 bp, S. cerevisiae
gaatttcacttttattccgccgaag

SEQ ID NO: 28946 - DNA, 25 bp, S. cerevisiae
gaattacttgcccttatctattttg

SEQ ID NO: 28947 - DNA, 25 bp, S. cerevisiae
gaattttggtcttacgttgctgaaa

SEQ ID NO: 28948 - DNA, 25 bp, S. cerevisiae
gaattctcttcatagagctcgtcga

SEQ ID NO: 28949 - DNA, 25 bp, S. cerevisiae
gaatatcctgttgcagatgcggtaa

SEQ ID NO: 28950 - DNA, 25 bp, S. cerevisiae
gaatatgccatatcacattgcgaag

SEQ ID NO: 28951 - DNA, 25 bp, S. cerevisiae
gaattggtcgtcaaatctgcaagag

SEQ ID NO: 28952 - DNA, 25 bp, S. cerevisiae
gaattcgactctgcaattgctcaag

SEQ ID NO: 28953 - DNA, 25 bp, S. cerevisiae
gaatttgcatcatccacattacata

SEQ ID NO: 28954 - DNA, 25 bp, S. cerevisiae
gaatcactggaactagactacgacc

SEQ ID NO: 28955 - DNA, 25 bp, S. cerevisiae
gaatttggtacctacctagtcacca

SEQ ID NO: 28956 - DNA, 25 bp, S. cerevisiae
gaatttgcagtggtaacgctagagc

SEQ ID NO: 28957 - DNA, 25 bp, S. cerevisiae
gaatttgcagatcagaccgctaatg

SEQ ID NO: 28958 - DNA, 25 bp, S. cerevisiae
gagccttgcagagaacgagccaacc

SEQ ID NO: 28959 - DNA, 25 bp, S. cerevisiae
gaagattgtaaacctccgagtactg

SEQ ID NO: 28960 - DNA, 25 bp, S. cerevisiae
gaatctttaaatgagctcggctatc

SEQ ID NO: 28961 - DNA, 25 bp, S. cerevisiae
gaagatccctttgtaggtcgaacaa

SEQ ID NO: 28962 - DNA, 25 bp, S. cerevisiae
gaattatcacgcttgacaaacggta

SEQ ID NO: 28963 - DNA, 25 bp, S. cerevisiae
gaatacagaccaacaaaaagtgagc

SEQ ID NO: 28964 - DNA, 25 bp, S. cerevisiae
gaattaccccactacttcgtatatt

SEQ ID NO: 28965 - DNA, 25 bp, S. cerevisiae
gaattcgccactagatatttgcctg

SEQ ID NO: 28966 - DNA, 25 bp, S. cerevisiae
gaattctcgcaaggtcatttgcctg

SEQ ID NO: 28967 - DNA, 25 bp, S. cerevisiae
gaattcctcgagatctattgctgct

SEQ ID NO: 28968 - DNA, 25 bp, S. cerevisiae
gaatctttccctaactttgacgaca

SEQ ID NO: 28969 - DNA, 25 bp, S. cerevisiae
gaattgttgcccatcttttacgaaa

SEQ ID NO: 28970 - DNA, 25 bp, S. cerevisiae
gaattcctgcccactttgaacaaag

SEQ ID NO: 28971 - DNA, 25 bp, S. cerevisiae
gaattgccctctatccaagacaaaa

SEQ ID NO: 28972 - DNA, 25 bp, S. cerevisiae
gaattcagctctgacccaacagtaa

SEQ ID NO: 28973 - DNA, 25 bp, S. cerevisiae
gaattgactctttcacgctacttga

SEQ ID NO: 28974 - DNA, 25 bp, S. cerevisiae
gaatatcccatttgcagcgttcaat

SEQ ID NO: 28975 - DNA, 25 bp, S. cerevisiae
gaatattccaatagcagccccaagt

SEQ ID NO: 28976 - DNA, 25 bp, S. cerevisiae
gaatttcaatttcgcacgccagttg

SEQ ID NO: 28977 - DNA, 25 bp, S. cerevisiae
gaattattatttcacgcatcccgat

SEQ ID NO: 28978 - DNA, 25 bp, S. cerevisiae
gaatttgagtttgaaccccgctata

SEQ ID NO: 28979 - DNA, 25 bp, S. cerevisiae
gaattctggttgatagacttcctct

SEQ ID NO: 28980 - DNA, 25 bp, S. cerevisiae
gaatttcttccaatggactgtctta

SEQ ID NO: 28981 - DNA, 25 bp, S. cerevisiae
gaatattttgaactcgaccttctaa

SEQ ID NO: 28982 - DNA, 25 bp, S. cerevisiae
gaatattttgagctctaccattcaa

SEQ ID NO: 28983 - DNA, 25 bp, S. cerevisiae
gaatttgaagatttccccattgaca

SEQ ID NO: 28984 - DNA, 25 bp, S. cerevisiae
gaatattgtagaactcccttggact

SEQ ID NO: 28985 - DNA, 25 bp, S. cerevisiae
gaattttaccaatcgtctggacggt

SEQ ID NO: 28986 - DNA, 25 bp, S. cerevisiae
gaattttgtccagtactgttaacga

SEQ ID NO: 28987 - DNA, 25 bp, S. cerevisiae
gaatatttggcctttgtaacaacga

SEQ ID NO: 28988 - DNA, 25 bp, S. cerevisiae
gaatttatgtcctcttacaatgctc

SEQ ID NO: 28989 - DNA, 25 bp, S. cerevisiae
gaattattggtctccttaactgcaa

SEQ ID NO: 28990 - DNA, 25 bp, S. cerevisiae
gaatttcgagtgactatactttcca

SEQ ID NO: 28991 - DNA, 25 bp, S. cerevisiae
gaattgatcggtaccagagctgcta

SEQ ID NO: 28992 - DNA, 25 bp, S. cerevisiae
gaattgatccttacgctgcaagaga

SEQ ID NO: 28993 - DNA, 25 bp, S. cerevisiae
gaattcatttgcaagccagatccaa

SEQ ID NO: 28994 - DNA, 25 bp, S. cerevisiae
gaatttattccgactttcaccaagg

SEQ ID NO: 28995 - DNA, 25 bp, S. cerevisiae
gaattaccttcgctgttcagcaacg

SEQ ID NO: 28996 - DNA, 25 bp, S. cerevisiae
gaattcctgcttacagtactcggct

SEQ ID NO: 28997 - DNA, 25 bp, S. cerevisiae
gaattctttgaacacaggccacatg

SEQ ID NO: 28998 - DNA, 25 bp, S. cerevisiae
gaatcttttgaacaagcgcttcgga

SEQ ID NO: 28999 - DNA, 25 bp, S. cerevisiae
gaatttacctatccgttgcaatgtt

SEQ ID NO: 29000 - DNA, 25 bp, S. cerevisiae
gaacgacgggattacaaagctgaaa

SEQ ID NO: 29001 - DNA, 25 bp, S. cerevisiae
gaataccgatactttccatacgcac

SEQ ID NO: 29002 - DNA, 25 bp, S. cerevisiae
gaatttcaatccttttcaagcacag

SEQ ID NO: 29003 - DNA, 25 bp, S. cerevisiae
gaatatgagccacttttgccaagga

SEQ ID NO: 29004 - DNA, 25 bp, S. cerevisiae
gaatacaccaagattgtcaaggctg

SEQ ID NO: 29005 - DNA, 25 bp, S. cerevisiae
gaattgcccgaaaatgcttcaggtg

SEQ ID NO: 29006 - DNA, 25 bp, S. cerevisiae
gaattacctgaaagtgcctctgact

SEQ ID NO: 29007 - DNA, 25 bp, S. cerevisiae
gaattcagcctccattgtacaagac

SEQ ID NO: 29008 - DNA, 25 bp, S. cerevisiae
gaattccgtccattcatcagaagat

SEQ ID NO: 29009 - DNA, 25 bp, S. cerevisiae
gaatttcggttcctcgtcgaataag

SEQ ID NO: 29010 - DNA, 25 bp, S. cerevisiae
gaatctttggttgcggaggctcaat

SEQ ID NO: 29011 - DNA, 25 bp, S. cerevisiae
gaattctaatgtacgcgagagcgct

SEQ ID NO: 29012 - DNA, 25 bp, S. cerevisiae
gaacctagcaaggacgtcacctgga

SEQ ID NO: 29013 - DNA, 25 bp, S. cerevisiae
gaatcctcagctcaacctaaggtga

SEQ ID NO: 29014 - DNA, 25 bp, S. cerevisiae
gaataccgttacagcttcaggcata

SEQ ID NO: 29015 - DNA, 25 bp, S. cerevisiae
gaattatcccttgctagtgtgctgt

SEQ ID NO: 29016 - DNA, 25 bp, S. cerevisiae
gaatttgctctcgtaccttggagtc

SEQ ID NO: 29017 - DNA, 25 bp, S. cerevisiae
gaatattccaacactcaatagagct

SEQ ID NO: 29018 - DNA, 25 bp, S. cerevisiae
gaattctacaacactggtaagccaa

SEQ ID NO: 29019 - DNA, 25 bp, S. cerevisiae
gaatttacttgtccggtacccacag

SEQ ID NO: 29020 - DNA, 25 bp, S. cerevisiae
gaatactatgactccgaacttgata

SEQ ID NO: 29021 - DNA, 25 bp, S. cerevisiae
gaatacttaatccttctacattgag

SEQ ID NO: 29022 - DNA, 25 bp, S. cerevisiae
gaattttgaaccgtcgacagtcgag

SEQ ID NO: 29023 - DNA, 25 bp, S. cerevisiae
gaacttgaagcatgaggtctatggt

SEQ ID NO: 29024 - DNA, 25 bp, S. cerevisiae
gaagaaaggctcaaggttccaattt

SEQ ID NO: 29025 - DNA, 25 bp, S. cerevisiae
gaatagcaacggaagtttcaaatct

SEQ ID NO: 29026 - DNA, 25 bp, S. cerevisiae
gaatcgaaaggtcttctcgatgttt

SEQ ID NO: 29027 - DNA, 25 bp, S. cerevisiae
gaatatacataccattcgtacttta

SEQ ID NO: 29028 - DNA, 25 bp, S. cerevisiae
gaagtcaaagtcactgctacctatg

SEQ ID NO: 29029 - DNA, 25 bp, S. cerevisiae
gaattcaaaggctactgtcacacta

SEQ ID NO: 29030 - DNA, 25 bp, S. cerevisiae
gaattcataatgatcctgtcctcga

SEQ ID NO: 29031 - DNA, 25 bp, S. cerevisiae
gaatatcaaagcttcctggagtcag

SEQ ID NO: 29032 - DNA, 25 bp, S. cerevisiae
gaattacatattccgtgatcccgat

SEQ ID NO: 29033 - DNA, 25 bp, S. cerevisiae
gaattcatatgtactggctcgtcca

SEQ ID NO: 29034 - DNA, 25 bp, S. cerevisiae
gaattcatcattatggctgctgact

SEQ ID NO: 29035 - DNA, 25 bp, S. cerevisiae
gaatattcattcctgcatgttgacg

SEQ ID NO: 29036 - DNA, 25 bp, S. cerevisiae
gaatttatagctatttgcaccgata

SEQ ID NO: 29037 - DNA, 25 bp, S. cerevisiae
gaatttccagctaatcgtgatcact

SEQ ID NO: 29038 - DNA, 25 bp, S. cerevisiae
gaatttagatgctcaggaccaggaa

SEQ ID NO: 29039 - DNA, 25 bp, S. cerevisiae
gaatatgctaatcaaggactccgaa

SEQ ID NO: 29040 - DNA, 25 bp, S. cerevisiae
gaattttttgtctttgagagcccaa

SEQ ID NO: 29041 - DNA, 25 bp, S. cerevisiae
gaatatgctgttctcaattgtcccc

SEQ ID NO: 29042 - DNA, 25 bp, S. cerevisiae
gaattcttgatcctatcgcggttaa

SEQ ID NO: 29043 - DNA, 25 bp, S. cerevisiae
gaattcttgctcctgaagctcgtat

SEQ ID NO: 29044 - DNA, 25 bp, S. cerevisiae
gaattcgtgccccatcatgacttat

SEQ ID NO: 29045 - DNA, 25 bp, S. cerevisiae
gaatacgttgcagatgatggcgaag

SEQ ID NO: 29046 - DNA, 25 bp, S. cerevisiae
gaatttcactctttctgggacaaaa

SEQ ID NO: 29047 - DNA, 25 bp, S. cerevisiae
gaattcatacgcttccttgggaaaa

SEQ ID NO: 29048 - DNA, 25 bp, S. cerevisiae
gaattatcactaacaccttgctgag

SEQ ID NO: 29049 - DNA, 25 bp, S. cerevisiae
gaattcatcattcgcctctttagat

SEQ ID NO: 29050 - DNA, 25 bp, S. cerevisiae
gaattctatcgacctctctaatatc

SEQ ID NO: 29051 - DNA, 25 bp, S. cerevisiae
gaattcaacagagcttctaggcccc

SEQ ID NO: 29052 - DNA, 25 bp, S. cerevisiae
gaattcacctatgtttcaacaccag

SEQ ID NO: 29053 - DNA, 25 bp, S. cerevisiae
gaattatgcctttcctatcaaacca

SEQ ID NO: 29054 - DNA, 25 bp, S. cerevisiae
gaattcagcatcacgttattaccag

SEQ ID NO: 29055 - DNA, 25 bp, S. cerevisiae
gaattctcagcttcttcaactgaca

SEQ ID NO: 29056 - DNA, 25 bp, S. cerevisiae
gaattagcctctttacagactgcat

SEQ ID NO: 29057 - DNA, 25 bp, S. cerevisiae
gaatacacctctttagcaactatag

SEQ ID NO: 29058 - DNA, 25 bp, S. cerevisiae
gaatacccctgctattaagtcagat

SEQ ID NO: 29059 - DNA, 25 bp, S. cerevisiae
gaatatgaggcagacccctttatta

SEQ ID NO: 29060 - DNA, 25 bp, S. cerevisiae
gaatcaggatgccacgtacgactct

SEQ ID NO: 29061 - DNA, 25 bp, S. cerevisiae
gaataagatgctgccgcacaactct

SEQ ID NO: 29062 - DNA, 25 bp, S. cerevisiae
gaatatcctctggtagtggtgccct

SEQ ID NO: 29063 - DNA, 25 bp, S. cerevisiae
gaattcagacttcagtggtgtccat

SEQ ID NO: 29064 - DNA, 25 bp, S. cerevisiae
gaattaccgcattgttctgtcgaag

SEQ ID NO: 29065 - DNA, 25 bp, S. cerevisiae
gaataaccacagctccgacgatgag

SEQ ID NO: 29066 - DNA, 25 bp, S. cerevisiae
gaataacccagcactcagaaacatg

SEQ ID NO: 29067 - DNA, 25 bp, S. cerevisiae
gaatatgagcgcacaatcccaacct

SEQ ID NO: 29068 - DNA, 25 bp, S. cerevisiae
gaataaggacaccatgccgcatgca

SEQ ID NO: 29069 - DNA, 25 bp, S. cerevisiae
gaattatgaatctctgcagcaatgc

SEQ ID NO: 29070 - DNA, 25 bp, S. cerevisiae
gaatcacagatcactcagagggagg

SEQ ID NO: 29071 - DNA, 25 bp, S. cerevisiae
gaaccaggttcccacaatgagggat

SEQ ID NO: 29072 - DNA, 25 bp, S. cerevisiae
gaactggtttcacaaaagggcgcaa

SEQ ID NO: 29073 - DNA, 25 bp, S. cerevisiae
gaacggtaccatcagtaagacagga

SEQ ID NO: 29074 - DNA, 25 bp, S. cerevisiae
gaatttggctctgacgttactccag

SEQ ID NO: 29075 - DNA, 25 bp, S. cerevisiae
gaatttgtctgtgaacttgtccgcc

SEQ ID NO: 29076 - DNA, 25 bp, S. cerevisiae
gaatttggctcgtgatctgggccca

SEQ ID NO: 29077 - DNA, 25 bp, S. cerevisiae
gaatttgctttcaatggcccaacaa

SEQ ID NO: 29078 - DNA, 25 bp, S. cerevisiae
gaattacagcctgatgttcctccat

SEQ ID NO: 29079 - DNA, 25 bp, S. cerevisiae
gaattcacagttcaagacacccatt

SEQ ID NO: 29080 - DNA, 25 bp, S. cerevisiae
gaattcacagttgcaaagcacgcct

SEQ ID NO: 29081 - DNA, 25 bp, S. cerevisiae
gaatttgattctaccaaccatcctg

SEQ ID NO: 29082 - DNA, 25 bp, S. cerevisiae
gaataccgtttactgcacgaagcaa

SEQ ID NO: 29083 - DNA, 25 bp, S. cerevisiae
gaatacgctgcaaatatcccaaagt

SEQ ID NO: 29084 - DNA, 25 bp, S. cerevisiae
gaatacgtctgcgatgcctacaaat

SEQ ID NO: 29085 - DNA, 25 bp, S. cerevisiae
gaatatcggccttccatacaagagt

SEQ ID NO: 29086 - DNA, 25 bp, S. cerevisiae
gaatatcgtcccacaagataccttt

SEQ ID NO: 29087 - DNA, 25 bp, S. cerevisiae
gaattttcgcctagattgcacaaca

SEQ ID NO: 29088 - DNA, 25 bp, S. cerevisiae
gaatatttccaacatgctctacagt

SEQ ID NO: 29089 - DNA, 25 bp, S. cerevisiae
gaatcatttgccaagtacctacagg

SEQ ID NO: 29090 - DNA, 25 bp, S. cerevisiae
gaatttctgctaatgacgcctacac

SEQ ID NO: 29091 - DNA, 25 bp, S. cerevisiae
gaatctaccatgataggctcgaaaa

SEQ ID NO: 29092 - DNA, 25 bp, S. cerevisiae
gaattaccagaatactctcttcgag

SEQ ID NO: 29093 - DNA, 25 bp, S. cerevisiae
gaatttgtcaaatcaccacttggtg

SEQ ID NO: 29094 - DNA, 25 bp, S. cerevisiae
gaattatcattacttccctactgca

SEQ ID NO: 29095 - DNA, 25 bp, S. cerevisiae
gaatttcgtactaccttcatatgcg

SEQ ID NO: 29096 - DNA, 25 bp, S. cerevisiae
gaatttagtgaccaacccatatgag

SEQ ID NO: 29097 - DNA, 25 bp, S. cerevisiae
gaatctaagctaggaccccaggacc

SEQ ID NO: 29098 - DNA, 25 bp, S. cerevisiae
gaagaagaaattagtcccggcgttg

SEQ ID NO: 29099 - DNA, 25 bp, S. cerevisiae
gaatatttaccaacacatccaagaa

SEQ ID NO: 29100 - DNA, 25 bp, S. cerevisiae
gaatatcctacaacgtcatacaaga

SEQ ID NO: 29101 - DNA, 25 bp, S. cerevisiae
gaatatggtgactccctaaatgggt

SEQ ID NO: 29102 - DNA, 25 bp, S. cerevisiae
gaatatgtttctttcccaagatcgg

SEQ ID NO: 29103 - DNA, 25 bp, S. cerevisiae
gaatatttgtgtttctcccaagctg

SEQ ID NO: 29104 - DNA, 25 bp, S. cerevisiae
gaatcaattggtgcagcttctctga

SEQ ID NO: 29105 - DNA, 25 bp, S. cerevisiae
gaattattgagaccactttacagag

SEQ ID NO: 29106 - DNA, 25 bp, S. cerevisiae
gaatttattgcgtctgggttcaaca

SEQ ID NO: 29107 - DNA, 25 bp, S. cerevisiae
gaatttgccgagtgaggtgatcaac

SEQ ID NO: 29108 - DNA, 25 bp, S. cerevisiae
gaatcattccgagtaccttttccat

SEQ ID NO: 29109 - DNA, 25 bp, S. cerevisiae
gaatactacagtttctcctttcatt

SEQ ID NO: 29110 - DNA, 25 bp, S. cerevisiae
gaatcacaagaatggccgctttcat

SEQ ID NO: 29111 - DNA, 25 bp, S. cerevisiae
gaataccattatctgcaccacttat

SEQ ID NO: 29112 - DNA, 25 bp, S. cerevisiae
gaataccatatacgtaccaccttta

SEQ ID NO: 29113 - DNA, 25 bp, S. cerevisiae
gaatccctacggtgaagcagtttga

SEQ ID NO: 29114 - DNA, 25 bp, S. cerevisiae
gaatttgtatcttctgatcctggtt

SEQ ID NO: 29115 - DNA, 25 bp, S. cerevisiae
gaatttcagaccttgtcagctgcgt

SEQ ID NO: 29116 - DNA, 25 bp, S. cerevisiae
gaatttgcaaccattcggcactgat

SEQ ID NO: 29117 - DNA, 25 bp, S. cerevisiae
gaatttgtatacagccgtgccgatg

SEQ ID NO: 29118 - DNA, 25 bp, S. cerevisiae
gaatttgtgaacagggccgcggctt

SEQ ID NO: 29119 - DNA, 25 bp, S. cerevisiae
gaacgatcgaaaacagggcccgctt

SEQ ID NO: 29120 - DNA, 25 bp, S. cerevisiae
gaatcgaggtttaatggccccggat

SEQ ID NO: 29121 - DNA, 25 bp, S. cerevisiae
gaatcggtgattgatatgactacca

SEQ ID NO: 29122 - DNA, 25 bp, S. cerevisiae
gaataggtgggttcatgtcgactcc

SEQ ID NO: 29123 - DNA, 25 bp, S. cerevisiae
gactcaaagtggttattcgactact

SEQ ID NO: 29124 - DNA, 25 bp, S. cerevisiae
gaatatcaaggtgttttggccatat

SEQ ID NO: 29125 - DNA, 25 bp, S. cerevisiae
gaatagcccattttttccaagcaat

SEQ ID NO: 29126 - DNA, 25 bp, S. cerevisiae
gaatacaccgacatgttagccactg

SEQ ID NO: 29127 - DNA, 25 bp, S. cerevisiae
gaattttcgtctacaagcatccgga

SEQ ID NO: 29128 - DNA, 25 bp, S. cerevisiae
gaattttcgatcctcaagatccgta

SEQ ID NO: 29129 - DNA, 25 bp, S. cerevisiae
gaattttcctcatgaagatgccgat

SEQ ID NO: 29130 - DNA, 25 bp, S. cerevisiae
gaatctttcacattaaatcccggag

SEQ ID NO: 29131 - DNA, 25 bp, S. cerevisiae
gaatgcactacgtgattttgccgca

SEQ ID NO: 29132 - DNA, 25 bp, S. cerevisiae
gaatcctcttggcacggcattatag

SEQ ID NO: 29133 - DNA, 25 bp, S. cerevisiae
gaatctacctccttcaagttttgga

SEQ ID NO: 29134 - DNA, 25 bp, S. cerevisiae
gaattttccggacgaatctctcatg

SEQ ID NO: 29135 - DNA, 25 bp, S. cerevisiae
gaatatttgccatgagcctttccag

SEQ ID NO: 29136 - DNA, 25 bp, S. cerevisiae
gaataccatggtagacctttcaaga

SEQ ID NO: 29137 - DNA, 25 bp, S. cerevisiae
gaataccgtggattactttatcgat

SEQ ID NO: 29138 - DNA, 25 bp, S. cerevisiae
gaataccaggtgtcaatcagcttat

SEQ ID NO: 29139 - DNA, 25 bp, S. cerevisiae
gaatatcactggtctacactgtaca

SEQ ID NO: 29140 - DNA, 25 bp, S. cerevisiae
gaatacactatactggatctaaaga

SEQ ID NO: 29141 - DNA, 25 bp, S. cerevisiae
gaaccctgggctgatcaaaacgaac

SEQ ID NO: 29142 - DNA, 25 bp, S. cerevisiae
gaaccctatggtgatcaaagtcgtc

SEQ ID NO: 29143 - DNA, 25 bp, S. cerevisiae
gaatatggctgtttctcgtacacca

SEQ ID NO: 29144 - DNA, 25 bp, S. cerevisiae
gaatatactttagcgtgagcccaga

SEQ ID NO: 29145 - DNA, 25 bp, S. cerevisiae
gaatttgtttatagccgactctaag

SEQ ID NO: 29146 - DNA, 25 bp, S. cerevisiae
gaattttcttctatctcacttcata

SEQ ID NO: 29147 - DNA, 25 bp, S. cerevisiae
gaatttgtacttggttccctgcatt

SEQ ID NO: 29148 - DNA, 25 bp, S. cerevisiae
gaattttccactcttttcgatgatt

SEQ ID NO: 29149 - DNA, 25 bp, S. cerevisiae
gaatctcttcccaatttaagcggtt

SEQ ID NO: 29150 - DNA, 25 bp, S. cerevisiae
gaattttcgcagcttctaatggact

SEQ ID NO: 29151 - DNA, 25 bp, S. cerevisiae
gaatttctggactttctactacagt

SEQ ID NO: 29152 - DNA, 25 bp, S. cerevisiae
gaatttggagatgctttacttcggg

SEQ ID NO: 29153 - DNA, 25 bp, S. cerevisiae
gaatctgggacgctcttatttaaga

SEQ ID NO: 29154 - DNA, 25 bp, S. cerevisiae
gaatcgggaactgtatttgactcaa

SEQ ID NO: 29155 - DNA, 25 bp, S. cerevisiae
gaactggcagagagtacaacgacta

SEQ ID NO: 29156 - DNA, 25 bp, S. cerevisiae
gaatctagaagatacgtttgccgac

SEQ ID NO: 29157 - DNA, 25 bp, S. cerevisiae
gaatcaccaagatgtttcctgccca

SEQ ID NO: 29158 - DNA, 25 bp, S. cerevisiae
gaatatgctcaaaagtctaccggta

SEQ ID NO: 29159 - DNA, 25 bp, S. cerevisiae
gaatttgcattctattaacctggta

SEQ ID NO: 29160 - DNA, 25 bp, S. cerevisiae
gaatattgatattttacccttggac

SEQ ID NO: 29161 - DNA, 25 bp, S. cerevisiae
gaatacggtatttgagcactcttta

SEQ ID NO: 29162 - DNA, 25 bp, S. cerevisiae
gaatcagcgagtgtcattgactcta

SEQ ID NO: 29163 - DNA, 25 bp, S. cerevisiae
gaatagtcccgcaacaacagctgaa

SEQ ID NO: 29164 - DNA, 25 bp, S. cerevisiae
gaatgagcatatccgcttcactatt

SEQ ID NO: 29165 - DNA, 25 bp, S. cerevisiae
gaatactctctatggaagtgcagat

SEQ ID NO: 29166 - DNA, 25 bp, S. cerevisiae
gaatatcacatttgtttctcagtac

SEQ ID NO: 29167 - DNA, 25 bp, S. cerevisiae
gaatatatccatggcgttatcgacc

SEQ ID NO: 29168 - DNA, 25 bp, S. cerevisiae
gaatatgtgcacacgctgaatggca

SEQ ID NO: 29169 - DNA, 25 bp, S. cerevisiae
gaatatctgcctgtgctgtatgtga

SEQ ID NO: 29170 - DNA, 25 bp, S. cerevisiae
gaatcttcactttgcccctggaaaa

SEQ ID NO: 29171 - DNA, 25 bp, S. cerevisiae
gaatcctgggaataccgctaatagt

SEQ ID NO: 29172 - DNA, 25 bp, S. cerevisiae
gaatacatggtttcaagggctatta

SEQ ID NO: 29173 - DNA, 25 bp, S. cerevisiae
gaatccggtgcaacaaaggtttact

SEQ ID NO: 29174 - DNA, 25 bp, S. cerevisiae
gaatacgtcgccgaattggactcca

SEQ ID NO: 29175 - DNA, 25 bp, S. cerevisiae
gaatcacgactcctgaattgttcat

SEQ ID NO: 29176 - DNA, 25 bp, S. cerevisiae
gaatagaattcccaactcatcatcc

SEQ ID NO: 29177 - DNA, 25 bp, S. cerevisiae
gaatacatcacttacgctttgtccg

SEQ ID NO: 29178 - DNA, 25 bp, S. cerevisiae
gaatatctcgtatccttcgtcctct

SEQ ID NO: 29179 - DNA, 25 bp, S. cerevisiae
gaataatggaatgccctactcactc

SEQ ID NO: 29180 - DNA, 25 bp, S. cerevisiae
gaatcaagagttcccacgagcagca

SEQ ID NO: 29181 - DNA, 25 bp, S. cerevisiae
gaataatggcgattcccaagcagcc

SEQ ID NO: 29182 - DNA, 25 bp, S. cerevisiae
gaataatgctacttcctcaacgtct

SEQ ID NO: 29183 - DNA, 25 bp, S. cerevisiae
gaatatctttgctcatccagacggt

SEQ ID NO: 29184 - DNA, 25 bp, S. cerevisiae
gaatcttcatcattgactccgacgg

SEQ ID NO: 29185 - DNA, 25 bp, S. cerevisiae
gaatttgctcaaagcttggaagctg

SEQ ID NO: 29186 - DNA, 25 bp, S. cerevisiae
gaatttgctcaatttcttcactact

SEQ ID NO: 29187 - DNA, 25 bp, S. cerevisiae
gaatttcttctcaagtcacactgga

SEQ ID NO: 29188 - DNA, 25 bp, S. cerevisiae
gaatttctattcatgcgcacactaa

SEQ ID NO: 29189 - DNA, 25 bp, S. cerevisiae
gaatttcattgacttggatggccaa

SEQ ID NO: 29190 - DNA, 25 bp, S. cerevisiae
gaatttcactttggcgtgtccatat

SEQ ID NO: 29191 - DNA, 25 bp, S. cerevisiae
gaatttctccgtcttctattacgaa

SEQ ID NO: 29192 - DNA, 25 bp, S. cerevisiae
gaatatgccccacgtttcaaaatcg

SEQ ID NO: 29193 - DNA, 25 bp, S. cerevisiae
gaagccgtggctcaattaaaactag

SEQ ID NO: 29194 - DNA, 25 bp, S. cerevisiae
gaatcctataacacccgaagaacta

SEQ ID NO: 29195 - DNA, 25 bp, S. cerevisiae
gaatctgtttccagcccaattgaac

SEQ ID NO: 29196 - DNA, 25 bp, S. cerevisiae
gaagcggttcaacaccacggaaggt

SEQ ID NO: 29197 - DNA, 25 bp, S. cerevisiae
gaatcggtttccacgaggccaagga

SEQ ID NO: 29198 - DNA, 25 bp, S. cerevisiae
gaatcaagtacttcaaagaggtcaa

SEQ ID NO: 29199 - DNA, 25 bp, S. cerevisiae
gaatctgactccataaaagcgctac

SEQ ID NO: 29200 - DNA, 25 bp, S. cerevisiae
gaatcttcacacatcggacaggcaa

SEQ ID NO: 29201 - DNA, 25 bp, S. cerevisiae
gaatttgacactccgacatctggta

SEQ ID NO: 29202 - DNA, 25 bp, S. cerevisiae
gaatttgacttcgaggctgctgtaa

SEQ ID NO: 29203 - DNA, 25 bp, S. cerevisiae
gaatactattccctatgtcatggta

SEQ ID NO: 29204 - DNA, 25 bp, S. cerevisiae
gaatagtttgcatccattagcacta

SEQ ID NO: 29205 - DNA, 25 bp, S. cerevisiae
gaatatgtttccttgcatgtgagac

SEQ ID NO: 29206 - DNA, 25 bp, S. cerevisiae
gaatactcccttttggcatggacca

SEQ ID NO: 29207 - DNA, 25 bp, S. cerevisiae
gaatctaatggtgccatgtctactt

SEQ ID NO: 29208 - DNA, 25 bp, S. cerevisiae
gaatctatcatcgtcgccgaatgac

SEQ ID NO: 29209 - DNA, 25 bp, S. cerevisiae
gaatcattctcgttgctgtaaaagc

SEQ ID NO: 29210 - DNA, 25 bp, S. cerevisiae
gaatttgtctaggtcgacttccctc

SEQ ID NO: 29211 - DNA, 25 bp, S. cerevisiae
gaatttgttgatgtcgccatcccat

SEQ ID NO: 29212 - DNA, 25 bp, S. cerevisiae
gaatctgaagtttccggctccgttg

SEQ ID NO: 29213 - DNA, 25 bp, S. cerevisiae
gaatctttgttgtacgactcagcgt

SEQ ID NO: 29214 - DNA, 25 bp, S. cerevisiae
gaatatattgataggtccaccagag

SEQ ID NO: 29215 - DNA, 25 bp, S. cerevisiae
gaatatctagcaatggcccatcaga

SEQ ID NO: 29216 - DNA, 25 bp, S. cerevisiae
gaatactacatgaagcacctgctgg

SEQ ID NO: 29217 - DNA, 25 bp, S. cerevisiae
gaatcttcaaaagccgcagagtccg

SEQ ID NO: 29218 - DNA, 25 bp, S. cerevisiae
gaatatgtctataaggccaaggcta

SEQ ID NO: 29219 - DNA, 25 bp, S. cerevisiae
gaatatatgtctaatcctgatgatg

SEQ ID NO: 29220 - DNA, 25 bp, S. cerevisiae
gaatagattcctacatcgatgagat

SEQ ID NO: 29221 - DNA, 25 bp, S. cerevisiae
gaatacattgttcccgagattctcg

SEQ ID NO: 29222 - DNA, 25 bp, S. cerevisiae
gaataatcctgctacgcagccaatt

SEQ ID NO: 29223 - DNA, 25 bp, S. cerevisiae
gaatttgctatcatggttgtttcta

SEQ ID NO: 29224 - DNA, 25 bp, S. cerevisiae
gaatctactgacattgttttccata

SEQ ID NO: 29225 - DNA, 25 bp, S. cerevisiae
gaatcagacagtgttttggtcgcac

SEQ ID NO: 29226 - DNA, 25 bp, S. cerevisiae
gaatcaactgctgttttgcgtctag

SEQ ID NO: 29227 - DNA, 25 bp, S. cerevisiae
gaatgccagcgaccttatacgtaag

SEQ ID NO: 29228 - DNA, 25 bp, S. cerevisiae
gaatatggctccattatcgcctgca

SEQ ID NO: 29229 - DNA, 25 bp, S. cerevisiae
gaatttgtctccaatactacagcag

SEQ ID NO: 29230 - DNA, 25 bp, S. cerevisiae
gaatacgagtccaacgctacaaacg

SEQ ID NO: 29231 - DNA, 25 bp, S. cerevisiae
gaatactaccatgagttgaccaact

SEQ ID NO: 29232 - DNA, 25 bp, S. cerevisiae
gaatattacgctatgttgtccaaga

SEQ ID NO: 29233 - DNA, 25 bp, S. cerevisiae
gaataatggctctgtatcttccaaa

SEQ ID NO: 29234 - DNA, 25 bp, S. cerevisiae
gaatctctcgaagagctttgctcca

SEQ ID NO: 29235 - DNA, 25 bp, S. cerevisiae
gaacggtgaactacttgaagccttt

SEQ ID NO: 29236 - DNA, 25 bp, S. cerevisiae
gaatccgtggacaactgctgaacct

SEQ ID NO: 29237 - DNA, 25 bp, S. cerevisiae
gaatcctctgaagaccggttttgca

SEQ ID NO: 29238 - DNA, 25 bp, S. cerevisiae
gaatcttctttctataccgttttat

SEQ ID NO: 29239 - DNA, 25 bp, S. cerevisiae
gaatctttgtccaaggtcgcttatc

SEQ ID NO: 29240 - DNA, 25 bp, S. cerevisiae
gaatacgtttctcgtaacgcttcta

SEQ ID NO: 29241 - DNA, 25 bp, S. cerevisiae
gaataccactttgaacgggatgcat

SEQ ID NO: 29242 - DNA, 25 bp, S. cerevisiae
gaataccgttctgattgccgatatg

SEQ ID NO: 29243 - DNA, 25 bp, S. cerevisiae
gaatagtctgtctcaaatttggcat

SEQ ID NO: 29244 - DNA, 25 bp, S. cerevisiae
gaatatgcccgattctctttggatc

SEQ ID NO: 29245 - DNA, 25 bp, S. cerevisiae
gaatctggcgcaagagcttttcaat

SEQ ID NO: 29246 - DNA, 25 bp, S. cerevisiae
gaatctacgcatgcagtttctattg

SEQ ID NO: 29247 - DNA, 25 bp, S. cerevisiae
gaatcataccgccagatatccgtta

SEQ ID NO: 29248 - DNA, 25 bp, S. cerevisiae
gaatattctttattatctggtcata

SEQ ID NO: 29249 - DNA, 25 bp, S. cerevisiae
gaatattgccatctgtgctcttaaa

SEQ ID NO: 29250 - DNA, 25 bp, S. cerevisiae
gaatatggtctaactcatctcagag

SEQ ID NO: 29251 - DNA, 25 bp, S. cerevisiae
gaatcatgatcctctcaaacagcgt

SEQ ID NO: 29252 - DNA, 25 bp, S. cerevisiae
gaatcaaatttccagaaccggacta

SEQ ID NO: 29253 - DNA, 25 bp, S. cerevisiae
gaatactccctcatactagacttgt

SEQ ID NO: 29254 - DNA, 25 bp, S. cerevisiae
gaatagctctgcgaatcatggtaat

SEQ ID NO: 29255 - DNA, 25 bp, S. cerevisiae
gaatagttctgccttgagccaacaa

SEQ ID NO: 29256 - DNA, 25 bp, S. cerevisiae
gaatatttcatcatctcccttcaat

SEQ ID NO: 29257 - DNA, 25 bp, S. cerevisiae
gaatcaaaatctgtccagcctggca

SEQ ID NO: 29258 - DNA, 25 bp, S. cerevisiae
gaataacaactcgtccaaccaagga

SEQ ID NO: 29259 - DNA, 25 bp, S. cerevisiae
gaatcaaacacctccaacgacgtaa

SEQ ID NO: 29260 - DNA, 25 bp, S. cerevisiae
gaatacaaggccaaccatacagcgt

SEQ ID NO: 29261 - DNA, 25 bp, S. cerevisiae
gaatctaaggctcaagcagacaaga

SEQ ID NO: 29262 - DNA, 25 bp, S. cerevisiae
gaatatgattgagttggcacagctt

SEQ ID NO: 29263 - DNA, 25 bp, S. cerevisiae
gaatatgatatgtttgctgccgaag

SEQ ID NO: 29264 - DNA, 25 bp, S. cerevisiae
gaatatgcctcgactggacgagatt

SEQ ID NO: 29265 - DNA, 25 bp, S. cerevisiae
gaatagttggttcctgttcaagcat

SEQ ID NO: 29266 - DNA, 25 bp, S. cerevisiae
gaatacttggttgctgaaccacctg

SEQ ID NO: 29267 - DNA, 25 bp, S. cerevisiae
gaataggtcttcttctgtgtatatg

SEQ ID NO: 29268 - DNA, 25 bp, S. cerevisiae
gaatactatttctctgatctctcat

SEQ ID NO: 29269 - DNA, 25 bp, S. cerevisiae
gaatactgttacgtctgtccagata

SEQ ID NO: 29270 - DNA, 25 bp, S. cerevisiae
gaatgacgctttataatttggcttt

SEQ ID NO: 29271 - DNA, 25 bp, S. cerevisiae
gaatgccttcttcaatttcggtcat

SEQ ID NO: 29272 - DNA, 25 bp, S. cerevisiae
gaatcctttagagacatatcagagt

SEQ ID NO: 29273 - DNA, 25 bp, S. cerevisiae
gaatcaatttttcatctcaatgttg

SEQ ID NO: 29274 - DNA, 25 bp, S. cerevisiae
gaatacttttgtcttgcatgctctt

SEQ ID NO: 29275 - DNA, 25 bp, S. cerevisiae
gattccgttaggcaactactatcaa

SEQ ID NO: 29276 - DNA, 25 bp, S. cerevisiae
gaatccgctagacgttattaccaca

SEQ ID NO: 29277 - DNA, 25 bp, S. cerevisiae
gaatcccttggtggtatcgaatctc

SEQ ID NO: 29278 - DNA, 25 bp, S. cerevisiae
gaatctctagggtggattgaactaa

SEQ ID NO: 29279 - DNA, 25 bp, S. cerevisiae
gaatctaactcgtggtatcaacttg

SEQ ID NO: 29280 - DNA, 25 bp, S. cerevisiae
gaatcttcccgattatatatctcgc

SEQ ID NO: 29281 - DNA, 25 bp, S. cerevisiae
gaataacactcctacttctgtcgaa

SEQ ID NO: 29282 - DNA, 25 bp, S. cerevisiae
gaatacgtgatccattttcaatgaa

SEQ ID NO: 29283 - DNA, 25 bp, S. cerevisiae
gaatgattttcagtcgcttaaagca

SEQ ID NO: 29284 - DNA, 25 bp, S. cerevisiae
gaatcacccctttgcctaaaggcat

SEQ ID NO: 29285 - DNA, 25 bp, S. cerevisiae
gaatacggtgttttactggagaggt

SEQ ID NO: 29286 - DNA, 25 bp, S. cerevisiae
ggtcgtcgtttaccaactgaatccg

SEQ ID NO: 29287 - DNA, 25 bp, S. cerevisiae
gaatcgtcggtcttacaactaattg

SEQ ID NO: 29288 - DNA, 25 bp, S. cerevisiae
gaatcttcctttagacaagtccaag

SEQ ID NO: 29289 - DNA, 25 bp, S. cerevisiae
gaatccaaactctgacaaatccaag

SEQ ID NO: 29290 - DNA, 25 bp, S. cerevisiae
gaatctaaagcctccaagacagcaa

SEQ ID NO: 29291 - DNA, 25 bp, S. cerevisiae
gaatacgaagatcctccaaacgaag

SEQ ID NO: 29292 - DNA, 25 bp, S. cerevisiae
gaatccaagacacatcccggagaga

SEQ ID NO: 29293 - DNA, 25 bp, S. cerevisiae
gaatccaagtaaatgtgccccaaga

SEQ ID NO: 29294 - DNA, 25 bp, S. cerevisiae
gaatctcatagtcagttcgtcgcga

SEQ ID NO: 29295 - DNA, 25 bp, S. cerevisiae
gaatatccatccctggtattacggg

SEQ ID NO: 29296 - DNA, 25 bp, S. cerevisiae
gaatacacacaacaaatctaccaaa

SEQ ID NO: 29297 - DNA, 25 bp, S. cerevisiae
gaagaacaaagtgcggtcaccccgg

SEQ ID NO: 29298 - DNA, 25 bp, S. cerevisiae
gaatggaaacttgcgagtctcccta

SEQ ID NO: 29299 - DNA, 25 bp, S. cerevisiae
gaaggtccaagtgcgaccaccatta

SEQ ID NO: 29300 - DNA, 25 bp, S. cerevisiae
gaatctgtcaaacccgcaaacgcat

SEQ ID NO: 29301 - DNA, 25 bp, S. cerevisiae
gaatcagtgaaaccccaattcgaaa

SEQ ID NO: 29302 - DNA, 25 bp, S. cerevisiae
gaatgacgacgaggtgccatccatg

SEQ ID NO: 29303 - DNA, 25 bp, S. cerevisiae
gaatctgatgaagcgctttgccatt

SEQ ID NO: 29304 - DNA, 25 bp, S. cerevisiae
gaagtgcaagatgggctttttcaac

SEQ ID NO: 29305 - DNA, 25 bp, S. cerevisiae
gaatcttctacaaagctcttcgtgg

SEQ ID NO: 29306 - DNA, 25 bp, S. cerevisiae
gaatcaactagcgaatgttcctcat

SEQ ID NO: 29307 - DNA, 25 bp, S. cerevisiae
gaatacacaacatggtgtcctattt

SEQ ID NO: 29308 - DNA, 25 bp, S. cerevisiae
gaatcaccccaaagttaatctagtt

SEQ ID NO: 29309 - DNA, 25 bp, S. cerevisiae
gaatcaccccaagcactgaacaatt

SEQ ID NO: 29310 - DNA, 25 bp, S. cerevisiae
gaataccaacgagtccgaacatgtt

SEQ ID NO: 29311 - DNA, 25 bp, S. cerevisiae
gaataccaagctgctgttgaacaga

SEQ ID NO: 29312 - DNA, 25 bp, S. cerevisiae
gaatctcaatgcatattttgaagca

SEQ ID NO: 29313 - DNA, 25 bp, S. cerevisiae
gaatctcaatgcatattttgaagca

SEQ ID NO: 29314 - DNA, 25 bp, S. cerevisiae
gaatcaaatcctccgttaactttca

SEQ ID NO: 29315 - DNA, 25 bp, S. cerevisiae
gaatgaaatccttgttaaatctttg

SEQ ID NO: 29316 - DNA, 25 bp, S. cerevisiae
gaataacaacttttcttcctgaaca

SEQ ID NO: 29317 - DNA, 25 bp, S. cerevisiae
gaatcctcaatgttttcctaaatta

SEQ ID NO: 29318 - DNA, 25 bp, S. cerevisiae
gaatcactcgatctacagcatctga

SEQ ID NO: 29319 - DNA, 25 bp, S. cerevisiae
gaatactatatgttccaagctgctc

SEQ ID NO: 29320 - DNA, 25 bp, S. cerevisiae
gaatacttcattcccatcagcgatc

SEQ ID NO: 29321 - DNA, 25 bp, S. cerevisiae
gaatcagcttttgcaacgttgacta

SEQ ID NO: 29322 - DNA, 25 bp, S. cerevisiae
gaatgcctgtactacgatatggtta

SEQ ID NO: 29323 - DNA, 25 bp, S. cerevisiae
gaatgcactgacctgaagacgaaat

SEQ ID NO: 29324 - DNA, 25 bp, S. cerevisiae
gaatctatggcactgaacaacgaat

SEQ ID NO: 29325 - DNA, 25 bp, S. cerevisiae
gaatctaatgatcctctaacgaata

SEQ ID NO: 29326 - DNA, 25 bp, S. cerevisiae
gaatgatactagcttgagtctgaac

SEQ ID NO: 29327 - DNA, 25 bp, S. cerevisiae
gaatcaacgactactattcggcctt

SEQ ID NO: 29328 - DNA, 25 bp, S. cerevisiae
gaatcatacggtactgcttctggta

SEQ ID NO: 29329 - DNA, 25 bp, S. cerevisiae
gaatcatacgaaccgcacattgtgg

SEQ ID NO: 29330 - DNA, 25 bp, S. cerevisiae
gaatcaatcatgtatccacttcaag

SEQ ID NO: 29331 - DNA, 25 bp, S. cerevisiae
gaatcactaacaccacatgtcagag

SEQ ID NO: 29332 - DNA, 25 bp, S. cerevisiae
gaatactccaaactgtctcatcaaa

SEQ ID NO: 29333 - DNA, 25 bp, S. cerevisiae
gaatacgtacagtgtcctacagtaa

SEQ ID NO: 29334 - DNA, 25 bp, S. cerevisiae
gaatactgctaggtggttctacgat

SEQ ID NO: 29335 - DNA, 25 bp, S. cerevisiae
gaatccaatccataccgttctatta

SEQ ID NO: 29336 - DNA, 25 bp, S. cerevisiae
gaatcattccttatccagagactat

SEQ ID NO: 29337 - DNA, 25 bp, S. cerevisiae
gaatacccactcttccaagtttaat

SEQ ID NO: 29338 - DNA, 25 bp, S. cerevisiae
gaatcgcagccaaagtcacgtttaa

SEQ ID NO: 29339 - DNA, 25 bp, S. cerevisiae
gaatgggtcaagttgcacaggctat

SEQ ID NO: 29340 - DNA, 25 bp, S. cerevisiae
gaatgaaacgaggacagggcccaca

SEQ ID NO: 29341 - DNA, 25 bp, S. cerevisiae
gaatacaagcggtccaacgccaaca

SEQ ID NO: 29342 - DNA, 25 bp, S. cerevisiae
gaatccaacggccaaatcacacaag

SEQ ID NO: 29343 - DNA, 25 bp, S. cerevisiae
gaatcctaagggtactgacaaattt

SEQ ID NO: 29344 - DNA, 25 bp, S. cerevisiae
gaatccatcaaggtgggcgacccat

SEQ ID NO: 29345 - DNA, 25 bp, S. cerevisiae
gaatccatagatgaggcagcacaga

SEQ ID NO: 29346 - DNA, 25 bp, S. cerevisiae
gaatcagcaagagcgccatcagcag

SEQ ID NO: 29347 - DNA, 25 bp, S. cerevisiae
gaatcacacgtcttgcatcagcgag

SEQ ID NO: 29348 - DNA, 25 bp, S. cerevisiae
gaatctatccgctaacacaggtcct

SEQ ID NO: 29349 - DNA, 25 bp, S. cerevisiae
gaatgctacagccacagcagcagag

SEQ ID NO: 29350 - DNA, 25 bp, S. cerevisiae
gaatgccagcgccacattgaagaaa

SEQ ID NO: 29351 - DNA, 25 bp, S. cerevisiae
gaatgctcgtccttccaaaaagcgt

SEQ ID NO: 29352 - DNA, 25 bp, S. cerevisiae
gaatcagcttgaatcgtatgcattt

SEQ ID NO: 29353 - DNA, 25 bp, S. cerevisiae
gaatcctgggtaccagcttctagaa

SEQ ID NO: 29354 - DNA, 25 bp, S. cerevisiae
gaatcccaatcgaccaaatctgcaa

SEQ ID NO: 29355 - DNA, 25 bp, S. cerevisiae
gaatcttcttcacccatgacattga

SEQ ID NO: 29356 - DNA, 25 bp, S. cerevisiae
gaatctggtaatcccgtcaatgacg

SEQ ID NO: 29357 - DNA, 25 bp, S. cerevisiae
gaatctgagttttccgatacaaagg

SEQ ID NO: 29358 - DNA, 25 bp, S. cerevisiae
gaataagcccttgacacatgatgaa

SEQ ID NO: 29359 - DNA, 25 bp, S. cerevisiae
gaatcaaccgtttcatcacaatact

SEQ ID NO: 29360 - DNA, 25 bp, S. cerevisiae
gaatcacaacgctattatgactcaa

SEQ ID NO: 29361 - DNA, 25 bp, S. cerevisiae
gaaccaatcgcaacagcaagtctcg

SEQ ID NO: 29362 - DNA, 25 bp, S. cerevisiae
gaatccgccgcaaagaaagcagctg

SEQ ID NO: 29363 - DNA, 25 bp, S. cerevisiae
gaatcttcgctattgaattgtccag

SEQ ID NO: 29364 - DNA, 25 bp, S. cerevisiae
gaatcttccatttgaagctactagg

SEQ ID NO: 29365 - DNA, 25 bp, S. cerevisiae
gaatctaccgcttcaactgtcttga

SEQ ID NO: 29366 - DNA, 25 bp, S. cerevisiae
gaagtttacttgatccggagaccaa

SEQ ID NO: 29367 - DNA, 25 bp, S. cerevisiae
gatttttactatggtccgggcgacg

SEQ ID NO: 29368 - DNA, 25 bp, S. cerevisiae
gaatctttacgatgtccatggtccc

SEQ ID NO: 29369 - DNA, 25 bp, S. cerevisiae
gaatcctatgacttggaactcgata

SEQ ID NO: 29370 - DNA, 25 bp, S. cerevisiae
gaatcacacacctagggatgccgaa

SEQ ID NO: 29371 - DNA, 25 bp, S. cerevisiae
gaatcaaatcactacaagcccgcaa

SEQ ID NO: 29372 - DNA, 25 bp, S. cerevisiae
gaatcaggcatagactcgaactcaa

SEQ ID NO: 29373 - DNA, 25 bp, S. cerevisiae
gaatcagagctacggtcgctaccag

SEQ ID NO: 29374 - DNA, 25 bp, S. cerevisiae
gaatcgagaggcagacccactcagg

SEQ ID NO: 29375 - DNA, 25 bp, S. cerevisiae
gaatcgcagggaagtccagccataa

SEQ ID NO: 29376 - DNA, 25 bp, S. cerevisiae
gaatctttgtgaagcttcgcaagta

SEQ ID NO: 29377 - DNA, 25 bp, S. cerevisiae
gaatacattgcccttgttgatcaac

SEQ ID NO: 29378 - DNA, 25 bp, S. cerevisiae
gaatccgacacgatcttgatgttat

SEQ ID NO: 29379 - DNA, 25 bp, S. cerevisiae
gaatctcgacaaaggttggttatta

SEQ ID NO: 29380 - DNA, 25 bp, S. cerevisiae
gaatcttttagcctggtggttctta

SEQ ID NO: 29381 - DNA, 25 bp, S. cerevisiae
gaatcatctaactttactgcacgtg

SEQ ID NO: 29382 - DNA, 25 bp, S. cerevisiae
gaatctgctaaatctattgacgctt

SEQ ID NO: 29383 - DNA, 25 bp, S. cerevisiae
gaatcgcccacaatgttgaagcttt

SEQ ID NO: 29384 - DNA, 25 bp, S. cerevisiae
gaatctactggcatttgcactgttc

SEQ ID NO: 29385 - DNA, 25 bp, S. cerevisiae
gaatcacatcttgtcttgcgtggtt

SEQ ID NO: 29386 - DNA, 25 bp, S. cerevisiae
gaataattatatccctcctcctgat

SEQ ID NO: 29387 - DNA, 25 bp, S. cerevisiae
gaataaagacacacttccctccggc

SEQ ID NO: 29388 - DNA, 25 bp, S. cerevisiae
gaataaagcaacacactaccagaag

SEQ ID NO: 29389 - DNA, 25 bp, S. cerevisiae
gaataaaacatctacacgaccaggg

SEQ ID NO: 29390 - DNA, 25 bp, S. cerevisiae
gaatgcggatagtgttcaaccttgt

SEQ ID NO: 29391 - DNA, 25 bp, S. cerevisiae
gaatgcctatggtgactaccctttt

SEQ ID NO: 29392 - DNA, 25 bp, S. cerevisiae
gaatcctgatgtgaaaatcccattt

SEQ ID NO: 29393 - DNA, 25 bp, S. cerevisiae
gaatcacctgatgaaactcccttct

SEQ ID NO: 29394 - DNA, 25 bp, S. cerevisiae
gaatcacctattcatgttcgcgaat

SEQ ID NO: 29395 - DNA, 25 bp, S. cerevisiae
gaatacagcgtctacttttgccact

SEQ ID NO: 29396 - DNA, 25 bp, S. cerevisiae
gaataagtgcccatcatgcggccat

SEQ ID NO: 29397 - DNA, 25 bp, S. cerevisiae
gaataattcactttcgaaccatgtg

SEQ ID NO: 29398 - DNA, 25 bp, S. cerevisiae
gaagacttcagtttggtacttggat

SEQ ID NO: 29399 - DNA, 25 bp, S. cerevisiae
gaatctctattggaagtgcccgctg

SEQ ID NO: 29400 - DNA, 25 bp, S. cerevisiae
gaatcaatactcaacggctcctgtg

SEQ ID NO: 29401 - DNA, 25 bp, S. cerevisiae
gaatctggtgccgatatcgaacctc

SEQ ID NO: 29402 - DNA, 25 bp, S. cerevisiae
gaatgtcatgctgaatatctacccc

SEQ ID NO: 29403 - DNA, 25 bp, S. cerevisiae
gaatgccgaaaatcctatctccaag

SEQ ID NO: 29404 - DNA, 25 bp, S. cerevisiae
gaagacggtagaactctatctgact

SEQ ID NO: 29405 - DNA, 25 bp, S. cerevisiae
gaatccatcaatagatacgtcctga

SEQ ID NO: 29406 - DNA, 25 bp, S. cerevisiae
gaatcacatttgaatcacggtctgg

SEQ ID NO: 29407 - DNA, 25 bp, S. cerevisiae
gaatccctgctgaacatctgaatgt

SEQ ID NO: 29408 - DNA, 25 bp, S. cerevisiae
gaatccgctggtgttgcagatctga

SEQ ID NO: 29409 - DNA, 25 bp, S. cerevisiae
gaatgtcgtgcggaagtaattgcca

SEQ ID NO: 29410 - DNA, 25 bp, S. cerevisiae
gaatcccggtgaagtatcatttaag

SEQ ID NO: 29411 - DNA, 25 bp, S. cerevisiae
gaatctcccggaagatcagctcgtt

SEQ ID NO: 29412 - DNA, 25 bp, S. cerevisiae
gaatccacagggatatgcatgccct

SEQ ID NO: 29413 - DNA, 25 bp, S. cerevisiae
gaatcgccagaaaatacaccagtaa

SEQ ID NO: 29414 - DNA, 25 bp, S. cerevisiae
gaatcgcaagaacaactagccaata

SEQ ID NO: 29415 - DNA, 25 bp, S. cerevisiae
gaatccctgaaggaagcttcaacat

SEQ ID NO: 29416 - DNA, 25 bp, S. cerevisiae
gaatcggccttggaatcttggaccc

SEQ ID NO: 29417 - DNA, 25 bp, S. cerevisiae
gaatccactttacatttggtcttga

SEQ ID NO: 29418 - DNA, 25 bp, S. cerevisiae
gaatccgcttttcaaatagacgtgg

SEQ ID NO: 29419 - DNA, 25 bp, S. cerevisiae
gaagctatttggatttacccaggaa

SEQ ID NO: 29420 - DNA, 25 bp, S. cerevisiae
gaatcgttttatccttgtttcgcgg

SEQ ID NO: 29421 - DNA, 25 bp, S. cerevisiae
gaatcatgtcttttacagtttcctg

SEQ ID NO: 29422 - DNA, 25 bp, S. cerevisiae
gaatctttatttctattgcactcat

SEQ ID NO: 29423 - DNA, 25 bp, S. cerevisiae
gaatctttgccagctttggatacca

SEQ ID NO: 29424 - DNA, 25 bp, S. cerevisiae
gaatctttggctcctttcgataatc

SEQ ID NO: 29425 - DNA, 25 bp, S. cerevisiae
gaatctctggaagcttatttggaaa

SEQ ID NO: 29426 - DNA, 25 bp, S. cerevisiae
gaaccaagagaataaccgccgaaat

SEQ ID NO: 29427 - DNA, 25 bp, S. cerevisiae
gaaggccaaacacaaccggaggaag

SEQ ID NO: 29428 - DNA, 25 bp, S. cerevisiae
gaatcggaacccaaagctgcggagg

SEQ ID NO: 29429 - DNA, 25 bp, S. cerevisiae
gaatctgatgaatcctggcacgggt

SEQ ID NO: 29430 - DNA, 25 bp, S. cerevisiae
gaatctgaatactggccacgtttga

SEQ ID NO: 29431 - DNA, 25 bp, S. cerevisiae
gaatcggaatccaactcatttgacg

SEQ ID NO: 29432 - DNA, 25 bp, S. cerevisiae
gaatcggcctctcattttgaacagt

SEQ ID NO: 29433 - DNA, 25 bp, S. cerevisiae
gaatgggccgagcaccacagagact

SEQ ID NO: 29434 - DNA, 25 bp, S. cerevisiae
gaatgcacgatctcagtgatccaga

SEQ ID NO: 29435 - DNA, 25 bp, S. cerevisiae
gaatgacattgctcaggtgcccaaa

SEQ ID NO: 29436 - DNA, 25 bp, S. cerevisiae
gaatgcacatttgagttcaccaacg

SEQ ID NO: 29437 - DNA, 25 bp, S. cerevisiae
gaatgctctttggagtagttgccat

SEQ ID NO: 29438 - DNA, 25 bp, S. cerevisiae
gaatcatcattccagcaccatatgc

SEQ ID NO: 29439 - DNA, 25 bp, S. cerevisiae
gaatcaagatattgcctctgctctt

SEQ ID NO: 29440 - DNA, 25 bp, S. cerevisiae
gaatcaagcatcatgagcactccct

SEQ ID NO: 29441 - DNA, 25 bp, S. cerevisiae
gaatgacactgtagcagactccatt

SEQ ID NO: 29442 - DNA, 25 bp, S. cerevisiae
gaatgaaatgttgccctcacgagtg

SEQ ID NO: 29443 - DNA, 25 bp, S. cerevisiae
gaatctcaattcagcgccggtagat

SEQ ID NO: 29444 - DNA, 25 bp, S. cerevisiae
gaatcgcttccaacctctgagaaat

SEQ ID NO: 29445 - DNA, 25 bp, S. cerevisiae
gaatccgtgcgttccattgtagaat

SEQ ID NO: 29446 - DNA, 25 bp, S. cerevisiae
gaatcacccaattccatcatggcag

SEQ ID NO: 29447 - DNA, 25 bp, S. cerevisiae
gaatccccatgatatcattgaaggc

SEQ ID NO: 29448 - DNA, 25 bp, S. cerevisiae
gaatcacccatactatattgctact

SEQ ID NO: 29449 - DNA, 25 bp, S. cerevisiae
gaatcatcatcctcgacttcaaagg

SEQ ID NO: 29450 - DNA, 25 bp, S. cerevisiae
gaatgcttgctatggcctcattaca

SEQ ID NO: 29451 - DNA, 25 bp, S. cerevisiae
gaatccattcagtcgccttatttat

SEQ ID NO: 29452 - DNA, 25 bp, S. cerevisiae
gaatccatgatcctactacatctaa

SEQ ID NO: 29453 - DNA, 25 bp, S. cerevisiae
gaatcgatctcgaatcaacgactgt

SEQ ID NO: 29454 - DNA, 25 bp, S. cerevisiae
gaatcagatctcgtatatcacatca

SEQ ID NO: 29455 - DNA, 25 bp, S. cerevisiae
gaatcggccacatcatccattatgg

SEQ ID NO: 29456 - DNA, 25 bp, S. cerevisiae
gaatctgccatagtttcaatgctca

SEQ ID NO: 29457 - DNA, 25 bp, S. cerevisiae
gaatctattatcctcagcattgcca

SEQ ID NO: 29458 - DNA, 25 bp, S. cerevisiae
gaatctattagtcatgcttccaatg

SEQ ID NO: 29459 - DNA, 25 bp, S. cerevisiae
gaatgctattagaggcttgccagaa

SEQ ID NO: 29460 - DNA, 25 bp, S. cerevisiae
gaagatcagttgacggccagtaaca

SEQ ID NO: 29461 - DNA, 25 bp, S. cerevisiae
gaatccaactccgtgtcagaaatca

SEQ ID NO: 29462 - DNA, 25 bp, S. cerevisiae
gaaggccctaaccaaaagtctcaag

SEQ ID NO: 29463 - DNA, 25 bp, S. cerevisiae
gaagaacccttcatttggcccgaag

SEQ ID NO: 29464 - DNA, 25 bp, S. cerevisiae
gaaggagaccgacttaggcgacaaa

SEQ ID NO: 29465 - DNA, 25 bp, S. cerevisiae
gaaggcccagcatggactacaaaaa

SEQ ID NO: 29466 - DNA, 25 bp, S. cerevisiae
gaaggctctagacgctttacaaggt

SEQ ID NO: 29467 - DNA, 25 bp, S. cerevisiae
gaacgccaaatcctccaacaaggaa

SEQ ID NO: 29468 - DNA, 25 bp, S. cerevisiae
gaatcggcgtacatatctcaaagta

SEQ ID NO: 29469 - DNA, 25 bp, S. cerevisiae
gaatcccgctgctttacaagaacac

SEQ ID NO: 29470 - DNA, 25 bp, S. cerevisiae
gaatcctcccttttcaagcatgaaa

SEQ ID NO: 29471 - DNA, 25 bp, S. cerevisiae
gaaggtggtcctgagagcaataaaa

SEQ ID NO: 29472 - DNA, 25 bp, S. cerevisiae
gaatcgatattctgggtctagctga

SEQ ID NO: 29473 - DNA, 25 bp, S. cerevisiae
gaatctgattctacggctttacata

SEQ ID NO: 29474 - DNA, 25 bp, S. cerevisiae
gaatctgttgttcagctactggtaa

SEQ ID NO: 29475 - DNA, 25 bp, S. cerevisiae
gaatcgtacttggaatggaggtcta

SEQ ID NO: 29476 - DNA, 25 bp, S. cerevisiae
gaatcgtcacctgcggaggttccaa

SEQ ID NO: 29477 - DNA, 25 bp, S. cerevisiae
gaatctgagtcattcgccaacgatg

SEQ ID NO: 29478 - DNA, 25 bp, S. cerevisiae
gaatcaggatttctttctctccact

SEQ ID NO: 29479 - DNA, 25 bp, S. cerevisiae
gaatctgtgttctcttttccacaaa

SEQ ID NO: 29480 - DNA, 25 bp, S. cerevisiae
gaatgtggccgctcaggctatccgt

SEQ ID NO: 29481 - DNA, 25 bp, S. cerevisiae
gaagcaagctctgccaggtattcct

SEQ ID NO: 29482 - DNA, 25 bp, S. cerevisiae
gaagcagaagtcacaaacattcttg

SEQ ID NO: 29483 - DNA, 25 bp, S. cerevisiae
gaatccacacagtcaaccactgttt

SEQ ID NO: 29484 - DNA, 25 bp, S. cerevisiae
gaatgcccaagatgacgcacgagtt

SEQ ID NO: 29485 - DNA, 25 bp, S. cerevisiae
gaatcttcatcaattgacccgaggg

SEQ ID NO: 29486 - DNA, 25 bp, S. cerevisiae
gaatctgcttctttaccgaagggta

SEQ ID NO: 29487 - DNA, 25 bp, S. cerevisiae
gaatgctatttctcatcgtggtaaa

SEQ ID NO: 29488 - DNA, 25 bp, S. cerevisiae
gaatgaatcaattgcgctcgcttgc

SEQ ID NO: 29489 - DNA, 25 bp, S. cerevisiae
gaatgaattatctgccgctgagcca

SEQ ID NO: 29490 - DNA, 25 bp, S. cerevisiae
gaatcattcttcaccagatacacag

SEQ ID NO: 29491 - DNA, 25 bp, S. cerevisiae
gaatgaatcccactggactgtttgt

SEQ ID NO: 29492 - DNA, 25 bp, S. cerevisiae
gaatgtatcacgtggtcgcaactgg

SEQ ID NO: 29493 - DNA, 25 bp, S. cerevisiae
gaatgctagccgtagagtccacata

SEQ ID NO: 29494 - DNA, 25 bp, S. cerevisiae
gaatctcaattgatctatcccgcat

SEQ ID NO: 29495 - DNA, 25 bp, S. cerevisiae
gaatctcattaggtctaccagtcgg

SEQ ID NO: 29496 - DNA, 25 bp, S. cerevisiae
gaatcgatttgcgtctaccaatccg

SEQ ID NO: 29497 - DNA, 25 bp, S. cerevisiae
gaatctcagtgtcttcctgcaatgt

SEQ ID NO: 29498 - DNA, 25 bp, S. cerevisiae
taattcgttgactgcccataggttt

SEQ ID NO: 29499 - DNA, 25 bp, S. cerevisiae
taatttgaccccagcattaggtttg

SEQ ID NO: 29500 - DNA, 25 bp, S. cerevisiae
gaatgaccaatactcgtctattttg

SEQ ID NO: 29501 - DNA, 25 bp, S. cerevisiae
gaatctccaatctcggtgaagaagg

SEQ ID NO: 29502 - DNA, 25 bp, S. cerevisiae
gaatgcttatattccgagctacaga

SEQ ID NO: 29503 - DNA, 25 bp, S. cerevisiae
gaatcgtgtaactagtgcatgcaat

SEQ ID NO: 29504 - DNA, 25 bp, S. cerevisiae
gaagcttcgtgccaaatacggtata

SEQ ID NO: 29505 - DNA, 25 bp, S. cerevisiae
gaatgcaaatatcacctgaccagat

SEQ ID NO: 29506 - DNA, 25 bp, S. cerevisiae
gaatgatctcgttttggaagcgatt

SEQ ID NO: 29507 - DNA, 25 bp, S. cerevisiae
gaatcgccagccttctaagttgata

SEQ ID NO: 29508 - DNA, 25 bp, S. cerevisiae
gaatcgtcctgctatctgggtaaat

SEQ ID NO: 29509 - DNA, 25 bp, S. cerevisiae
gaatctgatgcggttgctgaagcta

SEQ ID NO: 29510 - DNA, 25 bp, S. cerevisiae
gaatcgggcagtacatacacctcta

SEQ ID NO: 29511 - DNA, 25 bp, S. cerevisiae
gaatcgtcaggtacatcttccgcta

SEQ ID NO: 29512 - DNA, 25 bp, S. cerevisiae
gaatctgtagataactttggtcatg

SEQ ID NO: 29513 - DNA, 25 bp, S. cerevisiae
gaatctggctaaactactcaacaaa

SEQ ID NO: 29514 - DNA, 25 bp, S. cerevisiae
gaatctcgccagacagctatctaaa

SEQ ID NO: 29515 - DNA, 25 bp, S. cerevisiae
gaatctgcggagtcatccattgaag

SEQ ID NO: 29516 - DNA, 25 bp, S. cerevisiae
gaatctcacgaaaccatatgtagcg

SEQ ID NO: 29517 - DNA, 25 bp, S. cerevisiae
gaaccagagcaaacaggccctttta

SEQ ID NO: 29518 - DNA, 25 bp, S. cerevisiae
gttcttcaagttcaggcgtcggtaa

SEQ ID NO: 29519 - DNA, 25 bp, S. cerevisiae
gaactgtttgttctggtttggtcaa

SEQ ID NO: 29520 - DNA, 25 bp, S. cerevisiae
gaatcccttttctacttcttgttca

SEQ ID NO: 29521 - DNA, 25 bp, S. cerevisiae
gaatcgtcgttttgacacccttatt

SEQ ID NO: 29522 - DNA, 25 bp, S. cerevisiae
gaatggacgtttcaagcccaacaca

SEQ ID NO: 29523 - DNA, 25 bp, S. cerevisiae
gaatcgaaatcatccgctgctgaaa

SEQ ID NO: 29524 - DNA, 25 bp, S. cerevisiae
gaatcgaaggctttactcagagaga

SEQ ID NO: 29525 - DNA, 25 bp, S. cerevisiae
gaatgtcagtactttgatccaagga

SEQ ID NO: 29526 - DNA, 25 bp, S. cerevisiae
gaatgttgaccaagtgccaaccgta

SEQ ID NO: 29527 - DNA, 25 bp, S. cerevisiae
gaatgcttgagccagacatttactc

SEQ ID NO: 29528 - DNA, 25 bp, S. cerevisiae
gaatgcttcacgtatcattgctaga

SEQ ID NO: 29529 - DNA, 25 bp, S. cerevisiae
gaatgcctactttccacgtggatgt

SEQ ID NO: 29530 - DNA, 25 bp, S. cerevisiae
gaatgccggtgttcatacgttgatc

SEQ ID NO: 29531 - DNA, 25 bp, S. cerevisiae
gaatcctgtggactttgctctagat

SEQ ID NO: 29532 - DNA, 25 bp, S. cerevisiae
gaatccttagaaatctcctctgatg

SEQ ID NO: 29533 - DNA, 25 bp, S. cerevisiae
gaatgctgtccatactgcaaacgaa

SEQ ID NO: 29534 - DNA, 25 bp, S. cerevisiae
gaatgcgtcgcagaggcctaaagcc

SEQ ID NO: 29535 - DNA, 25 bp, S. cerevisiae
gaatggtagcgcttgccgtacttgc

SEQ ID NO: 29536 - DNA, 25 bp, S. cerevisiae
gaatcctatcctttgcgtgtcaaaa

SEQ ID NO: 29537 - DNA, 25 bp, S. cerevisiae
gaatctccgttgaatcgttattgaa

SEQ ID NO: 29538 - DNA, 25 bp, S. cerevisiae
gaatgtcgcttgcatataagttcag

SEQ ID NO: 29539 - DNA, 25 bp, S. cerevisiae
gaatcggcgtttgcatagatacatg

SEQ ID NO: 29540 - DNA, 25 bp, S. cerevisiae
gaatccgctgatttggctagaacta

SEQ ID NO: 29541 - DNA, 25 bp, S. cerevisiae
gaatcctgttgaaggctaggactaa

SEQ ID NO: 29542 - DNA, 25 bp, S. cerevisiae
gaatccggtaatgcgcaggacaaca

SEQ ID NO: 29543 - DNA, 25 bp, S. cerevisiae
gaatctgcacgatacttctacaaca

SEQ ID NO: 29544 - DNA, 25 bp, S. cerevisiae
gaatcgccctactttctagagatca

SEQ ID NO: 29545 - DNA, 25 bp, S. cerevisiae
gaacccctaagtttgactcatcgtg

SEQ ID NO: 29546 - DNA, 25 bp, S. cerevisiae
gaagacaccgtctcttggttcaagc

SEQ ID NO: 29547 - DNA, 25 bp, S. cerevisiae
gaatgggtccgatgttcaacaatga

SEQ ID NO: 29548 - DNA, 25 bp, S. cerevisiae
gaaggcccgttccttcggcaggaat

SEQ ID NO: 29549 - DNA, 25 bp, S. cerevisiae
gaacgagtctttcagggaaggaatt

SEQ ID NO: 29550 - DNA, 25 bp, S. cerevisiae
gaatcgttctttaagcggactggat

SEQ ID NO: 29551 - DNA, 25 bp, S. cerevisiae
gaatctgtccttaaacgaccgtgat

SEQ ID NO: 29552 - DNA, 25 bp, S. cerevisiae
gaatgctttcaataacgccgctgct

SEQ ID NO: 29553 - DNA, 25 bp, S. cerevisiae
gaatcgtctgactcaatcacaagat

SEQ ID NO: 29554 - DNA, 25 bp, S. cerevisiae
gaatcgctggtcttagcacaactga

SEQ ID NO: 29555 - DNA, 25 bp, S. cerevisiae
gaatccggagcaatatcaccaatga

SEQ ID NO: 29556 - DNA, 25 bp, S. cerevisiae
gaatccggtgacaacccactagatt

SEQ ID NO: 29557 - DNA, 25 bp, S. cerevisiae
gagttcggtatcaacactactgttc

SEQ ID NO: 29558 - DNA, 25 bp, S. cerevisiae
gaggtttttagctctttttgcaact

SEQ ID NO: 29559 - DNA, 25 bp, S. cerevisiae
gaatgtcaggttatgccatcaatga

SEQ ID NO: 29560 - DNA, 25 bp, S. cerevisiae
gaatgtcaatgagttttcgcagaac

SEQ ID NO: 29561 - DNA, 25 bp, S. cerevisiae
gaatgttctttctcttgactgtgaa

SEQ ID NO: 29562 - DNA, 25 bp, S. cerevisiae
gaatgactgctcttgcacagaacct

SEQ ID NO: 29563 - DNA, 25 bp, S. cerevisiae
gaatgcctccacgaggaactgatgt

SEQ ID NO: 29564 - DNA, 25 bp, S. cerevisiae
gaatccatcgcaaccggatctgtta

SEQ ID NO: 29565 - DNA, 25 bp, S. cerevisiae
gactattccaaggtcgatcgttccg

SEQ ID NO: 29566 - DNA, 25 bp, S. cerevisiae
gaatggtaaacctgctcgttcatat

SEQ ID NO: 29567 - DNA, 25 bp, S. cerevisiae
gaaggtaacaccctctactggaacg

SEQ ID NO: 29568 - DNA, 25 bp, S. cerevisiae
gaacgtgaacaatctttcggaacat

SEQ ID NO: 29569 - DNA, 25 bp, S. cerevisiae
gaaagtaccaaagctccggaactag

SEQ ID NO: 29570 - DNA, 25 bp, S. cerevisiae
gaaggaaccagcttgccccggattt

SEQ ID NO: 29571 - DNA, 25 bp, S. cerevisiae
gaaggaacaatttacccaggcagtg

SEQ ID NO: 29572 - DNA, 25 bp, S. cerevisiae
gaaggaacaattgactccatcgtca

SEQ ID NO: 29573 - DNA, 25 bp, S. cerevisiae
gaacgatatgcaagttccaccccaa

SEQ ID NO: 29574 - DNA, 25 bp, S. cerevisiae
gaaggtaaccttgcagcctacaact

SEQ ID NO: 29575 - DNA, 25 bp, S. cerevisiae
gaatgagctgaaaaagggccttgtc

SEQ ID NO: 29576 - DNA, 25 bp, S. cerevisiae
gaatccgaagaaccgtgccatttgc

SEQ ID NO: 29577 - DNA, 25 bp, S. cerevisiae
gaacgcgaaatacggtcaattgcat

SEQ ID NO: 29578 - DNA, 25 bp, S. cerevisiae
gaatgccaaatcaaaggctgaattg

SEQ ID NO: 29579 - DNA, 25 bp, S. cerevisiae
gaagtcaaatcatcaggtactcaga

SEQ ID NO: 29580 - DNA, 25 bp, S. cerevisiae
gaatgctgaacatccggcaaatcaa

SEQ ID NO: 29581 - DNA, 25 bp, S. cerevisiae
gaatgcagcccttatctagaaacga

SEQ ID NO: 29582 - DNA, 25 bp, S. cerevisiae
gaatgctgcaacttattcaaagcct

SEQ ID NO: 29583 - DNA, 25 bp, S. cerevisiae
gaatggtacttcaaaaactcactta

SEQ ID NO: 29584 - DNA, 25 bp, S. cerevisiae
gaatgaggccctaaagaccgcgctt

SEQ ID NO: 29585 - DNA, 25 bp, S. cerevisiae
gaaggaaatcaagaaattcgccaaa

SEQ ID NO: 29586 - DNA, 25 bp, S. cerevisiae
gaagtccaacaagctcaaaccgaga

SEQ ID NO: 29587 - DNA, 25 bp, S. cerevisiae
gaacgctataaagaccgatccggtg

SEQ ID NO: 29588 - DNA, 25 bp, S. cerevisiae
gaatcctgcgaatcaaccgatactg

SEQ ID NO: 29589 - DNA, 25 bp, S. cerevisiae
gaatcctcgagaatgtaccgcaatt

SEQ ID NO: 29590 - DNA, 25 bp, S. cerevisiae
gaatcctctgaaattccacagcaag

SEQ ID NO: 29591 - DNA, 25 bp, S. cerevisiae
gaatcggtactccagcaatgaccac

SEQ ID NO: 29592 - DNA, 25 bp, S. cerevisiae
gaatgctgcctaccaacaatacttt

SEQ ID NO: 29593 - DNA, 25 bp, S. cerevisiae
gaatgccatttatacagccaacgga

SEQ ID NO: 29594 - DNA, 25 bp, S. cerevisiae
gaatgcagagggtccggacgcacca

SEQ ID NO: 29595 - DNA, 25 bp, S. cerevisiae
gaatggagaggcctcggcatcacac

SEQ ID NO: 29596 - DNA, 25 bp, S. cerevisiae
gaatgtctacactcctgagggcgcg

SEQ ID NO: 29597 - DNA, 25 bp, S. cerevisiae
gaatgctcgaacacgatctgggcga

SEQ ID NO: 29598 - DNA, 25 bp, S. cerevisiae
gaatgtctacaaaggtctctccgtg

SEQ ID NO: 29599 - DNA, 25 bp, S. cerevisiae
gaatgtttcaagaagttgtcgctat

SEQ ID NO: 29600 - DNA, 25 bp, S. cerevisiae
gaagtttgatgcttggtttcctcaa

SEQ ID NO: 29601 - DNA, 25 bp, S. cerevisiae
gaatggcttagacaccgtaccaaaa

SEQ ID NO: 29602 - DNA, 25 bp, S. cerevisiae
gaatccactttgcacttagtcttga

SEQ ID NO: 29603 - DNA, 25 bp, S. cerevisiae
gaatccgtatttaaatgccagctta

SEQ ID NO: 29604 - DNA, 25 bp, S. cerevisiae
gaatgcgcatttcttcaagcctgat

SEQ ID NO: 29605 - DNA, 25 bp, S. cerevisiae
gaatgatggaccctaatgccggtat

SEQ ID NO: 29606 - DNA, 25 bp, S. cerevisiae
gaaggagatgcaaccgcagcctggt

SEQ ID NO: 29607 - DNA, 25 bp, S. cerevisiae
gaaggcaagattacctcctactggt

SEQ ID NO: 29608 - DNA, 25 bp, S. cerevisiae
gaatgagcaagttcccaccgacgag

SEQ ID NO: 29609 - DNA, 25 bp, S. cerevisiae
gaatggctgaactatgcactaggtt

SEQ ID NO: 29610 - DNA, 25 bp, S. cerevisiae
gaatggcggatcaactcacagattt

SEQ ID NO: 29611 - DNA, 25 bp, S. cerevisiae
gaatgacacgtctatctccgattta

SEQ ID NO: 29612 - DNA, 25 bp, S. cerevisiae
gaatccttgacaatgtacgttccaa

SEQ ID NO: 29613 - DNA, 25 bp, S. cerevisiae
gaatccttcggtacaggttccaatc

SEQ ID NO: 29614 - DNA, 25 bp, S. cerevisiae
gaatccatatcgactataggtacct

SEQ ID NO: 29615 - DNA, 25 bp, S. cerevisiae
gacccagaccctcaagtaactgatt

SEQ ID NO: 29616 - DNA, 25 bp, S. cerevisiae
gaagacgactcccaaattaacggtg

SEQ ID NO: 29617 - DNA, 25 bp, S. cerevisiae
gaagctcaaccccaacattaaagaa

SEQ ID NO: 29618 - DNA, 25 bp, S. cerevisiae
gaatgcatccacacgtacttgaaga

SEQ ID NO: 29619 - DNA, 25 bp, S. cerevisiae
gaatgcaatcaaatcaagagtcgac

SEQ ID NO: 29620 - DNA, 25 bp, S. cerevisiae
gaatgcctgacatcaaagtcgagct

SEQ ID NO: 29621 - DNA, 25 bp, S. cerevisiae
gaatcgcgagcaaaacgttgcacat

SEQ ID NO: 29622 - DNA, 25 bp, S. cerevisiae
gaatgccggtttgggattcaagacc

SEQ ID NO: 29623 - DNA, 25 bp, S. cerevisiae
gaatcctggtttggctattgctgaa

SEQ ID NO: 29624 - DNA, 25 bp, S. cerevisiae
gaatgcggctttccagattacaaga

SEQ ID NO: 29625 - DNA, 25 bp, S. cerevisiae
gaatgttgttctctacgatgtaccc

SEQ ID NO: 29626 - DNA, 25 bp, S. cerevisiae
gacacttatttgaacccttaccctg

SEQ ID NO: 29627 - DNA, 25 bp, S. cerevisiae
gaaggacatttacggctggactcaa

SEQ ID NO: 29628 - DNA, 25 bp, S. cerevisiae
gaatggtcctttcgtggtaccgaga

SEQ ID NO: 29629 - DNA, 25 bp, S. cerevisiae
gaatggtgcctttacgttttcgata

SEQ ID NO: 29630 - DNA, 25 bp, S. cerevisiae
gaatgttccatatgtctttgttcca

SEQ ID NO: 29631 - DNA, 25 bp, S. cerevisiae
gaatgggcgttctatctttgcttcc

SEQ ID NO: 29632 - DNA, 25 bp, S. cerevisiae
gaatgccacgcctgatattagctat

SEQ ID NO: 29633 - DNA, 25 bp, S. cerevisiae
gaatgcttccgtcatcaaatctatg

SEQ ID NO: 29634 - DNA, 25 bp, S. cerevisiae
gaatgcccgaaagcttgctctatta

SEQ ID NO: 29635 - DNA, 25 bp, S. cerevisiae
gaaggcaatgagttctgacgcgttt

SEQ ID NO: 29636 - DNA, 25 bp, S. cerevisiae
gaaggcctcgatcctgaagaactag

SEQ ID NO: 29637 - DNA, 25 bp, S. cerevisiae
gaatgcccgcaatatatcagaactt

SEQ ID NO: 29638 - DNA, 25 bp, S. cerevisiae
gaatgcactccattaatccagcaaa

SEQ ID NO: 29639 - DNA, 25 bp, S. cerevisiae
gaatgctccagtgttcactttactg

SEQ ID NO: 29640 - DNA, 25 bp, S. cerevisiae
gaatgctcctcgctttggtgtggaa

SEQ ID NO: 29641 - DNA, 25 bp, S. cerevisiae
gaacctttcaaacagcaattaacac

SEQ ID NO: 29642 - DNA, 25 bp, S. cerevisiae
gaaggtcccaaagatgctaacaaat

SEQ ID NO: 29643 - DNA, 25 bp, S. cerevisiae
gaaggacccaaatgcccctaagagg

SEQ ID NO: 29644 - DNA, 25 bp, S. cerevisiae
gaaggatcctaacgcccctaagagg

SEQ ID NO: 29645 - DNA, 25 bp, S. cerevisiae
gaaggatgctgccatgggcccacta

SEQ ID NO: 29646 - DNA, 25 bp, S. cerevisiae
gaatggagtcagacgccgaaatctt

SEQ ID NO: 29647 - DNA, 25 bp, S. cerevisiae
gaatgaatcttcgtgcctagacaga

SEQ ID NO: 29648 - DNA, 25 bp, S. cerevisiae
gaatgtatcctcctttgagcacaat

SEQ ID NO: 29649 - DNA, 25 bp, S. cerevisiae
gaaggccccatctagtctaagcaat

SEQ ID NO: 29650 - DNA, 25 bp, S. cerevisiae
gaatgggatcctagtttttccaaag

SEQ ID NO: 29651 - DNA, 25 bp, S. cerevisiae
gaaggttcccgtatggtccgtgagc

SEQ ID NO: 29652 - DNA, 25 bp, S. cerevisiae
gaagtggtcccgctacgtgttgtac

SEQ ID NO: 29653 - DNA, 25 bp, S. cerevisiae
gaagtggaaacccttggcgattttg

SEQ ID NO: 29654 - DNA, 25 bp, S. cerevisiae
gaaagccgaacccaaggaattcttg

SEQ ID NO: 29655 - DNA, 25 bp, S. cerevisiae
gaaggactacaacgaaggattttat

SEQ ID NO: 29656 - DNA, 25 bp, S. cerevisiae
gaaggcgttatttgagggattctct

SEQ ID NO: 29657 - DNA, 25 bp, S. cerevisiae
gaaagctgtcgttaagggtactaat

SEQ ID NO: 29658 - DNA, 25 bp, S. cerevisiae
gaatggtgggtttggcgttattaat

SEQ ID NO: 29659 - DNA, 25 bp, S. cerevisiae
gaatgttgccctcgagtgtgttaat

SEQ ID NO: 29660 - DNA, 25 bp, S. cerevisiae
gaatcctcctcaagagtcgtcaaca

SEQ ID NO: 29661 - DNA, 25 bp, S. cerevisiae
gaatggcaaaaatccgttagcttgt

SEQ ID NO: 29662 - DNA, 25 bp, S. cerevisiae
gaagttaaggctgtcgcccagttaa

SEQ ID NO: 29663 - DNA, 25 bp, S. cerevisiae
gaagtaacaccggttgtccatttca

SEQ ID NO: 29664 - DNA, 25 bp, S. cerevisiae
gaaggaatccctatctaataaatct

SEQ ID NO: 29665 - DNA, 25 bp, S. cerevisiae
gaaggccatgcggtaccaaaaacgt

SEQ ID NO: 29666 - DNA, 25 bp, S. cerevisiae
gaagtcttagtgtacgacgacaagc

SEQ ID NO: 29667 - DNA, 25 bp, S. cerevisiae
gaatgtcttgacaatccagagctga

SEQ ID NO: 29668 - DNA, 25 bp, S. cerevisiae
gaatgtacatctgcagtagccccag

SEQ ID NO: 29669 - DNA, 25 bp, S. cerevisiae
gaaggtacttcagcagaccgtgaaa

SEQ ID NO: 29670 - DNA, 25 bp, S. cerevisiae
gaatgagctatttcaagacgtcctt

SEQ ID NO: 29671 - DNA, 25 bp, S. cerevisiae
gaaggccaccggttttcattattcg

SEQ ID NO: 29672 - DNA, 25 bp, S. cerevisiae
gaagaccaagtttttgtcaccatct

SEQ ID NO: 29673 - DNA, 25 bp, S. cerevisiae
gaaggccaaattgcttgagctcccc

SEQ ID NO: 29674 - DNA, 25 bp, S. cerevisiae
gaatgacatccttgaccagtttaat

SEQ ID NO: 29675 - DNA, 25 bp, S. cerevisiae
gaatgatgtcgttacacgttctgaa

SEQ ID NO: 29676 - DNA, 25 bp, S. cerevisiae
gaatgtctgtgtgcctattgatgaa

SEQ ID NO: 29677 - DNA, 25 bp, S. cerevisiae
gaatgccaccgctatacatataagt

SEQ ID NO: 29678 - DNA, 25 bp, S. cerevisiae
gaatgtccgagaaaacctgactagt

SEQ ID NO: 29679 - DNA, 25 bp, S. cerevisiae
gaatggaccattagctatacatcac

SEQ ID NO: 29680 - DNA, 25 bp, S. cerevisiae
gaatggcaccttacaattgaacgcg

SEQ ID NO: 29681 - DNA, 25 bp, S. cerevisiae
gaatgcgcagttggatccgtaacca

SEQ ID NO: 29682 - DNA, 25 bp, S. cerevisiae
gaatgcgatgttgcttcttacaata

SEQ ID NO: 29683 - DNA, 25 bp, S. cerevisiae
gaagttttacttatgggtctgcctt

SEQ ID NO: 29684 - DNA, 25 bp, S. cerevisiae
gacgttgtaaccgtgtggtccgcgc

SEQ ID NO: 29685 - DNA, 25 bp, S. cerevisiae
gaatgttatcgtgcccggacaatac

SEQ ID NO: 29686 - DNA, 25 bp, S. cerevisiae
gaaggttcctccacggaaagatggt

SEQ ID NO: 29687 - DNA, 25 bp, S. cerevisiae
gaaggttttccaacgcttacggctg

SEQ ID NO: 29688 - DNA, 25 bp, S. cerevisiae
gaagatgttaccgttccttttggcg

SEQ ID NO: 29689 - DNA, 25 bp, S. cerevisiae
gaatgctggtgaagccatcttttta

SEQ ID NO: 29690 - DNA, 25 bp, S. cerevisiae
gaatgcagtggaacggcttttgagt

SEQ ID NO: 29691 - DNA, 25 bp, S. cerevisiae
gaatgcattggtcggtattttcgtt

SEQ ID NO: 29692 - DNA, 25 bp, S. cerevisiae
gaatgataagtctcttcactcgcgc

SEQ ID NO: 29693 - DNA, 25 bp, S. cerevisiae
gaactcacggcaacattcactgggc

SEQ ID NO: 29694 - DNA, 25 bp, S. cerevisiae
gaaggacatccaagattgcatctgt

SEQ ID NO: 29695 - DNA, 25 bp, S. cerevisiae
gaatggctaccacatatcgctgatg

SEQ ID NO: 29696 - DNA, 25 bp, S. cerevisiae
gaatgctgtttcttgaccctgaagt

SEQ ID NO: 29697 - DNA, 25 bp, S. cerevisiae
gaaggtcactgggatcgttagatgt

SEQ ID NO: 29698 - DNA, 25 bp, S. cerevisiae
gaaggttctggttctttaactgctt

SEQ ID NO: 29699 - DNA, 25 bp, S. cerevisiae
gaaggcctccgttcttatggttatt

SEQ ID NO: 29700 - DNA, 25 bp, S. cerevisiae
gaaggccttcttatttgatgttaat

SEQ ID NO: 29701 - DNA, 25 bp, S. cerevisiae
gaatgcgccagtttttgtagattta

SEQ ID NO: 29702 - DNA, 25 bp, S. cerevisiae
gaatgcggattcagtggcccaattg

SEQ ID NO: 29703 - DNA, 25 bp, S. cerevisiae
gaatgccatttcatttgccatccat

SEQ ID NO: 29704 - DNA, 25 bp, S. cerevisiae
gaatgctgctattcagtgtctcact

SEQ ID NO: 29705 - DNA, 25 bp, S. cerevisiae
gaatgatgctgtccagacgctactg

SEQ ID NO: 29706 - DNA, 25 bp, S. cerevisiae
gaatgacaattttccatggcatgta

SEQ ID NO: 29707 - DNA, 25 bp, S. cerevisiae
gaatgagcctttaccattggatgtg

SEQ ID NO: 29708 - DNA, 25 bp, S. cerevisiae
gaatgaccctgcttttgcagaaact

SEQ ID NO: 29709 - DNA, 25 bp, S. cerevisiae
gaaggccgctcatttacgaaagcta

SEQ ID NO: 29710 - DNA, 25 bp, S. cerevisiae
gaaggccatgctaattgtgtaaact

SEQ ID NO: 29711 - DNA, 25 bp, S. cerevisiae
gaatggctcatcgatctagtttaag

SEQ ID NO: 29712 - DNA, 25 bp, S. cerevisiae
gaatgcgatcgcaggctgttttaag

SEQ ID NO: 29713 - DNA, 25 bp, S. cerevisiae
gaaggcgctgtatctgatagctaac

SEQ ID NO: 29714 - DNA, 25 bp, S. cerevisiae
gaatggacactagactctgcccaag

SEQ ID NO: 29715 - DNA, 25 bp, S. cerevisiae
gaatgatgaggtccttcggtttgaa

SEQ ID NO: 29716 - DNA, 25 bp, S. cerevisiae
gaagagcgaccgtccagagtacgtc

SEQ ID NO: 29717 - DNA, 25 bp, S. cerevisiae
gaaggctatgcagactcagaaacgt

SEQ ID NO: 29718 - DNA, 25 bp, S. cerevisiae
gaaggcgattcatttctcaacaata

SEQ ID NO: 29719 - DNA, 25 bp, S. cerevisiae
gaaggcgatgccaatactgaagatt

SEQ ID NO: 29720 - DNA, 25 bp, S. cerevisiae
gaatggctctcgcttatgaatgatc

SEQ ID NO: 29721 - DNA, 25 bp, S. cerevisiae
gagaggccctgggttcaattcccag

SEQ ID NO: 29722 - DNA, 25 bp, S. cerevisiae
gaagtccggaggttggattcccagt

SEQ ID NO: 29723 - DNA, 25 bp, S. cerevisiae
gaagtacgtcgttccagagggccgt

SEQ ID NO: 29724 - DNA, 25 bp, S. cerevisiae
gagaggtcccgcattaagggcctac

SEQ ID NO: 29725 - DNA, 25 bp, S. cerevisiae
gaaggccgcgccattccaggtgaat

SEQ ID NO: 29726 - DNA, 25 bp, S. cerevisiae
gaaggccgcgacattatcaataagt

SEQ ID NO: 29727 - DNA, 25 bp, S. cerevisiae
gaaggcacgaacttttgtcaaaatt

SEQ ID NO: 29728 - DNA, 25 bp, S. cerevisiae
gaagacgccaaggttgttacacgca

SEQ ID NO: 29729 - DNA, 25 bp, S. cerevisiae
gaaggcgcaatagaagctttcacca

SEQ ID NO: 29730 - DNA, 25 bp, S. cerevisiae
gaaggcgcatcaaaggactttacat

SEQ ID NO: 29731 - DNA, 25 bp, S. cerevisiae
gacagggcccaagcagtagagacat

SEQ ID NO: 29732 - DNA, 25 bp, S. cerevisiae
gaaggacgccaagattctgacttat

SEQ ID NO: 29733 - DNA, 25 bp, S. cerevisiae
gaatggacccaaaactcgactactc

SEQ ID NO: 29734 - DNA, 25 bp, S. cerevisiae
gaatggtacccaaagccgtctgaat

SEQ ID NO: 29735 - DNA, 25 bp, S. cerevisiae
gaaggccctaccaaagcgtaatcat

SEQ ID NO: 29736 - DNA, 25 bp, S. cerevisiae
gaaggccgcagaactacagcgtaca

SEQ ID NO: 29737 - DNA, 25 bp, S. cerevisiae
gaaggccatgtaagtcacatcgatt

SEQ ID NO: 29738 - DNA, 25 bp, S. cerevisiae
gaagttttacgtgatgccatgcatt

SEQ ID NO: 29739 - DNA, 25 bp, S. cerevisiae
gaatggttttttgatccgcttgcat

SEQ ID NO: 29740 - DNA, 25 bp, S. cerevisiae
gaatgtttatcgattaactttgatg

SEQ ID NO: 29741 - DNA, 25 bp, S. cerevisiae
gaatggcattcttctttaactttga

SEQ ID NO: 29742 - DNA, 25 bp, S. cerevisiae
gaaggcttttcctaacatggttaag

SEQ ID NO: 29743 - DNA, 25 bp, S. cerevisiae
gaaggctctttactaaggtgttcgg

SEQ ID NO: 29744 - DNA, 25 bp, S. cerevisiae
gaatggttttactacaagttactga

SEQ ID NO: 29745 - DNA, 25 bp, S. cerevisiae
gaaggactattccatcgacagtgtt

SEQ ID NO: 29746 - DNA, 25 bp, S. cerevisiae
gaatggtaatcctttgacaatgcag

SEQ ID NO: 29747 - DNA, 25 bp, S. cerevisiae
gaaggatacagtttccactgcgaac

SEQ ID NO: 29748 - DNA, 25 bp, S. cerevisiae
gaatgctcccgcctaggatttaagg

SEQ ID NO: 29749 - DNA, 25 bp, S. cerevisiae
gaaggaaggcgcagacattcaggct

SEQ ID NO: 29750 - DNA, 25 bp, S. cerevisiae
gaaggtcaactaccaccatggtgta

SEQ ID NO: 29751 - DNA, 25 bp, S. cerevisiae
gaagggatcatcacacctcagggtc

SEQ ID NO: 29752 - DNA, 25 bp, S. cerevisiae
gaatgacgacatttccgccttggat

SEQ ID NO: 29753 - DNA, 25 bp, S. cerevisiae
gaaggcgttatctacatgggaggaa

SEQ ID NO: 29754 - DNA, 25 bp, S. cerevisiae
gaaggtgcctattatcgagggacaa

SEQ ID NO: 29755 - DNA, 25 bp, S. cerevisiae
gaatgaactatccacgacggacagt

SEQ ID NO: 29756 - DNA, 25 bp, S. cerevisiae
gaatgattctaaccacagatcctct

SEQ ID NO: 29757 - DNA, 25 bp, S. cerevisiae
gaatgattctcccagcatggatcaa

SEQ ID NO: 29758 - DNA, 25 bp, S. cerevisiae
gaatgagatacttgaaacacgtttc

SEQ ID NO: 29759 - DNA, 25 bp, S. cerevisiae
gaaggagactaggagaccgctttaa

SEQ ID NO: 29760 - DNA, 25 bp, S. cerevisiae
gaaggtgacacagggccctatttac

SEQ ID NO: 29761 - DNA, 25 bp, S. cerevisiae
gaaggaccaactgcccgatttagag

SEQ ID NO: 29762 - DNA, 25 bp, S. cerevisiae
gaatggtccatcaagggttcctttg

SEQ ID NO: 29763 - DNA, 25 bp, S. cerevisiae
gaaggatccacttttgaccaatttg

SEQ ID NO: 29764 - DNA, 25 bp, S. cerevisiae
gaaggcacaccttttgatctagagg

SEQ ID NO: 29765 - DNA, 25 bp, S. cerevisiae
gaatgtgactcttttcaagcaggat

SEQ ID NO: 29766 - DNA, 25 bp, S. cerevisiae
gaatgaaaatctccgccttagttgc

SEQ ID NO: 29767 - DNA, 25 bp, S. cerevisiae
gaatgcaaactacttttcctcgcaa

SEQ ID NO: 29768 - DNA, 25 bp, S. cerevisiae
gaatgcagccagtgttttaccaact

SEQ ID NO: 29769 - DNA, 25 bp, S. cerevisiae
gaaggcgcgattttggtgcaccagc

SEQ ID NO: 29770 - DNA, 25 bp, S. cerevisiae
gaagatccgttgtggcaaaatgcca

SEQ ID NO: 29771 - DNA, 25 bp, S. cerevisiae
gaagtgccaagttcgtcaataacca

SEQ ID NO: 29772 - DNA, 25 bp, S. cerevisiae
gaagatgaaactcaggctaccacca

SEQ ID NO: 29773 - DNA, 25 bp, S. cerevisiae
gaaggaatacgccaagctacaccct

SEQ ID NO: 29774 - DNA, 25 bp, S. cerevisiae
gaagtctacgtaccaactgtctttg

SEQ ID NO: 29775 - DNA, 25 bp, S. cerevisiae
gaagtcgtcgtctcaaaggattatg

SEQ ID NO: 29776 - DNA, 25 bp, S. cerevisiae
gaaggcgatatttccaaactattag

SEQ ID NO: 29777 - DNA, 25 bp, S. cerevisiae
gaagggcatcatcatcgcagacact

SEQ ID NO: 29778 - DNA, 25 bp, S. cerevisiae
gaaggccatgctttcgcaacagatt

SEQ ID NO: 29779 - DNA, 25 bp, S. cerevisiae
gaatgtacacttccagagcgcagtt

SEQ ID NO: 29780 - DNA, 25 bp, S. cerevisiae
gaatgttgcactatcgagtgccact

SEQ ID NO: 29781 - DNA, 25 bp, S. cerevisiae
gaatggtggcatatcaagaccctgc

SEQ ID NO: 29782 - DNA, 25 bp, S. cerevisiae
gaatggctccacgaaagaatgcctt

SEQ ID NO: 29783 - DNA, 25 bp, S. cerevisiae
gaagtgaccgtaccaatgcatcctt

SEQ ID NO: 29784 - DNA, 25 bp, S. cerevisiae
gaaggcccagaacagtcaccatatg

SEQ ID NO: 29785 - DNA, 25 bp, S. cerevisiae
gaatgagaccagtagcggaacccat

SEQ ID NO: 29786 - DNA, 25 bp, S. cerevisiae
gaaggacgctgatctgctgaactcc

SEQ ID NO: 29787 - DNA, 25 bp, S. cerevisiae
gaagtagctgctgatgaggaacctc

SEQ ID NO: 29788 - DNA, 25 bp, S. cerevisiae
gaatggatctgtgtcgttccacgct

SEQ ID NO: 29789 - DNA, 25 bp, S. cerevisiae
gaaggatcgttatgcttcccacttt

SEQ ID NO: 29790 - DNA, 25 bp, S. cerevisiae
gaatggtcacttatttgccagacga

SEQ ID NO: 29791 - DNA, 25 bp, S. cerevisiae
gaaggtcattcctgaacagcgacag

SEQ ID NO: 29792 - DNA, 25 bp, S. cerevisiae
gaaggtgcattttcgtaagctgaat

SEQ ID NO: 29793 - DNA, 25 bp, S. cerevisiae
gaatgagtctatttcagtcatgaaa

SEQ ID NO: 29794 - DNA, 25 bp, S. cerevisiae
gaaggctgctgattgatggtcaaga

SEQ ID NO: 29795 - DNA, 25 bp, S. cerevisiae
gaagtacacaagcatgcctgccagt

SEQ ID NO: 29796 - DNA, 25 bp, S. cerevisiae
gaagtggccaagagtctgacattgc

SEQ ID NO: 29797 - DNA, 25 bp, S. cerevisiae
gaaggcatcaagttcagggcagcaa

SEQ ID NO: 29798 - DNA, 25 bp, S. cerevisiae
gaatggtcaattggaggctgcgcaa

SEQ ID NO: 29799 - DNA, 25 bp, S. cerevisiae
gaaggctcaagggaagtctctggat

SEQ ID NO: 29800 - DNA, 25 bp, S. cerevisiae
gaaggtcaacggcatcttccgttaa

SEQ ID NO: 29801 - DNA, 25 bp, S. cerevisiae
gaaggttctagtcacctccatttat

SEQ ID NO: 29802 - DNA, 25 bp, S. cerevisiae
gaaggaattggttaccgctccatta

SEQ ID NO: 29803 - DNA, 25 bp, S. cerevisiae
gaatgtaagctctactaccagcctg

SEQ ID NO: 29804 - DNA, 25 bp, S. cerevisiae
gaatgatagaccttctaccgatgag

SEQ ID NO: 29805 - DNA, 25 bp, S. cerevisiae
gaatgtacactctcagaacttgaag

SEQ ID NO: 29806 - DNA, 25 bp, S. cerevisiae
gaatgttccagatgactctaaggca

SEQ ID NO: 29807 - DNA, 25 bp, S. cerevisiae
gaatggtccgcaatactctaatgta

SEQ ID NO: 29808 - DNA, 25 bp, S. cerevisiae
gaatgttcccacacttattggagca

SEQ ID NO: 29809 - DNA, 25 bp, S. cerevisiae
gaaggcttgctgaccacttcttggg

SEQ ID NO: 29810 - DNA, 25 bp, S. cerevisiae
gaatggcctgggaaccgcttatagt

SEQ ID NO: 29811 - DNA, 25 bp, S. cerevisiae
gaaggttagcgaagattcacatttt

SEQ ID NO: 29812 - DNA, 25 bp, S. cerevisiae
gaaggcttcacgttgcaactggttt

SEQ ID NO: 29813 - DNA, 25 bp, S. cerevisiae
gaaggcttccaaggccaagaatgtt

SEQ ID NO: 29814 - DNA, 25 bp, S. cerevisiae
gaatggtatcacttcccaagttctt

SEQ ID NO: 29815 - DNA, 25 bp, S. cerevisiae
gaatggtgtcatgttcctgcagatt

SEQ ID NO: 29816 - DNA, 25 bp, S. cerevisiae
gaatggtctagtgctcgtcaattgc

SEQ ID NO: 29817 - DNA, 25 bp, S. cerevisiae
gaaggtcacgctcatcgtcagttcg

SEQ ID NO: 29818 - DNA, 25 bp, S. cerevisiae
gaatgtgtatttccaaggccgagtc

SEQ ID NO: 29819 - DNA, 25 bp, S. cerevisiae
gaatgttattgtccttggccatgat

SEQ ID NO: 29820 - DNA, 25 bp, S. cerevisiae
gaatgtatatgcttccttgctctct

SEQ ID NO: 29821 - DNA, 25 bp, S. cerevisiae
gaatgataactttcactcttctcac

SEQ ID NO: 29822 - DNA, 25 bp, S. cerevisiae
gaatgatccgttggcagctttggct

SEQ ID NO: 29823 - DNA, 25 bp, S. cerevisiae
gaatgtccgtttcaatggagcacaa

SEQ ID NO: 29824 - DNA, 25 bp, S. cerevisiae
gaatgtccgtacctcagggccagaa

SEQ ID NO: 29825 - DNA, 25 bp, S. cerevisiae
gaatgagtcgcgtttattggccaaa

SEQ ID NO: 29826 - DNA, 25 bp, S. cerevisiae
gaaggttcggtactactcgacaatc

SEQ ID NO: 29827 - DNA, 25 bp, S. cerevisiae
gaaggactagctcaccagtaagaac

SEQ ID NO: 29828 - DNA, 25 bp, S. cerevisiae
gaatgagctacttacagcacttgaa

SEQ ID NO: 29829 - DNA, 25 bp, S. cerevisiae
gaaggcatactaaatactattgaag

SEQ ID NO: 29830 - DNA, 25 bp, S. cerevisiae
gaaggcaccaaatactcttgtagag

SEQ ID NO: 29831 - DNA, 25 bp, S. cerevisiae
gaaggaccaaactttttcgcagatc

SEQ ID NO: 29832 - DNA, 25 bp, S. cerevisiae
gaaggtaaggatttgatggtcacta

SEQ ID NO: 29833 - DNA, 25 bp, S. cerevisiae
gaaggtaagctgaccgattccctag

SEQ ID NO: 29834 - DNA, 25 bp, S. cerevisiae
gaaggtaacatcaacgttgtccaac

SEQ ID NO: 29835 - DNA, 25 bp, S. cerevisiae
gaaggctctcgtatggatcaccaga

SEQ ID NO: 29836 - DNA, 25 bp, S. cerevisiae
gaaggcatctcatctagaatccaag

SEQ ID NO: 29837 - DNA, 25 bp, S. cerevisiae
gaaggcatgcctactataaccagga

SEQ ID NO: 29838 - DNA, 25 bp, S. cerevisiae
gaatgttctgctgctacaaacgctg

SEQ ID NO: 29839 - DNA, 25 bp, S. cerevisiae
gaatgtgtttatgccaataagggtt

SEQ ID NO: 29840 - DNA, 25 bp, S. cerevisiae
gaatgatttgcttttacccgaggag

SEQ ID NO: 29841 - DNA, 25 bp, S. cerevisiae
gaatgattgtggtcttccaactaaa

SEQ ID NO: 29842 - DNA, 25 bp, S. cerevisiae
gatggaagtttagtttcctctaact

SEQ ID NO: 29843 - DNA, 25 bp, S. cerevisiae
gaagacctattgcagtacctaaaat

SEQ ID NO: 29844 - DNA, 25 bp, S. cerevisiae
gaagtccgaatctgttgtgtaccaa

SEQ ID NO: 29845 - DNA, 25 bp, S. cerevisiae
gaagatagcggttggtctgttccta

SEQ ID NO: 29846 - DNA, 25 bp, S. cerevisiae
gaaggcaggtgttgtctttatacaa

SEQ ID NO: 29847 - DNA, 25 bp, S. cerevisiae
gaatggctcattgtatcgttccaat

SEQ ID NO: 29848 - DNA, 25 bp, S. cerevisiae
gaatgtctcagttagaagatgcact

SEQ ID NO: 29849 - DNA, 25 bp, S. cerevisiae
gaatgtcttggctcaaatgatctct

SEQ ID NO: 29850 - DNA, 25 bp, S. cerevisiae
gaatgttcacgagcaactcagcaat

SEQ ID NO: 29851 - DNA, 25 bp, S. cerevisiae
gaatgtgtgccagatgtcccaggat

SEQ ID NO: 29852 - DNA, 25 bp, S. cerevisiae
gaatggttcaagtctatcccactgt

SEQ ID NO: 29853 - DNA, 25 bp, S. cerevisiae
gaaggagctaagtcttcctccagta

SEQ ID NO: 29854 - DNA, 25 bp, S. cerevisiae
gaatggctaacctttcccaaatcta

SEQ ID NO: 29855 - DNA, 25 bp, S. cerevisiae
gaatggccaactattccacagttat

SEQ ID NO: 29856 - DNA, 25 bp, S. cerevisiae
gaaggctctacctattccggaggac

SEQ ID NO: 29857 - DNA, 25 bp, S. cerevisiae
gaagggttccagattccaacaaatt

SEQ ID NO: 29858 - DNA, 25 bp, S. cerevisiae
gaaggttcttcatttgaccaaaaat

SEQ ID NO: 29859 - DNA, 25 bp, S. cerevisiae
gaaggcaactatattggccacgttt

SEQ ID NO: 29860 - DNA, 25 bp, S. cerevisiae
gaaggctaccatagttgtgcacaag

SEQ ID NO: 29861 - DNA, 25 bp, S. cerevisiae
gaaggcggtcacattatcactatga

SEQ ID NO: 29862 - DNA, 25 bp, S. cerevisiae
gaaggcggtgccagtaacattgtta

SEQ ID NO: 29863 - DNA, 25 bp, S. cerevisiae
gaaggtttaccaggctcttcgagtt

SEQ ID NO: 29864 - DNA, 25 bp, S. cerevisiae
gaaggatttccaccgtgcattagag

SEQ ID NO: 29865 - DNA, 25 bp, S. cerevisiae
gaaggcaggcctttgcagtttcaag

SEQ ID NO: 29866 - DNA, 25 bp, S. cerevisiae
gaaggcatggcagatctcgtcaaaa

SEQ ID NO: 29867 - DNA, 25 bp, S. cerevisiae
gaagggagactctcactccgagatg

SEQ ID NO: 29868 - DNA, 25 bp, S. cerevisiae
gaaggcggactgtttgctaaaattg

SEQ ID NO: 29869 - DNA, 25 bp, S. cerevisiae
gaaggcgatcctgtatgctaaattt

SEQ ID NO: 29870 - DNA, 25 bp, S. cerevisiae
gaaggctaccgtcgatgaattccca

SEQ ID NO: 29871 - DNA, 25 bp, S. cerevisiae
gaagttactcgtcataaagcggcag

SEQ ID NO: 29872 - DNA, 25 bp, S. cerevisiae
gaaggcatttttcaagcttcccgtt

SEQ ID NO: 29873 - DNA, 25 bp, S. cerevisiae
gaatgtgatttgatccatcctaccc

SEQ ID NO: 29874 - DNA, 25 bp, S. cerevisiae
gaatgggctctgcaaaggataaacc

SEQ ID NO: 29875 - DNA, 25 bp, S. cerevisiae
gaatggcaatcgcaacagctgcaaa

SEQ ID NO: 29876 - DNA, 25 bp, S. cerevisiae
gaagtgactcgcaagcaggctgaaa

SEQ ID NO: 29877 - DNA, 25 bp, S. cerevisiae
gaaggattcgaccacgtagacaaag

SEQ ID NO: 29878 - DNA, 25 bp, S. cerevisiae
gaatggaccgactcaaaggctacag

SEQ ID NO: 29879 - DNA, 25 bp, S. cerevisiae
gaagttgccgaacacaatggcccag

SEQ ID NO: 29880 - DNA, 25 bp, S. cerevisiae
gaaggcgatgagttcgttcgcaccc

SEQ ID NO: 29881 - DNA, 25 bp, S. cerevisiae
gagagggcaaactgttccgcaccaa

SEQ ID NO: 29882 - DNA, 25 bp, S. cerevisiae
gaaggccgatacattgtcgaggcaa

SEQ ID NO: 29883 - DNA, 25 bp, S. cerevisiae
gaatgtccacatattgctgtcggag

SEQ ID NO: 29884 - DNA, 25 bp, S. cerevisiae
gaatgtctacagaatccactcgggc

SEQ ID NO: 29885 - DNA, 25 bp, S. cerevisiae
gaaggcatccaatggccatattgag

SEQ ID NO: 29886 - DNA, 25 bp, S. cerevisiae
gaatggtttactgtcatttgtccaa

SEQ ID NO: 29887 - DNA, 25 bp, S. cerevisiae
gaaggtacctctctttatactaaat

SEQ ID NO: 29888 - DNA, 25 bp, S. cerevisiae
gaagggcccttgtctcaagttccaa

SEQ ID NO: 29889 - DNA, 25 bp, S. cerevisiae
gaaggtttcacagttcgagttcgaa

SEQ ID NO: 29890 - DNA, 25 bp, S. cerevisiae
gaatgggttgatctattcactccaa

SEQ ID NO: 29891 - DNA, 25 bp, S. cerevisiae
gaatgggtttgaaatctcgagtata

SEQ ID NO: 29892 - DNA, 25 bp, S. cerevisiae
gaaggattgtctttccctggacaca

SEQ ID NO: 29893 - DNA, 25 bp, S. cerevisiae
gaaggatcgtcatcatggcctgaaa

SEQ ID NO: 29894 - DNA, 25 bp, S. cerevisiae
gaaggctaggatccaagagaccaaa

SEQ ID NO: 29895 - DNA, 25 bp, S. cerevisiae
gaaggctaggctttggctggcaata

SEQ ID NO: 29896 - DNA, 25 bp, S. cerevisiae
gaaggtacaaatctcagtgctgata

SEQ ID NO: 29897 - DNA, 25 bp, S. cerevisiae
gaaggtcaaatctaaagcaatgtca

SEQ ID NO: 29898 - DNA, 25 bp, S. cerevisiae
gaatgtgtgaagtctctaggtaatc

SEQ ID NO: 29899 - DNA, 25 bp, S. cerevisiae
gaagggtttcgctcactattttttg

SEQ ID NO: 29900 - DNA, 25 bp, S. cerevisiae
gaaggcgttttctcatttttcaacg

SEQ ID NO: 29901 - DNA, 25 bp, S. cerevisiae
gaatgggactgaacaagctttacaa

SEQ ID NO: 29902 - DNA, 25 bp, S. cerevisiae
gaatgggcctggaacatgctgtata

SEQ ID NO: 29903 - DNA, 25 bp, S. cerevisiae
gaatggccatgttgaaccggataca

SEQ ID NO: 29904 - DNA, 25 bp, S. cerevisiae
gaaggctattgatcactcagttgaa

SEQ ID NO: 29905 - DNA, 25 bp, S. cerevisiae
gaaggctattattccccgatgtatc

SEQ ID NO: 29906 - DNA, 25 bp, S. cerevisiae
gaagggcaacggttcatcatctcat

SEQ ID NO: 29907 - DNA, 25 bp, S. cerevisiae
gaacgttttgttcggaccaacattg

SEQ ID NO: 29908 - DNA, 25 bp, S. cerevisiae
gaaggaatttgagcggacccctcta

SEQ ID NO: 29909 - DNA, 25 bp, S. cerevisiae
gaagggccaacaagcgcgttcaata

SEQ ID NO: 29910 - DNA, 25 bp, S. cerevisiae
gaagtgatcgaaccgctggaattta

SEQ ID NO: 29911 - DNA, 25 bp, S. cerevisiae
gaaggcgcgtacgtcggagattcaa

SEQ ID NO: 29912 - DNA, 25 bp, S. cerevisiae
gaagtccaacaccagaagggccact

SEQ ID NO: 29913 - DNA, 25 bp, S. cerevisiae
gaaggcgcacttcacacaaaacgtc

SEQ ID NO: 29914 - DNA, 25 bp, S. cerevisiae
gaagtggaacgatgccctgacacca

SEQ ID NO: 29915 - DNA, 25 bp, S. cerevisiae
gaaggagacctgaccccagaagaag

SEQ ID NO: 29916 - DNA, 25 bp, S. cerevisiae
gaatggatgctgaccactcggtaaa

SEQ ID NO: 29917 - DNA, 25 bp, S. cerevisiae
gaaggtttcacaaaggctatctaac

SEQ ID NO: 29918 - DNA, 25 bp, S. cerevisiae
gaaggtcgtctaatcacgtttactg

SEQ ID NO: 29919 - DNA, 25 bp, S. cerevisiae
gaaggctcctatatattctcttttg

SEQ ID NO: 29920 - DNA, 25 bp, S. cerevisiae
gaaggatccgactatgatttcattt

SEQ ID NO: 29921 - DNA, 25 bp, S. cerevisiae
gaaggatctcttccgattatcgaag

SEQ ID NO: 29922 - DNA, 25 bp, S. cerevisiae
gaatggctctctggacgtgacaaga

SEQ ID NO: 29923 - DNA, 25 bp, S. cerevisiae
gaaggcatctctgtatcgacattga

SEQ ID NO: 29924 - DNA, 25 bp, S. cerevisiae
gaagggctcttctactgggtacgaa

SEQ ID NO: 29925 - DNA, 25 bp, S. cerevisiae
gaagcggcgcttctatgggtacaaa

SEQ ID NO: 29926 - DNA, 25 bp, S. cerevisiae
gaaggaccctctaacgcgaataaag

SEQ ID NO: 29927 - DNA, 25 bp, S. cerevisiae
gaaggaccacgtcatcgcaaagatt

SEQ ID NO: 29928 - DNA, 25 bp, S. cerevisiae
gaaggacctcttcagcgcagatcga

SEQ ID NO: 29929 - DNA, 25 bp, S. cerevisiae
gaaggaacctagcacaggctctaaa

SEQ ID NO: 29930 - DNA, 25 bp, S. cerevisiae
gaaggttctttggacggccctgtga

SEQ ID NO: 29931 - DNA, 25 bp, S. cerevisiae
gaaggatgctattaccaagttctac

SEQ ID NO: 29932 - DNA, 25 bp, S. cerevisiae
gaaggattctgctcaaagtttggac

SEQ ID NO: 29933 - DNA, 25 bp, S. cerevisiae
gaagtgtgcttgctaaagtctctgt

SEQ ID NO: 29934 - DNA, 25 bp, S. cerevisiae
gaagaccttcgtgaacatttatttg

SEQ ID NO: 29935 - DNA, 25 bp, S. cerevisiae
gaatggccgctatggaccaatggtt

SEQ ID NO: 29936 - DNA, 25 bp, S. cerevisiae
gaagtccaggcaaggcaccaagagt

SEQ ID NO: 29937 - DNA, 25 bp, S. cerevisiae
gaaggctaattactgcaccaagggt

SEQ ID NO: 29938 - DNA, 25 bp, S. cerevisiae
gaaggttatctacatcgcaatccgt

SEQ ID NO: 29939 - DNA, 25 bp, S. cerevisiae
gaaacttactactatccttgacctt

SEQ ID NO: 29940 - DNA, 25 bp, S. cerevisiae
gaagctagaggccttctatttgggc

SEQ ID NO: 29941 - DNA, 25 bp, S. cerevisiae
gaagtcaacggttttacatgaagcc

SEQ ID NO: 29942 - DNA, 25 bp, S. cerevisiae
gaaggacctgtgcaagataatgaaa

SEQ ID NO: 29943 - DNA, 25 bp, S. cerevisiae
gaatggcccgctaagagtcaagaaa

SEQ ID NO: 29944 - DNA, 25 bp, S. cerevisiae
gaaggactgttaccaggtgacgaat

SEQ ID NO: 29945 - DNA, 25 bp, S. cerevisiae
gaagttctttacaaggtcagagcca

SEQ ID NO: 29946 - DNA, 25 bp, S. cerevisiae
gaagtcctccaagagattcgcgtca

SEQ ID NO: 29947 - DNA, 25 bp, S. cerevisiae
gaaggcatttcgatgagcattccat

SEQ ID NO: 29948 - DNA, 25 bp, S. cerevisiae
gaaggcctgcgcaaatatttccact

SEQ ID NO: 29949 - DNA, 25 bp, S. cerevisiae
gaaggccaagagttcatcttcctct

SEQ ID NO: 29950 - DNA, 25 bp, S. cerevisiae
gaagggttacctgttgtttgctggt

SEQ ID NO: 29951 - DNA, 25 bp, S. cerevisiae
gaagagtttaccactttattgcaac

SEQ ID NO: 29952 - DNA, 25 bp, S. cerevisiae
gaaggtcctccgtgtttgagaacat

SEQ ID NO: 29953 - DNA, 25 bp, S. cerevisiae
gaaggtcatcgctgttttagaaact

SEQ ID NO: 29954 - DNA, 25 bp, S. cerevisiae
gaagggtctattctttattctccag

SEQ ID NO: 29955 - DNA, 25 bp, S. cerevisiae
gaagtaggccattcactgctgggca

SEQ ID NO: 29956 - DNA, 25 bp, S. cerevisiae
gaaggcatggccacattctggaagg

SEQ ID NO: 29957 - DNA, 25 bp, S. cerevisiae
gaagggttctcaagcaatggttatg

SEQ ID NO: 29958 - DNA, 25 bp, S. cerevisiae
gaagtgacgatgctctgtatgtaaa

SEQ ID NO: 29959 - DNA, 25 bp, S. cerevisiae
gaagtcatcggttcgtatctacggg

SEQ ID NO: 29960 - DNA, 25 bp, S. cerevisiae
gaagtcgcagaattcgatacaccat

SEQ ID NO: 29961 - DNA, 25 bp, S. cerevisiae
gaaggcagaaatatcatcacccatt

SEQ ID NO: 29962 - DNA, 25 bp, S. cerevisiae
gaaggcggagtgactatccacgcta

SEQ ID NO: 29963 - DNA, 25 bp, S. cerevisiae
gaagtccggtgcaaatccactagaa

SEQ ID NO: 29964 - DNA, 25 bp, S. cerevisiae
gaagtacggcctataatcgacagac

SEQ ID NO: 29965 - DNA, 25 bp, S. cerevisiae
gaagtgaccaatctcttaaccaacc

SEQ ID NO: 29966 - DNA, 25 bp, S. cerevisiae
gaaggatcctgtcattttaccagca

SEQ ID NO: 29967 - DNA, 25 bp, S. cerevisiae
gaaggctccatgacaactgtttcca

SEQ ID NO: 29968 - DNA, 25 bp, S. cerevisiae
gaaggtatgccctggattcatgcca

SEQ ID NO: 29969 - DNA, 25 bp, S. cerevisiae
gaaggtagacctgctgctgctatgc

SEQ ID NO: 29970 - DNA, 25 bp, S. cerevisiae
gaagtttatccgattgaaccaccaa

SEQ ID NO: 29971 - DNA, 25 bp, S. cerevisiae
gaagttttccacattaacaaacctg

SEQ ID NO: 29972 - DNA, 25 bp, S. cerevisiae
gaaattttaacgcttactgattcac

SEQ ID NO: 29973 - DNA, 25 bp, S. cerevisiae
gaaggtttgccctgcattgaacacg

SEQ ID NO: 29974 - DNA, 25 bp, S. cerevisiae
gaaggttgaccctcctgacgtagag

SEQ ID NO: 29975 - DNA, 25 bp, S. cerevisiae
gaagggttcccttttgagcgaaatg

SEQ ID NO: 29976 - DNA, 25 bp, S. cerevisiae
gaagggcgaaccattttgcagaaat

SEQ ID NO: 29977 - DNA, 25 bp, S. cerevisiae
gaagttgaagcgcttatttggcaaa

SEQ ID NO: 29978 - DNA, 25 bp, S. cerevisiae
gaagtcttacacctgtatagggctt

SEQ ID NO: 29979 - DNA, 25 bp, S. cerevisiae
gaaggcattcctgcttatcatgggt

SEQ ID NO: 29980 - DNA, 25 bp, S. cerevisiae
gaaggcatcttctcatttctaggtt

SEQ ID NO: 29981 - DNA, 25 bp, S. cerevisiae
gaagtgcatcaaaccatttctagat

SEQ ID NO: 29982 - DNA, 25 bp, S. cerevisiae
gaaggcagatgtcacatccttagat

SEQ ID NO: 29983 - DNA, 25 bp, S. cerevisiae
gaaggcatagcactttccgacaact

SEQ ID NO: 29984 - DNA, 25 bp, S. cerevisiae
gaaggcattccgcacgagaaactga

SEQ ID NO: 29985 - DNA, 25 bp, S. cerevisiae
gaagtaaacgctcccgaatacgaga

SEQ ID NO: 29986 - DNA, 25 bp, S. cerevisiae
gaaggcaagtctcactgttacaatg

SEQ ID NO: 29987 - DNA, 25 bp, S. cerevisiae
gaaggtatgattcttgctgccaaat

SEQ ID NO: 29988 - DNA, 25 bp, S. cerevisiae
gaaggctttctgatttgcaacaata

SEQ ID NO: 29989 - DNA, 25 bp, S. cerevisiae
gaaggcattatccattttatcaaaa

SEQ ID NO: 29990 - DNA, 25 bp, S. cerevisiae
gaaggcattagcatcgcttatgcaa

SEQ ID NO: 29991 - DNA, 25 bp, S. cerevisiae
gaaggcaatataagctgacgatccg

SEQ ID NO: 29992 - DNA, 25 bp, S. cerevisiae
gaaggctttgttcttgtctaagatc

SEQ ID NO: 29993 - DNA, 25 bp, S. cerevisiae
gaaattgttggtcacaactccaccc

SEQ ID NO: 29994 - DNA, 25 bp, S. cerevisiae
gaagtggttttgctggtacctacga

SEQ ID NO: 29995 - DNA, 25 bp, S. cerevisiae
gaagttcctttggatttatcccacg

SEQ ID NO: 29996 - DNA, 25 bp, S. cerevisiae
gaaggattttctggcatttgcttat

SEQ ID NO: 29997 - DNA, 25 bp, S. cerevisiae
gaaggatttcatgcgtttgtactct

SEQ ID NO: 29998 - DNA, 25 bp, S. cerevisiae
gaaggtgcctccagtagtgtcacat

SEQ ID NO: 29999 - DNA, 25 bp, S. cerevisiae
gaaggcgtgtgaactctcctatagc

SEQ ID NO: 30000 - DNA, 25 bp, S. cerevisiae
gaaggagtgataactctcctctgcc

SEQ ID NO: 30001 - DNA, 25 bp, S. cerevisiae
gaagaagctttatcccctgagttca

SEQ ID NO: 30002 - DNA, 25 bp, S. cerevisiae
gaaggatgcttttactcttaaatgt

SEQ ID NO: 30003 - DNA, 25 bp, S. cerevisiae
gaaggagtgttctctctctaacgag

SEQ ID NO: 30004 - DNA, 25 bp, S. cerevisiae
gaaggagtacactacctgttaggac

SEQ ID NO: 30005 - DNA, 25 bp, S. cerevisiae
gaaggaaatcacttcgctcgaagga

SEQ ID NO: 30006 - DNA, 25 bp, S. cerevisiae
gaaggatacgccacagactgaagta

SEQ ID NO: 30007 - DNA, 25 bp, S. cerevisiae
gaaggctacaccacagaagacgatt

SEQ ID NO: 30008 - DNA, 25 bp, S. cerevisiae
gaaggcttccaagagaacgcagctt

SEQ ID NO: 30009 - DNA, 25 bp, S. cerevisiae
gaaggctatctttgacgaaccattt

SEQ ID NO: 30010 - DNA, 25 bp, S. cerevisiae
gaaggcttctgttaactactccatt

SEQ ID NO: 30011 - DNA, 25 bp, S. cerevisiae
gaaggcttgccattggacactttat

SEQ ID NO: 30012 - DNA, 25 bp, S. cerevisiae
gaaggtctgccattacagcagcctt

SEQ ID NO: 30013 - DNA, 25 bp, S. cerevisiae
gaaggcttgcactttaatgtgtcat

SEQ ID NO: 30014 - DNA, 25 bp, S. cerevisiae
gaagtctctgctttggacttgtctc

SEQ ID NO: 30015 - DNA, 25 bp, S. cerevisiae
gaagtttggtggtatttgtccctca

SEQ ID NO: 30016 - DNA, 25 bp, S. cerevisiae
gaagtttgggacatctttgcccaga

SEQ ID NO: 30017 - DNA, 25 bp, S. cerevisiae
gaagtacatggagccctttgacctt

SEQ ID NO: 30018 - DNA, 25 bp, S. cerevisiae
gaaaactaggcagcccagtgacctg

SEQ ID NO: 30019 - DNA, 25 bp, S. cerevisiae
gaagcaacgaaagcccgctgggtag

SEQ ID NO: 30020 - DNA, 25 bp, S. cerevisiae
gaagacactggattactacgggtta

SEQ ID NO: 30021 - DNA, 25 bp, S. cerevisiae
gaaggactcattatctcaggcggtt

SEQ ID NO: 30022 - DNA, 25 bp, S. cerevisiae
gaaggactcagaaattaacgcagat

SEQ ID NO: 30023 - DNA, 25 bp, S. cerevisiae
gaaggatcctagtatacaggctcaa

SEQ ID NO: 30024 - DNA, 25 bp, S. cerevisiae
gaaggcattgcaaccatacagtaca

SEQ ID NO: 30025 - DNA, 25 bp, S. cerevisiae
gaaggaactcccatcaatacacgtc

SEQ ID NO: 30026 - DNA, 25 bp, S. cerevisiae
gaagctgaagtcctttcaacacccg

SEQ ID NO: 30027 - DNA, 25 bp, S. cerevisiae
gaagatgtccattttaaagtcccta

SEQ ID NO: 30028 - DNA, 25 bp, S. cerevisiae
gaagaggccttcctaaagacccgcg

SEQ ID NO: 30029 - DNA, 25 bp, S. cerevisiae
gaaggcatactacgccaagactatt

SEQ ID NO: 30030 - DNA, 25 bp, S. cerevisiae
gaaggtcatgagtgccaatgccaat

SEQ ID NO: 30031 - DNA, 25 bp, S. cerevisiae
gaaggatcttgaacactacattgat

SEQ ID NO: 30032 - DNA, 25 bp, S. cerevisiae
gaaggcattgcaattcttacctatg

SEQ ID NO: 30033 - DNA, 25 bp, S. cerevisiae
gaaggcttccccatacacatatttt

SEQ ID NO: 30034 - DNA, 25 bp, S. cerevisiae
gaaggtttcgccgtagaacgtgctg

SEQ ID NO: 30035 - DNA, 25 bp, S. cerevisiae
gaaggcttcacctctacgaatgagt

SEQ ID NO: 30036 - DNA, 25 bp, S. cerevisiae
gaaggatctaggtaccatcgttgaa

SEQ ID NO: 30037 - DNA, 25 bp, S. cerevisiae
gaaggcattcgacaccacaggagaa

SEQ ID NO: 30038 - DNA, 25 bp, S. cerevisiae
gaaggttcagaaattgccatatcat

SEQ ID NO: 30039 - DNA, 25 bp, S. cerevisiae
gaaggttcagttatcatcggcaaat

SEQ ID NO: 30040 - DNA, 25 bp, S. cerevisiae
gaagtccctaggcaatcatctgaga

SEQ ID NO: 30041 - DNA, 25 bp, S. cerevisiae
gaaggagcccgcaccaagattggaa

SEQ ID NO: 30042 - DNA, 25 bp, S. cerevisiae
gaagaacccctcgtgacaactggat

SEQ ID NO: 30043 - DNA, 25 bp, S. cerevisiae
gaagaggtccctatttcgaacgccg

SEQ ID NO: 30044 - DNA, 25 bp, S. cerevisiae
gaagagggcggtattttctactgga

SEQ ID NO: 30045 - DNA, 25 bp, S. cerevisiae
gaagtactcggtcatgtgttgctaa

SEQ ID NO: 30046 - DNA, 25 bp, S. cerevisiae
gaagtacattcaaaccgaacaacaa

SEQ ID NO: 30047 - DNA, 25 bp, S. cerevisiae
gaagttttcacaagtcgttatcaaa

SEQ ID NO: 30048 - DNA, 25 bp, S. cerevisiae
gaagggctacctaattctgatttaa

SEQ ID NO: 30049 - DNA, 25 bp, S. cerevisiae
gaagttgattcctctacatttataa

SEQ ID NO: 30050 - DNA, 25 bp, S. cerevisiae
gaaggttgtctttgttgctgattat

SEQ ID NO: 30051 - DNA, 25 bp, S. cerevisiae
gaagtgttccacgtgcacgtatcat

SEQ ID NO: 30052 - DNA, 25 bp, S. cerevisiae
gaagtgttccatgctgtagtcacaa

SEQ ID NO: 30053 - DNA, 25 bp, S. cerevisiae
gaaggtaccatcctaatacagcaac

SEQ ID NO: 30054 - DNA, 25 bp, S. cerevisiae
gaagagaactctattcccctgacag

SEQ ID NO: 30055 - DNA, 25 bp, S. cerevisiae
gaaggacagcacgttgttggccgaa

SEQ ID NO: 30056 - DNA, 25 bp, S. cerevisiae
gaaggaatcctacgtcgacaagcac

SEQ ID NO: 30057 - DNA, 25 bp, S. cerevisiae
gaagggatccagcaatggccatacc

SEQ ID NO: 30058 - DNA, 25 bp, S. cerevisiae
gaagtggatccgcaatccgcaagaa

SEQ ID NO: 30059 - DNA, 25 bp, S. cerevisiae
gaagtgcgacaagatcataactatc

SEQ ID NO: 30060 - DNA, 25 bp, S. cerevisiae
gaagtggcacctgatgaaatctcat

SEQ ID NO: 30061 - DNA, 25 bp, S. cerevisiae
gaaggagcaactacgccatttgaaa

SEQ ID NO: 30062 - DNA, 25 bp, S. cerevisiae
gaaggagctcactctggcgctatga

SEQ ID NO: 30063 - DNA, 25 bp, S. cerevisiae
gaaggaatcgcagctgactcatata

SEQ ID NO: 30064 - DNA, 25 bp, S. cerevisiae
gaagtagcagccatgcaaccagtta

SEQ ID NO: 30065 - DNA, 25 bp, S. cerevisiae
gaagaggctgctccaaagccaccat

SEQ ID NO: 30066 - DNA, 25 bp, S. cerevisiae
gaagggtgctattatacccctgaag

SEQ ID NO: 30067 - DNA, 25 bp, S. cerevisiae
gaaggtcactagcatgaccccagct

SEQ ID NO: 30068 - DNA, 25 bp, S. cerevisiae
gaaggaactagttactgctccacta

SEQ ID NO: 30069 - DNA, 25 bp, S. cerevisiae
gaaggtggttccattcctatcactt

SEQ ID NO: 30070 - DNA, 25 bp, S. cerevisiae
gaagaggtttctcaaccagagccta

SEQ ID NO: 30071 - DNA, 25 bp, S. cerevisiae
gaagtggctcgttagtaaacatcat

SEQ ID NO: 30072 - DNA, 25 bp, S. cerevisiae
gaagggcccatatgcattcaaatac

SEQ ID NO: 30073 - DNA, 25 bp, S. cerevisiae
gaaggtcccaatgctaaaggacacc

SEQ ID NO: 30074 - DNA, 25 bp, S. cerevisiae
gaaggtccgtatctacaaggtctct

SEQ ID NO: 30075 - DNA, 25 bp, S. cerevisiae
gaaggactcaacgaagaaaacgcta

SEQ ID NO: 30076 - DNA, 25 bp, S. cerevisiae
gaagtgccaccataagagaaacgta

SEQ ID NO: 30077 - DNA, 25 bp, S. cerevisiae
gacggccaaaacttgaaggacttat

SEQ ID NO: 30078 - DNA, 25 bp, S. cerevisiae
gaagagccgaaaaaattggacattt

SEQ ID NO: 30079 - DNA, 25 bp, S. cerevisiae
gaagtgatttggcattcctttgcta

SEQ ID NO: 30080 - DNA, 25 bp, S. cerevisiae
gaagtgcgttgagtgacccgtatct

SEQ ID NO: 30081 - DNA, 25 bp, S. cerevisiae
gaaggtgttgcaaaccccattatga

SEQ ID NO: 30082 - DNA, 25 bp, S. cerevisiae
gaagggattaaacctccattcgata

SEQ ID NO: 30083 - DNA, 25 bp, S. cerevisiae
gaagtggattacttacccagtcgat

SEQ ID NO: 30084 - DNA, 25 bp, S. cerevisiae
gaagttgacaagtttcccgtcgaag

SEQ ID NO: 30085 - DNA, 25 bp, S. cerevisiae
gaagtccacaattgttaccgtagat

SEQ ID NO: 30086 - DNA, 25 bp, S. cerevisiae
gaagtcccaaaggtcgtcgatgata

SEQ ID NO: 30087 - DNA, 25 bp, S. cerevisiae
gaagttccaaatttctttgctgaaa

SEQ ID NO: 30088 - DNA, 25 bp, S. cerevisiae
gaagttccaatatgcgttggccaag

SEQ ID NO: 30089 - DNA, 25 bp, S. cerevisiae
gaaggttcataacgtttggcctgga

SEQ ID NO: 30090 - DNA, 25 bp, S. cerevisiae
gaaggttctaaagtcgatccctcta

SEQ ID NO: 30091 - DNA, 25 bp, S. cerevisiae
gaaggttctaaaatcgttgccggag

SEQ ID NO: 30092 - DNA, 25 bp, S. cerevisiae
gaaggtgtaagctttcccatattct

SEQ ID NO: 30093 - DNA, 25 bp, S. cerevisiae
gaagattggcagctttcccagtttt

SEQ ID NO: 30094 - DNA, 25 bp, S. cerevisiae
gaagtgtacctatttccagttgttt

SEQ ID NO: 30095 - DNA, 25 bp, S. cerevisiae
gaagttcctttacttggtattgcta

SEQ ID NO: 30096 - DNA, 25 bp, S. cerevisiae
gaagtgtcctgtatgcgatcgattt

SEQ ID NO: 30097 - DNA, 25 bp, S. cerevisiae
gaaggttcattttcgcgcttggcaa

SEQ ID NO: 30098 - DNA, 25 bp, S. cerevisiae
gaaggtatttcttctactgctggaa

SEQ ID NO: 30099 - DNA, 25 bp, S. cerevisiae
gaagttaccttagatgctcttgaaa

SEQ ID NO: 30100 - DNA, 25 bp, S. cerevisiae
gaagtttgacgaactactacagttt

SEQ ID NO: 30101 - DNA, 25 bp, S. cerevisiae
gaagatcctgaagacccaacaacct

SEQ ID NO: 30102 - DNA, 25 bp, S. cerevisiae
gaagtcttgaagttcctaacagatc

SEQ ID NO: 30103 - DNA, 25 bp, S. cerevisiae
gaagtcttggcaatttctagaaacg

SEQ ID NO: 30104 - DNA, 25 bp, S. cerevisiae
gaaggttgtgatcgttaagccacac

SEQ ID NO: 30105 - DNA, 25 bp, S. cerevisiae
gaagggtatggcagctctagcacga

SEQ ID NO: 30106 - DNA, 25 bp, S. cerevisiae
gaaggtgctgcaatgatccgtacca

SEQ ID NO: 30107 - DNA, 25 bp, S. cerevisiae
gaaggatgccaattccattatcaag

SEQ ID NO: 30108 - DNA, 25 bp, S. cerevisiae
gaaggatccagaacctctaagaaga

SEQ ID NO: 30109 - DNA, 25 bp, S. cerevisiae
gaaggaccagataccacctctgaaa

SEQ ID NO: 30110 - DNA, 25 bp, S. cerevisiae
gaaggattcgaaccctcttaatgag

SEQ ID NO: 30111 - DNA, 25 bp, S. cerevisiae
gaagtactcaagctgcgttccaacg

SEQ ID NO: 30112 - DNA, 25 bp, S. cerevisiae
gaagtcttcgtatcagattctaaag

SEQ ID NO: 30113 - DNA, 25 bp, S. cerevisiae
gaaggtacgtcaacagttccaaaag

SEQ ID NO: 30114 - DNA, 25 bp, S. cerevisiae
gaagttacggcaaccttaaaagctg

SEQ ID NO: 30115 - DNA, 25 bp, S. cerevisiae
gaagtgtttcaagtcgacccagaat

SEQ ID NO: 30116 - DNA, 25 bp, S. cerevisiae
gaagtagtgatttgtccacccgtat

SEQ ID NO: 30117 - DNA, 25 bp, S. cerevisiae
gaagtttagttccacatcgcgttat

SEQ ID NO: 30118 - DNA, 25 bp, S. cerevisiae
gaagttttgactgcagacctttccc

SEQ ID NO: 30119 - DNA, 25 bp, S. cerevisiae
gaaggtgggactccaacagcccata

SEQ ID NO: 30120 - DNA, 25 bp, S. cerevisiae
gaagtagggcacttagacccacagg

SEQ ID NO: 30121 - DNA, 25 bp, S. cerevisiae
gaagggcggagcttacctgccgaat

SEQ ID NO: 30122 - DNA, 25 bp, S. cerevisiae
gaagggcggttcgtcccaagagcat

SEQ ID NO: 30123 - DNA, 25 bp, S. cerevisiae
gaagaccggtttcgcattctagaac

SEQ ID NO: 30124 - DNA, 25 bp, S. cerevisiae
gaaggtccagctctaattctaaaac

SEQ ID NO: 30125 - DNA, 25 bp, S. cerevisiae
gaagttcggtgtccttatttgcgat

SEQ ID NO: 30126 - DNA, 25 bp, S. cerevisiae
gaagttttgtacgtcacctgcttac

SEQ ID NO: 30127 - DNA, 25 bp, S. cerevisiae
gaagttatcttggtcgaccctcaac

SEQ ID NO: 30128 - DNA, 25 bp, S. cerevisiae
gaagttttgcaatctgttatcgcag

SEQ ID NO: 30129 - DNA, 25 bp, S. cerevisiae
gaagtcattggtgataagccctcgt

SEQ ID NO: 30130 - DNA, 25 bp, S. cerevisiae
gaagaggaggtcaaacaggccacca

SEQ ID NO: 30131 - DNA, 25 bp, S. cerevisiae
gaagcaaagcaaccaaaggaaccaa

SEQ ID NO: 30132 - DNA, 25 bp, S. cerevisiae
gaagtactgcaccatgtgaccgtga

SEQ ID NO: 30133 - DNA, 25 bp, S. cerevisiae
gaagttctacgcagagctagctgag

SEQ ID NO: 30134 - DNA, 25 bp, S. cerevisiae
gaagttgtcactaatgcagccgctg

SEQ ID NO: 30135 - DNA, 25 bp, S. cerevisiae
gaagatgtcgtgttaccatcgccgg

SEQ ID NO: 30136 - DNA, 25 bp, S. cerevisiae
gaaggttctgcagtcagcacaagac

SEQ ID NO: 30137 - DNA, 25 bp, S. cerevisiae
gaagaggttgagtcgcagcagtatc

SEQ ID NO: 30138 - DNA, 25 bp, S. cerevisiae
gaaggtgagagccagatccaaataa

SEQ ID NO: 30139 - DNA, 25 bp, S. cerevisiae
gaagggcaaggaatctctcaaggaa

SEQ ID NO: 30140 - DNA, 25 bp, S. cerevisiae
gaagggcaagcgattcccgatggaa

SEQ ID NO: 30141 - DNA, 25 bp, S. cerevisiae
gaaggatttcgaattagctcacaag

SEQ ID NO: 30142 - DNA, 25 bp, S. cerevisiae
gaagtctaagggtgctgctccagaa

SEQ ID NO: 30143 - DNA, 25 bp, S. cerevisiae
gaagtgctgcgaaagggctgcccaa

SEQ ID NO: 30144 - DNA, 25 bp, S. cerevisiae
gaagtggttctttggatcgctctat

SEQ ID NO: 30145 - DNA, 25 bp, S. cerevisiae
gaagtgtgcttcatacggccctaaa

SEQ ID NO: 30146 - DNA, 25 bp, S. cerevisiae
gaaggtttcatcaaggtgcatccta

SEQ ID NO: 30147 - DNA, 25 bp, S. cerevisiae
gaagggctattatctatcatccaac

SEQ ID NO: 30148 - DNA, 25 bp, S. cerevisiae
gaagggtgaatctactccaccacat

SEQ ID NO: 30149 - DNA, 25 bp, S. cerevisiae
gaagtccttcttgacctacattaag

SEQ ID NO: 30150 - DNA, 25 bp, S. cerevisiae
gaagtcctctttgccaattctttgg

SEQ ID NO: 30151 - DNA, 25 bp, S. cerevisiae
gaagatatcgtattccttatttttg

SEQ ID NO: 30152 - DNA, 25 bp, S. cerevisiae
gaaggtactcaattcttggccaagt

SEQ ID NO: 30153 - DNA, 25 bp, S. cerevisiae
gaagggactgcgttgttagccaaaa

SEQ ID NO: 30154 - DNA, 25 bp, S. cerevisiae
gaaggtgctgctggtcgtgtatcat

SEQ ID NO: 30155 - DNA, 25 bp, S. cerevisiae
gaaggtgcttttgggtcatcaggtc

SEQ ID NO: 30156 - DNA, 25 bp, S. cerevisiae
gaagacggcaatacggccacaggac

SEQ ID NO: 30157 - DNA, 25 bp, S. cerevisiae
gaagattgccaaatgcgaccccgaa

SEQ ID NO: 30158 - DNA, 25 bp, S. cerevisiae
gaagtatctcaagtggacctccacc

SEQ ID NO: 30159 - DNA, 25 bp, S. cerevisiae
gaaggtcattgagacattctacccc

SEQ ID NO: 30160 - DNA, 25 bp, S. cerevisiae
gaaggtataggcctacttatcccca

SEQ ID NO: 30161 - DNA, 25 bp, S. cerevisiae
gaagagaaaggcgtacccacctcac

SEQ ID NO: 30162 - DNA, 25 bp, S. cerevisiae
gaagttcgatggctacaccaacaca

SEQ ID NO: 30163 - DNA, 25 bp, S. cerevisiae
gaagtacgatgtctactcgtccaca

SEQ ID NO: 30164 - DNA, 25 bp, S. cerevisiae
gaagtatgacaagctctgccgagtt

SEQ ID NO: 30165 - DNA, 25 bp, S. cerevisiae
gaagtctgccaaggctaccaaggct

SEQ ID NO: 30166 - DNA, 25 bp, S. cerevisiae
gaagcttcggaggaaccacaggctc

SEQ ID NO: 30167 - DNA, 25 bp, S. cerevisiae
gaagatatgctgctggaaccaccgt

SEQ ID NO: 30168 - DNA, 25 bp, S. cerevisiae
gaagaaattactggacgccctcaaa

SEQ ID NO: 30169 - DNA, 25 bp, S. cerevisiae
gaagaaattccggaacctgctaaag

SEQ ID NO: 30170 - DNA, 25 bp, S. cerevisiae
gaagatacctttgacaacttacaac

SEQ ID NO: 30171 - DNA, 25 bp, S. cerevisiae
gaagttcttcgacccaagagtctgg

SEQ ID NO: 30172 - DNA, 25 bp, S. cerevisiae
gaaggtttcgattccatcaaagcta

SEQ ID NO: 30173 - DNA, 25 bp, S. cerevisiae
gaaggtttctggtttcaaggatgaa

SEQ ID NO: 30174 - DNA, 25 bp, S. cerevisiae
gaagtttcttcctttatgacgtata

SEQ ID NO: 30175 - DNA, 25 bp, S. cerevisiae
gaagtctgtgttccgtctatacacg

SEQ ID NO: 30176 - DNA, 25 bp, S. cerevisiae
gaagtctttcgctgaccaagccaag

SEQ ID NO: 30177 - DNA, 25 bp, S. cerevisiae
gaagtatttcactgaccaagtcaaa

SEQ ID NO: 30178 - DNA, 25 bp, S. cerevisiae
gaagatttccattagaaaggcccca

SEQ ID NO: 30179 - DNA, 25 bp, S. cerevisiae
gaagtggctccaacacatacagata

SEQ ID NO: 30180 - DNA, 25 bp, S. cerevisiae
gaagtggccgcatccacaatacaat

SEQ ID NO: 30181 - DNA, 25 bp, S. cerevisiae
gaagtcaagtattccaatcaccgaa

SEQ ID NO: 30182 - DNA, 25 bp, S. cerevisiae
gaaggtagtatgtcccagctgtgct

SEQ ID NO: 30183 - DNA, 25 bp, S. cerevisiae
gaagttttgcttttcaatggcgtca

SEQ ID NO: 30184 - DNA, 25 bp, S. cerevisiae
gaagttcaaccctcgcagaaagcaa

SEQ ID NO: 30185 - DNA, 25 bp, S. cerevisiae
gaaggtaccctttctgagatactca

SEQ ID NO: 30186 - DNA, 25 bp, S. cerevisiae
gaagtttcctcttacatggacaccg

SEQ ID NO: 30187 - DNA, 25 bp, S. cerevisiae
gaagggtgctttccatttggcacaa

SEQ ID NO: 30188 - DNA, 25 bp, S. cerevisiae
gaagggtatcttcattgctagtaga

SEQ ID NO: 30189 - DNA, 25 bp, S. cerevisiae
gaagggtttcttttctgttcagaca

SEQ ID NO: 30190 - DNA, 25 bp, S. cerevisiae
gaaggtgctgtttccggtatgtcac

SEQ ID NO: 30191 - DNA, 25 bp, S. cerevisiae
gaagtgtcagttagcctcggtgtac

SEQ ID NO: 30192 - DNA, 25 bp, S. cerevisiae
gaagtgatgctcttggtaggcattt

SEQ ID NO: 30193 - DNA, 25 bp, S. cerevisiae
gaagtggtcgagctacgcattccct

SEQ ID NO: 30194 - DNA, 25 bp, S. cerevisiae
gaagggtgacacttacgtttccatc

SEQ ID NO: 30195 - DNA, 25 bp, S. cerevisiae
gaagtcatatatgcgcccgttctta

SEQ ID NO: 30196 - DNA, 25 bp, S. cerevisiae
gaagttgcatgaaacgccccattta

SEQ ID NO: 30197 - DNA, 25 bp, S. cerevisiae
gaagatgctttatgccggcgcatta

SEQ ID NO: 30198 - DNA, 25 bp, S. cerevisiae
gaagttttcatgtccaggctgttca

SEQ ID NO: 30199 - DNA, 25 bp, S. cerevisiae
gaaggtcttgtgtttggctgttgcc

SEQ ID NO: 30200 - DNA, 25 bp, S. cerevisiae
gaagactacattatcggctgccaag

SEQ ID NO: 30201 - DNA, 25 bp, S. cerevisiae
gaagactgtctagcgggctgtctag

SEQ ID NO: 30202 - DNA, 25 bp, S. cerevisiae
gaagatccactaaaggcgttgtact

SEQ ID NO: 30203 - DNA, 25 bp, S. cerevisiae
gactacccgggcactgaaaacatgg

SEQ ID NO: 30204 - DNA, 25 bp, S. cerevisiae
gaagaccctgggaacgagaattctg

SEQ ID NO: 30205 - DNA, 25 bp, S. cerevisiae
gaactacctgagttgacaaaaacta

SEQ ID NO: 30206 - DNA, 25 bp, S. cerevisiae
gaagttcactcatttgaccaacaat

SEQ ID NO: 30207 - DNA, 25 bp, S. cerevisiae
gaagttccatcgatatcgcaacctg

SEQ ID NO: 30208 - DNA, 25 bp, S. cerevisiae
gaagttcacctttccaaaatgatgg

SEQ ID NO: 30209 - DNA, 25 bp, S. cerevisiae
gaagttgacgttccttatgatgagt

SEQ ID NO: 30210 - DNA, 25 bp, S. cerevisiae
gaagttggcctaccttattcagagt

SEQ ID NO: 30211 - DNA, 25 bp, S. cerevisiae
gaagttatttattcttgattatgag

SEQ ID NO: 30212 - DNA, 25 bp, S. cerevisiae
gaagttattccttcttggcctagaa

SEQ ID NO: 30213 - DNA, 25 bp, S. cerevisiae
gaagttcaaaaatggcgtctgcagt

SEQ ID NO: 30214 - DNA, 25 bp, S. cerevisiae
gaacttccggaattactgagcccga

SEQ ID NO: 30215 - DNA, 25 bp, S. cerevisiae
gaagttctgcgtgtttctaatacta

SEQ ID NO: 30216 - DNA, 25 bp, S. cerevisiae
gaagttccattgattttccattctc

SEQ ID NO: 30217 - DNA, 25 bp, S. cerevisiae
gaagttcctttcattaccattcatc

SEQ ID NO: 30218 - DNA, 25 bp, S. cerevisiae
gaagattctttactggctacgccct

SEQ ID NO: 30219 - DNA, 25 bp, S. cerevisiae
gaagttcgtctcaattatccatgga

SEQ ID NO: 30220 - DNA, 25 bp, S. cerevisiae
gaagtacctgatgtcaacgctctaa

SEQ ID NO: 30221 - DNA, 25 bp, S. cerevisiae
gaagctatgctgatcccaaccttag

SEQ ID NO: 30222 - DNA, 25 bp, S. cerevisiae
gaagatgggtgttccatacgccatt

SEQ ID NO: 30223 - DNA, 25 bp, S. cerevisiae
gaagtggttcattccatgtcgaatt

SEQ ID NO: 30224 - DNA, 25 bp, S. cerevisiae
gaagggatcatccaccatgattgat

SEQ ID NO: 30225 - DNA, 25 bp, S. cerevisiae
gaaggtgtctctgccatgatatgct

SEQ ID NO: 30226 - DNA, 25 bp, S. cerevisiae
gaaggtgtctctgtatttgctatgt

SEQ ID NO: 30227 - DNA, 25 bp, S. cerevisiae
gaagggtatcccatctacttatgat

SEQ ID NO: 30228 - DNA, 25 bp, S. cerevisiae
gaagtacttccccttaattcaattg

SEQ ID NO: 30229 - DNA, 25 bp, S. cerevisiae
gaagtactgtctccgttaatcctag

SEQ ID NO: 30230 - DNA, 25 bp, S. cerevisiae
gaagaactggctcgcgtaacaccat

SEQ ID NO: 30231 - DNA, 25 bp, S. cerevisiae
gaagatctcgttagcgtgaaccaag

SEQ ID NO: 30232 - DNA, 25 bp, S. cerevisiae
gaagttgcgtctacttaacggtgga

SEQ ID NO: 30233 - DNA, 25 bp, S. cerevisiae
gaagtgcattaaaatctaccgagga

SEQ ID NO: 30234 - DNA, 25 bp, S. cerevisiae
gaagagcccaacttttcgatcagat

SEQ ID NO: 30235 - DNA, 25 bp, S. cerevisiae
gaagtgaccctgtttatcaaatgat

SEQ ID NO: 30236 - DNA, 25 bp, S. cerevisiae
gaagtgccctacagaactaatgaag

SEQ ID NO: 30237 - DNA, 25 bp, S. cerevisiae
gaagtcacacttccccagtaataga

SEQ ID NO: 30238 - DNA, 25 bp, S. cerevisiae
gaagatacaattccgagcctatggg

SEQ ID NO: 30239 - DNA, 25 bp, S. cerevisiae
gaagtaacagcgacggctctagcag

SEQ ID NO: 30240 - DNA, 25 bp, S. cerevisiae
gaagttatccggtagtttgctttat

SEQ ID NO: 30241 - DNA, 25 bp, S. cerevisiae
gaagagtgctccactaaacgttttt

SEQ ID NO: 30242 - DNA, 25 bp, S. cerevisiae
gaagacctataacgccttatgtccc

SEQ ID NO: 30243 - DNA, 25 bp, S. cerevisiae
gaagagttcttctgtcgtttcccta

SEQ ID NO: 30244 - DNA, 25 bp, S. cerevisiae
gaagagcttcttgcgctttttatcc

SEQ ID NO: 30245 - DNA, 25 bp, S. cerevisiae
gaagagctgtcctggcttcggtaac

SEQ ID NO: 30246 - DNA, 25 bp, S. cerevisiae
gaagcaagtcgctggttccttgaaa

SEQ ID NO: 30247 - DNA, 25 bp, S. cerevisiae
gaagatggacctcgttttttagcct

SEQ ID NO: 30248 - DNA, 25 bp, S. cerevisiae
gaagtgcccttgttttggaggatca

SEQ ID NO: 30249 - DNA, 25 bp, S. cerevisiae
gaagtgagcactattttcagggaaa

SEQ ID NO: 30250 - DNA, 25 bp, S. cerevisiae
gaacgagtcgatcttcctgggaaaa

SEQ ID NO: 30251 - DNA, 25 bp, S. cerevisiae
gaagaagggcttcactctgggaaaa

SEQ ID NO: 30252 - DNA, 25 bp, S. cerevisiae
gaagacggcgtcatttcggtggaaa

SEQ ID NO: 30253 - DNA, 25 bp, S. cerevisiae
gaagccaggtccatggctgggtaaa

SEQ ID NO: 30254 - DNA, 25 bp, S. cerevisiae
gaagcagatggtggcttgccttact

SEQ ID NO: 30255 - DNA, 25 bp, S. cerevisiae
gaagtatagtgcctacgctacacat

SEQ ID NO: 30256 - DNA, 25 bp, S. cerevisiae
gaagtctacgccatgataccaagtt

SEQ ID NO: 30257 - DNA, 25 bp, S. cerevisiae
gaagtagtcccaagatcagccacag

SEQ ID NO: 30258 - DNA, 25 bp, S. cerevisiae
gaagtatcaggaaatcatctgcacg

SEQ ID NO: 30259 - DNA, 25 bp, S. cerevisiae
gaagtacgagctttcatgcatcaac

SEQ ID NO: 30260 - DNA, 25 bp, S. cerevisiae
gaagtatcggttacacacatccctg

SEQ ID NO: 30261 - DNA, 25 bp, S. cerevisiae
gaagtacggatcaaccaatacgagg

SEQ ID NO: 30262 - DNA, 25 bp, S. cerevisiae
gaagatattgctgtacctgatacga

SEQ ID NO: 30263 - DNA, 25 bp, S. cerevisiae
gaagtcattcccactgtgaatctaa

SEQ ID NO: 30264 - DNA, 25 bp, S. cerevisiae
gaagtctagcactgccgtcgatata

SEQ ID NO: 30265 - DNA, 25 bp, S. cerevisiae
gaagagccagatgcggttaatgacg

SEQ ID NO: 30266 - DNA, 25 bp, S. cerevisiae
gaagtctatgtctattttgaactct

SEQ ID NO: 30267 - DNA, 25 bp, S. cerevisiae
gaagaaaccgagagagctgcaaaat

SEQ ID NO: 30268 - DNA, 25 bp, S. cerevisiae
gaagtaaacggcatcactgatccaa

SEQ ID NO: 30269 - DNA, 25 bp, S. cerevisiae
gaagtttaacagcttatgctccgaa

SEQ ID NO: 30270 - DNA, 25 bp, S. cerevisiae
gaagtgttctgaagtcattcccact

SEQ ID NO: 30271 - DNA, 25 bp, S. cerevisiae
gaagtaccgatgtctgctctttgat

SEQ ID NO: 30272 - DNA, 25 bp, S. cerevisiae
gaagtgtctcgatctcttgaaaact

SEQ ID NO: 30273 - DNA, 25 bp, S. cerevisiae
gaagtgctgtcgtttcttgaatata

SEQ ID NO: 30274 - DNA, 25 bp, S. cerevisiae
gaagtctgctcacccagctagattt

SEQ ID NO: 30275 - DNA, 25 bp, S. cerevisiae
gaagacaaaccccacgattcattag

SEQ ID NO: 30276 - DNA, 25 bp, S. cerevisiae
gaagaagaatccaccacttccgaga

SEQ ID NO: 30277 - DNA, 25 bp, S. cerevisiae
gaagaacgtcggtccttgtacagga

SEQ ID NO: 30278 - DNA, 25 bp, S. cerevisiae
gaagagtaatccacaaccagcttat

SEQ ID NO: 30279 - DNA, 25 bp, S. cerevisiae
gaagatttcgtcaagttggccccag

SEQ ID NO: 30280 - DNA, 25 bp, S. cerevisiae
gaagatctttggtgtttgccccata

SEQ ID NO: 30281 - DNA, 25 bp, S. cerevisiae
gaagagagcttgatttatctaccaa

SEQ ID NO: 30282 - DNA, 25 bp, S. cerevisiae
gaagaagttttctgattggcctact

SEQ ID NO: 30283 - DNA, 25 bp, S. cerevisiae
gaagattcacgatgttttgggctac

SEQ ID NO: 30284 - DNA, 25 bp, S. cerevisiae
gaagtttttcgcaagcagcaagcta

SEQ ID NO: 30285 - DNA, 25 bp, S. cerevisiae
gaagtttcttcgcaagatcctgaca

SEQ ID NO: 30286 - DNA, 25 bp, S. cerevisiae
gaagttgtcttctgcggaattgaga

SEQ ID NO: 30287 - DNA, 25 bp, S. cerevisiae
gaagtttctatcttgcatggtgatt

SEQ ID NO: 30288 - DNA, 25 bp, S. cerevisiae
gaagtctctgatatcgatgttacta

SEQ ID NO: 30289 - DNA, 25 bp, S. cerevisiae
gaagtcttgactcctgctgattgga

SEQ ID NO: 30290 - DNA, 25 bp, S. cerevisiae
gaagtactaccttgtgttgagcagt

SEQ ID NO: 30291 - DNA, 25 bp, S. cerevisiae
gaagatgccgttgtctcctctgatt

SEQ ID NO: 30292 - DNA, 25 bp, S. cerevisiae
gaagttcatcctctatctttttata

SEQ ID NO: 30293 - DNA, 25 bp, S. cerevisiae
gaagattgttcgatttgcctatgta

SEQ ID NO: 30294 - DNA, 25 bp, S. cerevisiae
gaagtcctgactcataagggcattt

SEQ ID NO: 30295 - DNA, 25 bp, S. cerevisiae
gaagtgccttgctgaagatagtgta

SEQ ID NO: 30296 - DNA, 25 bp, S. cerevisiae
gaagatcccgtgaacgagcttgttg

SEQ ID NO: 30297 - DNA, 25 bp, S. cerevisiae
gaagacgctgagttacaagctctat

SEQ ID NO: 30298 - DNA, 25 bp, S. cerevisiae
gaagtcgtgcgttatttctggcata

SEQ ID NO: 30299 - DNA, 25 bp, S. cerevisiae
gaagtaatcgatgcactcgtctctc

SEQ ID NO: 30300 - DNA, 25 bp, S. cerevisiae
gaagataagaaacctgtcgtcgaca

SEQ ID NO: 30301 - DNA, 25 bp, S. cerevisiae
gaagtacgacgacctgttgaaaata

SEQ ID NO: 30302 - DNA, 25 bp, S. cerevisiae
gaagaaagaccccttagccttcatc

SEQ ID NO: 30303 - DNA, 25 bp, S. cerevisiae
gaagatgcaccatgtcttattcagt

SEQ ID NO: 30304 - DNA, 25 bp, S. cerevisiae
gaagtgccatgagttcttcaccact

SEQ ID NO: 30305 - DNA, 25 bp, S. cerevisiae
gaagatgcctgattcgcaagcaaac

SEQ ID NO: 30306 - DNA, 25 bp, S. cerevisiae
gaacccagaatctgacaaatccaag

SEQ ID NO: 30307 - DNA, 25 bp, S. cerevisiae
gaacccaaatataacgacaccaccg

SEQ ID NO: 30308 - DNA, 25 bp, S. cerevisiae
gacagaggttcacggcattgcattt

SEQ ID NO: 30309 - DNA, 25 bp, S. cerevisiae
gaagacgacgattttgatgactttc

SEQ ID NO: 30310 - DNA, 25 bp, S. cerevisiae
gaagactacggtttactgattgcaa

SEQ ID NO: 30311 - DNA, 25 bp, S. cerevisiae
gaagtcccagagattcgtgcatcta

SEQ ID NO: 30312 - DNA, 25 bp, S. cerevisiae
gaagtactctcttttagcacctagt

SEQ ID NO: 30313 - DNA, 25 bp, S. cerevisiae
gaagtctactcttttatgacagata

SEQ ID NO: 30314 - DNA, 25 bp, S. cerevisiae
gaagtctcttcggtatatatcagat

SEQ ID NO: 30315 - DNA, 25 bp, S. cerevisiae
gaagagtttgagatctcgctgttga

SEQ ID NO: 30316 - DNA, 25 bp, S. cerevisiae
gaagagtgcaaccatcattcagatg

SEQ ID NO: 30317 - DNA, 25 bp, S. cerevisiae
gaagatcaaccccttgaggccatgg

SEQ ID NO: 30318 - DNA, 25 bp, S. cerevisiae
gaagtaactaccagtgatccacagt

SEQ ID NO: 30319 - DNA, 25 bp, S. cerevisiae
gaagttgacgacgatttcaccaatg

SEQ ID NO: 30320 - DNA, 25 bp, S. cerevisiae
gaagttcagcgattgattcccctat

SEQ ID NO: 30321 - DNA, 25 bp, S. cerevisiae
gaagtactcgaaaatctaacgtatg

SEQ ID NO: 30322 - DNA, 25 bp, S. cerevisiae
gaagtatttcccaagagcgtagtta

SEQ ID NO: 30323 - DNA, 25 bp, S. cerevisiae
gaagttttcccaaatcgaaacactg

SEQ ID NO: 30324 - DNA, 25 bp, S. cerevisiae
gaagtcgttcccagccagtgaaaat

SEQ ID NO: 30325 - DNA, 25 bp, S. cerevisiae
gaagtcgttttacctcatgatgaat

SEQ ID NO: 30326 - DNA, 25 bp, S. cerevisiae
gaagtctgttgctaagctgttgaaa

SEQ ID NO: 30327 - DNA, 25 bp, S. cerevisiae
gaagtcgtcgcagccatgttcaaaa

SEQ ID NO: 30328 - DNA, 25 bp, S. cerevisiae
gaagtcgtacctccatttgaaaaca

SEQ ID NO: 30329 - DNA, 25 bp, S. cerevisiae
gaagatttgactatttgcgaactaa

SEQ ID NO: 30330 - DNA, 25 bp, S. cerevisiae
gaagatttcctcactccgaattgat

SEQ ID NO: 30331 - DNA, 25 bp, S. cerevisiae
gaagattctttgatccctaatgtga

SEQ ID NO: 30332 - DNA, 25 bp, S. cerevisiae
gaagtctaccatgcatacactgaag

SEQ ID NO: 30333 - DNA, 25 bp, S. cerevisiae
gaagattgcccgataacattgcagg

SEQ ID NO: 30334 - DNA, 25 bp, S. cerevisiae
gaagattcctctagtggcacttatg

SEQ ID NO: 30335 - DNA, 25 bp, S. cerevisiae
gaagattcaactgatgctgacttat

SEQ ID NO: 30336 - DNA, 25 bp, S. cerevisiae
gaagttatcatcagagctaccagaa

SEQ ID NO: 30337 - DNA, 25 bp, S. cerevisiae
gaagatgcaaagaaagaccccgagt

SEQ ID NO: 30338 - DNA, 25 bp, S. cerevisiae
gaagagaactagaagacttaagaga

SEQ ID NO: 30339 - DNA, 25 bp, S. cerevisiae
gaagaacacgaaagccccattgatg

SEQ ID NO: 30340 - DNA, 25 bp, S. cerevisiae
gaagaacctggatgtaagcactgat

SEQ ID NO: 30341 - DNA, 25 bp, S. cerevisiae
gaagatgaactgaagagccaaccta

SEQ ID NO: 30342 - DNA, 25 bp, S. cerevisiae
gagctgaaactaggtggcgactcaa

SEQ ID NO: 30343 - DNA, 25 bp, S. cerevisiae
gaagtagcactagtgtggcacctaa

SEQ ID NO: 30344 - DNA, 25 bp, S. cerevisiae
gaagtagccctcaatgacaacgaag

SEQ ID NO: 30345 - DNA, 25 bp, S. cerevisiae
gaagtcagcgcattcgccaaattga

SEQ ID NO: 30346 - DNA, 25 bp, S. cerevisiae
gaagatcagcgatgccaccaaattg

SEQ ID NO: 30347 - DNA, 25 bp, S. cerevisiae
gaagactgtttcaccaaattgggag

SEQ ID NO: 30348 - DNA, 25 bp, S. cerevisiae
gaagaacgtcttgcctagtgtggag

SEQ ID NO: 30349 - DNA, 25 bp, S. cerevisiae
gaagtcacagctttcaactcgttcg

SEQ ID NO: 30350 - DNA, 25 bp, S. cerevisiae
gaagcttcagctcaaactcaggctc

SEQ ID NO: 30351 - DNA, 25 bp, S. cerevisiae
gaagaagacgtatcctacacctcta

SEQ ID NO: 30352 - DNA, 25 bp, S. cerevisiae
gaagacaaccatcagttaacctttt

SEQ ID NO: 30353 - DNA, 25 bp, S. cerevisiae
gaagaccttaagatacgcacggcag

SEQ ID NO: 30354 - DNA, 25 bp, S. cerevisiae
gaagttcttatagttcccaaggcat

SEQ ID NO: 30355 - DNA, 25 bp, S. cerevisiae
gaagaccttgatgaacccaaatttg

SEQ ID NO: 30356 - DNA, 25 bp, S. cerevisiae
gaagatgtcgcctctactaaaaccg

SEQ ID NO: 30357 - DNA, 25 bp, S. cerevisiae
gaacttcagcgactagagaggatac

SEQ ID NO: 30358 - DNA, 25 bp, S. cerevisiae
gaagctacagcgtctcaatggccat

SEQ ID NO: 30359 - DNA, 25 bp, S. cerevisiae
gaagaacaacaggaatcaaaacgta

SEQ ID NO: 30360 - DNA, 25 bp, S. cerevisiae
gaagacccacaagacattgacactg

SEQ ID NO: 30361 - DNA, 25 bp, S. cerevisiae
gaagtatactgcaagcatcaccgaa

SEQ ID NO: 30362 - DNA, 25 bp, S. cerevisiae
gaagtatactgggactcgcgcatag

SEQ ID NO: 30363 - DNA, 25 bp, S. cerevisiae
gaagttattggcaatccacccagta

SEQ ID NO: 30364 - DNA, 25 bp, S. cerevisiae
gaagattaaggaagccagggcaata

SEQ ID NO: 30365 - DNA, 25 bp, S. cerevisiae
gaagtttgacaaccacatcggcaat

SEQ ID NO: 30366 - DNA, 25 bp, S. cerevisiae
gaagttatacaacccataggagcaa

SEQ ID NO: 30367 - DNA, 25 bp, S. cerevisiae
gaagttatattagcctgcgacacag

SEQ ID NO: 30368 - DNA, 25 bp, S. cerevisiae
gaagattgaatttccacctccaagt

SEQ ID NO: 30369 - DNA, 25 bp, S. cerevisiae
gaagaagccatatccgttccagctt

SEQ ID NO: 30370 - DNA, 25 bp, S. cerevisiae
gaagagaccattcaaggctccatct

SEQ ID NO: 30371 - DNA, 25 bp, S. cerevisiae
gaagttccacatgaaggtgctatgt

SEQ ID NO: 30372 - DNA, 25 bp, S. cerevisiae
gaagttcccagagatgtgacgatgt

SEQ ID NO: 30373 - DNA, 25 bp, S. cerevisiae
gaagttacaaaccagtgatgcacga

SEQ ID NO: 30374 - DNA, 25 bp, S. cerevisiae
gaacatttcgtagcagatagcccct

SEQ ID NO: 30375 - DNA, 25 bp, S. cerevisiae
gaagaattgttcacgaacccctcgg

SEQ ID NO: 30376 - DNA, 25 bp, S. cerevisiae
gaagtttttcaataccacctccgag

SEQ ID NO: 30377 - DNA, 25 bp, S. cerevisiae
gaagtttcttgccagaaggcacctt

SEQ ID NO: 30378 - DNA, 25 bp, S. cerevisiae
gaagttccaggtcacaatgccaagt

SEQ ID NO: 30379 - DNA, 25 bp, S. cerevisiae
gaagttatcccatagacaagcatct

SEQ ID NO: 30380 - DNA, 25 bp, S. cerevisiae
gaagttagccacactagcagcatct

SEQ ID NO: 30381 - DNA, 25 bp, S. cerevisiae
gaagttacaacatctccttcttctc

SEQ ID NO: 30382 - DNA, 25 bp, S. cerevisiae
gaagttgccaacttgggtgattctt

SEQ ID NO: 30383 - DNA, 25 bp, S. cerevisiae
gaagttgctatccagagattttata

SEQ ID NO: 30384 - DNA, 25 bp, S. cerevisiae
gaagttcgtccaagattcgtcaaca

SEQ ID NO: 30385 - DNA, 25 bp, S. cerevisiae
gaagttcctaatagtgtcagcccac

SEQ ID NO: 30386 - DNA, 25 bp, S. cerevisiae
gaagattgtcttccgttgctcggag

SEQ ID NO: 30387 - DNA, 25 bp, S. cerevisiae
gaagttcacttcacatccaatgaga

SEQ ID NO: 30388 - DNA, 25 bp, S. cerevisiae
gaagaaagcttcatcactagtggaa

SEQ ID NO: 30389 - DNA, 25 bp, S. cerevisiae
gaagaaacgtctaagccattgcaac

SEQ ID NO: 30390 - DNA, 25 bp, S. cerevisiae
gaagatatgacgtttgagcctgaaa

SEQ ID NO: 30391 - DNA, 25 bp, S. cerevisiae
gaagatttcaagtttgccctccgta

SEQ ID NO: 30392 - DNA, 25 bp, S. cerevisiae
gaagttattcaaagtccctccgatg

SEQ ID NO: 30393 - DNA, 25 bp, S. cerevisiae
gaagtattgtacgtgctgctataaa

SEQ ID NO: 30394 - DNA, 25 bp, S. cerevisiae
gaagttcgtactgctgtatccaatg

SEQ ID NO: 30395 - DNA, 25 bp, S. cerevisiae
gaagattcggacactctatccaaat

SEQ ID NO: 30396 - DNA, 25 bp, S. cerevisiae
gaagattgtctactcaaacgctgtt

SEQ ID NO: 30397 - DNA, 25 bp, S. cerevisiae
gaagatatgctcattgcccggtttt

SEQ ID NO: 30398 - DNA, 25 bp, S. cerevisiae
gaagataatagtcgccagggtaata

SEQ ID NO: 30399 - DNA, 25 bp, S. cerevisiae
gaagaactaggagtcgtcgaaggca

SEQ ID NO: 30400 - DNA, 25 bp, S. cerevisiae
gaaacactagatgcggccagaacca

SEQ ID NO: 30401 - DNA, 25 bp, S. cerevisiae
gaagatcgtattttagttggaagct

SEQ ID NO: 30402 - DNA, 25 bp, S. cerevisiae
gaagacgttttaagggctatcaccg

SEQ ID NO: 30403 - DNA, 25 bp, S. cerevisiae
gaagaacgtcactgggatgcatata

SEQ ID NO: 30404 - DNA, 25 bp, S. cerevisiae
gaagatgacgaccacgacgacgaaa

SEQ ID NO: 30405 - DNA, 25 bp, S. cerevisiae
gaagatcttgtccatcagattgaag

SEQ ID NO: 30406 - DNA, 25 bp, S. cerevisiae
gaagttctcaaaagctgtacacgga

SEQ ID NO: 30407 - DNA, 25 bp, S. cerevisiae
gaacaaacgcactacaccggtgttt

SEQ ID NO: 30408 - DNA, 25 bp, S. cerevisiae
gaactaacgcgattaccgcagtttt

SEQ ID NO: 30409 - DNA, 25 bp, S. cerevisiae
gaagaaagccgaataccccactttg

SEQ ID NO: 30410 - DNA, 25 bp, S. cerevisiae
gaagaaacacgcagggccaaccgtc

SEQ ID NO: 30411 - DNA, 25 bp, S. cerevisiae
gaagacgcttacttatgtcattggt

SEQ ID NO: 30412 - DNA, 25 bp, S. cerevisiae
gaagatgtgttgaagctgccgcaga

SEQ ID NO: 30413 - DNA, 25 bp, S. cerevisiae
gaagatgcagggacaatgccgcaaa

SEQ ID NO: 30414 - DNA, 25 bp, S. cerevisiae
gaagatcagctaacagatgaccaaa

SEQ ID NO: 30415 - DNA, 25 bp, S. cerevisiae
gaagaacctcacgataccacggaaa

SEQ ID NO: 30416 - DNA, 25 bp, S. cerevisiae
gaagatatcttctctatctccggta

SEQ ID NO: 30417 - DNA, 25 bp, S. cerevisiae
gaagatatgttcaatttaccagatg

SEQ ID NO: 30418 - DNA, 25 bp, S. cerevisiae
gaagattatgagctctctccacaag

SEQ ID NO: 30419 - DNA, 25 bp, S. cerevisiae
gaagcagtaccattcaagctgacga

SEQ ID NO: 30420 - DNA, 25 bp, S. cerevisiae
gaagacgcaccagaagatgccgagc

SEQ ID NO: 30421 - DNA, 25 bp, S. cerevisiae
gaagaccgactccaagatgcgtaag

SEQ ID NO: 30422 - DNA, 25 bp, S. cerevisiae
gaagaccgctctcaaatacttggta

SEQ ID NO: 30423 - DNA, 25 bp, S. cerevisiae
gaagaaggtcaaactctccacgtaa

SEQ ID NO: 30424 - DNA, 25 bp, S. cerevisiae
gaagatagcctcgatcatggatcca

SEQ ID NO: 30425 - DNA, 25 bp, S. cerevisiae
gaagatgacctttgcagagagccag

SEQ ID NO: 30426 - DNA, 25 bp, S. cerevisiae
gaagatgaatcttatgccagagcat

SEQ ID NO: 30427 - DNA, 25 bp, S. cerevisiae
gaagttcacagttccaaaggcgtat

SEQ ID NO: 30428 - DNA, 25 bp, S. cerevisiae
gaagttaccttgcaaagggctttat

SEQ ID NO: 30429 - DNA, 25 bp, S. cerevisiae
gaagttccctgtataaggccattgt

SEQ ID NO: 30430 - DNA, 25 bp, S. cerevisiae
gaagactcctttttaaggcctaatg

SEQ ID NO: 30431 - DNA, 25 bp, S. cerevisiae
gaagacaacgtcttgtaggccctaa

SEQ ID NO: 30432 - DNA, 25 bp, S. cerevisiae
gaagatttgtactgttctccgctat

SEQ ID NO: 30433 - DNA, 25 bp, S. cerevisiae
gaagaaggatacctgggaccccatt

SEQ ID NO: 30434 - DNA, 25 bp, S. cerevisiae
gaagttacaacagtggagacctcct

SEQ ID NO: 30435 - DNA, 25 bp, S. cerevisiae
gaagaaacaacagcgagacctccta

SEQ ID NO: 30436 - DNA, 25 bp, S. cerevisiae
gaagaacctcaagataccctcctag

SEQ ID NO: 30437 - DNA, 25 bp, S. cerevisiae
gaaaaagctaggttaaccatccctg

SEQ ID NO: 30438 - DNA, 25 bp, S. cerevisiae
gaagacaagttgcacttacccacct

SEQ ID NO: 30439 - DNA, 25 bp, S. cerevisiae
gaagttcttggattcagttcatcac

SEQ ID NO: 30440 - DNA, 25 bp, S. cerevisiae
gaagttccaggattttgatgcacag

SEQ ID NO: 30441 - DNA, 25 bp, S. cerevisiae
gaagattcatcgtcaatttatgcca

SEQ ID NO: 30442 - DNA, 25 bp, S. cerevisiae
gaagattcacgtctatgtacgccaa

SEQ ID NO: 30443 - DNA, 25 bp, S. cerevisiae
gaagttcatcggtgattttgccatt

SEQ ID NO: 30444 - DNA, 25 bp, S. cerevisiae
gaagattcgtggtcgcaatttgtag

SEQ ID NO: 30445 - DNA, 25 bp, S. cerevisiae
gaagacaactcatccaacgcatggt

SEQ ID NO: 30446 - DNA, 25 bp, S. cerevisiae
gaagatagctctcagccaaagatga

SEQ ID NO: 30447 - DNA, 25 bp, S. cerevisiae
gaagatgatgctataccacaacgat

SEQ ID NO: 30448 - DNA, 25 bp, S. cerevisiae
gaagaattaggtgacaacgctgttt

SEQ ID NO: 30449 - DNA, 25 bp, S. cerevisiae
gaagaaaacttccaacacgcgtgta

SEQ ID NO: 30450 - DNA, 25 bp, S. cerevisiae
gaagaactcagtgccataacggtga

SEQ ID NO: 30451 - DNA, 25 bp, S. cerevisiae
gaagaactcgatgatgccggcctta

SEQ ID NO: 30452 - DNA, 25 bp, S. cerevisiae
gaagatattgacactgctgccttaa

SEQ ID NO: 30453 - DNA, 25 bp, S. cerevisiae
gaagatgaaatcaaggatcccaact

SEQ ID NO: 30454 - DNA, 25 bp, S. cerevisiae
gaagataacgaacccagcgcaacga

SEQ ID NO: 30455 - DNA, 25 bp, S. cerevisiae
gaagatattgctaaggccaccaaag

SEQ ID NO: 30456 - DNA, 25 bp, S. cerevisiae
gaagatcatatcattctcgacacta

SEQ ID NO: 30457 - DNA, 25 bp, S. cerevisiae
gaagatatcaggatccgagcacaaa

SEQ ID NO: 30458 - DNA, 25 bp, S. cerevisiae
gaagatgaagccaccattcacaaga

SEQ ID NO: 30459 - DNA, 25 bp, S. cerevisiae
gaagatattgtctccaacataaacg

SEQ ID NO: 30460 - DNA, 25 bp, S. cerevisiae
gaagcacaagttaccgttgaaccag

SEQ ID NO: 30461 - DNA, 25 bp, S. cerevisiae
gaagatgcaagttccctgttgccca

SEQ ID NO: 30462 - DNA, 25 bp, S. cerevisiae
gaagatccaatcatccaaaggctaa

SEQ ID NO: 30463 - DNA, 25 bp, S. cerevisiae
gaagattgcgacgtctccaaagtta

SEQ ID NO: 30464 - DNA, 25 bp, S. cerevisiae
gaagagccataccaagtccggtgaa

SEQ ID NO: 30465 - DNA, 25 bp, S. cerevisiae
gaagacggcaaaagccctgaggaaa

SEQ ID NO: 30466 - DNA, 25 bp, S. cerevisiae
gaagaagtcaacaccatgtgggaag

SEQ ID NO: 30467 - DNA, 25 bp, S. cerevisiae
gaagaagtgcttaactcggaggaac

SEQ ID NO: 30468 - DNA, 25 bp, S. cerevisiae
gaacgtgccgattggttgtcaagac

SEQ ID NO: 30469 - DNA, 25 bp, S. cerevisiae
gaagatcctcagcaagtatttgatg

SEQ ID NO: 30470 - DNA, 25 bp, S. cerevisiae
gaagacctgggattgtccgatatca

SEQ ID NO: 30471 - DNA, 25 bp, S. cerevisiae
gaagttgatgctgctcttgatttaa

SEQ ID NO: 30472 - DNA, 25 bp, S. cerevisiae
gaacatggatgctgctacggcttta

SEQ ID NO: 30473 - DNA, 25 bp, S. cerevisiae
gaaatggtgcagtgccagccgttcc

SEQ ID NO: 30474 - DNA, 25 bp, S. cerevisiae
gaagttgaactgtcatccgatgcct

SEQ ID NO: 30475 - DNA, 25 bp, S. cerevisiae
gaagttgcatgacatcccggacgaa

SEQ ID NO: 30476 - DNA, 25 bp, S. cerevisiae
gaagagttagtgtccaccgccgata

SEQ ID NO: 30477 - DNA, 25 bp, S. cerevisiae
gaagagttattgttcccattcgcac

SEQ ID NO: 30478 - DNA, 25 bp, S. cerevisiae
gaagacttactactccgattatgcg

SEQ ID NO: 30479 - DNA, 25 bp, S. cerevisiae
gaagacaattctttcgctttactag

SEQ ID NO: 30480 - DNA, 25 bp, S. cerevisiae
gaagaggtctattctcctagtataa

SEQ ID NO: 30481 - DNA, 25 bp, S. cerevisiae
gaagaagcttcatctgcgtacagga

SEQ ID NO: 30482 - DNA, 25 bp, S. cerevisiae
gaagaacatcttttttacaggagca

SEQ ID NO: 30483 - DNA, 25 bp, S. cerevisiae
gaagaaccggatattgcagcgttta

SEQ ID NO: 30484 - DNA, 25 bp, S. cerevisiae
gaagattgccgcgatccgtgactac

SEQ ID NO: 30485 - DNA, 25 bp, S. cerevisiae
gaagattgaccggagcgatgacaaa

SEQ ID NO: 30486 - DNA, 25 bp, S. cerevisiae
gaagattaccagtcacgagatccaa

SEQ ID NO: 30487 - DNA, 25 bp, S. cerevisiae
gaagattgcccattgacgagtacat

SEQ ID NO: 30488 - DNA, 25 bp, S. cerevisiae
gaagatagcccatcacagagatgct

SEQ ID NO: 30489 - DNA, 25 bp, S. cerevisiae
gaagatacatgcctgccatctatgt

SEQ ID NO: 30490 - DNA, 25 bp, S. cerevisiae
gaagatttacatacctgtgtcgcac

SEQ ID NO: 30491 - DNA, 25 bp, S. cerevisiae
gaagacatgtactaacagtccccgc

SEQ ID NO: 30492 - DNA, 25 bp, S. cerevisiae
gaagaccaaagatcaatcccctgca

SEQ ID NO: 30493 - DNA, 25 bp, S. cerevisiae
gaagatgtcaaaaaccacccctggt

SEQ ID NO: 30494 - DNA, 25 bp, S. cerevisiae
gaacgtacgattcttcggtgccatt

SEQ ID NO: 30495 - DNA, 25 bp, S. cerevisiae
gaacctccttgtcttcaagacctgt

SEQ ID NO: 30496 - DNA, 25 bp, S. cerevisiae
gaaactcccggtgatctagacgtgt

SEQ ID NO: 30497 - DNA, 25 bp, S. cerevisiae
gaagactccacaagttactcagaca

SEQ ID NO: 30498 - DNA, 25 bp, S. cerevisiae
gaagatccctctatgctagtagcaa

SEQ ID NO: 30499 - DNA, 25 bp, S. cerevisiae
gaagatcccctgcaatagtagcgat

SEQ ID NO: 30500 - DNA, 25 bp, S. cerevisiae
gaagaaccctgactatcgtgaagag

SEQ ID NO: 30501 - DNA, 25 bp, S. cerevisiae
gaagaccccattgttgaagcaatat

SEQ ID NO: 30502 - DNA, 25 bp, S. cerevisiae
gaagaacgccatacccgaaatattt

SEQ ID NO: 30503 - DNA, 25 bp, S. cerevisiae
gaagcaacgcttccccagaaaaaga

SEQ ID NO: 30504 - DNA, 25 bp, S. cerevisiae
gaagcatggtttatcgaaggtcaaa

SEQ ID NO: 30505 - DNA, 25 bp, S. cerevisiae
gaagatcctttcactgaccaatcaa

SEQ ID NO: 30506 - DNA, 25 bp, S. cerevisiae
gaagatatttccacgcgtagataag

SEQ ID NO: 30507 - DNA, 25 bp, S. cerevisiae
gaagatattcctgttgccactgaga

SEQ ID NO: 30508 - DNA, 25 bp, S. cerevisiae
gaagatctatcaggtttcccggaat

SEQ ID NO: 30509 - DNA, 25 bp, S. cerevisiae
gaagaggatcacatctttccggcaa

SEQ ID NO: 30510 - DNA, 25 bp, S. cerevisiae
gaagaggtcaaacatactgccgaca

SEQ ID NO: 30511 - DNA, 25 bp, S. cerevisiae
gaagaatggcaatactactccgaag

SEQ ID NO: 30512 - DNA, 25 bp, S. cerevisiae
gaagaacctattccattaccagaag

SEQ ID NO: 30513 - DNA, 25 bp, S. cerevisiae
gaagaccagtttctatcacgaggga

SEQ ID NO: 30514 - DNA, 25 bp, S. cerevisiae
gaagagcatcctttatttgaacggt

SEQ ID NO: 30515 - DNA, 25 bp, S. cerevisiae
gaagatccagatgctgacactctat

SEQ ID NO: 30516 - DNA, 25 bp, S. cerevisiae
gaagctgcaagttactaccgtcaga

SEQ ID NO: 30517 - DNA, 25 bp, S. cerevisiae
gaagatggcctaacagcagacgaat

SEQ ID NO: 30518 - DNA, 25 bp, S. cerevisiae
gaagattcacttatggatgtaccta

SEQ ID NO: 30519 - DNA, 25 bp, S. cerevisiae
gaagataccaacttggctgccattc

SEQ ID NO: 30520 - DNA, 25 bp, S. cerevisiae
gaagatattagtgcgtgctccctat

SEQ ID NO: 30521 - DNA, 25 bp, S. cerevisiae
gaagatggcccaattcctatcatgg

SEQ ID NO: 30522 - DNA, 25 bp, S. cerevisiae
gaagaggctatcctgatcagttcag

SEQ ID NO: 30523 - DNA, 25 bp, S. cerevisiae
gaagcagagcttcatgccatttatg

SEQ ID NO: 30524 - DNA, 25 bp, S. cerevisiae
gaagaagctacccaatctctatacc

SEQ ID NO: 30525 - DNA, 25 bp, S. cerevisiae
gaagaaattgcccagttctgccaac

SEQ ID NO: 30526 - DNA, 25 bp, S. cerevisiae
gaacatcatcatccggaagagccat

SEQ ID NO: 30527 - DNA, 25 bp, S. cerevisiae
gaagcaatccacaaacagatagcat

SEQ ID NO: 30528 - DNA, 25 bp, S. cerevisiae
gaagctttacaggtcgggttcaaca

SEQ ID NO: 30529 - DNA, 25 bp, S. cerevisiae
gaagctttgtcagagccagtggtac

SEQ ID NO: 30530 - DNA, 25 bp, S. cerevisiae
gaagatcacttttaccaattggaaa

SEQ ID NO: 30531 - DNA, 25 bp, S. cerevisiae
gaagagcttcattgttcccaagaga

SEQ ID NO: 30532 - DNA, 25 bp, S. cerevisiae
gaagagcctcctttgcctaagagaa

SEQ ID NO: 30533 - DNA, 25 bp, S. cerevisiae
gaagatactcaggatataccacaag

SEQ ID NO: 30534 - DNA, 25 bp, S. cerevisiae
gaagacctgatggtagacctcaaca

SEQ ID NO: 30535 - DNA, 25 bp, S. cerevisiae
gaagatggctctatggacaccgata

SEQ ID NO: 30536 - DNA, 25 bp, S. cerevisiae
gaagaaaccgtccacaccaataatg

SEQ ID NO: 30537 - DNA, 25 bp, S. cerevisiae
gaagagtcgcgcctaaatgatacta

SEQ ID NO: 30538 - DNA, 25 bp, S. cerevisiae
gaagcaaccgcctcaatagattata

SEQ ID NO: 30539 - DNA, 25 bp, S. cerevisiae
gaagaattggccttggaagatcaaa

SEQ ID NO: 30540 - DNA, 25 bp, S. cerevisiae
gaagactcaccggaggctagacata

SEQ ID NO: 30541 - DNA, 25 bp, S. cerevisiae
gaagagctcgccatttgtaggcaac

SEQ ID NO: 30542 - DNA, 25 bp, S. cerevisiae
gaagagaggcctattgtcgcagata

SEQ ID NO: 30543 - DNA, 25 bp, S. cerevisiae
gaagatatcccattccgggactcat

SEQ ID NO: 30544 - DNA, 25 bp, S. cerevisiae
gaagcaaaacaaccggcacagcctt

SEQ ID NO: 30545 - DNA, 25 bp, S. cerevisiae
gaagaaagtcaactcgcccagcgat

SEQ ID NO: 30546 - DNA, 25 bp, S. cerevisiae
gaagcaaagggacctcctcatcgaa

SEQ ID NO: 30547 - DNA, 25 bp, S. cerevisiae
gaagatgtacagactgcgggctaga

SEQ ID NO: 30548 - DNA, 25 bp, S. cerevisiae
gaagatgtgccacctcagttaccaa

SEQ ID NO: 30549 - DNA, 25 bp, S. cerevisiae
gaagaggacgacgacttcccaagaa

SEQ ID NO: 30550 - DNA, 25 bp, S. cerevisiae
gaagacgaagatgacaccccagata

SEQ ID NO: 30551 - DNA, 25 bp, S. cerevisiae
gaagatcgatcgtcacaaatccata

SEQ ID NO: 30552 - DNA, 25 bp, S. cerevisiae
gaagatgccgtagcttgtctaagaa

SEQ ID NO: 30553 - DNA, 25 bp, S. cerevisiae
gaagatctcctaacaatcattgaaa

SEQ ID NO: 30554 - DNA, 25 bp, S. cerevisiae
gaagctaccgcgtcgaaatggcaat

SEQ ID NO: 30555 - DNA, 25 bp, S. cerevisiae
gaagaaccacttcagaaagcactgg

SEQ ID NO: 30556 - DNA, 25 bp, S. cerevisiae
gaagaacgaccccagaatgtacagt

SEQ ID NO: 30557 - DNA, 25 bp, S. cerevisiae
gaagcaatcgactccaaatcaaact

SEQ ID NO: 30558 - DNA, 25 bp, S. cerevisiae
gaagactggccttacaaacaagcaa

SEQ ID NO: 30559 - DNA, 25 bp, S. cerevisiae
gaagatccttctttaagagcctcca

SEQ ID NO: 30560 - DNA, 25 bp, S. cerevisiae
gaagatccttggtatggtgacatac

SEQ ID NO: 30561 - DNA, 25 bp, S. cerevisiae
gaagatctcttctcatttcacctaa

SEQ ID NO: 30562 - DNA, 25 bp, S. cerevisiae
gaagatgcttgtctcagttcaccag

SEQ ID NO: 30563 - DNA, 25 bp, S. cerevisiae
gaagagctgttcatacttgcccgaa

SEQ ID NO: 30564 - DNA, 25 bp, S. cerevisiae
gaagatggtagaacgctgtcggact

SEQ ID NO: 30565 - DNA, 25 bp, S. cerevisiae
gaagatcttcattccttggttaaca

SEQ ID NO: 30566 - DNA, 25 bp, S. cerevisiae
gaagataacgtcatggccgctctag

SEQ ID NO: 30567 - DNA, 25 bp, S. cerevisiae
gaagatcctgtcacagtgggcgatt

SEQ ID NO: 30568 - DNA, 25 bp, S. cerevisiae
gaagatcctggtgcagtaggcctat

SEQ ID NO: 30569 - DNA, 25 bp, S. cerevisiae
gaagcaaaatctgtacctcccattc

SEQ ID NO: 30570 - DNA, 25 bp, S. cerevisiae
gaagagaatccttttcgcttctttc

SEQ ID NO: 30571 - DNA, 25 bp, S. cerevisiae
gaagagggtctcgatgaccgctttt

SEQ ID NO: 30572 - DNA, 25 bp, S. cerevisiae
gaagacgattccagcaacagttgtt

SEQ ID NO: 30573 - DNA, 25 bp, S. cerevisiae
gaagatccctctattgattgcctac

SEQ ID NO: 30574 - DNA, 25 bp, S. cerevisiae
gaagaactttgttatgtctattcac

SEQ ID NO: 30575 - DNA, 25 bp, S. cerevisiae
gaagagctccttgttgtcatttcac

SEQ ID NO: 30576 - DNA, 25 bp, S. cerevisiae
gaagactcctgcgaacggatcttga

SEQ ID NO: 30577 - DNA, 25 bp, S. cerevisiae
gaagagctatccgaagcgcgccagt

SEQ ID NO: 30578 - DNA, 25 bp, S. cerevisiae
gaagatgccatcgaatcggctccag

SEQ ID NO: 30579 - DNA, 25 bp, S. cerevisiae
gaagatgctatggtatttgtcgatt

SEQ ID NO: 30580 - DNA, 25 bp, S. cerevisiae
gaagacgatgagttgcttgccttta

SEQ ID NO: 30581 - DNA, 25 bp, S. cerevisiae
gaagacaagagattgcctgcaccct

SEQ ID NO: 30582 - DNA, 25 bp, S. cerevisiae
gaagagatatgcaagacctaccaga

SEQ ID NO: 30583 - DNA, 25 bp, S. cerevisiae
gaagatgatctgcaagaggttcaag

SEQ ID NO: 30584 - DNA, 25 bp, S. cerevisiae
gaagagcacgctgaggctttcaaga

SEQ ID NO: 30585 - DNA, 25 bp, S. cerevisiae
gaagacacctcaatttttggccaaa

SEQ ID NO: 30586 - DNA, 25 bp, S. cerevisiae
gaagcagcggtaactactccaacta

SEQ ID NO: 30587 - DNA, 25 bp, S. cerevisiae
gaagatgcgtcattaatacctcata

SEQ ID NO: 30588 - DNA, 25 bp, S. cerevisiae
gaagacgacaaactaccacatgaag

SEQ ID NO: 30589 - DNA, 25 bp, S. cerevisiae
gaagagtttctcagagccatcagac

SEQ ID NO: 30590 - DNA, 25 bp, S. cerevisiae
gaagaatctctgaaaacggtcaaag

SEQ ID NO: 30591 - DNA, 25 bp, S. cerevisiae
gaagaactccattcaacagcgtatg

SEQ ID NO: 30592 - DNA, 25 bp, S. cerevisiae
gaagacctctcagaatcgttttaat

SEQ ID NO: 30593 - DNA, 25 bp, S. cerevisiae
gaagacgattctccaatgattttaa

SEQ ID NO: 30594 - DNA, 25 bp, S. cerevisiae
gaaccaattgggtaacttcttgcaa

SEQ ID NO: 30595 - DNA, 25 bp, S. cerevisiae
gaacttacggccaaacttgtcagaa

SEQ ID NO: 30596 - DNA, 25 bp, S. cerevisiae
gaacctgtacccacacttcaagcta

SEQ ID NO: 30597 - DNA, 25 bp, S. cerevisiae
gaaccaaacgctaaaatctgcttac

SEQ ID NO: 30598 - DNA, 25 bp, S. cerevisiae
gaagaacttgcgtctagaccagtta

SEQ ID NO: 30599 - DNA, 25 bp, S. cerevisiae
gaagagatcctgcaattactcgcat

SEQ ID NO: 30600 - DNA, 25 bp, S. cerevisiae
gaagagtcatcatggacatcgtcct

SEQ ID NO: 30601 - DNA, 25 bp, S. cerevisiae
gaagatgttataccagctccaccta

SEQ ID NO: 30602 - DNA, 25 bp, S. cerevisiae
gaagagctgctacgacaacaagagg

SEQ ID NO: 30603 - DNA, 25 bp, S. cerevisiae
gaagcagcagcatggccaatcacaa

SEQ ID NO: 30604 - DNA, 25 bp, S. cerevisiae
gaacagcccggcgtagatgatgaag

SEQ ID NO: 30605 - DNA, 25 bp, S. cerevisiae
gaagagctccaaccatagtgaacaa

SEQ ID NO: 30606 - DNA, 25 bp, S. cerevisiae
gaagacgctccacaaatcaacattg

SEQ ID NO: 30607 - DNA, 25 bp, S. cerevisiae
gaagaccactgacgaaatccctgat

SEQ ID NO: 30608 - DNA, 25 bp, S. cerevisiae
gaagacgacgacgacagttccatgt

SEQ ID NO: 30609 - DNA, 25 bp, S. cerevisiae
gaagacgccaatgacttatccagtt

SEQ ID NO: 30610 - DNA, 25 bp, S. cerevisiae
gaagccgccagagaactagaagtta

SEQ ID NO: 30611 - DNA, 25 bp, S. cerevisiae
gaagagacatacacgaattggcaaa

SEQ ID NO: 30612 - DNA, 25 bp, S. cerevisiae
gaagacctacatacgcagctttaac

SEQ ID NO: 30613 - DNA, 25 bp, S. cerevisiae
gaagacgctcaactcgacgtagaac

SEQ ID NO: 30614 - DNA, 25 bp, S. cerevisiae
gaagagcttctattgtacttgtaca

SEQ ID NO: 30615 - DNA, 25 bp, S. cerevisiae
gaagatgttcattcgtccgttgcaa

SEQ ID NO: 30616 - DNA, 25 bp, S. cerevisiae
gaagatgttgagtcccacgaaaaat

SEQ ID NO: 30617 - DNA, 25 bp, S. cerevisiae
gaagagttgttcctccagaactcaa

SEQ ID NO: 30618 - DNA, 25 bp, S. cerevisiae
gaagacatggttttcccaactgaaa

SEQ ID NO: 30619 - DNA, 25 bp, S. cerevisiae
gaagacatcgttctaccatatgtga

SEQ ID NO: 30620 - DNA, 25 bp, S. cerevisiae
gaagaactaggctaggctctgcccc

SEQ ID NO: 30621 - DNA, 25 bp, S. cerevisiae
gaagacctttcgatttctaatttca

SEQ ID NO: 30622 - DNA, 25 bp, S. cerevisiae
gaagatgtctatgtttctccattga

SEQ ID NO: 30623 - DNA, 25 bp, S. cerevisiae
gaagcagtctcttatatccagcctt

SEQ ID NO: 30624 - DNA, 25 bp, S. cerevisiae
gaagagaaattcaacgcagccatta

SEQ ID NO: 30625 - DNA, 25 bp, S. cerevisiae
gaagagaaatcttagccgctgttaa

SEQ ID NO: 30626 - DNA, 25 bp, S. cerevisiae
gaagaacacagctagagacgcttat

SEQ ID NO: 30627 - DNA, 25 bp, S. cerevisiae
gaagagcccgctagatgataagcta

SEQ ID NO: 30628 - DNA, 25 bp, S. cerevisiae
gaagacactcccagcatgaacaata

SEQ ID NO: 30629 - DNA, 25 bp, S. cerevisiae
gaagaggagcccatgcgagaacata

SEQ ID NO: 30630 - DNA, 25 bp, S. cerevisiae
gaagaaagccacctcgatgatataa

SEQ ID NO: 30631 - DNA, 25 bp, S. cerevisiae
gaagaatactcagttgcagcacaaa

SEQ ID NO: 30632 - DNA, 25 bp, S. cerevisiae
gaagcactactaagaccaggacgat

SEQ ID NO: 30633 - DNA, 25 bp, S. cerevisiae
gtacgggattcaaaccaggctctgc

SEQ ID NO: 30634 - DNA, 25 bp, S. cerevisiae
gaagatggaattctaccggcacgaa

SEQ ID NO: 30635 - DNA, 25 bp, S. cerevisiae
gaagcatccaaacaaccggacttga

SEQ ID NO: 30636 - DNA, 25 bp, S. cerevisiae
gaactaaacatgcaaccgggtcgga

SEQ ID NO: 30637 - DNA, 25 bp, S. cerevisiae
gaagccaacaagcaacgctgaggaa

SEQ ID NO: 30638 - DNA, 25 bp, S. cerevisiae
gaagctaacattggccgtggaagaa

SEQ ID NO: 30639 - DNA, 25 bp, S. cerevisiae
gaagaaccatttccgctgagtgaac

SEQ ID NO: 30640 - DNA, 25 bp, S. cerevisiae
gaagaccagcttaagtcacgtgaaa

SEQ ID NO: 30641 - DNA, 25 bp, S. cerevisiae
gaagacctctgtattatctgaacaa

SEQ ID NO: 30642 - DNA, 25 bp, S. cerevisiae
gaagaccacgtctgttctgaaactg

SEQ ID NO: 30643 - DNA, 25 bp, S. cerevisiae
gaagaccaagttcctgttgaaacta

SEQ ID NO: 30644 - DNA, 25 bp, S. cerevisiae
gaagaccagcagattctccaaagtt

SEQ ID NO: 30645 - DNA, 25 bp, S. cerevisiae
gaagaactcgttactcaaaccatgg

SEQ ID NO: 30646 - DNA, 25 bp, S. cerevisiae
gaagaagctgctttactcataaaag

SEQ ID NO: 30647 - DNA, 25 bp, S. cerevisiae
gaagaaactcggtcgccgtcaagtt

SEQ ID NO: 30648 - DNA, 25 bp, S. cerevisiae
gaagaaaccgatttgccagtcagcg

SEQ ID NO: 30649 - DNA, 25 bp, S. cerevisiae
gaagaacaaacaactccctgcaaag

SEQ ID NO: 30650 - DNA, 25 bp, S. cerevisiae
gaagacagaaacaagatccaccaat

SEQ ID NO: 30651 - DNA, 25 bp, S. cerevisiae
gaagacagaaacaagatccaccaat

SEQ ID NO: 30652 - DNA, 25 bp, S. cerevisiae
gaagagggacaacatcacgcacaaa

SEQ ID NO: 30653 - DNA, 25 bp, S. cerevisiae
gaagacgtgatcaagggctgctcca

SEQ ID NO: 30654 - DNA, 25 bp, S. cerevisiae
gaagaatatctctgcaggctgccta

SEQ ID NO: 30655 - DNA, 25 bp, S. cerevisiae
gaagacatactaccaacagttacat

SEQ ID NO: 30656 - DNA, 25 bp, S. cerevisiae
gaagactactacaacacaggccaat

SEQ ID NO: 30657 - DNA, 25 bp, S. cerevisiae
gaagactatagacatcgcggcaata

SEQ ID NO: 30658 - DNA, 25 bp, S. cerevisiae
gaagacgatcacaactccgagggcg

SEQ ID NO: 30659 - DNA, 25 bp, S. cerevisiae
gaagacgcttctatcaaggccaagg

SEQ ID NO: 30660 - DNA, 25 bp, S. cerevisiae
gaagaagtctctaaaaggcaccatg

SEQ ID NO: 30661 - DNA, 25 bp, S. cerevisiae
gaagcacgtgctcaagtcacaaccg

SEQ ID NO: 30662 - DNA, 25 bp, S. cerevisiae
gaagcacctgcatatgattcgacgg

SEQ ID NO: 30663 - DNA, 25 bp, S. cerevisiae
gaagctaagctaaccttgcacgggt

SEQ ID NO: 30664 - DNA, 25 bp, S. cerevisiae
gaagaaacttttatgctccttttga

SEQ ID NO: 30665 - DNA, 25 bp, S. cerevisiae
gaagaataccgtcaagtccgtctgg

SEQ ID NO: 30666 - DNA, 25 bp, S. cerevisiae
gaagctaaccaagaagtcccatcat

SEQ ID NO: 30667 - DNA, 25 bp, S. cerevisiae
gaactggtcgcataacaaggatact

SEQ ID NO: 30668 - DNA, 25 bp, S. cerevisiae
gaagctaatccttaacagcggataa

SEQ ID NO: 30669 - DNA, 25 bp, S. cerevisiae
gaagcttacgccactcaagtcaaga

SEQ ID NO: 30670 - DNA, 25 bp, S. cerevisiae
gaagacgaagtctccagggccaaga

SEQ ID NO: 30671 - DNA, 25 bp, S. cerevisiae
gaagcttacttgtggaatctattga

SEQ ID NO: 30672 - DNA, 25 bp, S. cerevisiae
gaagcttccttgagagtccaaatgg

SEQ ID NO: 30673 - DNA, 25 bp, S. cerevisiae
gaagagctattcaccctacaagtgg

SEQ ID NO: 30674 - DNA, 25 bp, S. cerevisiae
gaagcattaactcatgcctacaagg

SEQ ID NO: 30675 - DNA, 25 bp, S. cerevisiae
gaagactgaacgtcgccatgacaag

SEQ ID NO: 30676 - DNA, 25 bp, S. cerevisiae
gaagcactgagacgtctgatatcat

SEQ ID NO: 30677 - DNA, 25 bp, S. cerevisiae
gaagactgcagatgctttgactcag

SEQ ID NO: 30678 - DNA, 25 bp, S. cerevisiae
gaagagctggctaccttattgaaac

SEQ ID NO: 30679 - DNA, 25 bp, S. cerevisiae
gaagagctgaatacgtttctgccaa

SEQ ID NO: 30680 - DNA, 25 bp, S. cerevisiae
gaagcattttcttatatggccactc

SEQ ID NO: 30681 - DNA, 25 bp, S. cerevisiae
gaagcttggttgctgtagatgccca

SEQ ID NO: 30682 - DNA, 25 bp, S. cerevisiae
gaagcttggctttgtagaggtgcaa

SEQ ID NO: 30683 - DNA, 25 bp, S. cerevisiae
gaagctctggcgaatttcaaggaaa

SEQ ID NO: 30684 - DNA, 25 bp, S. cerevisiae
gaagcttgtgagtcatgttccggtt

SEQ ID NO: 30685 - DNA, 25 bp, S. cerevisiae
gaagacgttggactaccggattcaa

SEQ ID NO: 30686 - DNA, 25 bp, S. cerevisiae
gaagaatttcgacaccgtcttgaaa

SEQ ID NO: 30687 - DNA, 25 bp, S. cerevisiae
gaagcgtttcgagacctggttaatc

SEQ ID NO: 30688 - DNA, 25 bp, S. cerevisiae
gaagcgttatcacaaactcgtcgac

SEQ ID NO: 30689 - DNA, 25 bp, S. cerevisiae
gaaccaaagcagactcaattttcaa

SEQ ID NO: 30690 - DNA, 25 bp, S. cerevisiae
gaaccaaccgttcatttgtacaccg

SEQ ID NO: 30691 - DNA, 25 bp, S. cerevisiae
gaaccaccgcctatgatttaaacca

SEQ ID NO: 30692 - DNA, 25 bp, S. cerevisiae
gaagacttccctgttctaaaaggca

SEQ ID NO: 30693 - DNA, 25 bp, S. cerevisiae
gaagaagctctcgatactgctgtta

SEQ ID NO: 30694 - DNA, 25 bp, S. cerevisiae
gaagaactacgtgctgctgctttat

SEQ ID NO: 30695 - DNA, 25 bp, S. cerevisiae
gaagaattcctagtccgtggaacaa

SEQ ID NO: 30696 - DNA, 25 bp, S. cerevisiae
gaagctttcaagagcgttgtatcta

SEQ ID NO: 30697 - DNA, 25 bp, S. cerevisiae
gaagctttacaaccagttatcgtca

SEQ ID NO: 30698 - DNA, 25 bp, S. cerevisiae
gaagctatacagatctttaggagtt

SEQ ID NO: 30699 - DNA, 25 bp, S. cerevisiae
gaagaatacgactctgactatgatt

SEQ ID NO: 30700 - DNA, 25 bp, S. cerevisiae
gaagaataccagtttatctcgcatt

SEQ ID NO: 30701 - DNA, 25 bp, S. cerevisiae
gaagcaaaacagaccattgccacaa

SEQ ID NO: 30702 - DNA, 25 bp, S. cerevisiae
gaagaagcgcacaatgccttggaaa

SEQ ID NO: 30703 - DNA, 25 bp, S. cerevisiae
gaagctattcaagagtcccgatggt

SEQ ID NO: 30704 - DNA, 25 bp, S. cerevisiae
gaagctgttccagagagcccaagag

SEQ ID NO: 30705 - DNA, 25 bp, S. cerevisiae
gaagcgtcatcccaaggtaacgtct

SEQ ID NO: 30706 - DNA, 25 bp, S. cerevisiae
gaactggactgggacatcgacgatt

SEQ ID NO: 30707 - DNA, 25 bp, S. cerevisiae
gaagcgaagtggagccccgattttt

SEQ ID NO: 30708 - DNA, 25 bp, S. cerevisiae
gaactactatggtgggaacgcctta

SEQ ID NO: 30709 - DNA, 25 bp, S. cerevisiae
gaagcggcttccaatttatcaaggt

SEQ ID NO: 30710 - DNA, 25 bp, S. cerevisiae
gaagaccatcctacattgagactga

SEQ ID NO: 30711 - DNA, 25 bp, S. cerevisiae
gaagaacatccttcttggattgcaa

SEQ ID NO: 30712 - DNA, 25 bp, S. cerevisiae
gaagcgagcccttgcacgcaaagag

SEQ ID NO: 30713 - DNA, 25 bp, S. cerevisiae
gaagcagacgacgattcagacgata

SEQ ID NO: 30714 - DNA, 25 bp, S. cerevisiae
gaagcattccgccattatgacaagt

SEQ ID NO: 30715 - DNA, 25 bp, S. cerevisiae
gaagcatacctcatctaagcaagat

SEQ ID NO: 30716 - DNA, 25 bp, S. cerevisiae
gaagcatactccaagccaatcggtt

SEQ ID NO: 30717 - DNA, 25 bp, S. cerevisiae
gaagcagttggctgcccaagtggaa

SEQ ID NO: 30718 - DNA, 25 bp, S. cerevisiae
gaagacgtcactgcattattggagc

SEQ ID NO: 30719 - DNA, 25 bp, S. cerevisiae
gaagacgtcactgaaacactaactg

SEQ ID NO: 30720 - DNA, 25 bp, S. cerevisiae
gaagacctattcagtgacaccagac

SEQ ID NO: 30721 - DNA, 25 bp, S. cerevisiae
gaagaagttgttcgtgccatccaca

SEQ ID NO: 30722 - DNA, 25 bp, S. cerevisiae
gaagacatcttgagtgtgccaacaa

SEQ ID NO: 30723 - DNA, 25 bp, S. cerevisiae
gaagaactatgagctggccaccagg

SEQ ID NO: 30724 - DNA, 25 bp, S. cerevisiae
gaagaaccagagcaagcaccagatg

SEQ ID NO: 30725 - DNA, 25 bp, S. cerevisiae
gaagaacctggtaagcactcggaga

SEQ ID NO: 30726 - DNA, 25 bp, S. cerevisiae
gaagcaatcatttttacagcggagg

SEQ ID NO: 30727 - DNA, 25 bp, S. cerevisiae
gaagaatattttggtacggctggaa

SEQ ID NO: 30728 - DNA, 25 bp, S. cerevisiae
gaagccgaagtttacactcctggta

SEQ ID NO: 30729 - DNA, 25 bp, S. cerevisiae
gaagccgaagatctaatccgtcgac

SEQ ID NO: 30730 - DNA, 25 bp, S. cerevisiae
gaagctctatcattgcggaataacc

SEQ ID NO: 30731 - DNA, 25 bp, S. cerevisiae
gacagttccgatgttgaggacgtta

SEQ ID NO: 30732 - DNA, 25 bp, S. cerevisiae
gaacgtgaccccacaggtgttttga

SEQ ID NO: 30733 - DNA, 25 bp, S. cerevisiae
gaagcgctaatagggctaggtcacc

SEQ ID NO: 30734 - DNA, 25 bp, S. cerevisiae
gaagcgccaatttacaacggcacgt

SEQ ID NO: 30735 - DNA, 25 bp, S. cerevisiae
gaagacccttcacaaggtcctgctg

SEQ ID NO: 30736 - DNA, 25 bp, S. cerevisiae
gaagaaccttcacaactgtcagtga

SEQ ID NO: 30737 - DNA, 25 bp, S. cerevisiae
gaagcacgatttgaacatccctgaa

SEQ ID NO: 30738 - DNA, 25 bp, S. cerevisiae
gaagacgctttggttgtgcacagaa

SEQ ID NO: 30739 - DNA, 25 bp, S. cerevisiae
gaagactcaacgtatttctcaaatg

SEQ ID NO: 30740 - DNA, 25 bp, S. cerevisiae
gaagcatatcaagccatttttcctt

SEQ ID NO: 30741 - DNA, 25 bp, S. cerevisiae
gaagcatatcaagccatttttcctt

SEQ ID NO: 30742 - DNA, 25 bp, S. cerevisiae
gaagcaccacaaccttatcatttct

SEQ ID NO: 30743 - DNA, 25 bp, S. cerevisiae
gaagacatccaagctgacatgcaag

SEQ ID NO: 30744 - DNA, 25 bp, S. cerevisiae
gaagcacaggattcagcgcatcaga

SEQ ID NO: 30745 - DNA, 25 bp, S. cerevisiae
gaagactctttgcaaacgcaggtta

SEQ ID NO: 30746 - DNA, 25 bp, S. cerevisiae
gaacgttaagccttcattcggtatt

SEQ ID NO: 30747 - DNA, 25 bp, S. cerevisiae
gaagcgtttagtatctggtccgagt

SEQ ID NO: 30748 - DNA, 25 bp, S. cerevisiae
tgaactagactctcggacggaggga

SEQ ID NO: 30749 - DNA, 25 bp, S. cerevisiae
gaagacatcatcgttgcctataagg

SEQ ID NO: 30750 - DNA, 25 bp, S. cerevisiae
gaagcaatccaagcctatcataggg

SEQ ID NO: 30751 - DNA, 25 bp, S. cerevisiae
gaagctatcagatccctaatctatg

SEQ ID NO: 30752 - DNA, 25 bp, S. cerevisiae
gaagcagacgcatcacttgtatttg

SEQ ID NO: 30753 - DNA, 25 bp, S. cerevisiae
gaagcagatggcgaacctttgttgg

SEQ ID NO: 30754 - DNA, 25 bp, S. cerevisiae
gaagcagcataacgtccgcattggt

SEQ ID NO: 30755 - DNA, 25 bp, S. cerevisiae
gaagcatttgacaactccatcaagc

SEQ ID NO: 30756 - DNA, 25 bp, S. cerevisiae
gaagacaatcgcgaactccaaaatg

SEQ ID NO: 30757 - DNA, 25 bp, S. cerevisiae
gaagacgtcgctgctctaaagaaga

SEQ ID NO: 30758 - DNA, 25 bp, S. cerevisiae
gaagaagtcgcatcctatgaaaggt

SEQ ID NO: 30759 - DNA, 25 bp, S. cerevisiae
gaagaattctattcccagctagacg

SEQ ID NO: 30760 - DNA, 25 bp, S. cerevisiae
gaagaattcgatgtctcctacaaga

SEQ ID NO: 30761 - DNA, 25 bp, S. cerevisiae
gaagcatatcgcgatgagttcacta

SEQ ID NO: 30762 - DNA, 25 bp, S. cerevisiae
gaagcacacccaaggtttacgttga

SEQ ID NO: 30763 - DNA, 25 bp, S. cerevisiae
gaaccccggtctttgtacggatgag

SEQ ID NO: 30764 - DNA, 25 bp, S. cerevisiae
gaaccaccacgaccgttacatggat

SEQ ID NO: 30765 - DNA, 25 bp, S. cerevisiae
gaagcgactaggaacgttacatttt

SEQ ID NO: 30766 - DNA, 25 bp, S. cerevisiae
gaagacattttgaagggccgtataa

SEQ ID NO: 30767 - DNA, 25 bp, S. cerevisiae
gaaactttgcatcagggtccgataa

SEQ ID NO: 30768 - DNA, 25 bp, S. cerevisiae
tgaaccggtccgatccttcgaaaag

SEQ ID NO: 30769 - DNA, 25 bp, S. cerevisiae
gaacgggctttacgatgttcctcgt

SEQ ID NO: 30770 - DNA, 25 bp, S. cerevisiae
gaagctggatcacaaacgacaggga

SEQ ID NO: 30771 - DNA, 25 bp, S. cerevisiae
gaagctgcatttcaaaccagtggta

SEQ ID NO: 30772 - DNA, 25 bp, S. cerevisiae
gaagacattcagcaatccatcttga

SEQ ID NO: 30773 - DNA, 25 bp, S. cerevisiae
gaagaatacgcttccatgctgcctg

SEQ ID NO: 30774 - DNA, 25 bp, S. cerevisiae
gaagaatcattttccagtgcctaat

SEQ ID NO: 30775 - DNA, 25 bp, S. cerevisiae
gaagacatgttatccctgcgtcaag

SEQ ID NO: 30776 - DNA, 25 bp, S. cerevisiae
gaagacatcaactacggtgttcaag

SEQ ID NO: 30777 - DNA, 25 bp, S. cerevisiae
gaagcactccttcatagttactttc

SEQ ID NO: 30778 - DNA, 25 bp, S. cerevisiae
gaagccctagtccacaaagatctgt

SEQ ID NO: 30779 - DNA, 25 bp, S. cerevisiae
gaagcgattcttaatggcgtgagga

SEQ ID NO: 30780 - DNA, 25 bp, S. cerevisiae
gaagctataatttctgggccgtcag

SEQ ID NO: 30781 - DNA, 25 bp, S. cerevisiae
gaagctaccaaaggtggccctcatg

SEQ ID NO: 30782 - DNA, 25 bp, S. cerevisiae
gaagctcgagtcagaccgtcattaa

SEQ ID NO: 30783 - DNA, 25 bp, S. cerevisiae
gaagcctgttttccaagacttgtac

SEQ ID NO: 30784 - DNA, 25 bp, S. cerevisiae
gaagctccccacatgaaaatctatt

SEQ ID NO: 30785 - DNA, 25 bp, S. cerevisiae
gaagcttccggcaaaaaatctactc

SEQ ID NO: 30786 - DNA, 25 bp, S. cerevisiae
gaacctcccgtacaaactagcttat

SEQ ID NO: 30787 - DNA, 25 bp, S. cerevisiae
gaaccctccctacaagaaagctttg

SEQ ID NO: 30788 - DNA, 25 bp, S. cerevisiae
gaagccctacccatacaaaggtctg

SEQ ID NO: 30789 - DNA, 25 bp, S. cerevisiae
gaagcacctagcctctttcaaaatt

SEQ ID NO: 30790 - DNA, 25 bp, S. cerevisiae
gaagcatttgtctttcgctgaaaac

SEQ ID NO: 30791 - DNA, 25 bp, S. cerevisiae
gaagctactgacttacttttccaag

SEQ ID NO: 30792 - DNA, 25 bp, S. cerevisiae
gaagctactggtttctaattccaat

SEQ ID NO: 30793 - DNA, 25 bp, S. cerevisiae
gaagctgttaccttcttgaagactg

SEQ ID NO: 30794 - DNA, 25 bp, S. cerevisiae
gaagctttcaacgtattcaaggtga

SEQ ID NO: 30795 - DNA, 25 bp, S. cerevisiae
gaagcgttcaatctttgtaggtaac

SEQ ID NO: 30796 - DNA, 25 bp, S. cerevisiae
gaagcggtagatcctttgatagaca

SEQ ID NO: 30797 - DNA, 25 bp, S. cerevisiae
gaagcattctacattctgagacgtg

SEQ ID NO: 30798 - DNA, 25 bp, S. cerevisiae
gaagaatctgactttctcaccacga

SEQ ID NO: 30799 - DNA, 25 bp, S. cerevisiae
gaagcattctgattttctactgaag

SEQ ID NO: 30800 - DNA, 25 bp, S. cerevisiae
gaagcattagctttgatctctagag

SEQ ID NO: 30801 - DNA, 25 bp, S. cerevisiae
gaagctgaccaatatttacatcgtg

SEQ ID NO: 30802 - DNA, 25 bp, S. cerevisiae
gaagctgcccaagatatctacaagg

SEQ ID NO: 30803 - DNA, 25 bp, S. cerevisiae
gaagctgctggatcttactaagggt

SEQ ID NO: 30804 - DNA, 25 bp, S. cerevisiae
gaagctgagagatccctgcatgacg

SEQ ID NO: 30805 - DNA, 25 bp, S. cerevisiae
gaacggtcaacgtctcggtggaaga

SEQ ID NO: 30806 - DNA, 25 bp, S. cerevisiae
gaacggtcaatatctccgctacaac

SEQ ID NO: 30807 - DNA, 25 bp, S. cerevisiae
gaacgagctcaagattccgaaagat

SEQ ID NO: 30808 - DNA, 25 bp, S. cerevisiae
gaagcggccgctgagttggaattat

SEQ ID NO: 30809 - DNA, 25 bp, S. cerevisiae
gaagcgaccatgacaatgctattga

SEQ ID NO: 30810 - DNA, 25 bp, S. cerevisiae
gaagcaaagctctgttacgtcttta

SEQ ID NO: 30811 - DNA, 25 bp, S. cerevisiae
gaagcaaggctcttgggtcatctct

SEQ ID NO: 30812 - DNA, 25 bp, S. cerevisiae
gaagcaagctgtttcttatcctatg

SEQ ID NO: 30813 - DNA, 25 bp, S. cerevisiae
gaagcatacatttggcagttcctag

SEQ ID NO: 30814 - DNA, 25 bp, S. cerevisiae
gaagcactctatggcaggcgtcgga

SEQ ID NO: 30815 - DNA, 25 bp, S. cerevisiae
gaagctcgtgatgagtccaatgata

SEQ ID NO: 30816 - DNA, 25 bp, S. cerevisiae
gaagctgctttcaccaagttggacc

SEQ ID NO: 30817 - DNA, 25 bp, S. cerevisiae
gaagctgtcttcaccaaattagtaa

SEQ ID NO: 30818 - DNA, 25 bp, S. cerevisiae
gaaccgctccaaaatccgataacgt

SEQ ID NO: 30819 - DNA, 25 bp, S. cerevisiae
gaaccgctcaaaaggcatttagaca

SEQ ID NO: 30820 - DNA, 25 bp, S. cerevisiae
gaagcttggctcagaggctctggat

SEQ ID NO: 30821 - DNA, 25 bp, S. cerevisiae
gaagccagagccagtgtctatcgca

SEQ ID NO: 30822 - DNA, 25 bp, S. cerevisiae
gaagctgagagcgacctttccgatg

SEQ ID NO: 30823 - DNA, 25 bp, S. cerevisiae
gaacgcctaacatacccattggttg

SEQ ID NO: 30824 - DNA, 25 bp, S. cerevisiae
gaagcgccaataaaaccacagggta

SEQ ID NO: 30825 - DNA, 25 bp, S. cerevisiae
gaagcaagtcgcaaccagtcgttaa

SEQ ID NO: 30826 - DNA, 25 bp, S. cerevisiae
gaagccaagccaaccagtcatgtaa

SEQ ID NO: 30827 - DNA, 25 bp, S. cerevisiae
gacgccggaccaaagacaattcaac

SEQ ID NO: 30828 - DNA, 25 bp, S. cerevisiae
gaagccgaactaaggacattatcta

SEQ ID NO: 30829 - DNA, 25 bp, S. cerevisiae
gaaccggactagctgactttacaag

SEQ ID NO: 30830 - DNA, 25 bp, S. cerevisiae
gaacgcgggttcttccatttaaatg

SEQ ID NO: 30831 - DNA, 25 bp, S. cerevisiae
gaagcagcgacgatcgtaactatat

SEQ ID NO: 30832 - DNA, 25 bp, S. cerevisiae
gaagcgtgcggccaggaccattatt

SEQ ID NO: 30833 - DNA, 25 bp, S. cerevisiae
gaagctgctgaagccttgggtgcca

SEQ ID NO: 30834 - DNA, 25 bp, S. cerevisiae
gaagctgctaagactttggccgcaa

SEQ ID NO: 30835 - DNA, 25 bp, S. cerevisiae
gaacggaatacgtcggcaccaaatt

SEQ ID NO: 30836 - DNA, 25 bp, S. cerevisiae
gaccgtcaaacgtgcctccaaggct

SEQ ID NO: 30837 - DNA, 25 bp, S. cerevisiae
gaacgaatttcagaccaacttggta

SEQ ID NO: 30838 - DNA, 25 bp, S. cerevisiae
gaagcgcaattgacccgcaaacagg

SEQ ID NO: 30839 - DNA, 25 bp, S. cerevisiae
gaagcacagcttttggaggatacaa

SEQ ID NO: 30840 - DNA, 25 bp, S. cerevisiae
gaagccggtgaagccgaagctgaaa

SEQ ID NO: 30841 - DNA, 25 bp, S. cerevisiae
gaacctgctggaaactaaactgaac

SEQ ID NO: 30842 - DNA, 25 bp, S. cerevisiae
gaagccattagatccggtactgcaa

SEQ ID NO: 30843 - DNA, 25 bp, S. cerevisiae
gaagccgatgtgaaccggtccgatc

SEQ ID NO: 30844 - DNA, 25 bp, S. cerevisiae
gaagccaattgtccggtatccaaca

SEQ ID NO: 30845 - DNA, 25 bp, S. cerevisiae
gaagcccttgccaatgagttctaca

SEQ ID NO: 30846 - DNA, 25 bp, S. cerevisiae
gaagcacctgtagaatttgtcagag

SEQ ID NO: 30847 - DNA, 25 bp, S. cerevisiae
gaacggtgattctctgattattgtc

SEQ ID NO: 30848 - DNA, 25 bp, S. cerevisiae
gaaccggattatcgctattcgtgac

SEQ ID NO: 30849 - DNA, 25 bp, S. cerevisiae
gaagcacgaagtcatgcctctggga

SEQ ID NO: 30850 - DNA, 25 bp, S. cerevisiae
gaagccacaagtcactgtcggtgct

SEQ ID NO: 30851 - DNA, 25 bp, S. cerevisiae
gaagctccagaacagcctcttttaa

SEQ ID NO: 30852 - DNA, 25 bp, S. cerevisiae
gaagctatctcaaatcgccgaatcc

SEQ ID NO: 30853 - DNA, 25 bp, S. cerevisiae
gaagctgaacatctaccagcaatct

SEQ ID NO: 30854 - DNA, 25 bp, S. cerevisiae
gaagctgagatcaaatcccatacct

SEQ ID NO: 30855 - DNA, 25 bp, S. cerevisiae
gaactagagcaaacgacttcccgct

SEQ ID NO: 30856 - DNA, 25 bp, S. cerevisiae
gaaccagttaacgttgtcaccgctg

SEQ ID NO: 30857 - DNA, 25 bp, S. cerevisiae
gaacccattttcataggccatttaa

SEQ ID NO: 30858 - DNA, 25 bp, S. cerevisiae
gaaccacatgctgtttctttggctt

SEQ ID NO: 30859 - DNA, 25 bp, S. cerevisiae
gaagcgttgggtttcttaggtcctg

SEQ ID NO: 30860 - DNA, 25 bp, S. cerevisiae
gacaggatcggcctttttagggatt

SEQ ID NO: 30861 - DNA, 25 bp, S. cerevisiae
gacaggagctgaacgtttcttggtt

SEQ ID NO: 30862 - DNA, 25 bp, S. cerevisiae
gaagctggcgcgtgaagacctgatt

SEQ ID NO: 30863 - DNA, 25 bp, S. cerevisiae
gaagcacctcaattttacaggtatt

SEQ ID NO: 30864 - DNA, 25 bp, S. cerevisiae
gaagcattcgcgttttaatattgac

SEQ ID NO: 30865 - DNA, 25 bp, S. cerevisiae
gaagctcctgctttattccaatttg

SEQ ID NO: 30866 - DNA, 25 bp, S. cerevisiae
gaagcttgcctcaattagccaattt

SEQ ID NO: 30867 - DNA, 25 bp, S. cerevisiae
gaacctgacgcttgttgagcagatc

SEQ ID NO: 30868 - DNA, 25 bp, S. cerevisiae
gaagaatatgctatgccggcatcaa

SEQ ID NO: 30869 - DNA, 25 bp, S. cerevisiae
gaagcattgatgttatcccacccaa

SEQ ID NO: 30870 - DNA, 25 bp, S. cerevisiae
gaagcaatccgagagctcactcaaa

SEQ ID NO: 30871 - DNA, 25 bp, S. cerevisiae
gaaccagactttgctcttaatgtga

SEQ ID NO: 30872 - DNA, 25 bp, S. cerevisiae
gaaccagacgtttccaaaatagata

SEQ ID NO: 30873 - DNA, 25 bp, S. cerevisiae
gaagcaaatcgctttcccacaaaga

SEQ ID NO: 30874 - DNA, 25 bp, S. cerevisiae
gaagcaggtttgttagcccttagag

SEQ ID NO: 30875 - DNA, 25 bp, S. cerevisiae
gaaacggtagatccccaattatggt

SEQ ID NO: 30876 - DNA, 25 bp, S. cerevisiae
gaacccggcgatcagcaatctttga

SEQ ID NO: 30877 - DNA, 25 bp, S. cerevisiae
gaagccaccgcaaaagagtctgtta

SEQ ID NO: 30878 - DNA, 25 bp, S. cerevisiae
gaacccactgggatcgttgtcgagt

SEQ ID NO: 30879 - DNA, 25 bp, S. cerevisiae
gaacccttggaagagtcagatcaga

SEQ ID NO: 30880 - DNA, 25 bp, S. cerevisiae
gaagcacctgaacaagcacctgaag

SEQ ID NO: 30881 - DNA, 25 bp, S. cerevisiae
gacagctcctaacaccaagcagaaa

SEQ ID NO: 30882 - DNA, 25 bp, S. cerevisiae
gacactttctcctccaagttgaaaa

SEQ ID NO: 30883 - DNA, 25 bp, S. cerevisiae
gaagctatttcgctccaaagttaat

SEQ ID NO: 30884 - DNA, 25 bp, S. cerevisiae
gaagcgatttcgactctactgaggt

SEQ ID NO: 30885 - DNA, 25 bp, S. cerevisiae
gaagctgattctggacactcactgg

SEQ ID NO: 30886 - DNA, 25 bp, S. cerevisiae
gaagctgtcaatgaacctctgccaa

SEQ ID NO: 30887 - DNA, 25 bp, S. cerevisiae
gaagcgttatggaacctgtcgaagt

SEQ ID NO: 30888 - DNA, 25 bp, S. cerevisiae
gaagccttctggaagcctttggact

SEQ ID NO: 30889 - DNA, 25 bp, S. cerevisiae
gaaccattgggtaccgttgagcctg

SEQ ID NO: 30890 - DNA, 25 bp, S. cerevisiae
gaaccacaaggtgccatgttggact

SEQ ID NO: 30891 - DNA, 25 bp, S. cerevisiae
gaacctaagcgaggccattcacgat

SEQ ID NO: 30892 - DNA, 25 bp, S. cerevisiae
gaagccatgaaggaggacgcctcta

SEQ ID NO: 30893 - DNA, 25 bp, S. cerevisiae
gaagcgctaatggacagattgcaat

SEQ ID NO: 30894 - DNA, 25 bp, S. cerevisiae
gaagcctcaaggtccatatcaacta

SEQ ID NO: 30895 - DNA, 25 bp, S. cerevisiae
gaaccgtacattcattgtgtcgttt

SEQ ID NO: 30896 - DNA, 25 bp, S. cerevisiae
tgaacggaactttagtagccttttg

SEQ ID NO: 30897 - DNA, 25 bp, S. cerevisiae
gaaccggatccattcagtaccattg

SEQ ID NO: 30898 - DNA, 25 bp, S. cerevisiae
gaagcgttcaaaaggttgccaattt

SEQ ID NO: 30899 - DNA, 25 bp, S. cerevisiae
gaagcgcttgcaaaatcgttctttt

SEQ ID NO: 30900 - DNA, 25 bp, S. cerevisiae
gaagcttctgaatgaccgttacgat

SEQ ID NO: 30901 - DNA, 25 bp, S. cerevisiae
gaagctgtgactttgaacttttata

SEQ ID NO: 30902 - DNA, 25 bp, S. cerevisiae
gaagcttggcttgtatcttttgatc

SEQ ID NO: 30903 - DNA, 25 bp, S. cerevisiae
gaagcgattcgaggtctattattgt

SEQ ID NO: 30904 - DNA, 25 bp, S. cerevisiae
gaagcagtaaacacgatccatttga

SEQ ID NO: 30905 - DNA, 25 bp, S. cerevisiae
gaacgttccaaactggcacagggat

SEQ ID NO: 30906 - DNA, 25 bp, S. cerevisiae
gaagcggtctaacttgcccaatagt

SEQ ID NO: 30907 - DNA, 25 bp, S. cerevisiae
gaagcatcgtttattcccattacta

SEQ ID NO: 30908 - DNA, 25 bp, S. cerevisiae
gaagcacttcttattgctcctgatc

SEQ ID NO: 30909 - DNA, 25 bp, S. cerevisiae
gaagcactatctaagttccgtgaga

SEQ ID NO: 30910 - DNA, 25 bp, S. cerevisiae
gaagctttagttggcagctcttcaa

SEQ ID NO: 30911 - DNA, 25 bp, S. cerevisiae
gaagctagtcataattgccatgcta

SEQ ID NO: 30912 - DNA, 25 bp, S. cerevisiae
gaagcttctcatatgtgcatggttt

SEQ ID NO: 30913 - DNA, 25 bp, S. cerevisiae
gaagcgcaattcctcttcagggaac

SEQ ID NO: 30914 - DNA, 25 bp, S. cerevisiae
gaagccgcctcatagtcagggcaaa

SEQ ID NO: 30915 - DNA, 25 bp, S. cerevisiae
gaacagggccaagaactctcggaat

SEQ ID NO: 30916 - DNA, 25 bp, S. cerevisiae
gtactgggacaacaacaacgggaat

SEQ ID NO: 30917 - DNA, 25 bp, S. cerevisiae
gaactatattgattgctacggcccc

SEQ ID NO: 30918 - DNA, 25 bp, S. cerevisiae
gaactacacagattgtccgatgata

SEQ ID NO: 30919 - DNA, 25 bp, S. cerevisiae
gaagcccagccttttgaagaagcca

SEQ ID NO: 30920 - DNA, 25 bp, S. cerevisiae
gaaccaatgagttatcctagcatca

SEQ ID NO: 30921 - DNA, 25 bp, S. cerevisiae
gaaccacaactttcgtaatcacacc

SEQ ID NO: 30922 - DNA, 25 bp, S. cerevisiae
gaagccacgagtgttaactcaacga

SEQ ID NO: 30923 - DNA, 25 bp, S. cerevisiae
gaagccaaagacctacaagtaccct

SEQ ID NO: 30924 - DNA, 25 bp, S. cerevisiae
gaagccacaagattttcaagtagac

SEQ ID NO: 30925 - DNA, 25 bp, S. cerevisiae
gaacccgagaatctatcgtcaagct

SEQ ID NO: 30926 - DNA, 25 bp, S. cerevisiae
gaagctatggaaatggccctgctaa

SEQ ID NO: 30927 - DNA, 25 bp, S. cerevisiae
gaactatggattaaggccgcgaaaa

SEQ ID NO: 30928 - DNA, 25 bp, S. cerevisiae
gaactgatggcttccagggcctatg

SEQ ID NO: 30929 - DNA, 25 bp, S. cerevisiae
gaagcggatgcattccgacggcata

SEQ ID NO: 30930 - DNA, 25 bp, S. cerevisiae
gaacacagaggcgtcgcagcggttc

SEQ ID NO: 30931 - DNA, 25 bp, S. cerevisiae
gaagctttgccacgagcatttataa

SEQ ID NO: 30932 - DNA, 25 bp, S. cerevisiae
gaactcaaccattctttatcggcag

SEQ ID NO: 30933 - DNA, 25 bp, S. cerevisiae
gaactaacgttttctttgttggatg

SEQ ID NO: 30934 - DNA, 25 bp, S. cerevisiae
gaagctgaacgttttcattcctgtt

SEQ ID NO: 30935 - DNA, 25 bp, S. cerevisiae
gaagcgtataccactacggctttac

SEQ ID NO: 30936 - DNA, 25 bp, S. cerevisiae
gaagcgtcgttagctatgcgtgttt

SEQ ID NO: 30937 - DNA, 25 bp, S. cerevisiae
gaacagtctcatggacaagaagatc

SEQ ID NO: 30938 - DNA, 25 bp, S. cerevisiae
gaagcttctgaaccagccattggat

SEQ ID NO: 30939 - DNA, 25 bp, S. cerevisiae
gaagctttgaatgccgtgcatgcca

SEQ ID NO: 30940 - DNA, 25 bp, S. cerevisiae
gaagctgtttatgggtctgatgaag

SEQ ID NO: 30941 - DNA, 25 bp, S. cerevisiae
gaagctgcctcattcaactatcaat

SEQ ID NO: 30942 - DNA, 25 bp, S. cerevisiae
gaagctgccacattgcaattacgag

SEQ ID NO: 30943 - DNA, 25 bp, S. cerevisiae
gaagctttcaaactatccatcattg

SEQ ID NO: 30944 - DNA, 25 bp, S. cerevisiae
gaagctgtcgctaagttccacttgg

SEQ ID NO: 30945 - DNA, 25 bp, S. cerevisiae
gaagcccacaagagcatagtcataa

SEQ ID NO: 30946 - DNA, 25 bp, S. cerevisiae
gaagctggttatggtggatctgact

SEQ ID NO: 30947 - DNA, 25 bp, S. cerevisiae
gaagcttttctccatgatattgtca

SEQ ID NO: 30948 - DNA, 25 bp, S. cerevisiae
gaagctattctcacattaccatcaa

SEQ ID NO: 30949 - DNA, 25 bp, S. cerevisiae
gaagctgtaccaactttccaacata

SEQ ID NO: 30950 - DNA, 25 bp, S. cerevisiae
gaagctgtggatcatctcatgtctt

SEQ ID NO: 30951 - DNA, 25 bp, S. cerevisiae
gaagctgtgagattgaccatgtctg

SEQ ID NO: 30952 - DNA, 25 bp, S. cerevisiae
gaagcggactatccacattgtgggc

SEQ ID NO: 30953 - DNA, 25 bp, S. cerevisiae
gaacgtaccgcagagcttatggcag

SEQ ID NO: 30954 - DNA, 25 bp, S. cerevisiae
gaagcgaggactttttgccatacag

SEQ ID NO: 30955 - DNA, 25 bp, S. cerevisiae
gaagccattgacaccttgaataaag

SEQ ID NO: 30956 - DNA, 25 bp, S. cerevisiae
gaagctgctcttgatcctggcaaaa

SEQ ID NO: 30957 - DNA, 25 bp, S. cerevisiae
gaagctgctcatggtaccgtgacaa

SEQ ID NO: 30958 - DNA, 25 bp, S. cerevisiae
gaagctactgtcgactcgttacagg

SEQ ID NO: 30959 - DNA, 25 bp, S. cerevisiae
gaagctgttcttgtcgtgaacccga

SEQ ID NO: 30960 - DNA, 25 bp, S. cerevisiae
gaagcgattgctacttgggcagaac

SEQ ID NO: 30961 - DNA, 25 bp, S. cerevisiae
gaacgacagctctacgatgcgtact

SEQ ID NO: 30962 - DNA, 25 bp, S. cerevisiae
gaacgtatgctgcagattggcctcc

SEQ ID NO: 30963 - DNA, 25 bp, S. cerevisiae
gaagctgacttcatcggtcacaact

SEQ ID NO: 30964 - DNA, 25 bp, S. cerevisiae
gaagctgagcttcttgttctaaaaa

SEQ ID NO: 30965 - DNA, 25 bp, S. cerevisiae
gaagctagatttgttccctgaagac

SEQ ID NO: 30966 - DNA, 25 bp, S. cerevisiae
gaagctcaacgtgttcaagctaaga

SEQ ID NO: 30967 - DNA, 25 bp, S. cerevisiae
gaactgccgagctacgaggacgtaa

SEQ ID NO: 30968 - DNA, 25 bp, S. cerevisiae
gaactgggaaaccacacagcgccaa

SEQ ID NO: 30969 - DNA, 25 bp, S. cerevisiae
gaaatgttaaaccaactggcgataa

SEQ ID NO: 30970 - DNA, 25 bp, S. cerevisiae
gaacgctaacaaacaaaggcagtat

SEQ ID NO: 30971 - DNA, 25 bp, S. cerevisiae
gaacctagtcgaacaccccaatgat

SEQ ID NO: 30972 - DNA, 25 bp, S. cerevisiae
gaagcgtgtgtttatctactctagt

SEQ ID NO: 30973 - DNA, 25 bp, S. cerevisiae
gaagctggtgttactagagccacaa

SEQ ID NO: 30974 - DNA, 25 bp, S. cerevisiae
gaagctgataaactgggcacaccaa

SEQ ID NO: 30975 - DNA, 25 bp, S. cerevisiae
gaagcggagcaaattgacacatcca

SEQ ID NO: 30976 - DNA, 25 bp, S. cerevisiae
gaagctggccaaagatcaagtcgca

SEQ ID NO: 30977 - DNA, 25 bp, S. cerevisiae
gaactcaggattcgacccattggac

SEQ ID NO: 30978 - DNA, 25 bp, S. cerevisiae
gaagccggaattggatccttggaca

SEQ ID NO: 30979 - DNA, 25 bp, S. cerevisiae
gaagctcggaacaatatttggtcca

SEQ ID NO: 30980 - DNA, 25 bp, S. cerevisiae
gaagccagcgtagatcattttgatc

SEQ ID NO: 30981 - DNA, 25 bp, S. cerevisiae
gaagccagctcgacaaactctgttc

SEQ ID NO: 30982 - DNA, 25 bp, S. cerevisiae
gaacgagtcgtcatagaccttcttt

SEQ ID NO: 30983 - DNA, 25 bp, S. cerevisiae
gaacgtggcgataaaagtcccttag

SEQ ID NO: 30984 - DNA, 25 bp, S. cerevisiae
gaactggtttgttacgtggttctca

SEQ ID NO: 30985 - DNA, 25 bp, S. cerevisiae
gaactctgagctcactcaactggat

SEQ ID NO: 30986 - DNA, 25 bp, S. cerevisiae
gaagccgccttgcatggtgctttgt

SEQ ID NO: 30987 - DNA, 25 bp, S. cerevisiae
gaagccgttcctgccgatttaatga

SEQ ID NO: 30988 - DNA, 25 bp, S. cerevisiae
gaagccgccgaggttaatagttgtt

SEQ ID NO: 30989 - DNA, 25 bp, S. cerevisiae
gaagcccacaagtttatggactgta

SEQ ID NO: 30990 - DNA, 25 bp, S. cerevisiae
gaagcgccctatatctatcaaatcc

SEQ ID NO: 30991 - DNA, 25 bp, S. cerevisiae
gaagcctcacttatcagatcaactt

SEQ ID NO: 30992 - DNA, 25 bp, S. cerevisiae
gaagccgccagttagcgatacaaat

SEQ ID NO: 30993 - DNA, 25 bp, S. cerevisiae
gaagccgtgcgacaagatccagagt

SEQ ID NO: 30994 - DNA, 25 bp, S. cerevisiae
gaagccttgaggttggtccgagtct

SEQ ID NO: 30995 - DNA, 25 bp, S. cerevisiae
gaagcctctattgttgactggttct

SEQ ID NO: 30996 - DNA, 25 bp, S. cerevisiae
gaagccatttgcatttggttcaggt

SEQ ID NO: 30997 - DNA, 25 bp, S. cerevisiae
gaagctgactgctttcctcaaagat

SEQ ID NO: 30998 - DNA, 25 bp, S. cerevisiae
gaagctggcgaatctttcacattaa

SEQ ID NO: 30999 - DNA, 25 bp, S. cerevisiae
gaacgaaacagaattgccgcttcca

SEQ ID NO: 31000 - DNA, 25 bp, S. cerevisiae
gaagcgtttacttttcgtgcaagat

SEQ ID NO: 31001 - DNA, 25 bp, S. cerevisiae
gaagcggtcagaatacgattacgat

SEQ ID NO: 31002 - DNA, 25 bp, S. cerevisiae
gaagctcatccttttccagtattag

SEQ ID NO: 31003 - DNA, 25 bp, S. cerevisiae
gaaccctatggttccaggtttggct

SEQ ID NO: 31004 - DNA, 25 bp, S. cerevisiae
gaagcctctaggtcaagtgtttttt

SEQ ID NO: 31005 - DNA, 25 bp, S. cerevisiae
gaagccagctagatccagcgtaaat

SEQ ID NO: 31006 - DNA, 25 bp, S. cerevisiae
gaagctacagctcgtccaggtacaa

SEQ ID NO: 31007 - DNA, 25 bp, S. cerevisiae
gaagctacagcgtccatcgactaca

SEQ ID NO: 31008 - DNA, 25 bp, S. cerevisiae
gaactacaggataagctggcaaccg

SEQ ID NO: 31009 - DNA, 25 bp, S. cerevisiae
gaaccggacgaaggtcattcctaca

SEQ ID NO: 31010 - DNA, 25 bp, S. cerevisiae
gaacccggtaaagatatccctgcac

SEQ ID NO: 31011 - DNA, 25 bp, S. cerevisiae
gaaccgtttttggagatacctgtgg

SEQ ID NO: 31012 - DNA, 25 bp, S. cerevisiae
gaagccgtttaccagagcatacctt

SEQ ID NO: 31013 - DNA, 25 bp, S. cerevisiae
gagagccgttaatagtgacatggtt

SEQ ID NO: 31014 - DNA, 25 bp, S. cerevisiae
gaactagttggtgagtactgggaac

SEQ ID NO: 31015 - DNA, 25 bp, S. cerevisiae
gaaccattcgaattcactttgggaa

SEQ ID NO: 31016 - DNA, 25 bp, S. cerevisiae
gaacctatgatgtaccgttttgcga

SEQ ID NO: 31017 - DNA, 25 bp, S. cerevisiae
gaacgacttaggtgtcttgaaaaga

SEQ ID NO: 31018 - DNA, 25 bp, S. cerevisiae
gaaccacagtacaaactcttcagag

SEQ ID NO: 31019 - DNA, 25 bp, S. cerevisiae
gaaccacaacgccagattcttgaag

SEQ ID NO: 31020 - DNA, 25 bp, S. cerevisiae
gaacctcccagctttacacatagag

SEQ ID NO: 31021 - DNA, 25 bp, S. cerevisiae
gaaccttccagcgacgacttaaagc

SEQ ID NO: 31022 - DNA, 25 bp, S. cerevisiae
gaaccttccatcgacagtttttgaa

SEQ ID NO: 31023 - DNA, 25 bp, S. cerevisiae
gaagcctcgcccgatgagtttatta

SEQ ID NO: 31024 - DNA, 25 bp, S. cerevisiae
gaagctcgcgctaacctaaattcaa

SEQ ID NO: 31025 - DNA, 25 bp, S. cerevisiae
gaagctcggtattcctatgttagag

SEQ ID NO: 31026 - DNA, 25 bp, S. cerevisiae
gaagctgctttgtccgatgctttgg

SEQ ID NO: 31027 - DNA, 25 bp, S. cerevisiae
gaactgccatttgctatgagtgcgg

SEQ ID NO: 31028 - DNA, 25 bp, S. cerevisiae
gaagctgagctattcctggagcagg

SEQ ID NO: 31029 - DNA, 25 bp, S. cerevisiae
gaagctgcccttcaatggtgatgaa

SEQ ID NO: 31030 - DNA, 25 bp, S. cerevisiae
gaactcgacttgaacaggctggatc

SEQ ID NO: 31031 - DNA, 25 bp, S. cerevisiae
gaagccatacttgttcgtcttgaac

SEQ ID NO: 31032 - DNA, 25 bp, S. cerevisiae
gaagccgactgtgctatggtcaatg

SEQ ID NO: 31033 - DNA, 25 bp, S. cerevisiae
gaagccgattgtttcatgaagcaac

SEQ ID NO: 31034 - DNA, 25 bp, S. cerevisiae
gaaccctttaacaaagcgagcctgg

SEQ ID NO: 31035 - DNA, 25 bp, S. cerevisiae
gaaccttcttcaagcaaggagacct

SEQ ID NO: 31036 - DNA, 25 bp, S. cerevisiae
gaaccttcacaactgtcagtgacaa

SEQ ID NO: 31037 - DNA, 25 bp, S. cerevisiae
gaagcccttgaaatgtccaaccaat

SEQ ID NO: 31038 - DNA, 25 bp, S. cerevisiae
gaagccctgtcatgattcctacaca

SEQ ID NO: 31039 - DNA, 25 bp, S. cerevisiae
gaacgccattgaggttactgaagat

SEQ ID NO: 31040 - DNA, 25 bp, S. cerevisiae
gaacctgatttctacttcgacgatg

SEQ ID NO: 31041 - DNA, 25 bp, S. cerevisiae
gaagcctgatttatatacgattatt

SEQ ID NO: 31042 - DNA, 25 bp, S. cerevisiae
gaagccttactactttagcaacaat

SEQ ID NO: 31043 - DNA, 25 bp, S. cerevisiae
gaagcctttgccctctttgataaag

SEQ ID NO: 31044 - DNA, 25 bp, S. cerevisiae
gaactatgtaagattttcgtagcca

SEQ ID NO: 31045 - DNA, 25 bp, S. cerevisiae
gaagccatgtcagcgttaacgtatg

SEQ ID NO: 31046 - DNA, 25 bp, S. cerevisiae
gaaccggagagtgatattccatcaa

SEQ ID NO: 31047 - DNA, 25 bp, S. cerevisiae
gaagccggtggttctcaagccagat

SEQ ID NO: 31048 - DNA, 25 bp, S. cerevisiae
gaagcctggttgtttcaagactgtt

SEQ ID NO: 31049 - DNA, 25 bp, S. cerevisiae
gaaccatccatcgttattgaccgtg

SEQ ID NO: 31050 - DNA, 25 bp, S. cerevisiae
gaagccgacgacatggaaccagttc

SEQ ID NO: 31051 - DNA, 25 bp, S. cerevisiae
gaacggacgaacctatgaccatttc

SEQ ID NO: 31052 - DNA, 25 bp, S. cerevisiae
gaaccggttatccttgaaattgcga

SEQ ID NO: 31053 - DNA, 25 bp, S. cerevisiae
gaacctggtgctacccaaatactgg

SEQ ID NO: 31054 - DNA, 25 bp, S. cerevisiae
gaaccgtcacttactacaatcacag

SEQ ID NO: 31055 - DNA, 25 bp, S. cerevisiae
gaacggtcagccaattcatggaaac

SEQ ID NO: 31056 - DNA, 25 bp, S. cerevisiae
gaagcgctagctctatcaggcaatg

SEQ ID NO: 31057 - DNA, 25 bp, S. cerevisiae
gaagccgatgatgagccagctccta

SEQ ID NO: 31058 - DNA, 25 bp, S. cerevisiae
gaagccgctgaaggtggtcctatcg

SEQ ID NO: 31059 - DNA, 25 bp, S. cerevisiae
gaagccgctgcaagaagtgtccaag

SEQ ID NO: 31060 - DNA, 25 bp, S. cerevisiae
gaagcccatatattgcagctgtcga

SEQ ID NO: 31061 - DNA, 25 bp, S. cerevisiae
gaacgccatgattatcgggccagcc

SEQ ID NO: 31062 - DNA, 25 bp, S. cerevisiae
gaagctgtgtctaggagcatcaaca

SEQ ID NO: 31063 - DNA, 25 bp, S. cerevisiae
gaagccactcttggtggttatccaa

SEQ ID NO: 31064 - DNA, 25 bp, S. cerevisiae
gaagcgactttctgttgatttagca

SEQ ID NO: 31065 - DNA, 25 bp, S. cerevisiae
gaagccactttctctaacttacaga

SEQ ID NO: 31066 - DNA, 25 bp, S. cerevisiae
gaagccagtttctctcgacaataaa

SEQ ID NO: 31067 - DNA, 25 bp, S. cerevisiae
gaaccaggttgctactttaatcaat

SEQ ID NO: 31068 - DNA, 25 bp, S. cerevisiae
gaagccaggcgtttgaagttagaaa

SEQ ID NO: 31069 - DNA, 25 bp, S. cerevisiae
gaacgcctggtatgaagtatagaca

SEQ ID NO: 31070 - DNA, 25 bp, S. cerevisiae
gaaccgttttagttcagattcctct

SEQ ID NO: 31071 - DNA, 25 bp, S. cerevisiae
gaagccatgactttggcacatcagt

SEQ ID NO: 31072 - DNA, 25 bp, S. cerevisiae
gaagccatcatatttagctgcaatg

SEQ ID NO: 31073 - DNA, 25 bp, S. cerevisiae
gaagcgcacatattggagcagaaat

SEQ ID NO: 31074 - DNA, 25 bp, S. cerevisiae
gaagccagagaagtcatgcagagaa

SEQ ID NO: 31075 - DNA, 25 bp, S. cerevisiae
gaaccaaagacaatatgagcacacg

SEQ ID NO: 31076 - DNA, 25 bp, S. cerevisiae
gaacaccaagtcattgaattccata

SEQ ID NO: 31077 - DNA, 25 bp, S. cerevisiae
gaagcggccggtggattcactaata

SEQ ID NO: 31078 - DNA, 25 bp, S. cerevisiae
gaaccggaagtacctgctactgatt

SEQ ID NO: 31079 - DNA, 25 bp, S. cerevisiae
gacaccaagacaaagactggctaat

SEQ ID NO: 31080 - DNA, 25 bp, S. cerevisiae
gaacccctgggtgctcattatatgc

SEQ ID NO: 31081 - DNA, 25 bp, S. cerevisiae
gaacggtacctaagtgcccaagagt

SEQ ID NO: 31082 - DNA, 25 bp, S. cerevisiae
gaaaagatacttacggcccaaggtg

SEQ ID NO: 31083 - DNA, 25 bp, S. cerevisiae
tcgtaagaagtcagaaccccaggtt

SEQ ID NO: 31084 - DNA, 25 bp, S. cerevisiae
tttaagggtcctgaactactagttg

SEQ ID NO: 31085 - DNA, 25 bp, S. cerevisiae
gaagcgccaaagaagcatagacctt

SEQ ID NO: 31086 - DNA, 25 bp, S. cerevisiae
gaacgtcataagaagtctggccttg

SEQ ID NO: 31087 - DNA, 25 bp, S. cerevisiae
gaagcgcactacaagcgtttgctca

SEQ ID NO: 31088 - DNA, 25 bp, S. cerevisiae
gaacgctggcagaggaattgcgaac

SEQ ID NO: 31089 - DNA, 25 bp, S. cerevisiae
gaagccggcgacaagatttcttaca

SEQ ID NO: 31090 - DNA, 25 bp, S. cerevisiae
gaagcctaagacttggttcctgctg

SEQ ID NO: 31091 - DNA, 25 bp, S. cerevisiae
gaactctcacggtcatggcaacggt

SEQ ID NO: 31092 - DNA, 25 bp, S. cerevisiae
gaaccagcgctggaagcactacggg

SEQ ID NO: 31093 - DNA, 25 bp, S. cerevisiae
gaagccggcttatgactatttgaga

SEQ ID NO: 31094 - DNA, 25 bp, S. cerevisiae
gaacctggtgaatttctatcgtcca

SEQ ID NO: 31095 - DNA, 25 bp, S. cerevisiae
gaaccaaatgaatttcttcgagacc

SEQ ID NO: 31096 - DNA, 25 bp, S. cerevisiae
gaagccaagaccatttttatcgcct

SEQ ID NO: 31097 - DNA, 25 bp, S. cerevisiae
gaagccgatatcattttgttgtcta

SEQ ID NO: 31098 - DNA, 25 bp, S. cerevisiae
gaacggtcccagcaagtatatgaaa

SEQ ID NO: 31099 - DNA, 25 bp, S. cerevisiae
gaagcgagctgtttgtaagtatcat

SEQ ID NO: 31100 - DNA, 25 bp, S. cerevisiae
gaagcgtctcttttgacaattcatc

SEQ ID NO: 31101 - DNA, 25 bp, S. cerevisiae
gaacgattcattcctagccattgac

SEQ ID NO: 31102 - DNA, 25 bp, S. cerevisiae
gaaccagttctgcataagccgtctg

SEQ ID NO: 31103 - DNA, 25 bp, S. cerevisiae
gaaccatccttttttcagccaatta

SEQ ID NO: 31104 - DNA, 25 bp, S. cerevisiae
gaacctgttacctttcttggaggct

SEQ ID NO: 31105 - DNA, 25 bp, S. cerevisiae
gaactggtgcgtgaattcctcggcg

SEQ ID NO: 31106 - DNA, 25 bp, S. cerevisiae
gaacgaatcgtatatgaccaaggca

SEQ ID NO: 31107 - DNA, 25 bp, S. cerevisiae
gaacgacacgtcagcctccaaaagt

SEQ ID NO: 31108 - DNA, 25 bp, S. cerevisiae
gaacctgacctttcgaatgggaacg

SEQ ID NO: 31109 - DNA, 25 bp, S. cerevisiae
gaaccaggccttttcaatgggaatt

SEQ ID NO: 31110 - DNA, 25 bp, S. cerevisiae
gaaccaaggttcatccaggtgatat

SEQ ID NO: 31111 - DNA, 25 bp, S. cerevisiae
gaaccgtggtatctccgaattcatc

SEQ ID NO: 31112 - DNA, 25 bp, S. cerevisiae
gaacttgtcgttctctaatttgtca

SEQ ID NO: 31113 - DNA, 25 bp, S. cerevisiae
gaagcgttctgcgatacatacaaca

SEQ ID NO: 31114 - DNA, 25 bp, S. cerevisiae
gaacggcatcatcatcgccaataag

SEQ ID NO: 31115 - DNA, 25 bp, S. cerevisiae
gaacggcagaagttgcgcagcgcaa

SEQ ID NO: 31116 - DNA, 25 bp, S. cerevisiae
gaacatgcaggcagatcatccacgc

SEQ ID NO: 31117 - DNA, 25 bp, S. cerevisiae
gaaccaatgcattcggtcatcaacg

SEQ ID NO: 31118 - DNA, 25 bp, S. cerevisiae
gaaccaatctcccagttaatctatg

SEQ ID NO: 31119 - DNA, 25 bp, S. cerevisiae
gaagccgtttgtagcgctttgcaat

SEQ ID NO: 31120 - DNA, 25 bp, S. cerevisiae
gaagcctgaatttcttgccaagaac

SEQ ID NO: 31121 - DNA, 25 bp, S. cerevisiae
gaagccgtcatgaatttgtcgaaac

SEQ ID NO: 31122 - DNA, 25 bp, S. cerevisiae
gaagccgctaaaatctttgagaact

SEQ ID NO: 31123 - DNA, 25 bp, S. cerevisiae
gaagcctggaaaatgttatctgcaa

SEQ ID NO: 31124 - DNA, 25 bp, S. cerevisiae
gaaccatgtcaaaattgcttctcaa

SEQ ID NO: 31125 - DNA, 25 bp, S. cerevisiae
gaaccatttaatttccttcaaggat

SEQ ID NO: 31126 - DNA, 25 bp, S. cerevisiae
gaactcaggtaatttgcccttaaat

SEQ ID NO: 31127 - DNA, 25 bp, S. cerevisiae
gaacgcgaaatttgggcctctgtca

SEQ ID NO: 31128 - DNA, 25 bp, S. cerevisiae
gaaccgtggatgatgtggtctctac

SEQ ID NO: 31129 - DNA, 25 bp, S. cerevisiae
gaagcctaacgttggttctgataga

SEQ ID NO: 31130 - DNA, 25 bp, S. cerevisiae
gaacctagtggttggtctttagcaa

SEQ ID NO: 31131 - DNA, 25 bp, S. cerevisiae
gaacctttggtcttggctaatctca

SEQ ID NO: 31132 - DNA, 25 bp, S. cerevisiae
gaaccttaggtcttggccagaacga

SEQ ID NO: 31133 - DNA, 25 bp, S. cerevisiae
gaagccattagagctcgtgccaagg

SEQ ID NO: 31134 - DNA, 25 bp, S. cerevisiae
gtacaaaatctactcctgggttcgt

SEQ ID NO: 31135 - DNA, 25 bp, S. cerevisiae
gaagccgccatcaaaaactcctacg

SEQ ID NO: 31136 - DNA, 25 bp, S. cerevisiae
gaagcgcctagattgaaaccagagc

SEQ ID NO: 31137 - DNA, 25 bp, S. cerevisiae
gaacgcactggaatataaccggctt

SEQ ID NO: 31138 - DNA, 25 bp, S. cerevisiae
gaaccactggaaaacatactcgctg

SEQ ID NO: 31139 - DNA, 25 bp, S. cerevisiae
gaacgtcaacggagccttcgcatgg

SEQ ID NO: 31140 - DNA, 25 bp, S. cerevisiae
gaagccataaatgctatccacatga

SEQ ID NO: 31141 - DNA, 25 bp, S. cerevisiae
gaagcgctctttgacactgaatgat

SEQ ID NO: 31142 - DNA, 25 bp, S. cerevisiae
gaagccatctaagccatcttactac

SEQ ID NO: 31143 - DNA, 25 bp, S. cerevisiae
gaagccactaatgcaagactttctg

SEQ ID NO: 31144 - DNA, 25 bp, S. cerevisiae
gaacccaacttgaaggcttttgcgg

SEQ ID NO: 31145 - DNA, 25 bp, S. cerevisiae
gaacctcgttactatatattgccct

SEQ ID NO: 31146 - DNA, 25 bp, S. cerevisiae
gaaccttatatgcaatccaccggga

SEQ ID NO: 31147 - DNA, 25 bp, S. cerevisiae
gaaccttcaaggtacgcaccgtcaa

SEQ ID NO: 31148 - DNA, 25 bp, S. cerevisiae
gaactttgagaggaatggcccgcta

SEQ ID NO: 31149 - DNA, 25 bp, S. cerevisiae
gaaccattgggttgacaccgtgtta

SEQ ID NO: 31150 - DNA, 25 bp, S. cerevisiae
gaaccaatgttgtaagcaccggatt

SEQ ID NO: 31151 - DNA, 25 bp, S. cerevisiae
gaagccaattattaactcggtcatc

SEQ ID NO: 31152 - DNA, 25 bp, S. cerevisiae
gaaccatgttgtctctttgattgaa

SEQ ID NO: 31153 - DNA, 25 bp, S. cerevisiae
gaacactacagcgatggcgacgttt

SEQ ID NO: 31154 - DNA, 25 bp, S. cerevisiae
gaacctaactgtggctggcggttaa

SEQ ID NO: 31155 - DNA, 25 bp, S. cerevisiae
gaacctactattggtgccgcatttt

SEQ ID NO: 31156 - DNA, 25 bp, S. cerevisiae
gaaccgtgtcattattgacgctctt

SEQ ID NO: 31157 - DNA, 25 bp, S. cerevisiae
gaacctgttttgaaggcgctttatg

SEQ ID NO: 31158 - DNA, 25 bp, S. cerevisiae
gaacgctttttgctacacattttgg

SEQ ID NO: 31159 - DNA, 25 bp, S. cerevisiae
gaacctttgagcactgatcctctaa

SEQ ID NO: 31160 - DNA, 25 bp, S. cerevisiae
gaaccttcagactcagttcctcaag

SEQ ID NO: 31161 - DNA, 25 bp, S. cerevisiae
gaaccaaatgactgctggtccaaca

SEQ ID NO: 31162 - DNA, 25 bp, S. cerevisiae
gaacgaattccaggtgattccgata

SEQ ID NO: 31163 - DNA, 25 bp, S. cerevisiae
gaactgtttccactggagagccgat

SEQ ID NO: 31164 - DNA, 25 bp, S. cerevisiae
gaacgcagcattgtgtgaggctctt

SEQ ID NO: 31165 - DNA, 25 bp, S. cerevisiae
gaacggttccgtgcatatttgggac

SEQ ID NO: 31166 - DNA, 25 bp, S. cerevisiae
gaacggccatctccaagacaaatga

SEQ ID NO: 31167 - DNA, 25 bp, S. cerevisiae
gaacaggcccttgacatatcaaaga

SEQ ID NO: 31168 - DNA, 25 bp, S. cerevisiae
gaacggcaaccccaatgatcaaata

SEQ ID NO: 31169 - DNA, 25 bp, S. cerevisiae
gaaccaaataccaaaagagccttat

SEQ ID NO: 31170 - DNA, 25 bp, S. cerevisiae
gaacgttaacgtcctgtattgcgat

SEQ ID NO: 31171 - DNA, 25 bp, S. cerevisiae
gaacgacataccaagcattgtttct

SEQ ID NO: 31172 - DNA, 25 bp, S. cerevisiae
gaaccaactcacatcatctgcaaaa

SEQ ID NO: 31173 - DNA, 25 bp, S. cerevisiae
gaactgctccccattggaatacgaa

SEQ ID NO: 31174 - DNA, 25 bp, S. cerevisiae
gaagccatggccataagtgaacata

SEQ ID NO: 31175 - DNA, 25 bp, S. cerevisiae
gaagccttgctcatcttggatatct

SEQ ID NO: 31176 - DNA, 25 bp, S. cerevisiae
gaacgcatctagtgctgcatcggaa

SEQ ID NO: 31177 - DNA, 25 bp, S. cerevisiae
gaaatcattgagtcagtgcacctga

SEQ ID NO: 31178 - DNA, 25 bp, S. cerevisiae
gaaccagcagatgaggatcctgaag

SEQ ID NO: 31179 - DNA, 25 bp, S. cerevisiae
gaaccgcagatcgaagtgcctcaga

SEQ ID NO: 31180 - DNA, 25 bp, S. cerevisiae
gaaccattgatcagcgatccattga

SEQ ID NO: 31181 - DNA, 25 bp, S. cerevisiae
gaaccagattattcaggcaaggcta

SEQ ID NO: 31182 - DNA, 25 bp, S. cerevisiae
gaagcctgcatttccggtagactat

SEQ ID NO: 31183 - DNA, 25 bp, S. cerevisiae
gaactttgtgttcactttcactgcc

SEQ ID NO: 31184 - DNA, 25 bp, S. cerevisiae
gaactccgtagtttttctagacagc

SEQ ID NO: 31185 - DNA, 25 bp, S. cerevisiae
gaacctaggttacgctctctgatta

SEQ ID NO: 31186 - DNA, 25 bp, S. cerevisiae
gaacgaatggtcactaccgctacta

SEQ ID NO: 31187 - DNA, 25 bp, S. cerevisiae
gaacgagttcccattagcttatgtc

SEQ ID NO: 31188 - DNA, 25 bp, S. cerevisiae
gaacgtcctatcgtcgcaagtactt

SEQ ID NO: 31189 - DNA, 25 bp, S. cerevisiae
gaacgactgtcttttgaaaactgct

SEQ ID NO: 31190 - DNA, 25 bp, S. cerevisiae
gaagccaaatctgttacgcacggtg

SEQ ID NO: 31191 - DNA, 25 bp, S. cerevisiae
gaagcctaattgcttgatcgccaga

SEQ ID NO: 31192 - DNA, 25 bp, S. cerevisiae
gaactcaattaccttccgaatggac

SEQ ID NO: 31193 - DNA, 25 bp, S. cerevisiae
gaaccatttacgagccgttgagcag

SEQ ID NO: 31194 - DNA, 25 bp, S. cerevisiae
gaaccgttatcagcagcggattacg

SEQ ID NO: 31195 - DNA, 25 bp, S. cerevisiae
gaacggacatgcatctcgcgtggca

SEQ ID NO: 31196 - DNA, 25 bp, S. cerevisiae
gaacatggacatgggtatgggtcat

SEQ ID NO: 31197 - DNA, 25 bp, S. cerevisiae
gaacgcatgtcatcgtatggagtct

SEQ ID NO: 31198 - DNA, 25 bp, S. cerevisiae
gaagccatgccatcagaatagttgc

SEQ ID NO: 31199 - DNA, 25 bp, S. cerevisiae
gaactcgacaactttcagattgctg

SEQ ID NO: 31200 - DNA, 25 bp, S. cerevisiae
gaacttctacttttcttcattcgcc

SEQ ID NO: 31201 - DNA, 25 bp, S. cerevisiae
gaagccttcacttttgctatcagat

SEQ ID NO: 31202 - DNA, 25 bp, S. cerevisiae
gaacctcaagtacgatcacatcaat

SEQ ID NO: 31203 - DNA, 25 bp, S. cerevisiae
gaacaccatgggtctcatccataat

SEQ ID NO: 31204 - DNA, 25 bp, S. cerevisiae
gaacctcgtcgcttcatcaatgaga

SEQ ID NO: 31205 - DNA, 25 bp, S. cerevisiae
gaactagacggtccatacatgtcga

SEQ ID NO: 31206 - DNA, 25 bp, S. cerevisiae
gaacgcagttcttctgcattcacta

SEQ ID NO: 31207 - DNA, 25 bp, S. cerevisiae
gaaccagcattctatcatcactata

SEQ ID NO: 31208 - DNA, 25 bp, S. cerevisiae
gaaccatcccagtatctcataaaat

SEQ ID NO: 31209 - DNA, 25 bp, S. cerevisiae
gaacctaccatcttataatcacaat

SEQ ID NO: 31210 - DNA, 25 bp, S. cerevisiae
gaaccaagcctttattgagcgtgtt

SEQ ID NO: 31211 - DNA, 25 bp, S. cerevisiae
gaacgaagccgctttagcctgtgat

SEQ ID NO: 31212 - DNA, 25 bp, S. cerevisiae
gaacggagatttgtccaggactgaa

SEQ ID NO: 31213 - DNA, 25 bp, S. cerevisiae
gaacgagatgttccgctacaagacg

SEQ ID NO: 31214 - DNA, 25 bp, S. cerevisiae
gaacgaaggtcatatcaaatacgaa

SEQ ID NO: 31215 - DNA, 25 bp, S. cerevisiae
gaacggaagtcatacactcaacagt

SEQ ID NO: 31216 - DNA, 25 bp, S. cerevisiae
gaacgggaccaataatgctacagct

SEQ ID NO: 31217 - DNA, 25 bp, S. cerevisiae
gaacctatcggtttgcatccaaaaa

SEQ ID NO: 31218 - DNA, 25 bp, S. cerevisiae
gaaccagtttgtaacctcaagaagt

SEQ ID NO: 31219 - DNA, 25 bp, S. cerevisiae
gaaccatgtgtcttcttctgacgag

SEQ ID NO: 31220 - DNA, 25 bp, S. cerevisiae
gaacaagtgtgctatctagtggcta

SEQ ID NO: 31221 - DNA, 25 bp, S. cerevisiae
gaaccagctggcaactcggtgcagg

SEQ ID NO: 31222 - DNA, 25 bp, S. cerevisiae
gaacgaatgatgacactggcgccaa

SEQ ID NO: 31223 - DNA, 25 bp, S. cerevisiae
gaactaaagtgttttgccccattat

SEQ ID NO: 31224 - DNA, 25 bp, S. cerevisiae
gaacgcaatgagtactctggtccat

SEQ ID NO: 31225 - DNA, 25 bp, S. cerevisiae
gaaccatctgggacattttaccgtt

SEQ ID NO: 31226 - DNA, 25 bp, S. cerevisiae
gaacgagtttgaagattcccggagt

SEQ ID NO: 31227 - DNA, 25 bp, S. cerevisiae
gaaccagtttgctagatctcacgct

SEQ ID NO: 31228 - DNA, 25 bp, S. cerevisiae
gaaccttttgggtttgccactcaga

SEQ ID NO: 31229 - DNA, 25 bp, S. cerevisiae
gaacgttctattcatttccacaaac

SEQ ID NO: 31230 - DNA, 25 bp, S. cerevisiae
gaacagcctgatggtacttggagat

SEQ ID NO: 31231 - DNA, 25 bp, S. cerevisiae
gaaccatttggtcctggatctggcg

SEQ ID NO: 31232 - DNA, 25 bp, S. cerevisiae
gaacttttggtttgaatctgacgaa

SEQ ID NO: 31233 - DNA, 25 bp, S. cerevisiae
gaacctttcgactgacatggccata

SEQ ID NO: 31234 - DNA, 25 bp, S. cerevisiae
gaacttttgacagaacctacaccag

SEQ ID NO: 31235 - DNA, 25 bp, S. cerevisiae
gaaccggttttcaacgccatgtgga

SEQ ID NO: 31236 - DNA, 25 bp, S. cerevisiae
gaaccgtagtatattggctgtccat

SEQ ID NO: 31237 - DNA, 25 bp, S. cerevisiae
gaaccagtcttggaagctatcttcg

SEQ ID NO: 31238 - DNA, 25 bp, S. cerevisiae
gaactttacatggtcaagggccgta

SEQ ID NO: 31239 - DNA, 25 bp, S. cerevisiae
gaactacgaaccaaattcctccaag

SEQ ID NO: 31240 - DNA, 25 bp, S. cerevisiae
gaacgcccaagaaaccgctttgaag

SEQ ID NO: 31241 - DNA, 25 bp, S. cerevisiae
gaaccaagcataatacccgcgttaa

SEQ ID NO: 31242 - DNA, 25 bp, S. cerevisiae
gaactccgctagaaagttgcgtgtc

SEQ ID NO: 31243 - DNA, 25 bp, S. cerevisiae
gaaccttggagaatgcaacgcagta

SEQ ID NO: 31244 - DNA, 25 bp, S. cerevisiae
gaaccatccaatcgacagaacgttt

SEQ ID NO: 31245 - DNA, 25 bp, S. cerevisiae
gaacctgagttaaacgtgtcgctta

SEQ ID NO: 31246 - DNA, 25 bp, S. cerevisiae
gaacctgatgttgaacgaccccata

SEQ ID NO: 31247 - DNA, 25 bp, S. cerevisiae
gaacctgttgatgaagctgaactaa

SEQ ID NO: 31248 - DNA, 25 bp, S. cerevisiae
gaacttggtgtcaaacttggtcaac

SEQ ID NO: 31249 - DNA, 25 bp, S. cerevisiae
gaaccctgtggcctcgaacttggtt

SEQ ID NO: 31250 - DNA, 25 bp, S. cerevisiae
gaacctcgttccaggattttctgat

SEQ ID NO: 31251 - DNA, 25 bp, S. cerevisiae
gaactttttctctgtttttgtatgt

SEQ ID NO: 31252 - DNA, 25 bp, S. cerevisiae
gaacccaggtcttttccagaagttg

SEQ ID NO: 31253 - DNA, 25 bp, S. cerevisiae
gaaccacggtgcattactcgagtga

SEQ ID NO: 31254 - DNA, 25 bp, S. cerevisiae
gaacccttatactaacagcagcata

SEQ ID NO: 31255 - DNA, 25 bp, S. cerevisiae
gaaccctcactaccgaacaatatgg

SEQ ID NO: 31256 - DNA, 25 bp, S. cerevisiae
gaacgctacacttccatagaatctg

SEQ ID NO: 31257 - DNA, 25 bp, S. cerevisiae
gaactgcaccgtacgctcagaatat

SEQ ID NO: 31258 - DNA, 25 bp, S. cerevisiae
gaaccggtgatcaggcagcacaatt

SEQ ID NO: 31259 - DNA, 25 bp, S. cerevisiae
gaaccgtgcctcagatgtcaagatt

SEQ ID NO: 31260 - DNA, 25 bp, S. cerevisiae
gacactttgaggttgctaatttgct

SEQ ID NO: 31261 - DNA, 25 bp, S. cerevisiae
gaacccgaccgtgacaatgatgata

SEQ ID NO: 31262 - DNA, 25 bp, S. cerevisiae
gaacgccaatctagtcccaataata

SEQ ID NO: 31263 - DNA, 25 bp, S. cerevisiae
gaacagtcacctaatccagttgaat

SEQ ID NO: 31264 - DNA, 25 bp, S. cerevisiae
gaacctattcgccatgctagttgaa

SEQ ID NO: 31265 - DNA, 25 bp, S. cerevisiae
gaacctttactacatgtgctgacaa

SEQ ID NO: 31266 - DNA, 25 bp, S. cerevisiae
gaacctttactgcatttcgatgtat

SEQ ID NO: 31267 - DNA, 25 bp, S. cerevisiae
gaaccggtgaatcttctcgcattta

SEQ ID NO: 31268 - DNA, 25 bp, S. cerevisiae
gaaccgcctacacatttggttagag

SEQ ID NO: 31269 - DNA, 25 bp, S. cerevisiae
gaacccgctgaacatgttggtccag

SEQ ID NO: 31270 - DNA, 25 bp, S. cerevisiae
gaacggcgccaaactactagatatt

SEQ ID NO: 31271 - DNA, 25 bp, S. cerevisiae
gaacctgccgcaaaactgttgatta

SEQ ID NO: 31272 - DNA, 25 bp, S. cerevisiae
gaaccatattagatccacttgcaga

SEQ ID NO: 31273 - DNA, 25 bp, S. cerevisiae
gaactcaaatagacaccagtgctac

SEQ ID NO: 31274 - DNA, 25 bp, S. cerevisiae
gaacctacggtcaaagagctgtctt

SEQ ID NO: 31275 - DNA, 25 bp, S. cerevisiae
gaaactctcgggatggacgtcttta

SEQ ID NO: 31276 - DNA, 25 bp, S. cerevisiae
gaaacttacaggaatcacccctttg

SEQ ID NO: 31277 - DNA, 25 bp, S. cerevisiae
gaactgtctagagtatccctccttg

SEQ ID NO: 31278 - DNA, 25 bp, S. cerevisiae
gaaccatcgagacctttattccaga

SEQ ID NO: 31279 - DNA, 25 bp, S. cerevisiae
gaaccattgccgatattataccaaa

SEQ ID NO: 31280 - DNA, 25 bp, S. cerevisiae
gaacctattcagagcgtaaccgaag

SEQ ID NO: 31281 - DNA, 25 bp, S. cerevisiae
gaacctggtttcttagtctttgaca

SEQ ID NO: 31282 - DNA, 25 bp, S. cerevisiae
gaactttctactgctactgttcctg

SEQ ID NO: 31283 - DNA, 25 bp, S. cerevisiae
gaacgtagacatgaccacttggaga

SEQ ID NO: 31284 - DNA, 25 bp, S. cerevisiae
gaacgctgaacaacacaacttggtc

SEQ ID NO: 31285 - DNA, 25 bp, S. cerevisiae
gaacagcgtgaagctcaagcacaag

SEQ ID NO: 31286 - DNA, 25 bp, S. cerevisiae
gaactccaccaatattgcttttttc

SEQ ID NO: 31287 - DNA, 25 bp, S. cerevisiae
gaacgccctaatatggctttatttg

SEQ ID NO: 31288 - DNA, 25 bp, S. cerevisiae
gaacccgtcttttatcattatgatt

SEQ ID NO: 31289 - DNA, 25 bp, S. cerevisiae
gaacgactcgctgctggttgattta

SEQ ID NO: 31290 - DNA, 25 bp, S. cerevisiae
gaacgctttttcctttgtgtcttat

SEQ ID NO: 31291 - DNA, 25 bp, S. cerevisiae
gaacctcattttgcttttatgatgc

SEQ ID NO: 31292 - DNA, 25 bp, S. cerevisiae
gaactgaacaatgcctggtctgtga

SEQ ID NO: 31293 - DNA, 25 bp, S. cerevisiae
gaacgttctcagacttgtcctattt

SEQ ID NO: 31294 - DNA, 25 bp, S. cerevisiae
gaaccggcttctttgcaattaatgc

SEQ ID NO: 31295 - DNA, 25 bp, S. cerevisiae
gaacccactatcattgccattaatc

SEQ ID NO: 31296 - DNA, 25 bp, S. cerevisiae
gaacctgatgttcatatccccatga

SEQ ID NO: 31297 - DNA, 25 bp, S. cerevisiae
gaacctgctggttttacgcacaaac

SEQ ID NO: 31298 - DNA, 25 bp, S. cerevisiae
gaactttgggagctacgtgacacac

SEQ ID NO: 31299 - DNA, 25 bp, S. cerevisiae
gaactacggtgtgtacggcatcaat

SEQ ID NO: 31300 - DNA, 25 bp, S. cerevisiae
gaactctacaaggtttgcatttgct

SEQ ID NO: 31301 - DNA, 25 bp, S. cerevisiae
gacaaggctaggagactaggctaca

SEQ ID NO: 31302 - DNA, 25 bp, S. cerevisiae
gaacggtaagcctgatcccgagggt

SEQ ID NO: 31303 - DNA, 25 bp, S. cerevisiae
gaaccgtacggtaatacctgattgg

SEQ ID NO: 31304 - DNA, 25 bp, S. cerevisiae
gaaccgtcaaaatgacatcactgat

SEQ ID NO: 31305 - DNA, 25 bp, S. cerevisiae
gaaccggcaagacttaaccagattt

SEQ ID NO: 31306 - DNA, 25 bp, S. cerevisiae
gaacccaacgcatattatctcctat

SEQ ID NO: 31307 - DNA, 25 bp, S. cerevisiae
gaactccatagcgaaagtaccactg

SEQ ID NO: 31308 - DNA, 25 bp, S. cerevisiae
gaactgcatagccaagggtaccact

SEQ ID NO: 31309 - DNA, 25 bp, S. cerevisiae
gaactcagaagctctgcccaagaga

SEQ ID NO: 31310 - DNA, 25 bp, S. cerevisiae
gaactgcgcagtccggttataacgt

SEQ ID NO: 31311 - DNA, 25 bp, S. cerevisiae
gaactcgcttgctcgtcatatgcaa

SEQ ID NO: 31312 - DNA, 25 bp, S. cerevisiae
gaactggccatattagatctgatcc

SEQ ID NO: 31313 - DNA, 25 bp, S. cerevisiae
gaacgccgctactacgtaaacttat

SEQ ID NO: 31314 - DNA, 25 bp, S. cerevisiae
gaacgcctttctaggtaataccgat

SEQ ID NO: 31315 - DNA, 25 bp, S. cerevisiae
gaacctgcttccaagtacaaaccga

SEQ ID NO: 31316 - DNA, 25 bp, S. cerevisiae
gaacgtggctctggactacaagaac

SEQ ID NO: 31317 - DNA, 25 bp, S. cerevisiae
gaacggattctcctttgataaccag

SEQ ID NO: 31318 - DNA, 25 bp, S. cerevisiae
gaacagggtttgtttgatagcaaca

SEQ ID NO: 31319 - DNA, 25 bp, S. cerevisiae
gaaccgcctctgataccagtgttat

SEQ ID NO: 31320 - DNA, 25 bp, S. cerevisiae
gaacgaggccagcaagcttttcaat

SEQ ID NO: 31321 - DNA, 25 bp, S. cerevisiae
gaacctgagccgtaactttgcttat

SEQ ID NO: 31322 - DNA, 25 bp, S. cerevisiae
gaacgccgtggcatctttaaagaaa

SEQ ID NO: 31323 - DNA, 25 bp, S. cerevisiae
gaacccgctgccatgtagtgacaag

SEQ ID NO: 31324 - DNA, 25 bp, S. cerevisiae
gaacccatgcccatgattctgcaat

SEQ ID NO: 31325 - DNA, 25 bp, S. cerevisiae
gaaccgtgccaaacatctatattaa

SEQ ID NO: 31326 - DNA, 25 bp, S. cerevisiae
gaacgattgccgcttttgtcgtagc

SEQ ID NO: 31327 - DNA, 25 bp, S. cerevisiae
gaacgaactactattaccaagcgaa

SEQ ID NO: 31328 - DNA, 25 bp, S. cerevisiae
gaacgacaaatcacttactccagaa

SEQ ID NO: 31329 - DNA, 25 bp, S. cerevisiae
gaactggcctctaaatatatatact

SEQ ID NO: 31330 - DNA, 25 bp, S. cerevisiae
gaacgaggctcatcaacttcaacta

SEQ ID NO: 31331 - DNA, 25 bp, S. cerevisiae
gaacatgggcctttatggtgaacga

SEQ ID NO: 31332 - DNA, 25 bp, S. cerevisiae
gaactcgaccgatttagctacggat

SEQ ID NO: 31333 - DNA, 25 bp, S. cerevisiae
gaactgcgttaaatccggtcgatca

SEQ ID NO: 31334 - DNA, 25 bp, S. cerevisiae
gaacgagttcaaaacgtctcagcat

SEQ ID NO: 31335 - DNA, 25 bp, S. cerevisiae
gaacgcagctcccaatttgttagat

SEQ ID NO: 31336 - DNA, 25 bp, S. cerevisiae
gaacgactttcactattgattatga

SEQ ID NO: 31337 - DNA, 25 bp, S. cerevisiae
gaacgacgatctagttgcttctcaa

SEQ ID NO: 31338 - DNA, 25 bp, S. cerevisiae
gaacgaccatttgcttgtcacatat

SEQ ID NO: 31339 - DNA, 25 bp, S. cerevisiae
gaacataccgttgattgcgcgatat

SEQ ID NO: 31340 - DNA, 25 bp, S. cerevisiae
tgaacccctgagtggtagcgagcca

SEQ ID NO: 31341 - DNA, 25 bp, S. cerevisiae
gaaccgcttagaaatgtcatggcag

SEQ ID NO: 31342 - DNA, 25 bp, S. cerevisiae
gaacgctgcgctgttggctgtcaga

SEQ ID NO: 31343 - DNA, 25 bp, S. cerevisiae
gaacgtgccagattttgtccagctg

SEQ ID NO: 31344 - DNA, 25 bp, S. cerevisiae
gaacgatactttactgtccgtcgac

SEQ ID NO: 31345 - DNA, 25 bp, S. cerevisiae
gaacttacatggttatggtcaccca

SEQ ID NO: 31346 - DNA, 25 bp, S. cerevisiae
gaacttccacgcagaggtcagcact

SEQ ID NO: 31347 - DNA, 25 bp, S. cerevisiae
gaacttccactaatacagtcgcctt

SEQ ID NO: 31348 - DNA, 25 bp, S. cerevisiae
gaacgtctcctaaagatatcgccga

SEQ ID NO: 31349 - DNA, 25 bp, S. cerevisiae
gaaccctattgaacaaactgccagc

SEQ ID NO: 31350 - DNA, 25 bp, S. cerevisiae
gaactcttcattcagatcaaccctg

SEQ ID NO: 31351 - DNA, 25 bp, S. cerevisiae
gaactgcccagtcttcaaagcgatc

SEQ ID NO: 31352 - DNA, 25 bp, S. cerevisiae
gaacttcaagtgtttctagtagtcc

SEQ ID NO: 31353 - DNA, 25 bp, S. cerevisiae
gaacttctgcccatattttacgttg

SEQ ID NO: 31354 - DNA, 25 bp, S. cerevisiae
gaactttcaccgaattttctcaacg

SEQ ID NO: 31355 - DNA, 25 bp, S. cerevisiae
gaactttttgactaccacgatgctg

SEQ ID NO: 31356 - DNA, 25 bp, S. cerevisiae
gaactaattgatagctcctccgatc

SEQ ID NO: 31357 - DNA, 25 bp, S. cerevisiae
gaacggtactgtcttgccatgtaac

SEQ ID NO: 31358 - DNA, 25 bp, S. cerevisiae
gaacgagaccttatctggcattgat

SEQ ID NO: 31359 - DNA, 25 bp, S. cerevisiae
gaacgtgctctatttacatggaagt

SEQ ID NO: 31360 - DNA, 25 bp, S. cerevisiae
gaacggcttattacctattagattg

SEQ ID NO: 31361 - DNA, 25 bp, S. cerevisiae
gaacccactgttgctaccgaaagtt

SEQ ID NO: 31362 - DNA, 25 bp, S. cerevisiae
gaaccctctttggtacatgcgataa

SEQ ID NO: 31363 - DNA, 25 bp, S. cerevisiae
gaacccactttgatgaatctcgaca

SEQ ID NO: 31364 - DNA, 25 bp, S. cerevisiae
gaacccaagtctgcggatacataca

SEQ ID NO: 31365 - DNA, 25 bp, S. cerevisiae
gaacccagattctcagtctcaagac

SEQ ID NO: 31366 - DNA, 25 bp, S. cerevisiae
gaaccgcagcatactacttttcatg

SEQ ID NO: 31367 - DNA, 25 bp, S. cerevisiae
gaacatcgcagcacatcttttacgc

SEQ ID NO: 31368 - DNA, 25 bp, S. cerevisiae
gaaccgcagctgaatctattgccaa

SEQ ID NO: 31369 - DNA, 25 bp, S. cerevisiae
gaacggccgaggtatcaaataattt

SEQ ID NO: 31370 - DNA, 25 bp, S. cerevisiae
gaacgaacgagcacatccaattatt

SEQ ID NO: 31371 - DNA, 25 bp, S. cerevisiae
gaactgaagttcagccctgttatta

SEQ ID NO: 31372 - DNA, 25 bp, S. cerevisiae
gaacgtatattcagccacagtggat

SEQ ID NO: 31373 - DNA, 25 bp, S. cerevisiae
gaactgaagttcaagccagactggg

SEQ ID NO: 31374 - DNA, 25 bp, S. cerevisiae
gaacatgaagtttcagccaagcttg

SEQ ID NO: 31375 - DNA, 25 bp, S. cerevisiae
gaacaggatgtttacgccgatggcc

SEQ ID NO: 31376 - DNA, 25 bp, S. cerevisiae
gaacgtgttaaagtgcacttcgacc

SEQ ID NO: 31377 - DNA, 25 bp, S. cerevisiae
gaacttgtccagtagtcacttcatg

SEQ ID NO: 31378 - DNA, 25 bp, S. cerevisiae
gaacttgtccgctgtgtacttggaa

SEQ ID NO: 31379 - DNA, 25 bp, S. cerevisiae
gaacttgttgcaattggctccaggt

SEQ ID NO: 31380 - DNA, 25 bp, S. cerevisiae
gaactcctatgtacatggctccaga

SEQ ID NO: 31381 - DNA, 25 bp, S. cerevisiae
gaacccatattaattgctcacagga

SEQ ID NO: 31382 - DNA, 25 bp, S. cerevisiae
gaacccatatatttgtgccacatcc

SEQ ID NO: 31383 - DNA, 25 bp, S. cerevisiae
gaacgatctcagtagcgctgttgct

SEQ ID NO: 31384 - DNA, 25 bp, S. cerevisiae
gaacggtggaaacgctagctccagc

SEQ ID NO: 31385 - DNA, 25 bp, S. cerevisiae
gaacggtgaatatatcgcactcgag

SEQ ID NO: 31386 - DNA, 25 bp, S. cerevisiae
gaactggattctctagacctgaaca

SEQ ID NO: 31387 - DNA, 25 bp, S. cerevisiae
gaacgaatatccatggtccagaaca

SEQ ID NO: 31388 - DNA, 25 bp, S. cerevisiae
gaactaaatgcgctgcttgccgaac

SEQ ID NO: 31389 - DNA, 25 bp, S. cerevisiae
gaactaatcagagaggtgcttgaac

SEQ ID NO: 31390 - DNA, 25 bp, S. cerevisiae
gaactacatacagcacgtgtccaga

SEQ ID NO: 31391 - DNA, 25 bp, S. cerevisiae
gaactctcaatacacctgccaagac

SEQ ID NO: 31392 - DNA, 25 bp, S. cerevisiae
gaaaaaatctttgccttgtccgtcg

SEQ ID NO: 31393 - DNA, 25 bp, S. cerevisiae
gaaaacgactacacatctttaaata

SEQ ID NO: 31394 - DNA, 25 bp, S. cerevisiae
gaaaatcccaacacctatcaaagcc

SEQ ID NO: 31395 - DNA, 25 bp, S. cerevisiae
gaaaattcctaatcctcaagtccct

SEQ ID NO: 31396 - DNA, 25 bp, S. cerevisiae
gaaaactctctatgaaacggccctt

SEQ ID NO: 31397 - DNA, 25 bp, S. cerevisiae
gaactagaccaatatgaacgtgcca

SEQ ID NO: 31398 - DNA, 25 bp, S. cerevisiae
gaactagagtcttatccaacggaca

SEQ ID NO: 31399 - DNA, 25 bp, S. cerevisiae
gaacatcaaggctttggaccactaa

SEQ ID NO: 31400 - DNA, 25 bp, S. cerevisiae
gaactccgacatgatgataccttta

SEQ ID NO: 31401 - DNA, 25 bp, S. cerevisiae
gaacgcccttaaactggtaacagat

SEQ ID NO: 31402 - DNA, 25 bp, S. cerevisiae
gaactgctcgcgaaaactggtctaa

SEQ ID NO: 31403 - DNA, 25 bp, S. cerevisiae
gaacccaggaagtattgctgatctt

SEQ ID NO: 31404 - DNA, 25 bp, S. cerevisiae
gaactccatggcaactttcttatta

SEQ ID NO: 31405 - DNA, 25 bp, S. cerevisiae
gaactcctgccaccagatatgtttt

SEQ ID NO: 31406 - DNA, 25 bp, S. cerevisiae
gaacatgctccctcaattatcttta

SEQ ID NO: 31407 - DNA, 25 bp, S. cerevisiae
gaactatcccagtataactactttg

SEQ ID NO: 31408 - DNA, 25 bp, S. cerevisiae
gaactcatcgaccactaacgtgcta

SEQ ID NO: 31409 - DNA, 25 bp, S. cerevisiae
gaacttcaaccacatcatcaatcat

SEQ ID NO: 31410 - DNA, 25 bp, S. cerevisiae
gaacttcatgtccatgcttcaggaa

SEQ ID NO: 31411 - DNA, 25 bp, S. cerevisiae
gaacttatgcatcagctcacgcaag

SEQ ID NO: 31412 - DNA, 25 bp, S. cerevisiae
gaacttagagaggtcacgcaactat

SEQ ID NO: 31413 - DNA, 25 bp, S. cerevisiae
gaacattaaggctctcagtatcgat

SEQ ID NO: 31414 - DNA, 25 bp, S. cerevisiae
gaacgttatcttagcaccatggtgt

SEQ ID NO: 31415 - DNA, 25 bp, S. cerevisiae
gaacttgccaggtctactgatgagt

SEQ ID NO: 31416 - DNA, 25 bp, S. cerevisiae
gaactcccatgtaatacttgcagct

SEQ ID NO: 31417 - DNA, 25 bp, S. cerevisiae
gaacgtcaacaattggcctatgatt

SEQ ID NO: 31418 - DNA, 25 bp, S. cerevisiae
gaacagcttcaacgtacctcttaag

SEQ ID NO: 31419 - DNA, 25 bp, S. cerevisiae
gaacagcgccatctgtgtacagact

SEQ ID NO: 31420 - DNA, 25 bp, S. cerevisiae
gaactgctccaaagtctgacaatgt

SEQ ID NO: 31421 - DNA, 25 bp, S. cerevisiae
gaacgtatcaaaatcgcctgccaat

SEQ ID NO: 31422 - DNA, 25 bp, S. cerevisiae
gaacgaatcatcctcaaacgccaat

SEQ ID NO: 31423 - DNA, 25 bp, S. cerevisiae
gaacaggaccatgaagacgccacta

SEQ ID NO: 31424 - DNA, 25 bp, S. cerevisiae
gaacaggacgatgtagccactaaaa

SEQ ID NO: 31425 - DNA, 25 bp, S. cerevisiae
gagcagtgggttcgctaacattcga

SEQ ID NO: 31426 - DNA, 25 bp, S. cerevisiae
gaactgataggattacagcccatat

SEQ ID NO: 31427 - DNA, 25 bp, S. cerevisiae
gaactgttgtgctatgtcggctaca

SEQ ID NO: 31428 - DNA, 25 bp, S. cerevisiae
gaactacatagccaaggtcttctca

SEQ ID NO: 31429 - DNA, 25 bp, S. cerevisiae
gaacggcatcatcaacgtttcagca

SEQ ID NO: 31430 - DNA, 25 bp, S. cerevisiae
gaacgtgccaaatcgctgttgaaat

SEQ ID NO: 31431 - DNA, 25 bp, S. cerevisiae
gaacgtgccttatctgctttcaaag

SEQ ID NO: 31432 - DNA, 25 bp, S. cerevisiae
gaacgacgagatccgaacagcagca

SEQ ID NO: 31433 - DNA, 25 bp, S. cerevisiae
gaacgataatcctgagaccagcaga

SEQ ID NO: 31434 - DNA, 25 bp, S. cerevisiae
gaacgatgctatgttgagcctcgaa

SEQ ID NO: 31435 - DNA, 25 bp, S. cerevisiae
gaacgcttcagcattggatctctaa

SEQ ID NO: 31436 - DNA, 25 bp, S. cerevisiae
gaactaccagtttgcagccataacc

SEQ ID NO: 31437 - DNA, 25 bp, S. cerevisiae
gaacttctcagaagcgagccttacc

SEQ ID NO: 31438 - DNA, 25 bp, S. cerevisiae
gaacttctgctaaaggctctggacc

SEQ ID NO: 31439 - DNA, 25 bp, S. cerevisiae
gaactttgaagcgacactggaatca

SEQ ID NO: 31440 - DNA, 25 bp, S. cerevisiae
gaacgagttgcttgcgttgggcaat

SEQ ID NO: 31441 - DNA, 25 bp, S. cerevisiae
gaacaggattctccagtgttggtat

SEQ ID NO: 31442 - DNA, 25 bp, S. cerevisiae
gaactgtttcctccactcataagaa

SEQ ID NO: 31443 - DNA, 25 bp, S. cerevisiae
gaacgtttgctttttgtttgcatct

SEQ ID NO: 31444 - DNA, 25 bp, S. cerevisiae
gaactccttttatagctttgcatgc

SEQ ID NO: 31445 - DNA, 25 bp, S. cerevisiae
gaactactcctcatcgttagcgatt

SEQ ID NO: 31446 - DNA, 25 bp, S. cerevisiae
gaacgatccgcaaacgatgctatgg

SEQ ID NO: 31447 - DNA, 25 bp, S. cerevisiae
gaacgatctcgatatgatgatgcta

SEQ ID NO: 31448 - DNA, 25 bp, S. cerevisiae
gaacgtcattttatatggccccaga

SEQ ID NO: 31449 - DNA, 25 bp, S. cerevisiae
gaacgattttaaatgattccaacga

SEQ ID NO: 31450 - DNA, 25 bp, S. cerevisiae
gaactggcttatttctacaacggtt

SEQ ID NO: 31451 - DNA, 25 bp, S. cerevisiae
gaacgttaattcacacactcctatt

SEQ ID NO: 31452 - DNA, 25 bp, S. cerevisiae
gaacgtggtcttccagtcaagttga

SEQ ID NO: 31453 - DNA, 25 bp, S. cerevisiae
gaactgacggtagcgctccaggtga

SEQ ID NO: 31454 - DNA, 25 bp, S. cerevisiae
gaacttcgacttgagaccaggtgtg

SEQ ID NO: 31455 - DNA, 25 bp, S. cerevisiae
gaactttgacttgagacctggtgta

SEQ ID NO: 31456 - DNA, 25 bp, S. cerevisiae
gaacatttacttcgaacggaggcaa

SEQ ID NO: 31457 - DNA, 25 bp, S. cerevisiae
gaaactatattcagaggtgccagga

SEQ ID NO: 31458 - DNA, 25 bp, S. cerevisiae
gaactctgtattcgctgggttagaa

SEQ ID NO: 31459 - DNA, 25 bp, S. cerevisiae
gaactggtgatctgggctttatcaa

SEQ ID NO: 31460 - DNA, 25 bp, S. cerevisiae
gaacggcattccaaacttgctgtta

SEQ ID NO: 31461 - DNA, 25 bp, S. cerevisiae
gaacatggactcgataagctggctt

SEQ ID NO: 31462 - DNA, 25 bp, S. cerevisiae
gatacttacggcgaagctgtcccat

SEQ ID NO: 31463 - DNA, 25 bp, S. cerevisiae
gaacttaccggaactgtcagattct

SEQ ID NO: 31464 - DNA, 25 bp, S. cerevisiae
gaactttccaaatctcgtgctttac

SEQ ID NO: 31465 - DNA, 25 bp, S. cerevisiae
gaactttacgaatcttgacgactac

SEQ ID NO: 31466 - DNA, 25 bp, S. cerevisiae
gaacacttagagcttttacaactac

SEQ ID NO: 31467 - DNA, 25 bp, S. cerevisiae
gaactactgccacgattttacaaaa

SEQ ID NO: 31468 - DNA, 25 bp, S. cerevisiae
gaacgaccccatatattatccaatc

SEQ ID NO: 31469 - DNA, 25 bp, S. cerevisiae
gaactggctctatttgtattaccca

SEQ ID NO: 31470 - DNA, 25 bp, S. cerevisiae
gaacaggtcctatgtattacaccat

SEQ ID NO: 31471 - DNA, 25 bp, S. cerevisiae
gaactggtccatgtttctaacgatc

SEQ ID NO: 31472 - DNA, 25 bp, S. cerevisiae
gaacttgccatagatctgaaccata

SEQ ID NO: 31473 - DNA, 25 bp, S. cerevisiae
gaacttgcaagtccacgaggccata

SEQ ID NO: 31474 - DNA, 25 bp, S. cerevisiae
gaacagctgaactccttggccatca

SEQ ID NO: 31475 - DNA, 25 bp, S. cerevisiae
gaacacgcaatcttccaggatggcc

SEQ ID NO: 31476 - DNA, 25 bp, S. cerevisiae
gaactagactatccgcgagagggca

SEQ ID NO: 31477 - DNA, 25 bp, S. cerevisiae
gaaaagacaccgctgagggccaaaa

SEQ ID NO: 31478 - DNA, 25 bp, S. cerevisiae
gaaagcaagtcggtgttggtaagtt

SEQ ID NO: 31479 - DNA, 25 bp, S. cerevisiae
gaacacaagaggttttgagaaggtt

SEQ ID NO: 31480 - DNA, 25 bp, S. cerevisiae
gaactagaggccttgtacaaacgtt

SEQ ID NO: 31481 - DNA, 25 bp, S. cerevisiae
gaacgattgaccgtaaatgaacctc

SEQ ID NO: 31482 - DNA, 25 bp, S. cerevisiae
gaacggtggtaactcttcgaagaag

SEQ ID NO: 31483 - DNA, 25 bp, S. cerevisiae
gaacgtcttatgagtctgcaacgac

SEQ ID NO: 31484 - DNA, 25 bp, S. cerevisiae
gaacgtgatgctaggttctacatct

SEQ ID NO: 31485 - DNA, 25 bp, S. cerevisiae
gaactcattcgtcgcgctggtagat

SEQ ID NO: 31486 - DNA, 25 bp, S. cerevisiae
gaacgattcacaaccgcgtaattct

SEQ ID NO: 31487 - DNA, 25 bp, S. cerevisiae
gaacgtaccaaaggcgagactccta

SEQ ID NO: 31488 - DNA, 25 bp, S. cerevisiae
gaactgaacacatacttggccctat

SEQ ID NO: 31489 - DNA, 25 bp, S. cerevisiae
gaacgtgccaaatttgagtccacaa

SEQ ID NO: 31490 - DNA, 25 bp, S. cerevisiae
gaacgtccacttatatgtcaccaga

SEQ ID NO: 31491 - DNA, 25 bp, S. cerevisiae
gaactgttcttagatatccatgcta

SEQ ID NO: 31492 - DNA, 25 bp, S. cerevisiae
gaacggtttcgatgacacacttaaa

SEQ ID NO: 31493 - DNA, 25 bp, S. cerevisiae
gaacgtttccgtactatcacttcat

SEQ ID NO: 31494 - DNA, 25 bp, S. cerevisiae
gaacgtttcctacctgacattatta

SEQ ID NO: 31495 - DNA, 25 bp, S. cerevisiae
gaactctttcccattgtctgtaatt

SEQ ID NO: 31496 - DNA, 25 bp, S. cerevisiae
gaactccttcgatctggacgttatt

SEQ ID NO: 31497 - DNA, 25 bp, S. cerevisiae
gaactatatctccacgtgtacagaa

SEQ ID NO: 31498 - DNA, 25 bp, S. cerevisiae
gaactgatgcagtccgttgtaagga

SEQ ID NO: 31499 - DNA, 25 bp, S. cerevisiae
gaacgtcaatgcgaattcactagca

SEQ ID NO: 31500 - DNA, 25 bp, S. cerevisiae
gaactgatcctgtacttcatataga

SEQ ID NO: 31501 - DNA, 25 bp, S. cerevisiae
gaacgattcgcctttcaatgaaaga

SEQ ID NO: 31502 - DNA, 25 bp, S. cerevisiae
gaacagcttctgctttcatacgagg

SEQ ID NO: 31503 - DNA, 25 bp, S. cerevisiae
gaacggcttgttctctgtcgatggc

SEQ ID NO: 31504 - DNA, 25 bp, S. cerevisiae
gaacgtttattgcatcgtgtggtca

SEQ ID NO: 31505 - DNA, 25 bp, S. cerevisiae
gaacttattattgaagctttgccaa

SEQ ID NO: 31506 - DNA, 25 bp, S. cerevisiae
gaactcgattttaccctattggaat

SEQ ID NO: 31507 - DNA, 25 bp, S. cerevisiae
gaactcatgatcttatacggctctt

SEQ ID NO: 31508 - DNA, 25 bp, S. cerevisiae
gaactttcctcattcgattgctgat

SEQ ID NO: 31509 - DNA, 25 bp, S. cerevisiae
gaactttttccgatatactccctag

SEQ ID NO: 31510 - DNA, 25 bp, S. cerevisiae
gaactttttaccatccttcatgact

SEQ ID NO: 31511 - DNA, 25 bp, S. cerevisiae
gaacttttatagatcgccagcttac

SEQ ID NO: 31512 - DNA, 25 bp, S. cerevisiae
gaacatcccaatgatgccagctggt

SEQ ID NO: 31513 - DNA, 25 bp, S. cerevisiae
gaactcgctaaaaagtccggatcta

SEQ ID NO: 31514 - DNA, 25 bp, S. cerevisiae
gaactcgatcaagaaaccgtcaaga

SEQ ID NO: 31515 - DNA, 25 bp, S. cerevisiae
gaactggctctagattcacctgtta

SEQ ID NO: 31516 - DNA, 25 bp, S. cerevisiae
gaactgttgctgtcttaccaccaaa

SEQ ID NO: 31517 - DNA, 25 bp, S. cerevisiae
gaactgaatgtgattactactgact

SEQ ID NO: 31518 - DNA, 25 bp, S. cerevisiae
gaactcagtggtcaatctgctcgac

SEQ ID NO: 31519 - DNA, 25 bp, S. cerevisiae
gaacttaaccgcttcttcttcaaat

SEQ ID NO: 31520 - DNA, 25 bp, S. cerevisiae
gaaatttacgactgggctggcgaat

SEQ ID NO: 31521 - DNA, 25 bp, S. cerevisiae
gaaacctacgcctacggtgtgggtg

SEQ ID NO: 31522 - DNA, 25 bp, S. cerevisiae
gaacacggagttccttttgaagttg

SEQ ID NO: 31523 - DNA, 25 bp, S. cerevisiae
gaacacccaaatttacctcattctg

SEQ ID NO: 31524 - DNA, 25 bp, S. cerevisiae
gaactccgaatgcaaactccaattt

SEQ ID NO: 31525 - DNA, 25 bp, S. cerevisiae
gacacgccaaatgaagtccctatgg

SEQ ID NO: 31526 - DNA, 25 bp, S. cerevisiae
gaactagcaaatggacagtccacga

SEQ ID NO: 31527 - DNA, 25 bp, S. cerevisiae
gaactccacaatgccagacagacta

SEQ ID NO: 31528 - DNA, 25 bp, S. cerevisiae
gaactccccacacatgagagatctt

SEQ ID NO: 31529 - DNA, 25 bp, S. cerevisiae
gaacatcccaactggtattccattg

SEQ ID NO: 31530 - DNA, 25 bp, S. cerevisiae
gaactctgctagaaagctacgtgtc

SEQ ID NO: 31531 - DNA, 25 bp, S. cerevisiae
gaactttggttggtgtttctcatac

SEQ ID NO: 31532 - DNA, 25 bp, S. cerevisiae
gaactttagtcaagctgtaccctat

SEQ ID NO: 31533 - DNA, 25 bp, S. cerevisiae
gaactctgaattgggatgactctct

SEQ ID NO: 31534 - DNA, 25 bp, S. cerevisiae
gaacttgatgctgatggagacacta

SEQ ID NO: 31535 - DNA, 25 bp, S. cerevisiae
gaacttcttattgcgaattgctata

SEQ ID NO: 31536 - DNA, 25 bp, S. cerevisiae
gaacttcttgagtattctgacgata

SEQ ID NO: 31537 - DNA, 25 bp, S. cerevisiae
gaactcgcaaaatggcttcgtattg

SEQ ID NO: 31538 - DNA, 25 bp, S. cerevisiae
gaactggccctattgacttgttttc

SEQ ID NO: 31539 - DNA, 25 bp, S. cerevisiae
gaacgggctctatactagattctct

SEQ ID NO: 31540 - DNA, 25 bp, S. cerevisiae
gaacggctgtcatcaatcgaatttt

SEQ ID NO: 31541 - DNA, 25 bp, S. cerevisiae
gaacggtggccaactagcatatttt

SEQ ID NO: 31542 - DNA, 25 bp, S. cerevisiae
gaacgtgggagctcctgatgatatt

SEQ ID NO: 31543 - DNA, 25 bp, S. cerevisiae
gaacaagtccttccgggctatttga

SEQ ID NO: 31544 - DNA, 25 bp, S. cerevisiae
gaacttattcggtccaggttacaag

SEQ ID NO: 31545 - DNA, 25 bp, S. cerevisiae
gaactatttcagaaccggtgaccaa

SEQ ID NO: 31546 - DNA, 25 bp, S. cerevisiae
gaactatatctatgtgccaggtgaa

SEQ ID NO: 31547 - DNA, 25 bp, S. cerevisiae
gaactctctggatgttgagggcaca

SEQ ID NO: 31548 - DNA, 25 bp, S. cerevisiae
gaacattttgcatcttgacggaagt

SEQ ID NO: 31549 - DNA, 25 bp, S. cerevisiae
gaactgcatttcaccatttggcttg

SEQ ID NO: 31550 - DNA, 25 bp, S. cerevisiae
gaacatgaggtaccacttgatgctg

SEQ ID NO: 31551 - DNA, 25 bp, S. cerevisiae
gaaaacctaggcgtggtcaacgata

SEQ ID NO: 31552 - DNA, 25 bp, S. cerevisiae
gaacaaacaagtggaccgaacgtga

SEQ ID NO: 31553 - DNA, 25 bp, S. cerevisiae
gaacaaagctccgaactcgaagccg

SEQ ID NO: 31554 - DNA, 25 bp, S. cerevisiae
gaaactagcttcgacaattggcagt

SEQ ID NO: 31555 - DNA, 25 bp, S. cerevisiae
gaacaacgtcatcggttttgtcctc

SEQ ID NO: 31556 - DNA, 25 bp, S. cerevisiae
gacaggtatgtacaagttccacttt

SEQ ID NO: 31557 - DNA, 25 bp, S. cerevisiae
gaactggtgctccaaacaacggtca

SEQ ID NO: 31558 - DNA, 25 bp, S. cerevisiae
gaacatcggacctgagtgacttctc

SEQ ID NO: 31559 - DNA, 25 bp, S. cerevisiae
gaactcgttactattgcgtatccta

SEQ ID NO: 31560 - DNA, 25 bp, S. cerevisiae
gaactccttgaaaaatgcgatacgt

SEQ ID NO: 31561 - DNA, 25 bp, S. cerevisiae
tgaactccttaagctatggaaccga

SEQ ID NO: 31562 - DNA, 25 bp, S. cerevisiae
gataagggcctgttaccgggattag

SEQ ID NO: 31563 - DNA, 25 bp, S. cerevisiae
gaaaaggtgctaatccgcgggtttg

SEQ ID NO: 31564 - DNA, 25 bp, S. cerevisiae
gaactatcagatacccagacccaaa

SEQ ID NO: 31565 - DNA, 25 bp, S. cerevisiae
gaacattttatctcccgatggttgg

SEQ ID NO: 31566 - DNA, 25 bp, S. cerevisiae
gaactttagtgctcctttcattcct

SEQ ID NO: 31567 - DNA, 25 bp, S. cerevisiae
gaaaaccaaccttgtctacggacag

SEQ ID NO: 31568 - DNA, 25 bp, S. cerevisiae
gaaaggcccaacaccggtgcgtatt

SEQ ID NO: 31569 - DNA, 25 bp, S. cerevisiae
tttagggaagccatccggcgcggat

SEQ ID NO: 31570 - DNA, 25 bp, S. cerevisiae
gattagtaaaccaatgcgggacgaa

SEQ ID NO: 31571 - DNA, 25 bp, S. cerevisiae
gactcagtacccatatcggtggata

SEQ ID NO: 31572 - DNA, 25 bp, S. cerevisiae
gaacagtcagaagcttggatcggtg

SEQ ID NO: 31573 - DNA, 25 bp, S. cerevisiae
gaacttaaattcatggctgcgtctg

SEQ ID NO: 31574 - DNA, 25 bp, S. cerevisiae
gaaaatccctctcaaggccaaggtt

SEQ ID NO: 31575 - DNA, 25 bp, S. cerevisiae
gaactactctctcaacaggcaaagg

SEQ ID NO: 31576 - DNA, 25 bp, S. cerevisiae
gaactgagccttttcatcggcaata

SEQ ID NO: 31577 - DNA, 25 bp, S. cerevisiae
gaactggtcaaacctcgtactaagc

SEQ ID NO: 31578 - DNA, 25 bp, S. cerevisiae
gaaatgtccaaagccgaactgccac

SEQ ID NO: 31579 - DNA, 25 bp, S. cerevisiae
gagaaagaaggatcctaacgcccct

SEQ ID NO: 31580 - DNA, 25 bp, S. cerevisiae
ggtaagaacgactctgacggtccaa

SEQ ID NO: 31581 - DNA, 25 bp, S. cerevisiae
gaaaagttcgtctctagcggtaaga

SEQ ID NO: 31582 - DNA, 25 bp, S. cerevisiae
gaaagaaatcgtcaaccggttgagt

SEQ ID NO: 31583 - DNA, 25 bp, S. cerevisiae
gaaaaatactctcaaaccgtcatgt

SEQ ID NO: 31584 - DNA, 25 bp, S. cerevisiae
gaacttggtcaaataacccactcaa

SEQ ID NO: 31585 - DNA, 25 bp, S. cerevisiae
gagcctagggaaaacgtcacccact

SEQ ID NO: 31586 - DNA, 25 bp, S. cerevisiae
gaacaagaagaaaccaagcagccca

SEQ ID NO: 31587 - DNA, 25 bp, S. cerevisiae
gaactatacacacttgacagcgtcc

SEQ ID NO: 31588 - DNA, 25 bp, S. cerevisiae
gaacttactagcaacaatcctgccc

SEQ ID NO: 31589 - DNA, 25 bp, S. cerevisiae
gaacttaccaattcagacatcccag

SEQ ID NO: 31590 - DNA, 25 bp, S. cerevisiae
gaactggacgaattaaatacctggt

SEQ ID NO: 31591 - DNA, 25 bp, S. cerevisiae
gaacattcaacatcttctgtacggg

SEQ ID NO: 31592 - DNA, 25 bp, S. cerevisiae
gaacattcggcatcaatcttaacgt

SEQ ID NO: 31593 - DNA, 25 bp, S. cerevisiae
gaacttctcgcatcactcggaaagc

SEQ ID NO: 31594 - DNA, 25 bp, S. cerevisiae
gaactatacatctgggaaacgacta

SEQ ID NO: 31595 - DNA, 25 bp, S. cerevisiae
gaaattttccctcgaaataggctat

SEQ ID NO: 31596 - DNA, 25 bp, S. cerevisiae
gaactttattgtcctactactcacc

SEQ ID NO: 31597 - DNA, 25 bp, S. cerevisiae
gaactgatgtttctagctctgagca

SEQ ID NO: 31598 - DNA, 25 bp, S. cerevisiae
gaaaatatttctaacttggctcctt

SEQ ID NO: 31599 - DNA, 25 bp, S. cerevisiae
gaacatcctttggatacggattctg

SEQ ID NO: 31600 - DNA, 25 bp, S. cerevisiae
gaacacctcattttaccgaacaaat

SEQ ID NO: 31601 - DNA, 25 bp, S. cerevisiae
gaacaggatctaattaccgaacagc

SEQ ID NO: 31602 - DNA, 25 bp, S. cerevisiae
gaactcccacgcttaatatctcaag

SEQ ID NO: 31603 - DNA, 25 bp, S. cerevisiae
gaacatcctcatccgctaaacaaag

SEQ ID NO: 31604 - DNA, 25 bp, S. cerevisiae
gaaatctcagctcgcattgggcaca

SEQ ID NO: 31605 - DNA, 25 bp, S. cerevisiae
gaacatgacactccattggtgcaat

SEQ ID NO: 31606 - DNA, 25 bp, S. cerevisiae
gaactagcacattctgtatggaact

SEQ ID NO: 31607 - DNA, 25 bp, S. cerevisiae
gaacatacactgttggttaccgaac

SEQ ID NO: 31608 - DNA, 25 bp, S. cerevisiae
gaaaagattggcctttccctggaga

SEQ ID NO: 31609 - DNA, 25 bp, S. cerevisiae
gaaaagatcggcttcttacaccggc

SEQ ID NO: 31610 - DNA, 25 bp, S. cerevisiae
gaacagaccttttttcgacgtgaat

SEQ ID NO: 31611 - DNA, 25 bp, S. cerevisiae
gaactaactccaaggtctgcattat

SEQ ID NO: 31612 - DNA, 25 bp, S. cerevisiae
gaacattttctgacattgagctgag

SEQ ID NO: 31613 - DNA, 25 bp, S. cerevisiae
gaacaggcttcaacttccaatggtt

SEQ ID NO: 31614 - DNA, 25 bp, S. cerevisiae
gaacagtttgtcgaatcccatagat

SEQ ID NO: 31615 - DNA, 25 bp, S. cerevisiae
gaacatgttagcacaagcccagagg

SEQ ID NO: 31616 - DNA, 25 bp, S. cerevisiae
gaacattctacaccatcagtcggga

SEQ ID NO: 31617 - DNA, 25 bp, S. cerevisiae
gaacattcccagctagttgcgagat

SEQ ID NO: 31618 - DNA, 25 bp, S. cerevisiae
gaactatcggccgaagatcttgaaa

SEQ ID NO: 31619 - DNA, 25 bp, S. cerevisiae
gaactacacagcgaagtttctgaaa

SEQ ID NO: 31620 - DNA, 25 bp, S. cerevisiae
gaacagccagattcttcttcgggaa

SEQ ID NO: 31621 - DNA, 25 bp, S. cerevisiae
gaacttccccattttaagcaacaag

SEQ ID NO: 31622 - DNA, 25 bp, S. cerevisiae
gaactctggatgattctgctattag

SEQ ID NO: 31623 - DNA, 25 bp, S. cerevisiae
gaactctggcgtattgcaacaattt

SEQ ID NO: 31624 - DNA, 25 bp, S. cerevisiae
gaactatccagtgcttgacgaatta

SEQ ID NO: 31625 - DNA, 25 bp, S. cerevisiae
gaacacaccatcttgttgcatgctc

SEQ ID NO: 31626 - DNA, 25 bp, S. cerevisiae
gaacacgcaccatgggctctaaaag

SEQ ID NO: 31627 - DNA, 25 bp, S. cerevisiae
gaacacaaacgattcatcctccaat

SEQ ID NO: 31628 - DNA, 25 bp, S. cerevisiae
gaacactaacgttgacggtaacatt

SEQ ID NO: 31629 - DNA, 25 bp, S. cerevisiae
gaaactaacgtcgaagtcactggat

SEQ ID NO: 31630 - DNA, 25 bp, S. cerevisiae
gaaaattttgatgctaggcctggat

SEQ ID NO: 31631 - DNA, 25 bp, S. cerevisiae
gaacaatcccgaagtaagcctgcgt

SEQ ID NO: 31632 - DNA, 25 bp, S. cerevisiae
gaaaaccatgcgaagctaaacgagc

SEQ ID NO: 31633 - DNA, 25 bp, S. cerevisiae
gaacaacctgggtcttacacgccta

SEQ ID NO: 31634 - DNA, 25 bp, S. cerevisiae
gaaaacctgccctggtggtaagcta

SEQ ID NO: 31635 - DNA, 25 bp, S. cerevisiae
gaaaaatccgcctgagtctggttta

SEQ ID NO: 31636 - DNA, 25 bp, S. cerevisiae
gaacaccattcccatggagtgctga

SEQ ID NO: 31637 - DNA, 25 bp, S. cerevisiae
gaactatttgaccactatcggcata

SEQ ID NO: 31638 - DNA, 25 bp, S. cerevisiae
gaacatgcgcgtactgctgcagtaa

SEQ ID NO: 31639 - DNA, 25 bp, S. cerevisiae
gaacattctgttatctcgagcaagt

SEQ ID NO: 31640 - DNA, 25 bp, S. cerevisiae
gaactatcatctactttcttcaagt

SEQ ID NO: 31641 - DNA, 25 bp, S. cerevisiae
gaacttcatcaacttactgtctaat

SEQ ID NO: 31642 - DNA, 25 bp, S. cerevisiae
gaactatctgttagcttccgtcaat

SEQ ID NO: 31643 - DNA, 25 bp, S. cerevisiae
gaactttgattgcttccgctggtaa

SEQ ID NO: 31644 - DNA, 25 bp, S. cerevisiae
gaactttcttcaattcaagagggct

SEQ ID NO: 31645 - DNA, 25 bp, S. cerevisiae
gtaaaggtttcacatcaatcggcgg

SEQ ID NO: 31646 - DNA, 25 bp, S. cerevisiae
gaactagttagtatcctccctgtaa

SEQ ID NO: 31647 - DNA, 25 bp, S. cerevisiae
gaacttggctattttcactcaccgt

SEQ ID NO: 31648 - DNA, 25 bp, S. cerevisiae
gaacttccttttatattgtcttgca

SEQ ID NO: 31649 - DNA, 25 bp, S. cerevisiae
gaacttggttaatcacactctgtac

SEQ ID NO: 31650 - DNA, 25 bp, S. cerevisiae
gaacatcttctatgtggtgcctcta

SEQ ID NO: 31651 - DNA, 25 bp, S. cerevisiae
gaactctcttactgtatccatcatt

SEQ ID NO: 31652 - DNA, 25 bp, S. cerevisiae
gaactttgcgtttctatacttcgaa

SEQ ID NO: 31653 - DNA, 25 bp, S. cerevisiae
gaacatcccttgtatataccgtgcg

SEQ ID NO: 31654 - DNA, 25 bp, S. cerevisiae
gaactttgcgatgcaggctatctta

SEQ ID NO: 31655 - DNA, 25 bp, S. cerevisiae
gaacagtggcaatcaggtcttaaga

SEQ ID NO: 31656 - DNA, 25 bp, S. cerevisiae
gaacaggccgtacgcagttgtcgaa

SEQ ID NO: 31657 - DNA, 25 bp, S. cerevisiae
gaacacctgtgataatctcattaag

SEQ ID NO: 31658 - DNA, 25 bp, S. cerevisiae
gaacatggcgatgtacttcttacag

SEQ ID NO: 31659 - DNA, 25 bp, S. cerevisiae
gaacatgcgcattccaactgtttat

SEQ ID NO: 31660 - DNA, 25 bp, S. cerevisiae
gaacattcttccaacgattcttcgg

SEQ ID NO: 31661 - DNA, 25 bp, S. cerevisiae
gaactatgttatccacgtcagtacg

SEQ ID NO: 31662 - DNA, 25 bp, S. cerevisiae
gaactcactgaacattgtcgcacct

SEQ ID NO: 31663 - DNA, 25 bp, S. cerevisiae
gaacttctacattttgtggcacacc

SEQ ID NO: 31664 - DNA, 25 bp, S. cerevisiae
gaactttgccatttattccgatgcc

SEQ ID NO: 31665 - DNA, 25 bp, S. cerevisiae
gaacatacaatgcattacccatggg

SEQ ID NO: 31666 - DNA, 25 bp, S. cerevisiae
gaacatccagattattactccagga

SEQ ID NO: 31667 - DNA, 25 bp, S. cerevisiae
gaacacccttgaatactgtcatgga

SEQ ID NO: 31668 - DNA, 25 bp, S. cerevisiae
gaaaattgccgatgaagtagtacca

SEQ ID NO: 31669 - DNA, 25 bp, S. cerevisiae
gaacttcgtagtaaaatcgctccaa

SEQ ID NO: 31670 - DNA, 25 bp, S. cerevisiae
gaacagtgcgtctttaaacctcaag

SEQ ID NO: 31671 - DNA, 25 bp, S. cerevisiae
gaacaccgcagctcaagaaagtcaa

SEQ ID NO: 31672 - DNA, 25 bp, S. cerevisiae
gaaactgctgatcgccaaaagacca

SEQ ID NO: 31673 - DNA, 25 bp, S. cerevisiae
gaaactgcaattcctgaactacaca

SEQ ID NO: 31674 - DNA, 25 bp, S. cerevisiae
gaacattacttcctttctgtcacaa

SEQ ID NO: 31675 - DNA, 25 bp, S. cerevisiae
gaacagtctttaacggtgtccaccg

SEQ ID NO: 31676 - DNA, 25 bp, S. cerevisiae
gaacaagctgctcaactgggtcctg

SEQ ID NO: 31677 - DNA, 25 bp, S. cerevisiae
gaacattgtcaacagcttggtccat

SEQ ID NO: 31678 - DNA, 25 bp, S. cerevisiae
gaactaccaacccaaattcgagcag

SEQ ID NO: 31679 - DNA, 25 bp, S. cerevisiae
gaactacccgacaaactattcgagt

SEQ ID NO: 31680 - DNA, 25 bp, S. cerevisiae
gaaaagacccagtattccttgtcca

SEQ ID NO: 31681 - DNA, 25 bp, S. cerevisiae
gaacaatgcaggtccaacgccagca

SEQ ID NO: 31682 - DNA, 25 bp, S. cerevisiae
gaactagatgattccgacgatgact

SEQ ID NO: 31683 - DNA, 25 bp, S. cerevisiae
gaaaattgttcctcgaccttgtcct

SEQ ID NO: 31684 - DNA, 25 bp, S. cerevisiae
gaaaattgttactcgggctggacac

SEQ ID NO: 31685 - DNA, 25 bp, S. cerevisiae
gaacagatcttatccacagtggtgg

SEQ ID NO: 31686 - DNA, 25 bp, S. cerevisiae
gaacaatgctgattcttccagtaat

SEQ ID NO: 31687 - DNA, 25 bp, S. cerevisiae
gaacacggcaagaatccagattata

SEQ ID NO: 31688 - DNA, 25 bp, S. cerevisiae
gacacaccgacgagctggattattt

SEQ ID NO: 31689 - DNA, 25 bp, S. cerevisiae
gaacaccagtaacgcggattcttta

SEQ ID NO: 31690 - DNA, 25 bp, S. cerevisiae
gaacaagaagagatcgccccaagct

SEQ ID NO: 31691 - DNA, 25 bp, S. cerevisiae
gaacaccaatgtcgatggtaacatt

SEQ ID NO: 31692 - DNA, 25 bp, S. cerevisiae
gaacacggccacgtcgtaacatatg

SEQ ID NO: 31693 - DNA, 25 bp, S. cerevisiae
gaacaccttacagagcgaacaatgg

SEQ ID NO: 31694 - DNA, 25 bp, S. cerevisiae
gaacagctcattcacttggaaatta

SEQ ID NO: 31695 - DNA, 25 bp, S. cerevisiae
gaacagtactgaacctttcccaaga

SEQ ID NO: 31696 - DNA, 25 bp, S. cerevisiae
taaaaaagtccctccaagatagaag

SEQ ID NO: 31697 - DNA, 25 bp, S. cerevisiae
gaaaaaagtctctcccctcaagaag

SEQ ID NO: 31698 - DNA, 25 bp, S. cerevisiae
gaaaaactagctgaactgactgtaa

SEQ ID NO: 31699 - DNA, 25 bp, S. cerevisiae
gatgaaaccgaactccaaaacttgt

SEQ ID NO: 31700 - DNA, 25 bp, S. cerevisiae
gaacaacacgaaatccatctacctg

SEQ ID NO: 31701 - DNA, 25 bp, S. cerevisiae
gaacagtcccaaacgttatcatcgg

SEQ ID NO: 31702 - DNA, 25 bp, S. cerevisiae
gaacttttgcctatcgtagctgacg

SEQ ID NO: 31703 - DNA, 25 bp, S. cerevisiae
gaacatatttgtcctgatcgtacta

SEQ ID NO: 31704 - DNA, 25 bp, S. cerevisiae
gaactttgtgatgttgtttgtacaa

SEQ ID NO: 31705 - DNA, 25 bp, S. cerevisiae
gaaaacggtattgttatcccacacg

SEQ ID NO: 31706 - DNA, 25 bp, S. cerevisiae
gaaaacgatgagattaagcccttga

SEQ ID NO: 31707 - DNA, 25 bp, S. cerevisiae
gaacaaactggcactaaggatctta

SEQ ID NO: 31708 - DNA, 25 bp, S. cerevisiae
gaaactccagcttgtgttgcgtact

SEQ ID NO: 31709 - DNA, 25 bp, S. cerevisiae
gaacttacacattcaagctcgacaa

SEQ ID NO: 31710 - DNA, 25 bp, S. cerevisiae
gaacttgaccgattactcgacaaaa

SEQ ID NO: 31711 - DNA, 25 bp, S. cerevisiae
gaacttgtcaaatcactctgccatg

SEQ ID NO: 31712 - DNA, 25 bp, S. cerevisiae
gaactttttcaagctagcacatggt

SEQ ID NO: 31713 - DNA, 25 bp, S. cerevisiae
gaactttattcaaactgcagactgg

SEQ ID NO: 31714 - DNA, 25 bp, S. cerevisiae
gaactttattgagagccagacctgg

SEQ ID NO: 31715 - DNA, 25 bp, S. cerevisiae
gaaaattttgaggagctggaccgct

SEQ ID NO: 31716 - DNA, 25 bp, S. cerevisiae
gaaaattctgagctcgctgtggcca

SEQ ID NO: 31717 - DNA, 25 bp, S. cerevisiae
gaacaaaccggtccattggccaaag

SEQ ID NO: 31718 - DNA, 25 bp, S. cerevisiae
gaacaaaacgctgccttgggacaag

SEQ ID NO: 31719 - DNA, 25 bp, S. cerevisiae
gaacaacctcttcccttaaatcaag

SEQ ID NO: 31720 - DNA, 25 bp, S. cerevisiae
gtaaagacatccagccctaaaccaa

SEQ ID NO: 31721 - DNA, 25 bp, S. cerevisiae
gaaaaccacatcatccctaaactaa

SEQ ID NO: 31722 - DNA, 25 bp, S. cerevisiae
gaaaagcaaatcatccaagaaggta

SEQ ID NO: 31723 - DNA, 25 bp, S. cerevisiae
gaacaagaagttaacatcatgggag

SEQ ID NO: 31724 - DNA, 25 bp, S. cerevisiae
gaacaagtagctgaaattccgcaaa

SEQ ID NO: 31725 - DNA, 25 bp, S. cerevisiae
gaaaagttccagtgttccaatgaca

SEQ ID NO: 31726 - DNA, 25 bp, S. cerevisiae
gaacaatcttactttggcgaatgcg

SEQ ID NO: 31727 - DNA, 25 bp, S. cerevisiae
gaacagatttccacgagcgtcacag

SEQ ID NO: 31728 - DNA, 25 bp, S. cerevisiae
gaacaattacaacaaggcgccacaa

SEQ ID NO: 31729 - DNA, 25 bp, S. cerevisiae
gaaaattgctaaaggtgaccccaag

SEQ ID NO: 31730 - DNA, 25 bp, S. cerevisiae
gaactttgattgagtatgatcccca

SEQ ID NO: 31731 - DNA, 25 bp, S. cerevisiae
gaacattatttgaacttagccgact

SEQ ID NO: 31732 - DNA, 25 bp, S. cerevisiae
gaacaacttatcgtcaggaacctct

SEQ ID NO: 31733 - DNA, 25 bp, S. cerevisiae
gaacttcttatcctacgaatctcta

SEQ ID NO: 31734 - DNA, 25 bp, S. cerevisiae
gaacttcgaaccaaccacatttata

SEQ ID NO: 31735 - DNA, 25 bp, S. cerevisiae
gaacatgatttcactaccactttaa

SEQ ID NO: 31736 - DNA, 25 bp, S. cerevisiae
gaacaaggttcactagcttctttga

SEQ ID NO: 31737 - DNA, 25 bp, S. cerevisiae
gaacaaaattctcgccattcttcaa

SEQ ID NO: 31738 - DNA, 25 bp, S. cerevisiae
gaacagagcatttctctgctgcctt

SEQ ID NO: 31739 - DNA, 25 bp, S. cerevisiae
gaacatgcagacttttgcgcctttc

SEQ ID NO: 31740 - DNA, 25 bp, S. cerevisiae
gaacatacatttagtggcttttcac

SEQ ID NO: 31741 - DNA, 25 bp, S. cerevisiae
gaacaaaatccacagcgtttctctc

SEQ ID NO: 31742 - DNA, 25 bp, S. cerevisiae
gaacacctcccgaaaattgtggcat

SEQ ID NO: 31743 - DNA, 25 bp, S. cerevisiae
gaaaactcacgtcttttaatctaca

SEQ ID NO: 31744 - DNA, 25 bp, S. cerevisiae
gaacatattccgttggctttacaga

SEQ ID NO: 31745 - DNA, 25 bp, S. cerevisiae
gaacagattcttttctctaacttgg

SEQ ID NO: 31746 - DNA, 25 bp, S. cerevisiae
gaacaattcgtcatcactgaacctg

SEQ ID NO: 31747 - DNA, 25 bp, S. cerevisiae
gaacatttcgagatccattccttgg

SEQ ID NO: 31748 - DNA, 25 bp, S. cerevisiae
gaaacacaatcagcacgtattcttg

SEQ ID NO: 31749 - DNA, 25 bp, S. cerevisiae
gaacaagcaccagccgatgatgact

SEQ ID NO: 31750 - DNA, 25 bp, S. cerevisiae
gaaaatgcacaaggctctggtaata

SEQ ID NO: 31751 - DNA, 25 bp, S. cerevisiae
gaaaaagagtggtgatcctaagaaa

SEQ ID NO: 31752 - DNA, 25 bp, S. cerevisiae
gaaaaaggtccttgatcaaacgatc

SEQ ID NO: 31753 - DNA, 25 bp, S. cerevisiae
gaaaaaagcccttccaaagcagcca

SEQ ID NO: 31754 - DNA, 25 bp, S. cerevisiae
gaaaactccttctgggacagcacca

SEQ ID NO: 31755 - DNA, 25 bp, S. cerevisiae
gaacacgcggcaaagtaattgacta

SEQ ID NO: 31756 - DNA, 25 bp, S. cerevisiae
gaacaccggctgaagttggtcataa

SEQ ID NO: 31757 - DNA, 25 bp, S. cerevisiae
gaacagtcttccaagtttcttaaag

SEQ ID NO: 31758 - DNA, 25 bp, S. cerevisiae
gaacagatcttttcactttctaata

SEQ ID NO: 31759 - DNA, 25 bp, S. cerevisiae
gaacactgctgtttcaccttatagt

SEQ ID NO: 31760 - DNA, 25 bp, S. cerevisiae
gaacatctgcagaatccatcgattt

SEQ ID NO: 31761 - DNA, 25 bp, S. cerevisiae
gaacatcagcgttacatcgataagg

SEQ ID NO: 31762 - DNA, 25 bp, S. cerevisiae
tgcaaacgccacagacccaattaaa

SEQ ID NO: 31763 - DNA, 25 bp, S. cerevisiae
gaacaagtccaaacttcagtcccag

SEQ ID NO: 31764 - DNA, 25 bp, S. cerevisiae
gaacatattgaccaccttgagggca

SEQ ID NO: 31765 - DNA, 25 bp, S. cerevisiae
gaacatagcgactcatttggcccaa

SEQ ID NO: 31766 - DNA, 25 bp, S. cerevisiae
gaacaaatggcctttcttgtacgcc

SEQ ID NO: 31767 - DNA, 25 bp, S. cerevisiae
gaacaataagccttttgtgtcaaat

SEQ ID NO: 31768 - DNA, 25 bp, S. cerevisiae
gaacattctaccttctgctgttgaa

SEQ ID NO: 31769 - DNA, 25 bp, S. cerevisiae
gaacagttactcttgtgctactcaa

SEQ ID NO: 31770 - DNA, 25 bp, S. cerevisiae
gaacaccatccttatttgactcaag

SEQ ID NO: 31771 - DNA, 25 bp, S. cerevisiae
gaacagtccttgtagtggcacacgt

SEQ ID NO: 31772 - DNA, 25 bp, S. cerevisiae
gaacaggctacttgagtgacccgtc

SEQ ID NO: 31773 - DNA, 25 bp, S. cerevisiae
gaacaggtatctgggaccacggtct

SEQ ID NO: 31774 - DNA, 25 bp, S. cerevisiae
gaaaattacggcgactccctgatca

SEQ ID NO: 31775 - DNA, 25 bp, S. cerevisiae
gaacaatttccattttaccttcacg

SEQ ID NO: 31776 - DNA, 25 bp, S. cerevisiae
gaacaagctctcttacgaaccatta

SEQ ID NO: 31777 - DNA, 25 bp, S. cerevisiae
gaacatactatcgtcacagcgacca

SEQ ID NO: 31778 - DNA, 25 bp, S. cerevisiae
gaacatactaccgatggtgactcga

SEQ ID NO: 31779 - DNA, 25 bp, S. cerevisiae
gaacatgaatcagcaagacccaaaa

SEQ ID NO: 31780 - DNA, 25 bp, S. cerevisiae
gaacagactcatgccatttcgaaag

SEQ ID NO: 31781 - DNA, 25 bp, S. cerevisiae
gaacagcactatatcttatgggaag

SEQ ID NO: 31782 - DNA, 25 bp, S. cerevisiae
gaacagagctttaccctggaagcac

SEQ ID NO: 31783 - DNA, 25 bp, S. cerevisiae
gaacagaactttccctggatgaatt

SEQ ID NO: 31784 - DNA, 25 bp, S. cerevisiae
gaacacatacttatcatcatcgaaa

SEQ ID NO: 31785 - DNA, 25 bp, S. cerevisiae
gaacaatgagttttatcccataggt

SEQ ID NO: 31786 - DNA, 25 bp, S. cerevisiae
gaacaagatgttccccaccgaggaa

SEQ ID NO: 31787 - DNA, 25 bp, S. cerevisiae
gaaaagatcctatccacctgagttc

SEQ ID NO: 31788 - DNA, 25 bp, S. cerevisiae
gaacaaatcaatttcttgcctgaga

SEQ ID NO: 31789 - DNA, 25 bp, S. cerevisiae
gaacatttgcttggtgctttggaga

SEQ ID NO: 31790 - DNA, 25 bp, S. cerevisiae
gaacattcctttccaatagcgagaa

SEQ ID NO: 31791 - DNA, 25 bp, S. cerevisiae
gaaaaccatcttggcgtagcgaaga

SEQ ID NO: 31792 - DNA, 25 bp, S. cerevisiae
gaacatctcctgaaagacgcggcaa

SEQ ID NO: 31793 - DNA, 25 bp, S. cerevisiae
gaacactggaattaccgctacaaat

SEQ ID NO: 31794 - DNA, 25 bp, S. cerevisiae
gaacactgctagaattccctaagga

SEQ ID NO: 31795 - DNA, 25 bp, S. cerevisiae
gaacacgtagacatcctcggcagcg

SEQ ID NO: 31796 - DNA, 25 bp, S. cerevisiae
tacaactgtaacaaacccggtcacg

SEQ ID NO: 31797 - DNA, 25 bp, S. cerevisiae
gaaacgaagaaagctccggtcactt

SEQ ID NO: 31798 - DNA, 25 bp, S. cerevisiae
gaacactggataaatttcccctcct

SEQ ID NO: 31799 - DNA, 25 bp, S. cerevisiae
gaacataggtgattcttgcgaccct

SEQ ID NO: 31800 - DNA, 25 bp, S. cerevisiae
gaacacggtgttcctgtagtgccat

SEQ ID NO: 31801 - DNA, 25 bp, S. cerevisiae
gaacaccgtgttcattgagcataca

SEQ ID NO: 31802 - DNA, 25 bp, S. cerevisiae
gaacactttcacacaagcaagtata

SEQ ID NO: 31803 - DNA, 25 bp, S. cerevisiae
gaacaatggctcctacagacaatta

SEQ ID NO: 31804 - DNA, 25 bp, S. cerevisiae
gaacagaagcctcgaagactttgca

SEQ ID NO: 31805 - DNA, 25 bp, S. cerevisiae
gaacaacaggctcgcaagaacttga

SEQ ID NO: 31806 - DNA, 25 bp, S. cerevisiae
gaaaatgatgaacaagaagcctgat

SEQ ID NO: 31807 - DNA, 25 bp, S. cerevisiae
gaaaaagcagagcaacaaccaggtt

SEQ ID NO: 31808 - DNA, 25 bp, S. cerevisiae
gaaagaagaggtcccacctgtcgtt

SEQ ID NO: 31809 - DNA, 25 bp, S. cerevisiae
gaaaaatggtctccgtcactttggt

SEQ ID NO: 31810 - DNA, 25 bp, S. cerevisiae
gaacaaacagtttaaccagccgcta

SEQ ID NO: 31811 - DNA, 25 bp, S. cerevisiae
gaaaacaccactagaaccagggcta

SEQ ID NO: 31812 - DNA, 25 bp, S. cerevisiae
gaaaacaccaccaagaccgaagact

SEQ ID NO: 31813 - DNA, 25 bp, S. cerevisiae
gaaaagagctcatcaagaacaaact

SEQ ID NO: 31814 - DNA, 25 bp, S. cerevisiae
gaacatctccgttggtgaatctggt

SEQ ID NO: 31815 - DNA, 25 bp, S. cerevisiae
gaacatgttcgttatctgccgttat

SEQ ID NO: 31816 - DNA, 25 bp, S. cerevisiae
gaacatgctagcgttgtggtccttt

SEQ ID NO: 31817 - DNA, 25 bp, S. cerevisiae
gacagagagggctcgagtacttcct

SEQ ID NO: 31818 - DNA, 25 bp, S. cerevisiae
gaaagggccacggaagacttcttcg

SEQ ID NO: 31819 - DNA, 25 bp, S. cerevisiae
gaaacgtgccctggagagactagta

SEQ ID NO: 31820 - DNA, 25 bp, S. cerevisiae
gaacacgctgctttggaaccaagat

SEQ ID NO: 31821 - DNA, 25 bp, S. cerevisiae
gaaacagcaataggcccggcagtgc

SEQ ID NO: 31822 - DNA, 25 bp, S. cerevisiae
gaaaactgaagggagccaccgctac

SEQ ID NO: 31823 - DNA, 25 bp, S. cerevisiae
gaaaactgtcggtgaaccctatggt

SEQ ID NO: 31824 - DNA, 25 bp, S. cerevisiae
gaaatttacggatcaagcatactat

SEQ ID NO: 31825 - DNA, 25 bp, S. cerevisiae
gaaaatttccgttcacgatatttga

SEQ ID NO: 31826 - DNA, 25 bp, S. cerevisiae
gaaaccttggtacactcttctttca

SEQ ID NO: 31827 - DNA, 25 bp, S. cerevisiae
gaaaggccaggcttcgtcgttaact

SEQ ID NO: 31828 - DNA, 25 bp, S. cerevisiae
gataaaggtcgctccagggactcaa

SEQ ID NO: 31829 - DNA, 25 bp, S. cerevisiae
gaaaataatccatttgcggacccaa

SEQ ID NO: 31830 - DNA, 25 bp, S. cerevisiae
gaacaaattcagatccacagccgct

SEQ ID NO: 31831 - DNA, 25 bp, S. cerevisiae
gaacacactatatcctcaagactct

SEQ ID NO: 31832 - DNA, 25 bp, S. cerevisiae
gaacactattctcctctaaggctag

SEQ ID NO: 31833 - DNA, 25 bp, S. cerevisiae
gaacaaccaagctgtttggagaagt

SEQ ID NO: 31834 - DNA, 25 bp, S. cerevisiae
gaacatactctaaactcgggaacca

SEQ ID NO: 31835 - DNA, 25 bp, S. cerevisiae
gaaaatggttttcctcgagagagca

SEQ ID NO: 31836 - DNA, 25 bp, S. cerevisiae
gaacaaggttttcattctagcgtaa

SEQ ID NO: 31837 - DNA, 25 bp, S. cerevisiae
gaaaattcctttgatccatctgata

SEQ ID NO: 31838 - DNA, 25 bp, S. cerevisiae
gaaaacatttggcaattctccggaa

SEQ ID NO: 31839 - DNA, 25 bp, S. cerevisiae
gaaaacttcggccaatccaggtaga

SEQ ID NO: 31840 - DNA, 25 bp, S. cerevisiae
gaaaagactcgaacaaccggtcata

SEQ ID NO: 31841 - DNA, 25 bp, S. cerevisiae
gaaaagttcttcctcagcaaaggga

SEQ ID NO: 31842 - DNA, 25 bp, S. cerevisiae
gaaacagttataccgtccttagcaa

SEQ ID NO: 31843 - DNA, 25 bp, S. cerevisiae
gaaaatgtttccactactgaagtag

SEQ ID NO: 31844 - DNA, 25 bp, S. cerevisiae
gacaatagtgttgcccgggaagtat

SEQ ID NO: 31845 - DNA, 25 bp, S. cerevisiae
gaacaagttcttccacgttgacgtt

SEQ ID NO: 31846 - DNA, 25 bp, S. cerevisiae
gaaaattgattctgcgcttcggtag

SEQ ID NO: 31847 - DNA, 25 bp, S. cerevisiae
gaaaatggactctctgttagttcag

SEQ ID NO: 31848 - DNA, 25 bp, S. cerevisiae
gaacaaaagctcaccatcgaaactg

SEQ ID NO: 31849 - DNA, 25 bp, S. cerevisiae
gaaaattccacttccagaggtacat

SEQ ID NO: 31850 - DNA, 25 bp, S. cerevisiae
gaacaagctcaagaccgttgctata

SEQ ID NO: 31851 - DNA, 25 bp, S. cerevisiae
gaacaactctgtaaggcgttgccta

SEQ ID NO: 31852 - DNA, 25 bp, S. cerevisiae
gaaaaggtacactcactcgtgctgc

SEQ ID NO: 31853 - DNA, 25 bp, S. cerevisiae
gaaaatgtgaaccttgccgcgacgg

SEQ ID NO: 31854 - DNA, 25 bp, S. cerevisiae
gaaaatacctcgctggtccaattgg

SEQ ID NO: 31855 - DNA, 25 bp, S. cerevisiae
gaaaaagatcctatagctcctattg

SEQ ID NO: 31856 - DNA, 25 bp, S. cerevisiae
gaaaaatgtcctgctccatcgaagg

SEQ ID NO: 31857 - DNA, 25 bp, S. cerevisiae
gaacaaaccttcctcaaacagcaag

SEQ ID NO: 31858 - DNA, 25 bp, S. cerevisiae
gaacacataccagcttagaccgcaa

SEQ ID NO: 31859 - DNA, 25 bp, S. cerevisiae
gaacacaccattgtcaaagcccaag

SEQ ID NO: 31860 - DNA, 25 bp, S. cerevisiae
gaaaaggctgtacaggccacctaaa

SEQ ID NO: 31861 - DNA, 25 bp, S. cerevisiae
gataacaaagtacttagccaccgaa

SEQ ID NO: 31862 - DNA, 25 bp, S. cerevisiae
gaacagaaactactgctaccgggca

SEQ ID NO: 31863 - DNA, 25 bp, S. cerevisiae
taacgaagacgtcgctaccaagtcc

SEQ ID NO: 31864 - DNA, 25 bp, S. cerevisiae
tgaaccaaaagtctaccgagtcgta

SEQ ID NO: 31865 - DNA, 25 bp, S. cerevisiae
gaaatcgttcaccaaaaggatgatg

SEQ ID NO: 31866 - DNA, 25 bp, S. cerevisiae
gaaaatgttactagcctccaaccta

SEQ ID NO: 31867 - DNA, 25 bp, S. cerevisiae
gaaaatttgaaggttgccctacagc

SEQ ID NO: 31868 - DNA, 25 bp, S. cerevisiae
gaaattttgaatgttcccgtggcct

SEQ ID NO: 31869 - DNA, 25 bp, S. cerevisiae
gaaaatttgggctgtaccgtcgtca

SEQ ID NO: 31870 - DNA, 25 bp, S. cerevisiae
gaaactaatttctggaccgccgcca

SEQ ID NO: 31871 - DNA, 25 bp, S. cerevisiae
gaaacggattcttcggtcacaaggt

SEQ ID NO: 31872 - DNA, 25 bp, S. cerevisiae
gaaacgtagactgggttcaaatcga

SEQ ID NO: 31873 - DNA, 25 bp, S. cerevisiae
gaaaagcccgatcctttagacacgt

SEQ ID NO: 31874 - DNA, 25 bp, S. cerevisiae
gaaaatcccgattcttcaaacttgg

SEQ ID NO: 31875 - DNA, 25 bp, S. cerevisiae
gaaaaccctactgtgcaaactgctg

SEQ ID NO: 31876 - DNA, 25 bp, S. cerevisiae
gaaaataccccgagcattatgcaga

SEQ ID NO: 31877 - DNA, 25 bp, S. cerevisiae
gaaaaactaccgatctttagagatt

SEQ ID NO: 31878 - DNA, 25 bp, S. cerevisiae
gaaaatgcagcatccgatcctttag

SEQ ID NO: 31879 - DNA, 25 bp, S. cerevisiae
gaacaatcagttagtcgccaacaac

SEQ ID NO: 31880 - DNA, 25 bp, S. cerevisiae
gaaaacgttccggaagagcatcact

SEQ ID NO: 31881 - DNA, 25 bp, S. cerevisiae
gagaaacgacccacaaaccattgaa

SEQ ID NO: 31882 - DNA, 25 bp, S. cerevisiae
gaaaaggcttccagacaacaaagaa

SEQ ID NO: 31883 - DNA, 25 bp, S. cerevisiae
gaacacagggtccattgagcacaca

SEQ ID NO: 31884 - DNA, 25 bp, S. cerevisiae
gaacaagtttgccttggcagccaag

SEQ ID NO: 31885 - DNA, 25 bp, S. cerevisiae
gaaaagttatcctcgagcgcacata

SEQ ID NO: 31886 - DNA, 25 bp, S. cerevisiae
gaacaactactgctacaatggccat

SEQ ID NO: 31887 - DNA, 25 bp, S. cerevisiae
gaacaagcatactctcaaccattta

SEQ ID NO: 31888 - DNA, 25 bp, S. cerevisiae
gacaaggatggctctaattctggtt

SEQ ID NO: 31889 - DNA, 25 bp, S. cerevisiae
gacagcatcctagagactttccaaa

SEQ ID NO: 31890 - DNA, 25 bp, S. cerevisiae
gaacacgctatgtaatcatttcaca

SEQ ID NO: 31891 - DNA, 25 bp, S. cerevisiae
gaacacacctaactgagtctcaaat

SEQ ID NO: 31892 - DNA, 25 bp, S. cerevisiae
gaaatttcctcgatgtttacccttg

SEQ ID NO: 31893 - DNA, 25 bp, S. cerevisiae
gaaaccaccggtatttactgcctct

SEQ ID NO: 31894 - DNA, 25 bp, S. cerevisiae
gaaagtaccggctattgaaccgcca

SEQ ID NO: 31895 - DNA, 25 bp, S. cerevisiae
gaaaacccgccagacaatcctattt

SEQ ID NO: 31896 - DNA, 25 bp, S. cerevisiae
gaacaacctcatgatttatctgcta

SEQ ID NO: 31897 - DNA, 25 bp, S. cerevisiae
gaaaacgcttcgaattacatttatt

SEQ ID NO: 31898 - DNA, 25 bp, S. cerevisiae
gaaaaagctatccaaccctgatatg

SEQ ID NO: 31899 - DNA, 25 bp, S. cerevisiae
gaacacattgttccaggtacctaca

SEQ ID NO: 31900 - DNA, 25 bp, S. cerevisiae
gaacacattcgctagctgtggatca

SEQ ID NO: 31901 - DNA, 25 bp, S. cerevisiae
gaacacaatggccatgctccaaatg

SEQ ID NO: 31902 - DNA, 25 bp, S. cerevisiae
gaacacattagcagcgccatatcga

SEQ ID NO: 31903 - DNA, 25 bp, S. cerevisiae
gaaacatcctcaaagcagcactgcg

SEQ ID NO: 31904 - DNA, 25 bp, S. cerevisiae
gaaaatccgcatggcaacattcgaa

SEQ ID NO: 31905 - DNA, 25 bp, S. cerevisiae
gaacacgaagatcaatattagccaa

SEQ ID NO: 31906 - DNA, 25 bp, S. cerevisiae
gaacacgatccaaactttactgaag

SEQ ID NO: 31907 - DNA, 25 bp, S. cerevisiae
gaacacctgaattccttagttggat

SEQ ID NO: 31908 - DNA, 25 bp, S. cerevisiae
gaacagcttcaaactttgtatcagt

SEQ ID NO: 31909 - DNA, 25 bp, S. cerevisiae
gaacaccaggcgcttaacatgatat

SEQ ID NO: 31910 - DNA, 25 bp, S. cerevisiae
gaacaatacagcagcttccactggc

SEQ ID NO: 31911 - DNA, 25 bp, S. cerevisiae
gaacaagagcacacgtcacagatag

SEQ ID NO: 31912 - DNA, 25 bp, S. cerevisiae
gaacacgagacttggacctgatcta

SEQ ID NO: 31913 - DNA, 25 bp, S. cerevisiae
gaacaagaactctcaactgcatcta

SEQ ID NO: 31914 - DNA, 25 bp, S. cerevisiae
gaacaactcgtatccgaactctcat

SEQ ID NO: 31915 - DNA, 25 bp, S. cerevisiae
gaacaatcacggtacagcgaacatt

SEQ ID NO: 31916 - DNA, 25 bp, S. cerevisiae
gaacaaccggatctgcagtacgatt

SEQ ID NO: 31917 - DNA, 25 bp, S. cerevisiae
gaacaacgggtcttatgtactcgat

SEQ ID NO: 31918 - DNA, 25 bp, S. cerevisiae
gaaaacggtcacttcgacgtcgacg

SEQ ID NO: 31919 - DNA, 25 bp, S. cerevisiae
gaaaacgtgcgagttcctcgttact

SEQ ID NO: 31920 - DNA, 25 bp, S. cerevisiae
gaaacaagttccagtgcgtctacta

SEQ ID NO: 31921 - DNA, 25 bp, S. cerevisiae
gaaacaagttccctgaccttggcgt

SEQ ID NO: 31922 - DNA, 25 bp, S. cerevisiae
gaacaatcccattcacagtgtattc

SEQ ID NO: 31923 - DNA, 25 bp, S. cerevisiae
gaaaatcagagctcatcgtggtatc

SEQ ID NO: 31924 - DNA, 25 bp, S. cerevisiae
gaaaagggatctcgccagagctgct

SEQ ID NO: 31925 - DNA, 25 bp, S. cerevisiae
gaaaaagagatcaggcacatgctaa

SEQ ID NO: 31926 - DNA, 25 bp, S. cerevisiae
gaaaacttcccaatgttgtcgagca

SEQ ID NO: 31927 - DNA, 25 bp, S. cerevisiae
gaacaactattcgttccccaggaat

SEQ ID NO: 31928 - DNA, 25 bp, S. cerevisiae
gaaaatatttatctccacgctggcc

SEQ ID NO: 31929 - DNA, 25 bp, S. cerevisiae
gaaaactttaaaccaatcggcgctg

SEQ ID NO: 31930 - DNA, 25 bp, S. cerevisiae
gaaaaggtcctacttactcttcgct

SEQ ID NO: 31931 - DNA, 25 bp, S. cerevisiae
gaaaactgatgaacccatcctaccc

SEQ ID NO: 31932 - DNA, 25 bp, S. cerevisiae
gaaaaattgaattcccactcccatc

SEQ ID NO: 31933 - DNA, 25 bp, S. cerevisiae
gaaaacctatcatccaacttccata

SEQ ID NO: 31934 - DNA, 25 bp, S. cerevisiae
gaaaattccatatatctcatcttga

SEQ ID NO: 31935 - DNA, 25 bp, S. cerevisiae
gaaaatcctcatttcatccatatta

SEQ ID NO: 31936 - DNA, 25 bp, S. cerevisiae
gaacacgatttactttgctgctatt

SEQ ID NO: 31937 - DNA, 25 bp, S. cerevisiae
gaacaagtctctatggtgctccttt

SEQ ID NO: 31938 - DNA, 25 bp, S. cerevisiae
gaaaagtcactttgcagtacctcct

SEQ ID NO: 31939 - DNA, 25 bp, S. cerevisiae
gaaaatggccttgttacatccgccc

SEQ ID NO: 31940 - DNA, 25 bp, S. cerevisiae
gaaaagttgccggattactcacctc

SEQ ID NO: 31941 - DNA, 25 bp, S. cerevisiae
gaacaactgtctgaatcattggaag

SEQ ID NO: 31942 - DNA, 25 bp, S. cerevisiae
gaacactgcttcgttattctaagag

SEQ ID NO: 31943 - DNA, 25 bp, S. cerevisiae
gaacactgctgctgctaatttgact

SEQ ID NO: 31944 - DNA, 25 bp, S. cerevisiae
gaacactttagcgatttcctccgaa

SEQ ID NO: 31945 - DNA, 25 bp, S. cerevisiae
gaaaatttcgaggttgcacatgcaa

SEQ ID NO: 31946 - DNA, 25 bp, S. cerevisiae
gaaaagtacgaattgctgcctaata

SEQ ID NO: 31947 - DNA, 25 bp, S. cerevisiae
gaacaatggactatgctgcacctga

SEQ ID NO: 31948 - DNA, 25 bp, S. cerevisiae
gaaatcgcatattgtaaggcctggt

SEQ ID NO: 31949 - DNA, 25 bp, S. cerevisiae
gaaactataatgtatgcgagcctga

SEQ ID NO: 31950 - DNA, 25 bp, S. cerevisiae
gaaacatctaagttgctgcgtgatg

SEQ ID NO: 31951 - DNA, 25 bp, S. cerevisiae
gaaaatcttctgtatgcatggtggt

SEQ ID NO: 31952 - DNA, 25 bp, S. cerevisiae
gacaaattccccagtgaccatatac

SEQ ID NO: 31953 - DNA, 25 bp, S. cerevisiae
gaaaatttcaccaggatcacttcgc

SEQ ID NO: 31954 - DNA, 25 bp, S. cerevisiae
gacagttcaacctcaaaatttccct

SEQ ID NO: 31955 - DNA, 25 bp, S. cerevisiae
gacagtcagtccaccaaaaattcta

SEQ ID NO: 31956 - DNA, 25 bp, S. cerevisiae
gaaacgtttggtcccagttaagctg

SEQ ID NO: 31957 - DNA, 25 bp, S. cerevisiae
gaaaatctcattcacttgtaccatt

SEQ ID NO: 31958 - DNA, 25 bp, S. cerevisiae
gataaattcactgacggcggcctat

SEQ ID NO: 31959 - DNA, 25 bp, S. cerevisiae
gaaaagcacgctgtaacttctcaaa

SEQ ID NO: 31960 - DNA, 25 bp, S. cerevisiae
gaacaaccctgcagaatcatttaag

SEQ ID NO: 31961 - DNA, 25 bp, S. cerevisiae
gaaaaggaccaccatgattctgcat

SEQ ID NO: 31962 - DNA, 25 bp, S. cerevisiae
gaacaatggcattctggacgagagt

SEQ ID NO: 31963 - DNA, 25 bp, S. cerevisiae
gaaaataatcacttacagcaggctt

SEQ ID NO: 31964 - DNA, 25 bp, S. cerevisiae
gacaaaaacgtcaagcacagtggta

SEQ ID NO: 31965 - DNA, 25 bp, S. cerevisiae
gaaaaggatctcgtctctgttggga

SEQ ID NO: 31966 - DNA, 25 bp, S. cerevisiae
gaaaccgaatcctctatttctaaca

SEQ ID NO: 31967 - DNA, 25 bp, S. cerevisiae
gaaaaggaatcctctacttccagtg

SEQ ID NO: 31968 - DNA, 25 bp, S. cerevisiae
gaaatcgaaacctcgcgctaacaag

SEQ ID NO: 31969 - DNA, 25 bp, S. cerevisiae
gaaaagcagacagtacccgccaaaa

SEQ ID NO: 31970 - DNA, 25 bp, S. cerevisiae
gaacaataacattacctcagctaga

SEQ ID NO: 31971 - DNA, 25 bp, S. cerevisiae
gaacaaattctttctccagatggtg

SEQ ID NO: 31972 - DNA, 25 bp, S. cerevisiae
gaacaaatttctcccatcaagttga

SEQ ID NO: 31973 - DNA, 25 bp, S. cerevisiae
gaacaaatttatccctacctatagt

SEQ ID NO: 31974 - DNA, 25 bp, S. cerevisiae
gaaaaattcctctctagtcctagtg

SEQ ID NO: 31975 - DNA, 25 bp, S. cerevisiae
gaaaaattgtcctctacttccacta

SEQ ID NO: 31976 - DNA, 25 bp, S. cerevisiae
gaaaaactgtccaattacccaatga

SEQ ID NO: 31977 - DNA, 25 bp, S. cerevisiae
gaaaaaatgttcctgatatcgcccc

SEQ ID NO: 31978 - DNA, 25 bp, S. cerevisiae
gaaaagtatgctgccgttgcctcaa

SEQ ID NO: 31979 - DNA, 25 bp, S. cerevisiae
gaaaagttttccagcattctatgaa

SEQ ID NO: 31980 - DNA, 25 bp, S. cerevisiae
gaaaacggtgtcgatagcgtggaaa

SEQ ID NO: 31981 - DNA, 25 bp, S. cerevisiae
gaaaacccttccgttgatcttagat

SEQ ID NO: 31982 - DNA, 25 bp, S. cerevisiae
gaaaacacccttttgtatcgacaat

SEQ ID NO: 31983 - DNA, 25 bp, S. cerevisiae
gaacaagacaatcacctacgctatt

SEQ ID NO: 31984 - DNA, 25 bp, S. cerevisiae
gaacaagagtctgccatgctcaaaa

SEQ ID NO: 31985 - DNA, 25 bp, S. cerevisiae
gaacaaggttccttccaacacattt

SEQ ID NO: 31986 - DNA, 25 bp, S. cerevisiae
gaaaagggcttatcacggcacatct

SEQ ID NO: 31987 - DNA, 25 bp, S. cerevisiae
gaaaaggacatctacgagcgtaact

SEQ ID NO: 31988 - DNA, 25 bp, S. cerevisiae
gaaaactcttcaactgaaagccttt

SEQ ID NO: 31989 - DNA, 25 bp, S. cerevisiae
gaaaactcgatctctaggttcttat

SEQ ID NO: 31990 - DNA, 25 bp, S. cerevisiae
gaaaagcggttggtctgctgcgtca

SEQ ID NO: 31991 - DNA, 25 bp, S. cerevisiae
gaaaatcaggttcccagctagtcat

SEQ ID NO: 31992 - DNA, 25 bp, S. cerevisiae
gaaaatagcggcgtctctgcttctt

SEQ ID NO: 31993 - DNA, 25 bp, S. cerevisiae
gaaacattcggtaagtgccagtata

SEQ ID NO: 31994 - DNA, 25 bp, S. cerevisiae
gaaacgtcaagtccagtgcaatatg

SEQ ID NO: 31995 - DNA, 25 bp, S. cerevisiae
gaacaatcgctacaatctgcaaacg

SEQ ID NO: 31996 - DNA, 25 bp, S. cerevisiae
gaaaatgcgctatacctaatctctg

SEQ ID NO: 31997 - DNA, 25 bp, S. cerevisiae
gaaaagttctgccaactctgtccgt

SEQ ID NO: 31998 - DNA, 25 bp, S. cerevisiae
gaaaagcccagcaaaatctgttttt

SEQ ID NO: 31999 - DNA, 25 bp, S. cerevisiae
gaaaagttcagtactcaatttttga

SEQ ID NO: 32000 - DNA, 25 bp, S. cerevisiae
gaaaactattctccctgtgtaggta

SEQ ID NO: 32001 - DNA, 25 bp, S. cerevisiae
gaaaattttcctaccatcataccaa

SEQ ID NO: 32002 - DNA, 25 bp, S. cerevisiae
gaaaagtttcagtaccatagacgga

SEQ ID NO: 32003 - DNA, 25 bp, S. cerevisiae
gaaaatggctccagttccaatggaa

SEQ ID NO: 32004 - DNA, 25 bp, S. cerevisiae
gaaaattgcgccattgtccttgaag

SEQ ID NO: 32005 - DNA, 25 bp, S. cerevisiae
gaacaatttcactttgccttctcaa

SEQ ID NO: 32006 - DNA, 25 bp, S. cerevisiae
gaaaagctacaagggcgtctccaaa

SEQ ID NO: 32007 - DNA, 25 bp, S. cerevisiae
gaaaacgaaatggtcttctccgaat

SEQ ID NO: 32008 - DNA, 25 bp, S. cerevisiae
gaaactcaacttcattgacccgtat

SEQ ID NO: 32009 - DNA, 25 bp, S. cerevisiae
gaaataccattttttaccgcctctg

SEQ ID NO: 32010 - DNA, 25 bp, S. cerevisiae
gaaaaaatctttgccaccgactcat

SEQ ID NO: 32011 - DNA, 25 bp, S. cerevisiae
gaaaagttctactccactcaaattg

SEQ ID NO: 32012 - DNA, 25 bp, S. cerevisiae
gaaaatggatcttcaccccgataag

SEQ ID NO: 32013 - DNA, 25 bp, S. cerevisiae
gaaaatggtttgaccgcctacagat

SEQ ID NO: 32014 - DNA, 25 bp, S. cerevisiae
gaaactggatatacccgtcggagaa

SEQ ID NO: 32015 - DNA, 25 bp, S. cerevisiae
gaaacacatcctttgtttaacgccg

SEQ ID NO: 32016 - DNA, 25 bp, S. cerevisiae
gaaaagcactcctttagtaccactc

SEQ ID NO: 32017 - DNA, 25 bp, S. cerevisiae
gaaaaggcacctattgtcacactcg

SEQ ID NO: 32018 - DNA, 25 bp, S. cerevisiae
gaaaaccacgcagacctttatgcaa

SEQ ID NO: 32019 - DNA, 25 bp, S. cerevisiae
gaaaaacccgcaactttgttcgatg

SEQ ID NO: 32020 - DNA, 25 bp, S. cerevisiae
gaaaggaccggctgctctttgggac

SEQ ID NO: 32021 - DNA, 25 bp, S. cerevisiae
gaaaattcacggtgtagcttggacc

SEQ ID NO: 32022 - DNA, 25 bp, S. cerevisiae
gaaaattcgcggatgatatttgaga

SEQ ID NO: 32023 - DNA, 25 bp, S. cerevisiae
gaaaattccatccacttagctgttg

SEQ ID NO: 32024 - DNA, 25 bp, S. cerevisiae
gaaaattcattctgcttcaagctct

SEQ ID NO: 32025 - DNA, 25 bp, S. cerevisiae
gaaaattcaagctcccaagttctcc

SEQ ID NO: 32026 - DNA, 25 bp, S. cerevisiae
gaaacttatttcagcttttgacgac

SEQ ID NO: 32027 - DNA, 25 bp, S. cerevisiae
gaacaatattctgacgctgcttttt

SEQ ID NO: 32028 - DNA, 25 bp, S. cerevisiae
gaaacatgttcttccgtgtacgtta

SEQ ID NO: 32029 - DNA, 25 bp, S. cerevisiae
gaaacatgtctacgcgggctagctt

SEQ ID NO: 32030 - DNA, 25 bp, S. cerevisiae
gaaaatgtccatcgtcggccgcatt

SEQ ID NO: 32031 - DNA, 25 bp, S. cerevisiae
gaaaattgccagaatcgagccacat

SEQ ID NO: 32032 - DNA, 25 bp, S. cerevisiae
gaaaagctgcggatggctccatcac

SEQ ID NO: 32033 - DNA, 25 bp, S. cerevisiae
gaaaatcagcagcacggctccaaga

SEQ ID NO: 32034 - DNA, 25 bp, S. cerevisiae
gaacaatcacaattgcggtccaaga

SEQ ID NO: 32035 - DNA, 25 bp, S. cerevisiae
gaaaactatgtttgctgacccaagt

SEQ ID NO: 32036 - DNA, 25 bp, S. cerevisiae
gaaaacggtattgtcatccaggtaa

SEQ ID NO: 32037 - DNA, 25 bp, S. cerevisiae
gaaaccggtattgttcaagcctgtt

SEQ ID NO: 32038 - DNA, 25 bp, S. cerevisiae
gaaaccgttattgttgccaaagctc

SEQ ID NO: 32039 - DNA, 25 bp, S. cerevisiae
gaaaatcgatcagtctttgtccaaa

SEQ ID NO: 32040 - DNA, 25 bp, S. cerevisiae
gaaaatccatcagacttgtcgctgg

SEQ ID NO: 32041 - DNA, 25 bp, S. cerevisiae
gaaaacccagtaccattgcgatgtg

SEQ ID NO: 32042 - DNA, 25 bp, S. cerevisiae
gaaaacccatgttcttctcagagag

SEQ ID NO: 32043 - DNA, 25 bp, S. cerevisiae
gaaatacaggctgcctacggcatct

SEQ ID NO: 32044 - DNA, 25 bp, S. cerevisiae
gaaaaagtcctcaatgtcgatgatt

SEQ ID NO: 32045 - DNA, 25 bp, S. cerevisiae
gaaaaaccccttcatgagcatacaa

SEQ ID NO: 32046 - DNA, 25 bp, S. cerevisiae
gaaaaaccgatcatccatgtgccca

SEQ ID NO: 32047 - DNA, 25 bp, S. cerevisiae
gacaagcctacgattaagcctaaat

SEQ ID NO: 32048 - DNA, 25 bp, S. cerevisiae
gaaaatcgcaccatattctattagt

SEQ ID NO: 32049 - DNA, 25 bp, S. cerevisiae
gaaaattcgctgatctctcttacag

SEQ ID NO: 32050 - DNA, 25 bp, S. cerevisiae
gaaaagtagctcacctctatacagg

SEQ ID NO: 32051 - DNA, 25 bp, S. cerevisiae
gaaaacttctagctaggccaggcat

SEQ ID NO: 32052 - DNA, 25 bp, S. cerevisiae
gaaaactttaggtgccggcctgaat

SEQ ID NO: 32053 - DNA, 25 bp, S. cerevisiae
gaaaactttaactgctcgtcgtact

SEQ ID NO: 32054 - DNA, 25 bp, S. cerevisiae
gaaaacttccaccaatacagtcgta

SEQ ID NO: 32055 - DNA, 25 bp, S. cerevisiae
gaaaacttccactactacgtcatct

SEQ ID NO: 32056 - DNA, 25 bp, S. cerevisiae
gaaaattctgcagcaaccgctacta

SEQ ID NO: 32057 - DNA, 25 bp, S. cerevisiae
gaaaatacatcatccccagctaagg

SEQ ID NO: 32058 - DNA, 25 bp, S. cerevisiae
gaaaagactcccagatcagctacgg

SEQ ID NO: 32059 - DNA, 25 bp, S. cerevisiae
gaaaagatcccaagcatcacgttat

SEQ ID NO: 32060 - DNA, 25 bp, S. cerevisiae
gaaacattgtccttgaagagctaac

SEQ ID NO: 32061 - DNA, 25 bp, S. cerevisiae
gaaaatctgtctttgccagggaaga

SEQ ID NO: 32062 - DNA, 25 bp, S. cerevisiae
gaaaatcttggctccattagcagaa

SEQ ID NO: 32063 - DNA, 25 bp, S. cerevisiae
gaaaatgcatcctatgtctcatgaa

SEQ ID NO: 32064 - DNA, 25 bp, S. cerevisiae
gaaaagcttgattgcccatgataat

SEQ ID NO: 32065 - DNA, 25 bp, S. cerevisiae
gaaaagattcattgcctacgcatca

SEQ ID NO: 32066 - DNA, 25 bp, S. cerevisiae
gaaaatgtcatcaaggctatccgcg

SEQ ID NO: 32067 - DNA, 25 bp, S. cerevisiae
gaaaaccatcctgcgagcacaattt

SEQ ID NO: 32068 - DNA, 25 bp, S. cerevisiae
gaaaactatcccgaatccaattgcc

SEQ ID NO: 32069 - DNA, 25 bp, S. cerevisiae
gaaaatcttccaatcttccactaaa

SEQ ID NO: 32070 - DNA, 25 bp, S. cerevisiae
gaaaatagttataagagtgctgaaa

SEQ ID NO: 32071 - DNA, 25 bp, S. cerevisiae
gagaaagtccgtcagaggtgccatt

SEQ ID NO: 32072 - DNA, 25 bp, S. cerevisiae
gaaaaactgaatctgctaggagcac

SEQ ID NO: 32073 - DNA, 25 bp, S. cerevisiae
gaaaactctgaagatgctttgcata

SEQ ID NO: 32074 - DNA, 25 bp, S. cerevisiae
gaaactatgctctggcgtaactatt

SEQ ID NO: 32075 - DNA, 25 bp, S. cerevisiae
gaaaactaccaactcattactgaag

SEQ ID NO: 32076 - DNA, 25 bp, S. cerevisiae
gaaaactaacaccatgctctccagg

SEQ ID NO: 32077 - DNA, 25 bp, S. cerevisiae
gaaaaggcgtatgcatgtccctgtg

SEQ ID NO: 32078 - DNA, 25 bp, S. cerevisiae
gaaaagtggttagctgactctgaca

SEQ ID NO: 32079 - DNA, 25 bp, S. cerevisiae
gaaaatggtgtctactctggctctg

SEQ ID NO: 32080 - DNA, 25 bp, S. cerevisiae
gaaaagccgctttgttccgttgcaa

SEQ ID NO: 32081 - DNA, 25 bp, S. cerevisiae
gaaaaccccttttgcgcgcctgcga

SEQ ID NO: 32082 - DNA, 25 bp, S. cerevisiae
gaaaacaggcaatttcccgcttgga

SEQ ID NO: 32083 - DNA, 25 bp, S. cerevisiae
gaaaacagcgcatggatcccgcaat

SEQ ID NO: 32084 - DNA, 25 bp, S. cerevisiae
gaaacatccccacagtcaaagacga

SEQ ID NO: 32085 - DNA, 25 bp, S. cerevisiae
gaaaagcgatacacctgcgaatata

SEQ ID NO: 32086 - DNA, 25 bp, S. cerevisiae
gaaaacctacaccttcgacttatct

SEQ ID NO: 32087 - DNA, 25 bp, S. cerevisiae
gaaaagacttacaccaaggctccaa

SEQ ID NO: 32088 - DNA, 25 bp, S. cerevisiae
gaaattcactgtaaggccaaggccc

SEQ ID NO: 32089 - DNA, 25 bp, S. cerevisiae
gaaaatctcggaagtcgaacttaag

SEQ ID NO: 32090 - DNA, 25 bp, S. cerevisiae
gagaaaacggtaacgactcttcaag

SEQ ID NO: 32091 - DNA, 25 bp, S. cerevisiae
gacggacccgatttagacttgtaca

SEQ ID NO: 32092 - DNA, 25 bp, S. cerevisiae
gaaaagcctcgatttgaccttgttc

SEQ ID NO: 32093 - DNA, 25 bp, S. cerevisiae
gaaaagcccgtcttcatctattgtg

SEQ ID NO: 32094 - DNA, 25 bp, S. cerevisiae
gaaaagcctcctcataatgtcgatg

SEQ ID NO: 32095 - DNA, 25 bp, S. cerevisiae
gaaaagttcgtcactgtcattagaa

SEQ ID NO: 32096 - DNA, 25 bp, S. cerevisiae
gaaaagtgctgtttgccgcttacaa

SEQ ID NO: 32097 - DNA, 25 bp, S. cerevisiae
gaaaactgtcgcaaaggctcattta

SEQ ID NO: 32098 - DNA, 25 bp, S. cerevisiae
gaaaatgcctgccttctggagaaga

SEQ ID NO: 32099 - DNA, 25 bp, S. cerevisiae
gaaaactggcctgtcgagaatgatt

SEQ ID NO: 32100 - DNA, 25 bp, S. cerevisiae
gaaaaccattctatgtggtcactga

SEQ ID NO: 32101 - DNA, 25 bp, S. cerevisiae
gaaaagaattctacgccttccgacg

SEQ ID NO: 32102 - DNA, 25 bp, S. cerevisiae
gaaaaagtcattctcgcaccttcaa

SEQ ID NO: 32103 - DNA, 25 bp, S. cerevisiae
gaaactcttcttctacacaatttta

SEQ ID NO: 32104 - DNA, 25 bp, S. cerevisiae
gaaaaattcttcgtatccatatatt

SEQ ID NO: 32105 - DNA, 25 bp, S. cerevisiae
gaaaacttcgacgtcttggccaatg

SEQ ID NO: 32106 - DNA, 25 bp, S. cerevisiae
gaaaactacttctagtccgctaact

SEQ ID NO: 32107 - DNA, 25 bp, S. cerevisiae
gaaaacttaaataggtcgcatgaac

SEQ ID NO: 32108 - DNA, 25 bp, S. cerevisiae
gaaaacctaaaaccatccatcgacg

SEQ ID NO: 32109 - DNA, 25 bp, S. cerevisiae
gaaaatgccgaagtcatcctaccca

SEQ ID NO: 32110 - DNA, 25 bp, S. cerevisiae
gaaagagccaaattccttgtcgaaa

SEQ ID NO: 32111 - DNA, 25 bp, S. cerevisiae
gaaacaacttactcttctcaggcaa

SEQ ID NO: 32112 - DNA, 25 bp, S. cerevisiae
gaaaaactccaactttctcgagcgc

SEQ ID NO: 32113 - DNA, 25 bp, S. cerevisiae
gaaaaggcgtcatcagcgatattag

SEQ ID NO: 32114 - DNA, 25 bp, S. cerevisiae
gaaaccgatgtttgacgaagacgag

SEQ ID NO: 32115 - DNA, 25 bp, S. cerevisiae
gaaaacgtttctccggacactagag

SEQ ID NO: 32116 - DNA, 25 bp, S. cerevisiae
gaaaacgccttcgtcgactacaacg

SEQ ID NO: 32117 - DNA, 25 bp, S. cerevisiae
gaaaacccgttgctacatggcatac

SEQ ID NO: 32118 - DNA, 25 bp, S. cerevisiae
gaaaatgttcaggtcgctcaataat

SEQ ID NO: 32119 - DNA, 25 bp, S. cerevisiae
gaaaacttattcttgcctgtgtgga

SEQ ID NO: 32120 - DNA, 25 bp, S. cerevisiae
gaaaacgctaatttctcattgaaga

SEQ ID NO: 32121 - DNA, 25 bp, S. cerevisiae
gaaaaccttatttctcttcaaaatg

SEQ ID NO: 32122 - DNA, 25 bp, S. cerevisiae
gaaaatgttatctccgttgcaagtg

SEQ ID NO: 32123 - DNA, 25 bp, S. cerevisiae
tgataaagttcctgggtggttggct

SEQ ID NO: 32124 - DNA, 25 bp, S. cerevisiae
gaaaacgccattaccggtgtcatga

SEQ ID NO: 32125 - DNA, 25 bp, S. cerevisiae
gaaaagtccttcagcgtcgtatgat

SEQ ID NO: 32126 - DNA, 25 bp, S. cerevisiae
gaaatacttcccaggtctgttgagg

SEQ ID NO: 32127 - DNA, 25 bp, S. cerevisiae
gaaaacatggtcgttcctaccgtag

SEQ ID NO: 32128 - DNA, 25 bp, S. cerevisiae
gaaaagggtcttattctgccgtagg

SEQ ID NO: 32129 - DNA, 25 bp, S. cerevisiae
gaaaaaactctttgtctctgttgta

SEQ ID NO: 32130 - DNA, 25 bp, S. cerevisiae
gaaaactggtttcttcggcaaattg

SEQ ID NO: 32131 - DNA, 25 bp, S. cerevisiae
gaaaacggtctccattccaggaatt

SEQ ID NO: 32132 - DNA, 25 bp, S. cerevisiae
gaaaaccgttcttctcaacgatatg

SEQ ID NO: 32133 - DNA, 25 bp, S. cerevisiae
gaaaaccgttcgctcagatagattt

SEQ ID NO: 32134 - DNA, 25 bp, S. cerevisiae
gaaaaacattcccatgaaatcgaca

SEQ ID NO: 32135 - DNA, 25 bp, S. cerevisiae
gaaaaggcctcccacataagcgaga

SEQ ID NO: 32136 - DNA, 25 bp, S. cerevisiae
gaaaacgtctcccaacagcagagta

SEQ ID NO: 32137 - DNA, 25 bp, S. cerevisiae
gaaaacgtctcggaagctgctgttg

SEQ ID NO: 32138 - DNA, 25 bp, S. cerevisiae
gaaaaaccagcgtcttccacttaag

SEQ ID NO: 32139 - DNA, 25 bp, S. cerevisiae
gaaacttgagaacggacattcccat

SEQ ID NO: 32140 - DNA, 25 bp, S. cerevisiae
gaaaaggtgcttagcctttcccatt

SEQ ID NO: 32141 - DNA, 25 bp, S. cerevisiae
gaaaactttttcagatgacgcgaat

SEQ ID NO: 32142 - DNA, 25 bp, S. cerevisiae
gaaagtttatcagacgaagcgccca

SEQ ID NO: 32143 - DNA, 25 bp, S. cerevisiae
gaaattttacagatccaaccgcggg

SEQ ID NO: 32144 - DNA, 25 bp, S. cerevisiae
gaaactcctaagattacagcggcag

SEQ ID NO: 32145 - DNA, 25 bp, S. cerevisiae
gaaacgcagtcagcgggtgacaaat

SEQ ID NO: 32146 - DNA, 25 bp, S. cerevisiae
gaaactgcacactcaagggaaactt

SEQ ID NO: 32147 - DNA, 25 bp, S. cerevisiae
gagaacccctaaccagaagaagctg

SEQ ID NO: 32148 - DNA, 25 bp, S. cerevisiae
gaaaacatgcctccgtcaattggtt

SEQ ID NO: 32149 - DNA, 25 bp, S. cerevisiae
gaaagacgctaacgatccagtcgat

SEQ ID NO: 32150 - DNA, 25 bp, S. cerevisiae
gaaacacgtcaaacctagttgtata

SEQ ID NO: 32151 - DNA, 25 bp, S. cerevisiae
gaaaagtctgaaatctctacaaaag

SEQ ID NO: 32152 - DNA, 25 bp, S. cerevisiae
gaaaagcttgctgaattgacaaaga

SEQ ID NO: 32153 - DNA, 25 bp, S. cerevisiae
gaaaagctgccccattgcaattgaa

SEQ ID NO: 32154 - DNA, 25 bp, S. cerevisiae
gaaaagtcactggatcacacattag

SEQ ID NO: 32155 - DNA, 25 bp, S. cerevisiae
gaaaaccagtgcgaacctcatatga

SEQ ID NO: 32156 - DNA, 25 bp, S. cerevisiae
gaaaacttgctggtgatcctattga

SEQ ID NO: 32157 - DNA, 25 bp, S. cerevisiae
gaaaactaccgctctctcattaaag

SEQ ID NO: 32158 - DNA, 25 bp, S. cerevisiae
gaaaaatgcccctcattcattggaa

SEQ ID NO: 32159 - DNA, 25 bp, S. cerevisiae
gaaagacaaacggagttgcatcatt

SEQ ID NO: 32160 - DNA, 25 bp, S. cerevisiae
gaaacggtaggtattcacagtccta

SEQ ID NO: 32161 - DNA, 25 bp, S. cerevisiae
gaaactacgtctgttttatcacgct

SEQ ID NO: 32162 - DNA, 25 bp, S. cerevisiae
gaaaacactttgaaatctaaccttg

SEQ ID NO: 32163 - DNA, 25 bp, S. cerevisiae
gaaaccctggagaaactatcccctg

SEQ ID NO: 32164 - DNA, 25 bp, S. cerevisiae
gaaaaagctttgagcgcctccaaat

SEQ ID NO: 32165 - DNA, 25 bp, S. cerevisiae
gaaataagattctggccgtcgccaa

SEQ ID NO: 32166 - DNA, 25 bp, S. cerevisiae
gaaatatatgtatcggctgcacccg

SEQ ID NO: 32167 - DNA, 25 bp, S. cerevisiae
gaaaccttcaagttgttcaacaagt

SEQ ID NO: 32168 - DNA, 25 bp, S. cerevisiae
gaaaacatatgcgagttattgaact

SEQ ID NO: 32169 - DNA, 25 bp, S. cerevisiae
gaaaacttcatcagtcagtgtaaac

SEQ ID NO: 32170 - DNA, 25 bp, S. cerevisiae
gaaaagcctctgacgccacttaaat

SEQ ID NO: 32171 - DNA, 25 bp, S. cerevisiae
gaaaacctttcgacgttgaagatag

SEQ ID NO: 32172 - DNA, 25 bp, S. cerevisiae
gaaaagcactcttctttgtataaat

SEQ ID NO: 32173 - DNA, 25 bp, S. cerevisiae
gaaactagtcttatctgaatcacca

SEQ ID NO: 32174 - DNA, 25 bp, S. cerevisiae
gaaactacacttatcgaaatccatg

SEQ ID NO: 32175 - DNA, 25 bp, S. cerevisiae
gaaacttaccatatcggagtccagt

SEQ ID NO: 32176 - DNA, 25 bp, S. cerevisiae
gaaaccagccgtcttgagcgtgttc

SEQ ID NO: 32177 - DNA, 25 bp, S. cerevisiae
gaaacctcaagaccaagtcgttcgt

SEQ ID NO: 32178 - DNA, 25 bp, S. cerevisiae
gaaacttcacaagatatggccttca

SEQ ID NO: 32179 - DNA, 25 bp, S. cerevisiae
gaaactgatccattgcgtattgcca

SEQ ID NO: 32180 - DNA, 25 bp, S. cerevisiae
gaaactggcagatcttggacttgaa

SEQ ID NO: 32181 - DNA, 25 bp, S. cerevisiae
gaaactaagcctgatggatttgaat

SEQ ID NO: 32182 - DNA, 25 bp, S. cerevisiae
gaaacagaactcttctataacccag

SEQ ID NO: 32183 - DNA, 25 bp, S. cerevisiae
gaaacatgaacctcaatctactgaa

SEQ ID NO: 32184 - DNA, 25 bp, S. cerevisiae
gaaacaaagcgccaacgacactata

SEQ ID NO: 32185 - DNA, 25 bp, S. cerevisiae
gaaacaaacccatcagaggctttat

SEQ ID NO: 32186 - DNA, 25 bp, S. cerevisiae
gaaaaacacaactatcaagagcaat

SEQ ID NO: 32187 - DNA, 25 bp, S. cerevisiae
gaaaacacactacctgcgacacaag

SEQ ID NO: 32188 - DNA, 25 bp, S. cerevisiae
gaaaacaacgatcctagcaccaaga

SEQ ID NO: 32189 - DNA, 25 bp, S. cerevisiae
gaaaacggagtcttcgatccggctt

SEQ ID NO: 32190 - DNA, 25 bp, S. cerevisiae
gaaaacgtctactcagtgactggta

SEQ ID NO: 32191 - DNA, 25 bp, S. cerevisiae
gaaaacgtcctatcagtacatcctg

SEQ ID NO: 32192 - DNA, 25 bp, S. cerevisiae
gaaaccgttccatatgtcttgagac

SEQ ID NO: 32193 - DNA, 25 bp, S. cerevisiae
gaaaacgattccttctgtcacgaga

SEQ ID NO: 32194 - DNA, 25 bp, S. cerevisiae
gaaaacgtcatggaggctgccacaa

SEQ ID NO: 32195 - DNA, 25 bp, S. cerevisiae
gaaaacggatgccatgttccagcac

SEQ ID NO: 32196 - DNA, 25 bp, S. cerevisiae
gaaaacgagatcttcgtcgcatcca

SEQ ID NO: 32197 - DNA, 25 bp, S. cerevisiae
gaaaacgcgactgcagctgactcca

SEQ ID NO: 32198 - DNA, 25 bp, S. cerevisiae
gaaaacgccactaatcaacctgtaa

SEQ ID NO: 32199 - DNA, 25 bp, S. cerevisiae
gaaaaccttgtttcagacactctaa

SEQ ID NO: 32200 - DNA, 25 bp, S. cerevisiae
gaaaactctctgatggaagctcgaa

SEQ ID NO: 32201 - DNA, 25 bp, S. cerevisiae
gaaaacacatctactggacgccacg

SEQ ID NO: 32202 - DNA, 25 bp, S. cerevisiae
gaaaactcaatcgatttgcccaagt

SEQ ID NO: 32203 - DNA, 25 bp, S. cerevisiae
gaaagctcagtactacttccgttgg

SEQ ID NO: 32204 - DNA, 25 bp, S. cerevisiae
gaaactcagtattacaccaccggtg

SEQ ID NO: 32205 - DNA, 25 bp, S. cerevisiae
gaaacacactattatctccatcaag

SEQ ID NO: 32206 - DNA, 25 bp, S. cerevisiae
gaaacatttgacttcgccatctcaa

SEQ ID NO: 32207 - DNA, 25 bp, S. cerevisiae
gaaacacattgttgctgcccttcaa

SEQ ID NO: 32208 - DNA, 25 bp, S. cerevisiae
gaaacagatctttgggccactgggt

SEQ ID NO: 32209 - DNA, 25 bp, S. cerevisiae
gaaagctactagaccttcgaaacct

SEQ ID NO: 32210 - DNA, 25 bp, S. cerevisiae
gaaacaactcgtattccaactcttt

SEQ ID NO: 32211 - DNA, 25 bp, S. cerevisiae
gaaaaaacgtagctcctcaccattt

SEQ ID NO: 32212 - DNA, 25 bp, S. cerevisiae
gaaaactttgctcctgtattgccca

SEQ ID NO: 32213 - DNA, 25 bp, S. cerevisiae
gaaacattttctcctgtcttacttc

SEQ ID NO: 32214 - DNA, 25 bp, S. cerevisiae
gaaaaatctattctttatggctcta

SEQ ID NO: 32215 - DNA, 25 bp, S. cerevisiae
gaaaacgccattcttcttgggtatt

SEQ ID NO: 32216 - DNA, 25 bp, S. cerevisiae
gaaacaagcctgttttttgccagtt

SEQ ID NO: 32217 - DNA, 25 bp, S. cerevisiae
gaaacttcagggtattctcgagcag

SEQ ID NO: 32218 - DNA, 25 bp, S. cerevisiae
gaaactactggagcctgcctacgat

SEQ ID NO: 32219 - DNA, 25 bp, S. cerevisiae
gaaacttatcgaggccgctggaggt

SEQ ID NO: 32220 - DNA, 25 bp, S. cerevisiae
gaaaacatgatcttctcacgcatta

SEQ ID NO: 32221 - DNA, 25 bp, S. cerevisiae
gaaagtcagaattccactgctgtga

SEQ ID NO: 32222 - DNA, 25 bp, S. cerevisiae
gaaacctggctgttgtcactgcatt

SEQ ID NO: 32223 - DNA, 25 bp, S. cerevisiae
gaaacttgtctcttgtggctatgat

SEQ ID NO: 32224 - DNA, 25 bp, S. cerevisiae
gaaacttacctctgaaactagcaaa

SEQ ID NO: 32225 - DNA, 25 bp, S. cerevisiae
gaaactctgccgaggaaaccacaca

SEQ ID NO: 32226 - DNA, 25 bp, S. cerevisiae
tggaacttccatcaagaaaattcgg

SEQ ID NO: 32227 - DNA, 25 bp, S. cerevisiae
gaaacttgccatccaaaacatctta

SEQ ID NO: 32228 - DNA, 25 bp, S. cerevisiae
gaaacttcctactatcaaactctgg

SEQ ID NO: 32229 - DNA, 25 bp, S. cerevisiae
gaaacctcttactcaaatttggcaa

SEQ ID NO: 32230 - DNA, 25 bp, S. cerevisiae
gacacctttaactttcagtacggag

SEQ ID NO: 32231 - DNA, 25 bp, S. cerevisiae
gaaacttctcaaagtgacgatccaa

SEQ ID NO: 32232 - DNA, 25 bp, S. cerevisiae
gaaaacatgccacacccagtgatag

SEQ ID NO: 32233 - DNA, 25 bp, S. cerevisiae
gaaaacgagcgctaccacaagaggc

SEQ ID NO: 32234 - DNA, 25 bp, S. cerevisiae
gaaagacggcgctactatcaaggaa

SEQ ID NO: 32235 - DNA, 25 bp, S. cerevisiae
gaaacagctgcccaattgcataagg

SEQ ID NO: 32236 - DNA, 25 bp, S. cerevisiae
gaaaacatcccaattgtcttgtgtg

SEQ ID NO: 32237 - DNA, 25 bp, S. cerevisiae
gaaaccaatggcaatctatcgtgtg

SEQ ID NO: 32238 - DNA, 25 bp, S. cerevisiae
tgttgggaaacgacaccgcttattt

SEQ ID NO: 32239 - DNA, 25 bp, S. cerevisiae
gttcgacaagtctgcaagaggtttt

SEQ ID NO: 32240 - DNA, 25 bp, S. cerevisiae
gaaacggtttgacgctttacgcaga

SEQ ID NO: 32241 - DNA, 25 bp, S. cerevisiae
gaccaaggccttaacccaaagcaat

SEQ ID NO: 32242 - DNA, 25 bp, S. cerevisiae
gaaacaaggttcacatcagcaaaca

SEQ ID NO: 32243 - DNA, 25 bp, S. cerevisiae
gaaacacaactacatcatccgataa

SEQ ID NO: 32244 - DNA, 25 bp, S. cerevisiae
gaaaaacatccgctcataacaaaat

SEQ ID NO: 32245 - DNA, 25 bp, S. cerevisiae
gaaacaattccgctagacccaaatc

SEQ ID NO: 32246 - DNA, 25 bp, S. cerevisiae
gaaaacttgggcctttcctcaaatg

SEQ ID NO: 32247 - DNA, 25 bp, S. cerevisiae
gaaaaacgcttccacttgcactatt

SEQ ID NO: 32248 - DNA, 25 bp, S. cerevisiae
gaaaaacatcttctttgctgcatat

SEQ ID NO: 32249 - DNA, 25 bp, S. cerevisiae
gaaaaaactgtcgatcttgccatta

SEQ ID NO: 32250 - DNA, 25 bp, S. cerevisiae
gaaaaaccattcgatcctttgcctg

SEQ ID NO: 32251 - DNA, 25 bp, S. cerevisiae
gaaaaagctcttcctcagttagaaa

SEQ ID NO: 32252 - DNA, 25 bp, S. cerevisiae
gaaaaatctgtcgaacatctcctga

SEQ ID NO: 32253 - DNA, 25 bp, S. cerevisiae
gaaacaggtctaccatctgggcatc

SEQ ID NO: 32254 - DNA, 25 bp, S. cerevisiae
gaaacggacacagtctcggctcagt

SEQ ID NO: 32255 - DNA, 25 bp, S. cerevisiae
gaaactctggctcacttgagggcta

SEQ ID NO: 32256 - DNA, 25 bp, S. cerevisiae
gaaacacgtgctaacatccattggt

SEQ ID NO: 32257 - DNA, 25 bp, S. cerevisiae
gaaacatgcttctttgatccttgct

SEQ ID NO: 32258 - DNA, 25 bp, S. cerevisiae
gaaactggtcgctgagtctggtaga

SEQ ID NO: 32259 - DNA, 25 bp, S. cerevisiae
gaaacttgtggctgaatctactaaa

SEQ ID NO: 32260 - DNA, 25 bp, S. cerevisiae
gaaagcttaccattttgcagaggat

SEQ ID NO: 32261 - DNA, 25 bp, S. cerevisiae
gaaacttacgcatcttcatggtatc

SEQ ID NO: 32262 - DNA, 25 bp, S. cerevisiae
gaaactctagagtccgttgttgaat

SEQ ID NO: 32263 - DNA, 25 bp, S. cerevisiae
gaaaccactgaaagattagttgcga

SEQ ID NO: 32264 - DNA, 25 bp, S. cerevisiae
gaaacacctgacgagtttagtgcaa

SEQ ID NO: 32265 - DNA, 25 bp, S. cerevisiae
gatagactgggacaagtttgcccta

SEQ ID NO: 32266 - DNA, 25 bp, S. cerevisiae
gatgaactgggctccaattggtgcc

SEQ ID NO: 32267 - DNA, 25 bp, S. cerevisiae
gaaacctaaataattgggcgcgctt

SEQ ID NO: 32268 - DNA, 25 bp, S. cerevisiae
gaaacctataaagctcgtgagtggg

SEQ ID NO: 32269 - DNA, 25 bp, S. cerevisiae
gaaacacataactccgcgtacgtga

SEQ ID NO: 32270 - DNA, 25 bp, S. cerevisiae
gaaaccaattgtacccggacatgta

SEQ ID NO: 32271 - DNA, 25 bp, S. cerevisiae
gaaagcaaattttcaccggaagcaa

SEQ ID NO: 32272 - DNA, 25 bp, S. cerevisiae
gaaacacaagacaaccctgagagag

SEQ ID NO: 32273 - DNA, 25 bp, S. cerevisiae
gaaaccagaaccgaccaagacgtgt

SEQ ID NO: 32274 - DNA, 25 bp, S. cerevisiae
gaaactcacacgactctgctattaa

SEQ ID NO: 32275 - DNA, 25 bp, S. cerevisiae
gaaacccacggcactattctataat

SEQ ID NO: 32276 - DNA, 25 bp, S. cerevisiae
gaaacaacctgttcgaagtctactt

SEQ ID NO: 32277 - DNA, 25 bp, S. cerevisiae
gaaaaattcaagaccccagcaacct

SEQ ID NO: 32278 - DNA, 25 bp, S. cerevisiae
gaaatagttgtagccctcaaccctt

SEQ ID NO: 32279 - DNA, 25 bp, S. cerevisiae
gaaacgtattcaaactctctaccct

SEQ ID NO: 32280 - DNA, 25 bp, S. cerevisiae
gaaacggacgatgaccactcacaag

SEQ ID NO: 32281 - DNA, 25 bp, S. cerevisiae
gaaactgtgcatattcccaatacga

SEQ ID NO: 32282 - DNA, 25 bp, S. cerevisiae
gaaactgtcaatgtcgtcttgaaga

SEQ ID NO: 32283 - DNA, 25 bp, S. cerevisiae
gaaactacagacgtgcattcattcg

SEQ ID NO: 32284 - DNA, 25 bp, S. cerevisiae
gaaacgagcaacacatgtcccactt

SEQ ID NO: 32285 - DNA, 25 bp, S. cerevisiae
gaaacgaatacaccagaccactctc

SEQ ID NO: 32286 - DNA, 25 bp, S. cerevisiae
gaaacagctggatctcaaacatatg

SEQ ID NO: 32287 - DNA, 25 bp, S. cerevisiae
gaaacgtggcattcctatatgatat

SEQ ID NO: 32288 - DNA, 25 bp, S. cerevisiae
gaaacaggctcttttcaattctctg

SEQ ID NO: 32289 - DNA, 25 bp, S. cerevisiae
gaaacatgtctaccgtcaattccac

SEQ ID NO: 32290 - DNA, 25 bp, S. cerevisiae
gaaacatggcattcctttgatctcc

SEQ ID NO: 32291 - DNA, 25 bp, S. cerevisiae
gaaacacggcaatctcttgtcttaa

SEQ ID NO: 32292 - DNA, 25 bp, S. cerevisiae
gaaaccggagttcctgtagcttcac

SEQ ID NO: 32293 - DNA, 25 bp, S. cerevisiae
gaaagctacggtaacttagttctag

SEQ ID NO: 32294 - DNA, 25 bp, S. cerevisiae
gaaacttccggactctagcgacgaa

SEQ ID NO: 32295 - DNA, 25 bp, S. cerevisiae
gaaacttttcgcagctagcttcaaa

SEQ ID NO: 32296 - DNA, 25 bp, S. cerevisiae
gaaacttacggtactgaactcgatc

SEQ ID NO: 32297 - DNA, 25 bp, S. cerevisiae
gaaacttatcgacagcagacacttg

SEQ ID NO: 32298 - DNA, 25 bp, S. cerevisiae
gaaacttttgacttgagagcctggt

SEQ ID NO: 32299 - DNA, 25 bp, S. cerevisiae
gaaactttatatccgttctcgagtc

SEQ ID NO: 32300 - DNA, 25 bp, S. cerevisiae
gaaaaatttcaacagctatcgctca

SEQ ID NO: 32301 - DNA, 25 bp, S. cerevisiae
gaaaaattacatcctcgccaagtcg

SEQ ID NO: 32302 - DNA, 25 bp, S. cerevisiae
gaaaccgtactagatccaataacaa

SEQ ID NO: 32303 - DNA, 25 bp, S. cerevisiae
gaaacggtatcaagaagccaaagac

SEQ ID NO: 32304 - DNA, 25 bp, S. cerevisiae
gaaacaacaactagaagctcaagaa

SEQ ID NO: 32305 - DNA, 25 bp, S. cerevisiae
gaaaccatcagtgaggtccaggaag

SEQ ID NO: 32306 - DNA, 25 bp, S. cerevisiae
gaaactgcaaataacgtcgaggaag

SEQ ID NO: 32307 - DNA, 25 bp, S. cerevisiae
gaaacatcgttcatcttgcaaggag

SEQ ID NO: 32308 - DNA, 25 bp, S. cerevisiae
gatccccggttatgggcacgcagtt

SEQ ID NO: 32309 - DNA, 25 bp, S. cerevisiae
gaaaaagcggtcatccctgaggata

SEQ ID NO: 32310 - DNA, 25 bp, S. cerevisiae
gaaacccaagctaaccaataaccat

SEQ ID NO: 32311 - DNA, 25 bp, S. cerevisiae
gaaatgtgccaataacccaaagtaa

SEQ ID NO: 32312 - DNA, 25 bp, S. cerevisiae
gaaagagaacctattgcgacaccta

SEQ ID NO: 32313 - DNA, 25 bp, S. cerevisiae
gaaagagaacactcctctgtccttg

SEQ ID NO: 32314 - DNA, 25 bp, S. cerevisiae
gaaagcgaaaatccttcttccattg

SEQ ID NO: 32315 - DNA, 25 bp, S. cerevisiae
gaaagcccaaagttttcattactgg

SEQ ID NO: 32316 - DNA, 25 bp, S. cerevisiae
gaaacaccaaactcatgtgcccttg

SEQ ID NO: 32317 - DNA, 25 bp, S. cerevisiae
gaaacctccaatacttgctgttgcc

SEQ ID NO: 32318 - DNA, 25 bp, S. cerevisiae
gaaactctcgccaagtatcgattgc

SEQ ID NO: 32319 - DNA, 25 bp, S. cerevisiae
gaaacactcgaccagaacgatctcg

SEQ ID NO: 32320 - DNA, 25 bp, S. cerevisiae
gaaactttaccacatactgacgatg

SEQ ID NO: 32321 - DNA, 25 bp, S. cerevisiae
gaaactattccattaacgcctatta

SEQ ID NO: 32322 - DNA, 25 bp, S. cerevisiae
gaaacgtgtcgatagcatccgattt

SEQ ID NO: 32323 - DNA, 25 bp, S. cerevisiae
gaaactttcgagtctcactgagatt

SEQ ID NO: 32324 - DNA, 25 bp, S. cerevisiae
gaaactgcttccaatgccggtcaaa

SEQ ID NO: 32325 - DNA, 25 bp, S. cerevisiae
gaaactgttctcaacttggtgcagg

SEQ ID NO: 32326 - DNA, 25 bp, S. cerevisiae
gaaacagcagtctcatctcagggaa

SEQ ID NO: 32327 - DNA, 25 bp, S. cerevisiae
gaaacagagactgctccagaagcat

SEQ ID NO: 32328 - DNA, 25 bp, S. cerevisiae
gaaacatgatcccttgaatagcaat

SEQ ID NO: 32329 - DNA, 25 bp, S. cerevisiae
gaaactgaattgtttgctagacata

SEQ ID NO: 32330 - DNA, 25 bp, S. cerevisiae
gaaactgaagtgttcgacgaattcc

SEQ ID NO: 32331 - DNA, 25 bp, S. cerevisiae
gaaagcgcaattgatcagactgaat

SEQ ID NO: 32332 - DNA, 25 bp, S. cerevisiae
gaaactgccttctatttcagggcct

SEQ ID NO: 32333 - DNA, 25 bp, S. cerevisiae
gaaagctacttatttccctggctgc

SEQ ID NO: 32334 - DNA, 25 bp, S. cerevisiae
gaaactccttaaattccttctgcag

SEQ ID NO: 32335 - DNA, 25 bp, S. cerevisiae
gaaaccccagaattagatcccatga

SEQ ID NO: 32336 - DNA, 25 bp, S. cerevisiae
gaaactcccaaatcagtctggctca

SEQ ID NO: 32337 - DNA, 25 bp, S. cerevisiae
gaaactcctggaaaatgccggcatt

SEQ ID NO: 32338 - DNA, 25 bp, S. cerevisiae
gaaagcttatcgaaagacctgaaaa

SEQ ID NO: 32339 - DNA, 25 bp, S. cerevisiae
gaaacctgaaggaaatctgctatat

SEQ ID NO: 32340 - DNA, 25 bp, S. cerevisiae
gaaaccgaaggcacgaatcgtcata

SEQ ID NO: 32341 - DNA, 25 bp, S. cerevisiae
gaaaggcgaaggttccacccatcta

SEQ ID NO: 32342 - DNA, 25 bp, S. cerevisiae
gaaacagctgatataggtgaccaaa

SEQ ID NO: 32343 - DNA, 25 bp, S. cerevisiae
gaaacagctgacaccgaacgaaatt

SEQ ID NO: 32344 - DNA, 25 bp, S. cerevisiae
gacaagagccaagcacggactaatt

SEQ ID NO: 32345 - DNA, 25 bp, S. cerevisiae
gacagaaataccatacaaaccgttt

SEQ ID NO: 32346 - DNA, 25 bp, S. cerevisiae
gaaacactttcaccaatctcagtgg

SEQ ID NO: 32347 - DNA, 25 bp, S. cerevisiae
gaaacagtttcaacacagcaagtga

SEQ ID NO: 32348 - DNA, 25 bp, S. cerevisiae
gaaacattttgaaccatgtggcgat

SEQ ID NO: 32349 - DNA, 25 bp, S. cerevisiae
gaaacattgttgaagccgctgccgt

SEQ ID NO: 32350 - DNA, 25 bp, S. cerevisiae
gaaactgtgtatcgagactctgcaa

SEQ ID NO: 32351 - DNA, 25 bp, S. cerevisiae
gaaactgcctgacgtgatgggcaca

SEQ ID NO: 32352 - DNA, 25 bp, S. cerevisiae
gaaaccgctaaaatcccagctattg

SEQ ID NO: 32353 - DNA, 25 bp, S. cerevisiae
gaaacacgtttcaagaagattcaag

SEQ ID NO: 32354 - DNA, 25 bp, S. cerevisiae
gaaacagcgtctcaggaaaccattg

SEQ ID NO: 32355 - DNA, 25 bp, S. cerevisiae
gaaacagcctctcaagacaacgaat

SEQ ID NO: 32356 - DNA, 25 bp, S. cerevisiae
gaaagacgccaaagccctgtgtttt

SEQ ID NO: 32357 - DNA, 25 bp, S. cerevisiae
gaaacaccagccagatcgatttgat

SEQ ID NO: 32358 - DNA, 25 bp, S. cerevisiae
gaaagaccaggcgtatcgaatttaa

SEQ ID NO: 32359 - DNA, 25 bp, S. cerevisiae
gaaacactcggcatgtccaaattac

SEQ ID NO: 32360 - DNA, 25 bp, S. cerevisiae
gaaagaccggtcatgatccatcgtg

SEQ ID NO: 32361 - DNA, 25 bp, S. cerevisiae
gaaaccagcaggacccttcattaag

SEQ ID NO: 32362 - DNA, 25 bp, S. cerevisiae
gagaacctgggtcccgttctagaga

SEQ ID NO: 32363 - DNA, 25 bp, S. cerevisiae
gaaaccattggtcagcttttagata

SEQ ID NO: 32364 - DNA, 25 bp, S. cerevisiae
gaaacgtactagcactcattcagta

SEQ ID NO: 32365 - DNA, 25 bp, S. cerevisiae
gaaacacatattttaccattcgata

SEQ ID NO: 32366 - DNA, 25 bp, S. cerevisiae
gaaactactgtcgatgacctacagg

SEQ ID NO: 32367 - DNA, 25 bp, S. cerevisiae
gaaacgcgactatccggactatttt

SEQ ID NO: 32368 - DNA, 25 bp, S. cerevisiae
gaaacagaactattccgtggcttta

SEQ ID NO: 32369 - DNA, 25 bp, S. cerevisiae
gaaagctgaacgtaccgcggtttat

SEQ ID NO: 32370 - DNA, 25 bp, S. cerevisiae
gaaagaatacttcgcccagaatggt

SEQ ID NO: 32371 - DNA, 25 bp, S. cerevisiae
gaaagaccgtgttagttacattcat

SEQ ID NO: 32372 - DNA, 25 bp, S. cerevisiae
gaaaccgactatcctattgacaatc

SEQ ID NO: 32373 - DNA, 25 bp, S. cerevisiae
gaaagcgggccatctgcaatgacta

SEQ ID NO: 32374 - DNA, 25 bp, S. cerevisiae
gaaagcgcgtgttactcaaactaga

SEQ ID NO: 32375 - DNA, 25 bp, S. cerevisiae
gaaagccgactacttcaaagccatt

SEQ ID NO: 32376 - DNA, 25 bp, S. cerevisiae
gaaactctagctggtaaatggacac

SEQ ID NO: 32377 - DNA, 25 bp, S. cerevisiae
gaaacctaatctgagtagagccaac

SEQ ID NO: 32378 - DNA, 25 bp, S. cerevisiae
gaaacagcgaaagcttacaccaggg

SEQ ID NO: 32379 - DNA, 25 bp, S. cerevisiae
gaaagactacattacctacctcgag

SEQ ID NO: 32380 - DNA, 25 bp, S. cerevisiae
gaaagacatcaatacgctacccaag

SEQ ID NO: 32381 - DNA, 25 bp, S. cerevisiae
gaaagaagcagcaggtctaccgaca

SEQ ID NO: 32382 - DNA, 25 bp, S. cerevisiae
gaaagaacgccaaatcctccaacaa

SEQ ID NO: 32383 - DNA, 25 bp, S. cerevisiae
gaaacagacccatattgtcctcgca

SEQ ID NO: 32384 - DNA, 25 bp, S. cerevisiae
gaaacaggcctatagtatctaccaa

SEQ ID NO: 32385 - DNA, 25 bp, S. cerevisiae
gaaatcgacttgtacggaaacctag

SEQ ID NO: 32386 - DNA, 25 bp, S. cerevisiae
gaaagagacgtcatcgagccttcct

SEQ ID NO: 32387 - DNA, 25 bp, S. cerevisiae
gaaacttctctggacgatgatgatt

SEQ ID NO: 32388 - DNA, 25 bp, S. cerevisiae
gaaaccgtacgttatgttcctcatc

SEQ ID NO: 32389 - DNA, 25 bp, S. cerevisiae
gaaaccgctactctttttattgctg

SEQ ID NO: 32390 - DNA, 25 bp, S. cerevisiae
gaaactctccttcttttcaatgtgt

SEQ ID NO: 32391 - DNA, 25 bp, S. cerevisiae
gaaacttcactcttcttttatattg

SEQ ID NO: 32392 - DNA, 25 bp, S. cerevisiae
gaaactcttcccgtatatttcatta

SEQ ID NO: 32393 - DNA, 25 bp, S. cerevisiae
gaaactttcccaattattcgctgaa

SEQ ID NO: 32394 - DNA, 25 bp, S. cerevisiae
gaaactttcccaatcttggtcgaag

SEQ ID NO: 32395 - DNA, 25 bp, S. cerevisiae
gaaactttacaactttgggcccatg

SEQ ID NO: 32396 - DNA, 25 bp, S. cerevisiae
gaaacgttccccatgattggttgtt

SEQ ID NO: 32397 - DNA, 25 bp, S. cerevisiae
gaaactttgaacacggagctgcaat

SEQ ID NO: 32398 - DNA, 25 bp, S. cerevisiae
gaaacatcttgttggcttctgtcaa

SEQ ID NO: 32399 - DNA, 25 bp, S. cerevisiae
gaaacatcggtttcttctacacatg

SEQ ID NO: 32400 - DNA, 25 bp, S. cerevisiae
gaaacttttgtgttgtcaccgccag

SEQ ID NO: 32401 - DNA, 25 bp, S. cerevisiae
gaaactggtatttgagtgactctca

SEQ ID NO: 32402 - DNA, 25 bp, S. cerevisiae
gaaacttggctaggttctcagtgta

SEQ ID NO: 32403 - DNA, 25 bp, S. cerevisiae
gaaacatgtggctctgtcgaagact

SEQ ID NO: 32404 - DNA, 25 bp, S. cerevisiae
gacactgctccagtcagatctaaga

SEQ ID NO: 32405 - DNA, 25 bp, S. cerevisiae
gaaactggcctattgtcaactcgaa

SEQ ID NO: 32406 - DNA, 25 bp, S. cerevisiae
gaaactggcatttgcaaacctggaa

SEQ ID NO: 32407 - DNA, 25 bp, S. cerevisiae
gaaacgcaattacttaccgcatgaa

SEQ ID NO: 32408 - DNA, 25 bp, S. cerevisiae
gaaacggagtcactttccgcattcg

SEQ ID NO: 32409 - DNA, 25 bp, S. cerevisiae
gaaacttgactctttatccatccta

SEQ ID NO: 32410 - DNA, 25 bp, S. cerevisiae
gaaactaccgttttcttccattgat

SEQ ID NO: 32411 - DNA, 25 bp, S. cerevisiae
gaaatctaccggtgtattccgctta

SEQ ID NO: 32412 - DNA, 25 bp, S. cerevisiae
gaaactcaaggattggtctgcccct

SEQ ID NO: 32413 - DNA, 25 bp, S. cerevisiae
gaaagcaaaaatgggttccgccttg

SEQ ID NO: 32414 - DNA, 25 bp, S. cerevisiae
gaaagaaaatttaagtgccggcaca

SEQ ID NO: 32415 - DNA, 25 bp, S. cerevisiae
gagataactttacttcgggttcgag

SEQ ID NO: 32416 - DNA, 25 bp, S. cerevisiae
gaaatactttgaccctattttcgag

SEQ ID NO: 32417 - DNA, 25 bp, S. cerevisiae
gaaactttgaagcttatcctaggaa

SEQ ID NO: 32418 - DNA, 25 bp, S. cerevisiae
gaaagcgtgacgagttcaattctaa

SEQ ID NO: 32419 - DNA, 25 bp, S. cerevisiae
gactagaatcctacgtcgcttccat

SEQ ID NO: 32420 - DNA, 25 bp, S. cerevisiae
gaaactcgcggattccgaacagtct

SEQ ID NO: 32421 - DNA, 25 bp, S. cerevisiae
gaaactgtcacaggtactacaattc

SEQ ID NO: 32422 - DNA, 25 bp, S. cerevisiae
gaaacttacagcatcctccaattta

SEQ ID NO: 32423 - DNA, 25 bp, S. cerevisiae
gaaagcttacgcacccaaattgatt

SEQ ID NO: 32424 - DNA, 25 bp, S. cerevisiae
gaaagtttcgttatcgaccgatatt

SEQ ID NO: 32425 - DNA, 25 bp, S. cerevisiae
gaaagtttccggctcagacgtgttt

SEQ ID NO: 32426 - DNA, 25 bp, S. cerevisiae
gaaactctgaaggacactacggata

SEQ ID NO: 32427 - DNA, 25 bp, S. cerevisiae
gaaacttaatgtcactaccaaccaa

SEQ ID NO: 32428 - DNA, 25 bp, S. cerevisiae
gaaactactttttctagcgtcaata

SEQ ID NO: 32429 - DNA, 25 bp, S. cerevisiae
gaaacttcatttagatcccatcaca

SEQ ID NO: 32430 - DNA, 25 bp, S. cerevisiae
gaaactcaatcttattccgctgctg

SEQ ID NO: 32431 - DNA, 25 bp, S. cerevisiae
gaaactgacatttcacgatatcttg

SEQ ID NO: 32432 - DNA, 25 bp, S. cerevisiae
gaaagcgatcatttgaccttgcaag

SEQ ID NO: 32433 - DNA, 25 bp, S. cerevisiae
gaaacggcatgtgcttttcaaagaa

SEQ ID NO: 32434 - DNA, 25 bp, S. cerevisiae
gaaacggtgcgacatttgaattaac

SEQ ID NO: 32435 - DNA, 25 bp, S. cerevisiae
gaaacgactgggaatactgaatctt

SEQ ID NO: 32436 - DNA, 25 bp, S. cerevisiae
gaaaccactgtctgtgactactctt

SEQ ID NO: 32437 - DNA, 25 bp, S. cerevisiae
gaaagccacttctgttgttagatgt

SEQ ID NO: 32438 - DNA, 25 bp, S. cerevisiae
gaaagcacgtttctggtaagatttt

SEQ ID NO: 32439 - DNA, 25 bp, S. cerevisiae
gaaactcttgataggccacttgccg

SEQ ID NO: 32440 - DNA, 25 bp, S. cerevisiae
gaaagctaggtttgaccgtcataag

SEQ ID NO: 32441 - DNA, 25 bp, S. cerevisiae
gaaagccggtgaaatcgtcaacaat

SEQ ID NO: 32442 - DNA, 25 bp, S. cerevisiae
gaaaccgcgtcaaattgtgcccaaa

SEQ ID NO: 32443 - DNA, 25 bp, S. cerevisiae
gaaactctctgggttattgaccaaa

SEQ ID NO: 32444 - DNA, 25 bp, S. cerevisiae
gaaactgacctctttggtccagaag

SEQ ID NO: 32445 - DNA, 25 bp, S. cerevisiae
gaaactatacattcctttaccagat

SEQ ID NO: 32446 - DNA, 25 bp, S. cerevisiae
gaaacttagcattctcataccttaa

SEQ ID NO: 32447 - DNA, 25 bp, S. cerevisiae
gaaagcttacatttgcagacgtcaa

SEQ ID NO: 32448 - DNA, 25 bp, S. cerevisiae
gaaactttgatatcatctagtgaca

SEQ ID NO: 32449 - DNA, 25 bp, S. cerevisiae
gaaactattgcttacactggtcaag

SEQ ID NO: 32450 - DNA, 25 bp, S. cerevisiae
gaaactcattatttacttccagcat

SEQ ID NO: 32451 - DNA, 25 bp, S. cerevisiae
gaaactgctaggcttgttcgggaat

SEQ ID NO: 32452 - DNA, 25 bp, S. cerevisiae
gaaagcttatttctgatcttgggaa

SEQ ID NO: 32453 - DNA, 25 bp, S. cerevisiae
gacaatcgaggttccttctaacgac

SEQ ID NO: 32454 - DNA, 25 bp, S. cerevisiae
gaaacgattgtcgatctgaccaaaa

SEQ ID NO: 32455 - DNA, 25 bp, S. cerevisiae
gaaagccaatcgattcccatcaaga

SEQ ID NO: 32456 - DNA, 25 bp, S. cerevisiae
gaaacctggatgacttcacccaagg

SEQ ID NO: 32457 - DNA, 25 bp, S. cerevisiae
gaaaccggtgtcatcaagccaggta

SEQ ID NO: 32458 - DNA, 25 bp, S. cerevisiae
gaaaccgacgataacaacaccgata

SEQ ID NO: 32459 - DNA, 25 bp, S. cerevisiae
gaaagcctacctaaaagactccata

SEQ ID NO: 32460 - DNA, 25 bp, S. cerevisiae
gaaacccaactcaaagaccacaaag

SEQ ID NO: 32461 - DNA, 25 bp, S. cerevisiae
gaaacccaactcaaagaccacaaag

SEQ ID NO: 32462 - DNA, 25 bp, S. cerevisiae
gaaacccatcccaaagacctcaaag

SEQ ID NO: 32463 - DNA, 25 bp, S. cerevisiae
gaaacccatcccaaagacctcaaag

SEQ ID NO: 32464 - DNA, 25 bp, S. cerevisiae
gaaactcttggccaaagacccgtgg

SEQ ID NO: 32465 - DNA, 25 bp, S. cerevisiae
gaaaccgtggcatcaaacttcagtt

SEQ ID NO: 32466 - DNA, 25 bp, S. cerevisiae
gaaagctattgcacgaaattccata

SEQ ID NO: 32467 - DNA, 25 bp, S. cerevisiae
gaaaggccttattggagctgctaga

SEQ ID NO: 32468 - DNA, 25 bp, S. cerevisiae
gaaaggccaacgagtccatgtctgt

SEQ ID NO: 32469 - DNA, 25 bp, S. cerevisiae
gaaacgacgcctcttccatttgtaa

SEQ ID NO: 32470 - DNA, 25 bp, S. cerevisiae
gaaactgttcagcttcacaaagaaa

SEQ ID NO: 32471 - DNA, 25 bp, S. cerevisiae
gaaactgtaacatccaccacgaata

SEQ ID NO: 32472 - DNA, 25 bp, S. cerevisiae
gaaactcattgggagctctgcttca

SEQ ID NO: 32473 - DNA, 25 bp, S. cerevisiae
gaaaccgccgcttcattgaatgcaa

SEQ ID NO: 32474 - DNA, 25 bp, S. cerevisiae
gaaaccgcgtgccacactggtagag

SEQ ID NO: 32475 - DNA, 25 bp, S. cerevisiae
gaaacccgagcttcctgtttgctgt

SEQ ID NO: 32476 - DNA, 25 bp, S. cerevisiae
gaaaccacgcacttgttttggcgtt

SEQ ID NO: 32477 - DNA, 25 bp, S. cerevisiae
gaaagtaggcacatcccttacgtca

SEQ ID NO: 32478 - DNA, 25 bp, S. cerevisiae
gaaacgaggacaaccccatcagtta

SEQ ID NO: 32479 - DNA, 25 bp, S. cerevisiae
gaaacgactgaatctcccgcagaaa

SEQ ID NO: 32480 - DNA, 25 bp, S. cerevisiae
gaaactgctttccaacttacttaag

SEQ ID NO: 32481 - DNA, 25 bp, S. cerevisiae
gaaactgctgtacgaccttgactga

SEQ ID NO: 32482 - DNA, 25 bp, S. cerevisiae
gaaacctgtagccaacttgttgaca

SEQ ID NO: 32483 - DNA, 25 bp, S. cerevisiae
gaaagattaccgttgacttccgtca

SEQ ID NO: 32484 - DNA, 25 bp, S. cerevisiae
gaaacgctgactcactacttatggt

SEQ ID NO: 32485 - DNA, 25 bp, S. cerevisiae
gaaacgtactcttatagctgtgata

SEQ ID NO: 32486 - DNA, 25 bp, S. cerevisiae
gaaaccatcctcttatttgtatcaa

SEQ ID NO: 32487 - DNA, 25 bp, S. cerevisiae
gaaactgctaccttatatcttgaag

SEQ ID NO: 32488 - DNA, 25 bp, S. cerevisiae
gaaactgttcctggatcctatgaat

SEQ ID NO: 32489 - DNA, 25 bp, S. cerevisiae
gaaactggctcgagatcctagaata

SEQ ID NO: 32490 - DNA, 25 bp, S. cerevisiae
gaaacgtctctgactccgaaggtga

SEQ ID NO: 32491 - DNA, 25 bp, S. cerevisiae
gaaagagacattgctgggacggtaa

SEQ ID NO: 32492 - DNA, 25 bp, S. cerevisiae
gaaagacttatggaggcgctagatt

SEQ ID NO: 32493 - DNA, 25 bp, S. cerevisiae
gaaagccactgcagagccaagcgat

SEQ ID NO: 32494 - DNA, 25 bp, S. cerevisiae
gaaatcgcaactagaccacatggct

SEQ ID NO: 32495 - DNA, 25 bp, S. cerevisiae
gaaactgcgcaattagctcaaggct

SEQ ID NO: 32496 - DNA, 25 bp, S. cerevisiae
gaaagccgcctttgctcaatggaga

SEQ ID NO: 32497 - DNA, 25 bp, S. cerevisiae
gaaagaactctgaatccggtggaat

SEQ ID NO: 32498 - DNA, 25 bp, S. cerevisiae
gaaagtgccctccagacagggctta

SEQ ID NO: 32499 - DNA, 25 bp, S. cerevisiae
gaaagtgccgctggtagcaaatcca

SEQ ID NO: 32500 - DNA, 25 bp, S. cerevisiae
gaaaggccctccaacgatatactgg

SEQ ID NO: 32501 - DNA, 25 bp, S. cerevisiae
tgacaagtttactcccaatccttat

SEQ ID NO: 32502 - DNA, 25 bp, S. cerevisiae
gaaagatgttaacgctccacttcca

SEQ ID NO: 32503 - DNA, 25 bp, S. cerevisiae
gagaagttgaaacgtcctgcctcgt

SEQ ID NO: 32504 - DNA, 25 bp, S. cerevisiae
gaaactgttgattcatttgtatccg

SEQ ID NO: 32505 - DNA, 25 bp, S. cerevisiae
gaaactgtcgcttcttcagtacagc

SEQ ID NO: 32506 - DNA, 25 bp, S. cerevisiae
gaaactgtcaagtatctctgtgaaa

SEQ ID NO: 32507 - DNA, 25 bp, S. cerevisiae
gaaaccgctgataacttggaagata

SEQ ID NO: 32508 - DNA, 25 bp, S. cerevisiae
gaaagtcgcgattattccgagttgt

SEQ ID NO: 32509 - DNA, 25 bp, S. cerevisiae
gaaaggcgccatcgtaaacttgaga

SEQ ID NO: 32510 - DNA, 25 bp, S. cerevisiae
gaaagcggtatccataaactgcaaa

SEQ ID NO: 32511 - DNA, 25 bp, S. cerevisiae
gaaaccgagactaacaattctatca

SEQ ID NO: 32512 - DNA, 25 bp, S. cerevisiae
gaaatcggtgttgaccttttcaaat

SEQ ID NO: 32513 - DNA, 25 bp, S. cerevisiae
ttttaggcctgttaacggtatcaca

SEQ ID NO: 32514 - DNA, 25 bp, S. cerevisiae
gttgacggctatgttctcggtacaa

SEQ ID NO: 32515 - DNA, 25 bp, S. cerevisiae
gaaactggtatcacctccgaacaag

SEQ ID NO: 32516 - DNA, 25 bp, S. cerevisiae
gaaactggtactgatctcggagcaa

SEQ ID NO: 32517 - DNA, 25 bp, S. cerevisiae
gaaagcggaactattgataccagca

SEQ ID NO: 32518 - DNA, 25 bp, S. cerevisiae
gaaagcggaactcttcatcactaat

SEQ ID NO: 32519 - DNA, 25 bp, S. cerevisiae
gaaagcccaattgattccactagtg

SEQ ID NO: 32520 - DNA, 25 bp, S. cerevisiae
gaaaccatagaagcttacttgaaaa

SEQ ID NO: 32521 - DNA, 25 bp, S. cerevisiae
gaaaccataaatgcgactctccgat

SEQ ID NO: 32522 - DNA, 25 bp, S. cerevisiae
gaaagcctaaatgcgatccctggtt

SEQ ID NO: 32523 - DNA, 25 bp, S. cerevisiae
gaaatggaccaagccactgctttac

SEQ ID NO: 32524 - DNA, 25 bp, S. cerevisiae
gacaacgactttggagcctttcaac

SEQ ID NO: 32525 - DNA, 25 bp, S. cerevisiae
gaaagctacttaaacttgttgcaag

SEQ ID NO: 32526 - DNA, 25 bp, S. cerevisiae
gaaagtactaggtccatttgccaaa

SEQ ID NO: 32527 - DNA, 25 bp, S. cerevisiae
gaaagagtcatttaccaatcattgg

SEQ ID NO: 32528 - DNA, 25 bp, S. cerevisiae
gaaagcgtattaactcaatggtcaa

SEQ ID NO: 32529 - DNA, 25 bp, S. cerevisiae
gaaaccagaaagactccagaggcaa

SEQ ID NO: 32530 - DNA, 25 bp, S. cerevisiae
gaaacggcacaaattccggctgaag

SEQ ID NO: 32531 - DNA, 25 bp, S. cerevisiae
gaaactgtcatggaagttagacgaa

SEQ ID NO: 32532 - DNA, 25 bp, S. cerevisiae
gaaagctgccttgaattatgcggta

SEQ ID NO: 32533 - DNA, 25 bp, S. cerevisiae
gaaagctttgttaatctcctgcgtt

SEQ ID NO: 32534 - DNA, 25 bp, S. cerevisiae
gaaacgcccttcgaagcttgggaag

SEQ ID NO: 32535 - DNA, 25 bp, S. cerevisiae
gaaacctcgctataagcctgcagga

SEQ ID NO: 32536 - DNA, 25 bp, S. cerevisiae
gaaagctacgaatataccatgacta

SEQ ID NO: 32537 - DNA, 25 bp, S. cerevisiae
gaaaccaccaatatcatccaagcga

SEQ ID NO: 32538 - DNA, 25 bp, S. cerevisiae
gaaacctcatccagcatttaattta

SEQ ID NO: 32539 - DNA, 25 bp, S. cerevisiae
gaaacctcctccgaattcaacaaat

SEQ ID NO: 32540 - DNA, 25 bp, S. cerevisiae
gaaacgctgtttttgttggtactat

SEQ ID NO: 32541 - DNA, 25 bp, S. cerevisiae
gaaacgtcgtggtaaaggtgctcct

SEQ ID NO: 32542 - DNA, 25 bp, S. cerevisiae
gaaacgccgctggaaaaggctcttt

SEQ ID NO: 32543 - DNA, 25 bp, S. cerevisiae
gaaacgccacgagatgtccgtcttt

SEQ ID NO: 32544 - DNA, 25 bp, S. cerevisiae
gaaaccccaaggatcatcgagattt

SEQ ID NO: 32545 - DNA, 25 bp, S. cerevisiae
gagaaccaacaacactatccgttac

SEQ ID NO: 32546 - DNA, 25 bp, S. cerevisiae
gaaagctaagactaccaagaaggtt

SEQ ID NO: 32547 - DNA, 25 bp, S. cerevisiae
gaaagtgacaccttctgcagctaag

SEQ ID NO: 32548 - DNA, 25 bp, S. cerevisiae
gaaagtgtccctttgtccaacttgg

SEQ ID NO: 32549 - DNA, 25 bp, S. cerevisiae
gaaagctttgatggctaatatgaaa

SEQ ID NO: 32550 - DNA, 25 bp, S. cerevisiae
gaaagcagctggcttagcaagaaaa

SEQ ID NO: 32551 - DNA, 25 bp, S. cerevisiae
gaaacgccacgacagaacaacaaag

SEQ ID NO: 32552 - DNA, 25 bp, S. cerevisiae
gaaacgatacaaactacaccaacaa

SEQ ID NO: 32553 - DNA, 25 bp, S. cerevisiae
gaaacgcaacgacgctacaaataat

SEQ ID NO: 32554 - DNA, 25 bp, S. cerevisiae
gagataggaccgtggaaagattcta

SEQ ID NO: 32555 - DNA, 25 bp, S. cerevisiae
gaaaggccgcgcttcgaaagatctc

SEQ ID NO: 32556 - DNA, 25 bp, S. cerevisiae
gaaatcgtatccagaaccacaaggt

SEQ ID NO: 32557 - DNA, 25 bp, S. cerevisiae
gaaataatatccacaccgaacggtt

SEQ ID NO: 32558 - DNA, 25 bp, S. cerevisiae
tcgaaaataccaacgttccacggat

SEQ ID NO: 32559 - DNA, 25 bp, S. cerevisiae
tcgattctaacgttaccccaaggca

SEQ ID NO: 32560 - DNA, 25 bp, S. cerevisiae
tcacaactaagtctaccaccgatgg

SEQ ID NO: 32561 - DNA, 25 bp, S. cerevisiae
gaaagcatatcaaatatacccctga

SEQ ID NO: 32562 - DNA, 25 bp, S. cerevisiae
gaaaccaataattcagcaccatctt

SEQ ID NO: 32563 - DNA, 25 bp, S. cerevisiae
gaaaccaagaagtcatgctgctctg

SEQ ID NO: 32564 - DNA, 25 bp, S. cerevisiae
gaaacgttgaacctagttgacatga

SEQ ID NO: 32565 - DNA, 25 bp, S. cerevisiae
gaaagacgtcagttctaagcctagt

SEQ ID NO: 32566 - DNA, 25 bp, S. cerevisiae
gaaagctggccattttattgtgtac

SEQ ID NO: 32567 - DNA, 25 bp, S. cerevisiae
gaaagtttatcgtcgctatctctgg

SEQ ID NO: 32568 - DNA, 25 bp, S. cerevisiae
gaaacctgctttcacgagatcagcc

SEQ ID NO: 32569 - DNA, 25 bp, S. cerevisiae
gaaaccttgttcatcagagccaata

SEQ ID NO: 32570 - DNA, 25 bp, S. cerevisiae
gaaattctttttgaagccagaacag

SEQ ID NO: 32571 - DNA, 25 bp, S. cerevisiae
gaaatcactttcttcgaaactgaaa

SEQ ID NO: 32572 - DNA, 25 bp, S. cerevisiae
gaaagttgttatcccgacgaaaatg

SEQ ID NO: 32573 - DNA, 25 bp, S. cerevisiae
gaaaggtttcatccgctgaatacta

SEQ ID NO: 32574 - DNA, 25 bp, S. cerevisiae
gaaagcaaagcccttgactcaaaac

SEQ ID NO: 32575 - DNA, 25 bp, S. cerevisiae
gaaagaaaccttaatacaaactgca

SEQ ID NO: 32576 - DNA, 25 bp, S. cerevisiae
gaaagcaaagccttaattccaagga

SEQ ID NO: 32577 - DNA, 25 bp, S. cerevisiae
gaaattaactttcttctcaaagcct

SEQ ID NO: 32578 - DNA, 25 bp, S. cerevisiae
gaaacgccttctaccgaggatgaaa

SEQ ID NO: 32579 - DNA, 25 bp, S. cerevisiae
gaaatcaacttccacaaacgtcacc

SEQ ID NO: 32580 - DNA, 25 bp, S. cerevisiae
gacattcagggtacaagggcccgtt

SEQ ID NO: 32581 - DNA, 25 bp, S. cerevisiae
gaaacgcatgggactgtgtacacag

SEQ ID NO: 32582 - DNA, 25 bp, S. cerevisiae
gaaagccttggcatagattcatcaa

SEQ ID NO: 32583 - DNA, 25 bp, S. cerevisiae
gaaagccttggccatgacagtgcaa

SEQ ID NO: 32584 - DNA, 25 bp, S. cerevisiae
gaaacccagtgccatattcaaagtg

SEQ ID NO: 32585 - DNA, 25 bp, S. cerevisiae
gaaagcactagtcatacaaccagag

SEQ ID NO: 32586 - DNA, 25 bp, S. cerevisiae
gaaatgacgattcaagccccagcag

SEQ ID NO: 32587 - DNA, 25 bp, S. cerevisiae
gaaagactctcacttagacccagaa

SEQ ID NO: 32588 - DNA, 25 bp, S. cerevisiae
gaaatgttttacagttcgcctacga

SEQ ID NO: 32589 - DNA, 25 bp, S. cerevisiae
gacgaagacgaagactttacccttg

SEQ ID NO: 32590 - DNA, 25 bp, S. cerevisiae
gacagaaacgacttaattacctact

SEQ ID NO: 32591 - DNA, 25 bp, S. cerevisiae
gacgaaatccaacaagcgacctatt

SEQ ID NO: 32592 - DNA, 25 bp, S. cerevisiae
gaaagctttaacgaacgcagaattt

SEQ ID NO: 32593 - DNA, 25 bp, S. cerevisiae
gaaagttctaccaaagcccacttca

SEQ ID NO: 32594 - DNA, 25 bp, S. cerevisiae
gaaagttttctcagaccaccttcaa

SEQ ID NO: 32595 - DNA, 25 bp, S. cerevisiae
gaaagttgttctaagcgccaaacga

SEQ ID NO: 32596 - DNA, 25 bp, S. cerevisiae
gaaagttttctgtatcctcaaatga

SEQ ID NO: 32597 - DNA, 25 bp, S. cerevisiae
gaaacctttctttgtcagcattatg

SEQ ID NO: 32598 - DNA, 25 bp, S. cerevisiae
gaaagcttacctaatttgactgtga

SEQ ID NO: 32599 - DNA, 25 bp, S. cerevisiae
gaaagctggctttgtctccaaaaca

SEQ ID NO: 32600 - DNA, 25 bp, S. cerevisiae
gaaagctgcagcaccaggtatccaa

SEQ ID NO: 32601 - DNA, 25 bp, S. cerevisiae
gaaagtgcaatcaacggacatccta

SEQ ID NO: 32602 - DNA, 25 bp, S. cerevisiae
gaaagcccagcaacaaggcatcttt

SEQ ID NO: 32603 - DNA, 25 bp, S. cerevisiae
gaaaccccgctaagagcactgtatt

SEQ ID NO: 32604 - DNA, 25 bp, S. cerevisiae
gaaagccccgtaagaaccatcacaa

SEQ ID NO: 32605 - DNA, 25 bp, S. cerevisiae
gaaagctcctcgaatatcaacgcaa

SEQ ID NO: 32606 - DNA, 25 bp, S. cerevisiae
gaaaccgcatcgcataagacagcct

SEQ ID NO: 32607 - DNA, 25 bp, S. cerevisiae
gaaagagtctgttttgcccagattt

SEQ ID NO: 32608 - DNA, 25 bp, S. cerevisiae
gaaagagctgctcgtgttgctgcca

SEQ ID NO: 32609 - DNA, 25 bp, S. cerevisiae
gaaagagtcaggtttctagcaccaa

SEQ ID NO: 32610 - DNA, 25 bp, S. cerevisiae
gaaagagctggtctcttgaagccag

SEQ ID NO: 32611 - DNA, 25 bp, S. cerevisiae
gaaaggtcacatcaccgaagcacat

SEQ ID NO: 32612 - DNA, 25 bp, S. cerevisiae
gacatcaacatcaacggacgggcca

SEQ ID NO: 32613 - DNA, 25 bp, S. cerevisiae
gaaagatcaatacgaacaggaccat

SEQ ID NO: 32614 - DNA, 25 bp, S. cerevisiae
gaaattcggtgataccccatctgaa

SEQ ID NO: 32615 - DNA, 25 bp, S. cerevisiae
gaaatgtcgttagagctgctacttg

SEQ ID NO: 32616 - DNA, 25 bp, S. cerevisiae
gaaagcccattagatgctgctaagg

SEQ ID NO: 32617 - DNA, 25 bp, S. cerevisiae
gaaaccatatcttgatctgtccaca

SEQ ID NO: 32618 - DNA, 25 bp, S. cerevisiae
gaaacctcattcttgtcccaaatgt

SEQ ID NO: 32619 - DNA, 25 bp, S. cerevisiae
gaaagccttggatgctgtcgacgat

SEQ ID NO: 32620 - DNA, 25 bp, S. cerevisiae
gacaacctgtttgtggtgacttcca

SEQ ID NO: 32621 - DNA, 25 bp, S. cerevisiae
gaaagcggctttgatgagctagcta

SEQ ID NO: 32622 - DNA, 25 bp, S. cerevisiae
gaaagactgcaccattatagacgtt

SEQ ID NO: 32623 - DNA, 25 bp, S. cerevisiae
gaaagacttctgctaaacgttaatt

SEQ ID NO: 32624 - DNA, 25 bp, S. cerevisiae
gaaattgtcggagagtctatccaag

SEQ ID NO: 32625 - DNA, 25 bp, S. cerevisiae
gaaatgttcgctcatcggtacttat

SEQ ID NO: 32626 - DNA, 25 bp, S. cerevisiae
gaaatttgcgcacaacgaggctgtt

SEQ ID NO: 32627 - DNA, 25 bp, S. cerevisiae
gaaagcttgcgatctacgagttgat

SEQ ID NO: 32628 - DNA, 25 bp, S. cerevisiae
gaaacctctgcatctacaaatagtg

SEQ ID NO: 32629 - DNA, 25 bp, S. cerevisiae
gaaagcgtctgatccatgcacaata

SEQ ID NO: 32630 - DNA, 25 bp, S. cerevisiae
gaaagccatcgatcaagcatcttga

SEQ ID NO: 32631 - DNA, 25 bp, S. cerevisiae
gaaagccatctggaacagcacgcag

SEQ ID NO: 32632 - DNA, 25 bp, S. cerevisiae
gaaagccacggaatcacactacaca

SEQ ID NO: 32633 - DNA, 25 bp, S. cerevisiae
gaaagctatcagaagccccgagcat

SEQ ID NO: 32634 - DNA, 25 bp, S. cerevisiae
gaaatgtatatgaagcctgcagcaa

SEQ ID NO: 32635 - DNA, 25 bp, S. cerevisiae
gaaagttatgcagcaccatggcaga

SEQ ID NO: 32636 - DNA, 25 bp, S. cerevisiae
gaaagtagtcatcacgatctgcaaa

SEQ ID NO: 32637 - DNA, 25 bp, S. cerevisiae
gaaataccgggctgactccatacat

SEQ ID NO: 32638 - DNA, 25 bp, S. cerevisiae
gaaatacgttgagtcttcttcattc

SEQ ID NO: 32639 - DNA, 25 bp, S. cerevisiae
gaaattcgttgcttctatcccaatt

SEQ ID NO: 32640 - DNA, 25 bp, S. cerevisiae
gaaagtcgttagactagccccatga

SEQ ID NO: 32641 - DNA, 25 bp, S. cerevisiae
gaaagtgagaatagtccccaacata

SEQ ID NO: 32642 - DNA, 25 bp, S. cerevisiae
gaaagttccatttaagctacctgaa

SEQ ID NO: 32643 - DNA, 25 bp, S. cerevisiae
gaaagtgtcgtatctgacccctgat

SEQ ID NO: 32644 - DNA, 25 bp, S. cerevisiae
gaaagatacgctactatgacccctt

SEQ ID NO: 32645 - DNA, 25 bp, S. cerevisiae
gaaagtccaggagtcattagtcaag

SEQ ID NO: 32646 - DNA, 25 bp, S. cerevisiae
gaaagcccagatgacttactcaaaa

SEQ ID NO: 32647 - DNA, 25 bp, S. cerevisiae
gaaagggtcctttatagctcagatg

SEQ ID NO: 32648 - DNA, 25 bp, S. cerevisiae
gaaagggccaacgtagcaccatgtt

SEQ ID NO: 32649 - DNA, 25 bp, S. cerevisiae
gaaagggccatttctgacgccatgt

SEQ ID NO: 32650 - DNA, 25 bp, S. cerevisiae
gaaaggtagacttcgacgcagatga

SEQ ID NO: 32651 - DNA, 25 bp, S. cerevisiae
gaaaggtactattccactggatcat

SEQ ID NO: 32652 - DNA, 25 bp, S. cerevisiae
gaaaggtccagatcacccttcagga

SEQ ID NO: 32653 - DNA, 25 bp, S. cerevisiae
gaaatcgtccgtaaactattcagcg

SEQ ID NO: 32654 - DNA, 25 bp, S. cerevisiae
gaaaggcctgcagtctaactttatt

SEQ ID NO: 32655 - DNA, 25 bp, S. cerevisiae
gaaatggactccttaagattcttgt

SEQ ID NO: 32656 - DNA, 25 bp, S. cerevisiae
gaaagtggctcctttgagatccatt

SEQ ID NO: 32657 - DNA, 25 bp, S. cerevisiae
gaaagttgcctctgctaatgctact

SEQ ID NO: 32658 - DNA, 25 bp, S. cerevisiae
gaaaggtcgcttgccaaatgattca

SEQ ID NO: 32659 - DNA, 25 bp, S. cerevisiae
gaaatctgccatggccactggtaat

SEQ ID NO: 32660 - DNA, 25 bp, S. cerevisiae
gaaatcgacgctgttggtggtgctc

SEQ ID NO: 32661 - DNA, 25 bp, S. cerevisiae
gaaatgctcgagtccatgggtctac

SEQ ID NO: 32662 - DNA, 25 bp, S. cerevisiae
gaaagcattattagcgggcctcctt

SEQ ID NO: 32663 - DNA, 25 bp, S. cerevisiae
gaaagccttttgaacgagtcttgaa

SEQ ID NO: 32664 - DNA, 25 bp, S. cerevisiae
gaaagccatttaattcagctacaga

SEQ ID NO: 32665 - DNA, 25 bp, S. cerevisiae
gaaagattttcccattgcccggcga

SEQ ID NO: 32666 - DNA, 25 bp, S. cerevisiae
gacaatactggctcaagaccgtgaa

SEQ ID NO: 32667 - DNA, 25 bp, S. cerevisiae
gacacaagtggctcttaacgaaagt

SEQ ID NO: 32668 - DNA, 25 bp, S. cerevisiae
gacaagcatcgttagctctaaggaa

SEQ ID NO: 32669 - DNA, 25 bp, S. cerevisiae
gactaccgatgctgatgaaagtgaa

SEQ ID NO: 32670 - DNA, 25 bp, S. cerevisiae
gactaccccaaggaacagctgacag

SEQ ID NO: 32671 - DNA, 25 bp, S. cerevisiae
gactacaccgtgaagcaacctgaag

SEQ ID NO: 32672 - DNA, 25 bp, S. cerevisiae
gacagatcccgtaaaatccaaattg

SEQ ID NO: 32673 - DNA, 25 bp, S. cerevisiae
gacagatcccgagtggttccagaaa

SEQ ID NO: 32674 - DNA, 25 bp, S. cerevisiae
gaaatcgtcgacatttcccaactac

SEQ ID NO: 32675 - DNA, 25 bp, S. cerevisiae
gaaatgttaccaattacctcctgcc

SEQ ID NO: 32676 - DNA, 25 bp, S. cerevisiae
gaaagttctcctatcaaagcctcct

SEQ ID NO: 32677 - DNA, 25 bp, S. cerevisiae
gaaatattcctgcagtataacaact

SEQ ID NO: 32678 - DNA, 25 bp, S. cerevisiae
gaaagtccactatctgttgcaatac

SEQ ID NO: 32679 - DNA, 25 bp, S. cerevisiae
gaaagcctcctgtttattgccggag

SEQ ID NO: 32680 - DNA, 25 bp, S. cerevisiae
gaaagactagttgcctttgcctcca

SEQ ID NO: 32681 - DNA, 25 bp, S. cerevisiae
gaaatggtggttgctctttgcctta

SEQ ID NO: 32682 - DNA, 25 bp, S. cerevisiae
gaaagcttgccaaacctgtcattga

SEQ ID NO: 32683 - DNA, 25 bp, S. cerevisiae
gaaagctgcttggacagttgtttaa

SEQ ID NO: 32684 - DNA, 25 bp, S. cerevisiae
gaaagattccgttgctggctatcaa

SEQ ID NO: 32685 - DNA, 25 bp, S. cerevisiae
gaaagctctccagttcttcaagaat

SEQ ID NO: 32686 - DNA, 25 bp, S. cerevisiae
gaaagtctcggttcatcatcggaat

SEQ ID NO: 32687 - DNA, 25 bp, S. cerevisiae
gaaaggttatctccaacccattgtt

SEQ ID NO: 32688 - DNA, 25 bp, S. cerevisiae
gaaaggattacgataccctttctct

SEQ ID NO: 32689 - DNA, 25 bp, S. cerevisiae
gaaagtgattcctgtaaccgttctt

SEQ ID NO: 32690 - DNA, 25 bp, S. cerevisiae
gaaattttcagccagtcccaggtaa

SEQ ID NO: 32691 - DNA, 25 bp, S. cerevisiae
gaaataccgtggcatctctcgtgac

SEQ ID NO: 32692 - DNA, 25 bp, S. cerevisiae
gaaattcgctgtctgattctaggac

SEQ ID NO: 32693 - DNA, 25 bp, S. cerevisiae
gaaatcactccatgatagtttaagt

SEQ ID NO: 32694 - DNA, 25 bp, S. cerevisiae
gaaatttccacttgtaaccagctta

SEQ ID NO: 32695 - DNA, 25 bp, S. cerevisiae
gaaattatcacacggaaacctacgg

SEQ ID NO: 32696 - DNA, 25 bp, S. cerevisiae
gaaagttaccaacgatcgcctacaa

SEQ ID NO: 32697 - DNA, 25 bp, S. cerevisiae
gaaagctgaacctcaatagaccaca

SEQ ID NO: 32698 - DNA, 25 bp, S. cerevisiae
gaaagtgaaacctctaacagcagca

SEQ ID NO: 32699 - DNA, 25 bp, S. cerevisiae
gaaaggttccactgtaaccagcaat

SEQ ID NO: 32700 - DNA, 25 bp, S. cerevisiae
gaaagtttgacgcatctctaccaac

SEQ ID NO: 32701 - DNA, 25 bp, S. cerevisiae
gaaagctgttcatgactgttgtctg

SEQ ID NO: 32702 - DNA, 25 bp, S. cerevisiae
gaaagctgcaccttgtaagttgaat

SEQ ID NO: 32703 - DNA, 25 bp, S. cerevisiae
gaaatccagatggtggctgttccac

SEQ ID NO: 32704 - DNA, 25 bp, S. cerevisiae
gaaatcgctcgttgtaaaccgctaa

SEQ ID NO: 32705 - DNA, 25 bp, S. cerevisiae
gaaatcaggcctgccaaaccgctat

SEQ ID NO: 32706 - DNA, 25 bp, S. cerevisiae
gaaatgaaatctccaccaaccggat

SEQ ID NO: 32707 - DNA, 25 bp, S. cerevisiae
gacaataactcgacggaacctcctt

SEQ ID NO: 32708 - DNA, 25 bp, S. cerevisiae
gaaagactgttaaagatggcccatt

SEQ ID NO: 32709 - DNA, 25 bp, S. cerevisiae
gaaagcttggtccaaaggctcctaa

SEQ ID NO: 32710 - DNA, 25 bp, S. cerevisiae
gaaatgagcgttttttgttactaca

SEQ ID NO: 32711 - DNA, 25 bp, S. cerevisiae
gaaatccattaacttttcactccaa

SEQ ID NO: 32712 - DNA, 25 bp, S. cerevisiae
gaaatcgaacaatgcattcacacct

SEQ ID NO: 32713 - DNA, 25 bp, S. cerevisiae
gaaatggaccataatgcctcaccca

SEQ ID NO: 32714 - DNA, 25 bp, S. cerevisiae
gaaagatgttgctcatcctacctac

SEQ ID NO: 32715 - DNA, 25 bp, S. cerevisiae
gaaagtgtgatcttgtccttcatgt

SEQ ID NO: 32716 - DNA, 25 bp, S. cerevisiae
gaaagatcttatttccctcatctga

SEQ ID NO: 32717 - DNA, 25 bp, S. cerevisiae
gaaagatctgcttatgttaccacag

SEQ ID NO: 32718 - DNA, 25 bp, S. cerevisiae
gaaatgattcgattgttgggcagcg

SEQ ID NO: 32719 - DNA, 25 bp, S. cerevisiae
gaaagctatcttatcttgggatgag

SEQ ID NO: 32720 - DNA, 25 bp, S. cerevisiae
gaaattcattttcctgtatggaggt

SEQ ID NO: 32721 - DNA, 25 bp, S. cerevisiae
gaaataatgctatgacctcgtcgac

SEQ ID NO: 32722 - DNA, 25 bp, S. cerevisiae
gaaatagtcgacaagcgcccacaaa

SEQ ID NO: 32723 - DNA, 25 bp, S. cerevisiae
gaaagaatcgcagaggccgtaaata

SEQ ID NO: 32724 - DNA, 25 bp, S. cerevisiae
gaaatgtatagctggtcacgtaatt

SEQ ID NO: 32725 - DNA, 25 bp, S. cerevisiae
gaaagcagtagcgaggatctattaa

SEQ ID NO: 32726 - DNA, 25 bp, S. cerevisiae
gaaagaatacgctgatcctgtgata

SEQ ID NO: 32727 - DNA, 25 bp, S. cerevisiae
gaaagaatcatccatcatacgttca

SEQ ID NO: 32728 - DNA, 25 bp, S. cerevisiae
gaaagatcatggttccaccacacag

SEQ ID NO: 32729 - DNA, 25 bp, S. cerevisiae
gaaataatatctcagctggcctact

SEQ ID NO: 32730 - DNA, 25 bp, S. cerevisiae
gaaatcacatccgacggagcgcttt

SEQ ID NO: 32731 - DNA, 25 bp, S. cerevisiae
gaaatgccacctgatgtaggtccta

SEQ ID NO: 32732 - DNA, 25 bp, S. cerevisiae
gagatatccccggtcaagtagtcga

SEQ ID NO: 32733 - DNA, 25 bp, S. cerevisiae
gagaacccttggaagagtcagatca

SEQ ID NO: 32734 - DNA, 25 bp, S. cerevisiae
gaaatccctgacaaagtggctgatg

SEQ ID NO: 32735 - DNA, 25 bp, S. cerevisiae
gaaatccctggctgaaggctgacaa

SEQ ID NO: 32736 - DNA, 25 bp, S. cerevisiae
gaaatcccgccattgaagctttaga

SEQ ID NO: 32737 - DNA, 25 bp, S. cerevisiae
gaaagagcctctgaatgcttttgaa

SEQ ID NO: 32738 - DNA, 25 bp, S. cerevisiae
gaaagtccccaacgtgatttcaata

SEQ ID NO: 32739 - DNA, 25 bp, S. cerevisiae
gaaaggcccactcttcattgtcgaa

SEQ ID NO: 32740 - DNA, 25 bp, S. cerevisiae
gaaaggatccctgctaatcgtgaaa

SEQ ID NO: 32741 - DNA, 25 bp, S. cerevisiae
gaaagtggtaccatcaactggcaaa

SEQ ID NO: 32742 - DNA, 25 bp, S. cerevisiae
gaaagttccctaacttcatgcgcta

SEQ ID NO: 32743 - DNA, 25 bp, S. cerevisiae
gaaagttccactacaatctaccgat

SEQ ID NO: 32744 - DNA, 25 bp, S. cerevisiae
gaaagcatttcccatctatcaacac

SEQ ID NO: 32745 - DNA, 25 bp, S. cerevisiae
gaaagcacgtcatgcacctgtttga

SEQ ID NO: 32746 - DNA, 25 bp, S. cerevisiae
gaaattaaatcacccgccgacagag

SEQ ID NO: 32747 - DNA, 25 bp, S. cerevisiae
gaaagtagcaataaccccaaagact

SEQ ID NO: 32748 - DNA, 25 bp, S. cerevisiae
gaaatatgcatttgggactctctat

SEQ ID NO: 32749 - DNA, 25 bp, S. cerevisiae
gaaatcattgttcttattcggcaaa

SEQ ID NO: 32750 - DNA, 25 bp, S. cerevisiae
gaaagtgcctctgcgctaattgatg

SEQ ID NO: 32751 - DNA, 25 bp, S. cerevisiae
gaaagtgattcagagcaagatgcta

SEQ ID NO: 32752 - DNA, 25 bp, S. cerevisiae
gaaagattatacttgggtccaactc

SEQ ID NO: 32753 - DNA, 25 bp, S. cerevisiae
gaaagattcttctgggttcatccat

SEQ ID NO: 32754 - DNA, 25 bp, S. cerevisiae
gaaaggctatcctactttgcaagca

SEQ ID NO: 32755 - DNA, 25 bp, S. cerevisiae
gaaagagctcttgcgttgaagaagc

SEQ ID NO: 32756 - DNA, 25 bp, S. cerevisiae
gaaagtcacaccctgttcaatacgt

SEQ ID NO: 32757 - DNA, 25 bp, S. cerevisiae
gagcacctactctggtttggttgat

SEQ ID NO: 32758 - DNA, 25 bp, S. cerevisiae
gacacaattgagtcaatccaacgtg

SEQ ID NO: 32759 - DNA, 25 bp, S. cerevisiae
gaaagtaccagttcaacagaggagg

SEQ ID NO: 32760 - DNA, 25 bp, S. cerevisiae
gaaagtcacccaaatgactccagcc

SEQ ID NO: 32761 - DNA, 25 bp, S. cerevisiae
gaaagaacgccatatcagcgccatg

SEQ ID NO: 32762 - DNA, 25 bp, S. cerevisiae
gaaagacttgacacctacgatatta

SEQ ID NO: 32763 - DNA, 25 bp, S. cerevisiae
gaaagtcggactcacattaatggta

SEQ ID NO: 32764 - DNA, 25 bp, S. cerevisiae
gagaaatgttcgacctttaacgtat

SEQ ID NO: 32765 - DNA, 25 bp, S. cerevisiae
gaaatctttgccactattaacgagg

SEQ ID NO: 32766 - DNA, 25 bp, S. cerevisiae
gaaagaccgcagatatccaacagta

SEQ ID NO: 32767 - DNA, 25 bp, S. cerevisiae
gaaagtcacgaaagtcctacgtaat

SEQ ID NO: 32768 - DNA, 25 bp, S. cerevisiae
gaaagtgccttaatgatgcctgatc

SEQ ID NO: 32769 - DNA, 25 bp, S. cerevisiae
gaaagttctgctttatgcacgacat

SEQ ID NO: 32770 - DNA, 25 bp, S. cerevisiae
gaaagatttccaaatgtccagcgaa

SEQ ID NO: 32771 - DNA, 25 bp, S. cerevisiae
gaaagtgctacccactgcataactt

SEQ ID NO: 32772 - DNA, 25 bp, S. cerevisiae
gaaagactaccatcatcacatacct

SEQ ID NO: 32773 - DNA, 25 bp, S. cerevisiae
gaaatccgactctcatcgcatattt

SEQ ID NO: 32774 - DNA, 25 bp, S. cerevisiae
gaaatgccttctttgacgaattcat

SEQ ID NO: 32775 - DNA, 25 bp, S. cerevisiae
gaaattgccaatttgcctgaagtca

SEQ ID NO: 32776 - DNA, 25 bp, S. cerevisiae
gaaatccttgaatacctttcccatc

SEQ ID NO: 32777 - DNA, 25 bp, S. cerevisiae
gaaaggctcacagaaacggtatcaa

SEQ ID NO: 32778 - DNA, 25 bp, S. cerevisiae
gaaagtggtccatctatcgttcacc

SEQ ID NO: 32779 - DNA, 25 bp, S. cerevisiae
gaaagtcgtggttcctggtgtcaaa

SEQ ID NO: 32780 - DNA, 25 bp, S. cerevisiae
gaaagatatacttccatccacagta

SEQ ID NO: 32781 - DNA, 25 bp, S. cerevisiae
gaaagtgaagtttctccacaggaac

SEQ ID NO: 32782 - DNA, 25 bp, S. cerevisiae
gaaattcaagcatttactagctagt

SEQ ID NO: 32783 - DNA, 25 bp, S. cerevisiae
gaaatgtaaatgtcaatgccgctag

SEQ ID NO: 32784 - DNA, 25 bp, S. cerevisiae
gaaagatacaagtcattggcaccaa

SEQ ID NO: 32785 - DNA, 25 bp, S. cerevisiae
gacaatgaaacttcttgggccaagg

SEQ ID NO: 32786 - DNA, 25 bp, S. cerevisiae
gaaattgaagtgttccaccctgcca

SEQ ID NO: 32787 - DNA, 25 bp, S. cerevisiae
gaaagtaagcatcatcccgcgtgga

SEQ ID NO: 32788 - DNA, 25 bp, S. cerevisiae
gaaagtacgagctccacggtgtttg

SEQ ID NO: 32789 - DNA, 25 bp, S. cerevisiae
gaaagatgttgcttctgcacgtggc

SEQ ID NO: 32790 - DNA, 25 bp, S. cerevisiae
gaaagagatttcaagccctggcacc

SEQ ID NO: 32791 - DNA, 25 bp, S. cerevisiae
gaaagatgtttcaaccgcattgcat

SEQ ID NO: 32792 - DNA, 25 bp, S. cerevisiae
gaaagatgtttcacagactgtgtca

SEQ ID NO: 32793 - DNA, 25 bp, S. cerevisiae
gaaatggtgttcatcagaggagaca

SEQ ID NO: 32794 - DNA, 25 bp, S. cerevisiae
gaaatcgacctcttcagacgtgaaa

SEQ ID NO: 32795 - DNA, 25 bp, S. cerevisiae
gaaatcgacagcactgagccgcgaa

SEQ ID NO: 32796 - DNA, 25 bp, S. cerevisiae
gaaatcgccacaactgaattgcctc

SEQ ID NO: 32797 - DNA, 25 bp, S. cerevisiae
gaaatcgctcatatctacaagactg

SEQ ID NO: 32798 - DNA, 25 bp, S. cerevisiae
gaaatgcgtatgttcaattcgacca

SEQ ID NO: 32799 - DNA, 25 bp, S. cerevisiae
gaaatcgtgttacaagctgacaaaa

SEQ ID NO: 32800 - DNA, 25 bp, S. cerevisiae
gaaatcgtcctaccaagaatcagag

SEQ ID NO: 32801 - DNA, 25 bp, S. cerevisiae
gaaatcaccggaaacaccatatgcg

SEQ ID NO: 32802 - DNA, 25 bp, S. cerevisiae
gaaatgacccggaaactgcaacgca

SEQ ID NO: 32803 - DNA, 25 bp, S. cerevisiae
gaaatatcccggaatatcttagtta

SEQ ID NO: 32804 - DNA, 25 bp, S. cerevisiae
gagaacgaccctgaatccatggaaa

SEQ ID NO: 32805 - DNA, 25 bp, S. cerevisiae
gaaaggccatttgcattgccagaaa

SEQ ID NO: 32806 - DNA, 25 bp, S. cerevisiae
gaaatgggatgtcactctgcggcca

SEQ ID NO: 32807 - DNA, 25 bp, S. cerevisiae
gaaagtgccggttattgcatgccct

SEQ ID NO: 32808 - DNA, 25 bp, S. cerevisiae
gaaataccgcagatattccgcctca

SEQ ID NO: 32809 - DNA, 25 bp, S. cerevisiae
gagaaaacaaggtttcccctgctga

SEQ ID NO: 32810 - DNA, 25 bp, S. cerevisiae
gagaaaacaaggtttcccctgctga

SEQ ID NO: 32811 - DNA, 25 bp, S. cerevisiae
gacaaaccagggtctttccattctg

SEQ ID NO: 32812 - DNA, 25 bp, S. cerevisiae
gaaatgccccaagctattaagacta

SEQ ID NO: 32813 - DNA, 25 bp, S. cerevisiae
gaaagtacccaatttgctccaagtg

SEQ ID NO: 32814 - DNA, 25 bp, S. cerevisiae
gaaagattgccaccaactctaaagg

SEQ ID NO: 32815 - DNA, 25 bp, S. cerevisiae
gaaagtgtgccaggatcccgtgaaa

SEQ ID NO: 32816 - DNA, 25 bp, S. cerevisiae
gaaagtgctaaacctgccgagaaaa

SEQ ID NO: 32817 - DNA, 25 bp, S. cerevisiae
gaaaggtaagccctctctagagaat

SEQ ID NO: 32818 - DNA, 25 bp, S. cerevisiae
gaaagttcaaccctctacaacagaa

SEQ ID NO: 32819 - DNA, 25 bp, S. cerevisiae
gaaatcatgtccatttatcgccggg

SEQ ID NO: 32820 - DNA, 25 bp, S. cerevisiae
tccaaaatctacttcaacgccggtt

SEQ ID NO: 32821 - DNA, 25 bp, S. cerevisiae
tccctaataggcgttacccaatgtt

SEQ ID NO: 32822 - DNA, 25 bp, S. cerevisiae
gacagcctaaggtataccgtcggaa

SEQ ID NO: 32823 - DNA, 25 bp, S. cerevisiae
gacactaataactatcgggtcggta

SEQ ID NO: 32824 - DNA, 25 bp, S. cerevisiae
gattccaaggaatccgtcgccggat

SEQ ID NO: 32825 - DNA, 25 bp, S. cerevisiae
gacctaataaccaaatgtcccgcgt

SEQ ID NO: 32826 - DNA, 25 bp, S. cerevisiae
gaccaagaaactgaggaccctgact

SEQ ID NO: 32827 - DNA, 25 bp, S. cerevisiae
gacaaatcgaagacttggtccccgt

SEQ ID NO: 32828 - DNA, 25 bp, S. cerevisiae
gaaatgactgaagctagggcctaca

SEQ ID NO: 32829 - DNA, 25 bp, S. cerevisiae
gaaatatcgccggtccagaaccaaa

SEQ ID NO: 32830 - DNA, 25 bp, S. cerevisiae
gaaattcccagctggcgactacaaa

SEQ ID NO: 32831 - DNA, 25 bp, S. cerevisiae
gacaaatgcccctgcggtaacaagt

SEQ ID NO: 32832 - DNA, 25 bp, S. cerevisiae
gacaactcactactggacggaatca

SEQ ID NO: 32833 - DNA, 25 bp, S. cerevisiae
gacaacaattcacggatcctgacct

SEQ ID NO: 32834 - DNA, 25 bp, S. cerevisiae
gaaatcttaaatcgtgccgcacaat

SEQ ID NO: 32835 - DNA, 25 bp, S. cerevisiae
gaaagtgtttctggtacctcaacta

SEQ ID NO: 32836 - DNA, 25 bp, S. cerevisiae
gaaagtcattttggcttcctcactt

SEQ ID NO: 32837 - DNA, 25 bp, S. cerevisiae
gaaatgtccagctctttccatgatt

SEQ ID NO: 32838 - DNA, 25 bp, S. cerevisiae
gaaatgctccagcttggttcaagtt

SEQ ID NO: 32839 - DNA, 25 bp, S. cerevisiae
gacaaactcagcgttgggtcactgt

SEQ ID NO: 32840 - DNA, 25 bp, S. cerevisiae
gacaacttggacgttcttctacata

SEQ ID NO: 32841 - DNA, 25 bp, S. cerevisiae
gaaatccatttctttgacggtcttg

SEQ ID NO: 32842 - DNA, 25 bp, S. cerevisiae
gaaatatcctggtcgtgtggcatgg

SEQ ID NO: 32843 - DNA, 25 bp, S. cerevisiae
gaaattccagagtttatgcatgacg

SEQ ID NO: 32844 - DNA, 25 bp, S. cerevisiae
gacaagtccgagcttcatcgaaggt

SEQ ID NO: 32845 - DNA, 25 bp, S. cerevisiae
gaaagtctgaagcttcatcggatgt

SEQ ID NO: 32846 - DNA, 25 bp, S. cerevisiae
gaaatttgcaagctttacggttgga

SEQ ID NO: 32847 - DNA, 25 bp, S. cerevisiae
gaaatagccattaacgtacatgaag

SEQ ID NO: 32848 - DNA, 25 bp, S. cerevisiae
gaaagtgcttgtgacagtgccataa

SEQ ID NO: 32849 - DNA, 25 bp, S. cerevisiae
gaaatgacgtaccaactgatagaaa

SEQ ID NO: 32850 - DNA, 25 bp, S. cerevisiae
gacacatggtgctccaactgacgaa

SEQ ID NO: 32851 - DNA, 25 bp, S. cerevisiae
gaaaggtgcatctcaggctactgaa

SEQ ID NO: 32852 - DNA, 25 bp, S. cerevisiae
gacaaagcagcctcggtagcgcaca

SEQ ID NO: 32853 - DNA, 25 bp, S. cerevisiae
gaaatcttcgtgacggatttacccg

SEQ ID NO: 32854 - DNA, 25 bp, S. cerevisiae
gaaattttatctgaacccgcaatag

SEQ ID NO: 32855 - DNA, 25 bp, S. cerevisiae
gaaatgttacatgaataccgccgta

SEQ ID NO: 32856 - DNA, 25 bp, S. cerevisiae
gaaatggcaatcatcatcacccgcc

SEQ ID NO: 32857 - DNA, 25 bp, S. cerevisiae
gaaagtgctatctataccaccagca

SEQ ID NO: 32858 - DNA, 25 bp, S. cerevisiae
gaaatggctgacgaactatccagat

SEQ ID NO: 32859 - DNA, 25 bp, S. cerevisiae
gaaatggtccactacttccgttttg

SEQ ID NO: 32860 - DNA, 25 bp, S. cerevisiae
gaaatttccgcatgttttgctattt

SEQ ID NO: 32861 - DNA, 25 bp, S. cerevisiae
gaaattgataattccctacgggcta

SEQ ID NO: 32862 - DNA, 25 bp, S. cerevisiae
gaaatccaagtatgcttacgccgct

SEQ ID NO: 32863 - DNA, 25 bp, S. cerevisiae
gaaaggccgctattctctcttgcat

SEQ ID NO: 32864 - DNA, 25 bp, S. cerevisiae
gaaaggctcttactgctgctattac

SEQ ID NO: 32865 - DNA, 25 bp, S. cerevisiae
gaaagtgtctctactgcaagattca

SEQ ID NO: 32866 - DNA, 25 bp, S. cerevisiae
gaaaggtctctatcgcgttcatgag

SEQ ID NO: 32867 - DNA, 25 bp, S. cerevisiae
gaaagggtttgactccatctcaaat

SEQ ID NO: 32868 - DNA, 25 bp, S. cerevisiae
gaaagtgtattccttttgctccaca

SEQ ID NO: 32869 - DNA, 25 bp, S. cerevisiae
gaaatgcatccaaccttttctcgaa

SEQ ID NO: 32870 - DNA, 25 bp, S. cerevisiae
gaaatcacctgtctttattgtgcat

SEQ ID NO: 32871 - DNA, 25 bp, S. cerevisiae
gaaatgcagcctttttaatcactag

SEQ ID NO: 32872 - DNA, 25 bp, S. cerevisiae
gaaatcggtgccattgagaattctt

SEQ ID NO: 32873 - DNA, 25 bp, S. cerevisiae
gaaatgcacgacgagttcttcttcc

SEQ ID NO: 32874 - DNA, 25 bp, S. cerevisiae
gaaaggccacaaattcttcatcaca

SEQ ID NO: 32875 - DNA, 25 bp, S. cerevisiae
gaaaggctcacagattgctcgcaaa

SEQ ID NO: 32876 - DNA, 25 bp, S. cerevisiae
gaaatgtcccattgatgtcgtaaag

SEQ ID NO: 32877 - DNA, 25 bp, S. cerevisiae
gaaatgtctcaatcgtagctaacta

SEQ ID NO: 32878 - DNA, 25 bp, S. cerevisiae
gaaatggctcattacgaacaaactt

SEQ ID NO: 32879 - DNA, 25 bp, S. cerevisiae
gaaatgcaagactccagatcagaca

SEQ ID NO: 32880 - DNA, 25 bp, S. cerevisiae
gacaaccaagctgccattgctgaag

SEQ ID NO: 32881 - DNA, 25 bp, S. cerevisiae
gaaatcctccactcaagcgaagaaa

SEQ ID NO: 32882 - DNA, 25 bp, S. cerevisiae
gacaagacccaactcgagcgacaaa

SEQ ID NO: 32883 - DNA, 25 bp, S. cerevisiae
gaaatacgccgaccaggatgaaact

SEQ ID NO: 32884 - DNA, 25 bp, S. cerevisiae
gaaatacgcctatcacgcatgaatc

SEQ ID NO: 32885 - DNA, 25 bp, S. cerevisiae
gaaatacgacatccaagcgcagcaa

SEQ ID NO: 32886 - DNA, 25 bp, S. cerevisiae
gaaatcacgaagtctgctcacccag

SEQ ID NO: 32887 - DNA, 25 bp, S. cerevisiae
gaaatgcctaatactggacctggat

SEQ ID NO: 32888 - DNA, 25 bp, S. cerevisiae
gaaatggctacaatcctgactagaa

SEQ ID NO: 32889 - DNA, 25 bp, S. cerevisiae
gaaatctttgcaacatctgaagaaa

SEQ ID NO: 32890 - DNA, 25 bp, S. cerevisiae
gaaattctttgccactaaatccacg

SEQ ID NO: 32891 - DNA, 25 bp, S. cerevisiae
gaaatctctgatccgtttaactacg

SEQ ID NO: 32892 - DNA, 25 bp, S. cerevisiae
gaaatacggtatgcctccagtaggt

SEQ ID NO: 32893 - DNA, 25 bp, S. cerevisiae
gaccaattggttttccggtcatggt

SEQ ID NO: 32894 - DNA, 25 bp, S. cerevisiae
gacagagcctgtcggaaccggatta

SEQ ID NO: 32895 - DNA, 25 bp, S. cerevisiae
gaaaggcatctctaaaccgtcacca

SEQ ID NO: 32896 - DNA, 25 bp, S. cerevisiae
gaaaggccatgctaaacaactccat

SEQ ID NO: 32897 - DNA, 25 bp, S. cerevisiae
gaaaggctctcattagaagacccaa

SEQ ID NO: 32898 - DNA, 25 bp, S. cerevisiae
gaaaggctggctgggatagcaccaa

SEQ ID NO: 32899 - DNA, 25 bp, S. cerevisiae
gaaattaccacctacaccaataagc

SEQ ID NO: 32900 - DNA, 25 bp, S. cerevisiae
gaaatggacccaattgacttcgatt

SEQ ID NO: 32901 - DNA, 25 bp, S. cerevisiae
gaaaggcccgcaagatattgatctc

SEQ ID NO: 32902 - DNA, 25 bp, S. cerevisiae
gaaaggcacacaaggatattactgt

SEQ ID NO: 32903 - DNA, 25 bp, S. cerevisiae
gaaattccttggcatatgctcctgt

SEQ ID NO: 32904 - DNA, 25 bp, S. cerevisiae
gaaatccttgattcagataccggga

SEQ ID NO: 32905 - DNA, 25 bp, S. cerevisiae
gaaatcccagattcgcaaaaggtgg

SEQ ID NO: 32906 - DNA, 25 bp, S. cerevisiae
gaaatctcggtttcacagaaagcag

SEQ ID NO: 32907 - DNA, 25 bp, S. cerevisiae
gaaatcgaagtttgcactgacacag

SEQ ID NO: 32908 - DNA, 25 bp, S. cerevisiae
gaaatcgatgcattatctcctgata

SEQ ID NO: 32909 - DNA, 25 bp, S. cerevisiae
gaaatggcatagaatcccttactaa

SEQ ID NO: 32910 - DNA, 25 bp, S. cerevisiae
gaaaggatattctccatctccaaga

SEQ ID NO: 32911 - DNA, 25 bp, S. cerevisiae
gaaatgtggcattactccacttcaa

SEQ ID NO: 32912 - DNA, 25 bp, S. cerevisiae
gaaattaagtcattgccacctggat

SEQ ID NO: 32913 - DNA, 25 bp, S. cerevisiae
gaaattgagctatttaacgcggctg

SEQ ID NO: 32914 - DNA, 25 bp, S. cerevisiae
gaaattggtgtcataacgccctatt

SEQ ID NO: 32915 - DNA, 25 bp, S. cerevisiae
gaaattggtcttgaacatctccgtt

SEQ ID NO: 32916 - DNA, 25 bp, S. cerevisiae
gaaatttccgtttccttggctgata

SEQ ID NO: 32917 - DNA, 25 bp, S. cerevisiae
gaaatttctttcatggcgagtgtta

SEQ ID NO: 32918 - DNA, 25 bp, S. cerevisiae
gaaatcttttttcttctccagagtg

SEQ ID NO: 32919 - DNA, 25 bp, S. cerevisiae
gaaatatcgggaacgttatcgccaa

SEQ ID NO: 32920 - DNA, 25 bp, S. cerevisiae
gaaatcagcttcctgggttccagta

SEQ ID NO: 32921 - DNA, 25 bp, S. cerevisiae
gaaatacccccagtgttcaagaaag

SEQ ID NO: 32922 - DNA, 25 bp, S. cerevisiae
gaaatgataccacatcttccaagat

SEQ ID NO: 32923 - DNA, 25 bp, S. cerevisiae
gaaatacatccaaactgaacaacaa

SEQ ID NO: 32924 - DNA, 25 bp, S. cerevisiae
gaaatactcctgttcgaattacgaa

SEQ ID NO: 32925 - DNA, 25 bp, S. cerevisiae
gaaatacccgattagcaccttcaaa

SEQ ID NO: 32926 - DNA, 25 bp, S. cerevisiae
gagaaaaccgagtgcgtttcatgca

SEQ ID NO: 32927 - DNA, 25 bp, S. cerevisiae
ggaaactacgtgtggttctaccgag

SEQ ID NO: 32928 - DNA, 25 bp, S. cerevisiae
gagaattcttcgaccgagttgaaac

SEQ ID NO: 32929 - DNA, 25 bp, S. cerevisiae
gaaatgtttcatcccaatgtctatg

SEQ ID NO: 32930 - DNA, 25 bp, S. cerevisiae
gaaattcccataccagcaatgagtg

SEQ ID NO: 32931 - DNA, 25 bp, S. cerevisiae
gaaatgtcccttccctatgatgagg

SEQ ID NO: 32932 - DNA, 25 bp, S. cerevisiae
gaaatcccagtcgtatatgctcaag

SEQ ID NO: 32933 - DNA, 25 bp, S. cerevisiae
gaaatctgcacacttgcttatgctt

SEQ ID NO: 32934 - DNA, 25 bp, S. cerevisiae
gacacgctctacacaaaggctcagg

SEQ ID NO: 32935 - DNA, 25 bp, S. cerevisiae
gacacagactatgcactaaggcgaa

SEQ ID NO: 32936 - DNA, 25 bp, S. cerevisiae
gacaaatccatcattgaaggcgcat

SEQ ID NO: 32937 - DNA, 25 bp, S. cerevisiae
gacaacggtatcgtcaaggccttga

SEQ ID NO: 32938 - DNA, 25 bp, S. cerevisiae
gacaaaatgcttcacaaccctgatg

SEQ ID NO: 32939 - DNA, 25 bp, S. cerevisiae
gaaatggttgtctcttcaccagcag

SEQ ID NO: 32940 - DNA, 25 bp, S. cerevisiae
gaaatctttcttctgaaccatcaaa

SEQ ID NO: 32941 - DNA, 25 bp, S. cerevisiae
gacaagttttctccgcgaacataca

SEQ ID NO: 32942 - DNA, 25 bp, S. cerevisiae
gaaatttactctgcgtgacgtacca

SEQ ID NO: 32943 - DNA, 25 bp, S. cerevisiae
gaaatttgaattccgagtgcgtact

SEQ ID NO: 32944 - DNA, 25 bp, S. cerevisiae
gaaatcatgtcgaggctgctgtgtg

SEQ ID NO: 32945 - DNA, 25 bp, S. cerevisiae
gaaatcactcatttgatccgggaat

SEQ ID NO: 32946 - DNA, 25 bp, S. cerevisiae
gaaattccatcgtgatttgtcctct

SEQ ID NO: 32947 - DNA, 25 bp, S. cerevisiae
gaaatttccgctgacagtgtctctt

SEQ ID NO: 32948 - DNA, 25 bp, S. cerevisiae
gaaatacatggggtccttcctgagg

SEQ ID NO: 32949 - DNA, 25 bp, S. cerevisiae
gacaacaaggtcaactcttccgggc

SEQ ID NO: 32950 - DNA, 25 bp, S. cerevisiae
gacaacgcaagtgttattccgctag

SEQ ID NO: 32951 - DNA, 25 bp, S. cerevisiae
gacaatgccggtgttttacttagag

SEQ ID NO: 32952 - DNA, 25 bp, S. cerevisiae
gaaatcctgggactctttaaaagat

SEQ ID NO: 32953 - DNA, 25 bp, S. cerevisiae
gacactttgggtctgtatagcgata

SEQ ID NO: 32954 - DNA, 25 bp, S. cerevisiae
gaaattttcgccattttgcttacaa

SEQ ID NO: 32955 - DNA, 25 bp, S. cerevisiae
gaaatttgccaactacttttgcaca

SEQ ID NO: 32956 - DNA, 25 bp, S. cerevisiae
gaaatttctacaaggccgttccagc

SEQ ID NO: 32957 - DNA, 25 bp, S. cerevisiae
gaaattcctatcaagatgccggtac

SEQ ID NO: 32958 - DNA, 25 bp, S. cerevisiae
gaaatgcttcttcagagccaagcga

SEQ ID NO: 32959 - DNA, 25 bp, S. cerevisiae
gaaatgcttctggtatcacccaaga

SEQ ID NO: 32960 - DNA, 25 bp, S. cerevisiae
gacactataagatgcccgttactga

SEQ ID NO: 32961 - DNA, 25 bp, S. cerevisiae
gagagttccaactccaatacgccgt

SEQ ID NO: 32962 - DNA, 25 bp, S. cerevisiae
taagtacatgaagcctttacccgtc

SEQ ID NO: 32963 - DNA, 25 bp, S. cerevisiae
tgagagtaaatattccttaacccct

SEQ ID NO: 32964 - DNA, 25 bp, S. cerevisiae
gaaatacgtttcctctaagccactt

SEQ ID NO: 32965 - DNA, 25 bp, S. cerevisiae
gaaatagcgtttctccaatggaaga

SEQ ID NO: 32966 - DNA, 25 bp, S. cerevisiae
gaaattggctttccctctagattca

SEQ ID NO: 32967 - DNA, 25 bp, S. cerevisiae
gaaatctcagctgttccatatttta

SEQ ID NO: 32968 - DNA, 25 bp, S. cerevisiae
gaaattggtccacgcaaatattcta

SEQ ID NO: 32969 - DNA, 25 bp, S. cerevisiae
gaaatcagattaccacgtcttccgt

SEQ ID NO: 32970 - DNA, 25 bp, S. cerevisiae
gaaatccatgtaccaactctggcag

SEQ ID NO: 32971 - DNA, 25 bp, S. cerevisiae
gaaattcactcaccaaaccgcagtt

SEQ ID NO: 32972 - DNA, 25 bp, S. cerevisiae
gaaatatcactagaagcggccattg

SEQ ID NO: 32973 - DNA, 25 bp, S. cerevisiae
gaaattaccgtcgaccatactgaag

SEQ ID NO: 32974 - DNA, 25 bp, S. cerevisiae
gaaatcgcacgaccaattagacttg

SEQ ID NO: 32975 - DNA, 25 bp, S. cerevisiae
gaaatcggctatcaatttacctccc

SEQ ID NO: 32976 - DNA, 25 bp, S. cerevisiae
gaaatcggtatccttttatgcataa

SEQ ID NO: 32977 - DNA, 25 bp, S. cerevisiae
gaaatcggcgatcctcttttgatat

SEQ ID NO: 32978 - DNA, 25 bp, S. cerevisiae
gaaatgcagcaaagtctcgtcaaga

SEQ ID NO: 32979 - DNA, 25 bp, S. cerevisiae
gaaatcagccggttcctgcaagcaa

SEQ ID NO: 32980 - DNA, 25 bp, S. cerevisiae
gacaatcagagaccactcacgaagt

SEQ ID NO: 32981 - DNA, 25 bp, S. cerevisiae
gacattcaaattgcccgacgggagg

SEQ ID NO: 32982 - DNA, 25 bp, S. cerevisiae
gacattcaaaggatcgcctcgtacg

SEQ ID NO: 32983 - DNA, 25 bp, S. cerevisiae
gacaataatggttttcaacctccta

SEQ ID NO: 32984 - DNA, 25 bp, S. cerevisiae
gaaatcaactgtcagtctacccagt

SEQ ID NO: 32985 - DNA, 25 bp, S. cerevisiae
gaaattactgtatgtcaaccctccg

SEQ ID NO: 32986 - DNA, 25 bp, S. cerevisiae
gaaattgcttccttggttatcaggt

SEQ ID NO: 32987 - DNA, 25 bp, S. cerevisiae
gaaatccttcactgcagattccagg

SEQ ID NO: 32988 - DNA, 25 bp, S. cerevisiae
gaaatcatctccaaaagtgtccgtg

SEQ ID NO: 32989 - DNA, 25 bp, S. cerevisiae
gaaatcatcatcaactccggcatag

SEQ ID NO: 32990 - DNA, 25 bp, S. cerevisiae
gaaatcacattgtctgctccataca

SEQ ID NO: 32991 - DNA, 25 bp, S. cerevisiae
gaaatcagttgaccatctgctaagt

SEQ ID NO: 32992 - DNA, 25 bp, S. cerevisiae
gaaattgttcagaccgtcctgtggt

SEQ ID NO: 32993 - DNA, 25 bp, S. cerevisiae
gaaatcattcaagttgcctccactc

SEQ ID NO: 32994 - DNA, 25 bp, S. cerevisiae
gaaatcatcactgttggtccacact

SEQ ID NO: 32995 - DNA, 25 bp, S. cerevisiae
gaaatccactagtactgccagacgg

SEQ ID NO: 32996 - DNA, 25 bp, S. cerevisiae
gaaatccactatttctgctagagaa

SEQ ID NO: 32997 - DNA, 25 bp, S. cerevisiae
gaaatagtgcccgttctcaatgtaa

SEQ ID NO: 32998 - DNA, 25 bp, S. cerevisiae
gaaattgtccacttttcacggcaac

SEQ ID NO: 32999 - DNA, 25 bp, S. cerevisiae
gaaatttccatgctcttccgagaag

SEQ ID NO: 33000 - DNA, 25 bp, S. cerevisiae
gaaatcatcaccatccactatcaag

SEQ ID NO: 33001 - DNA, 25 bp, S. cerevisiae
gaaattcatccattgctaccacaag

SEQ ID NO: 33002 - DNA, 25 bp, S. cerevisiae
gaaatcataccgtcatgtccacaat

SEQ ID NO: 33003 - DNA, 25 bp, S. cerevisiae
gaaataatatccttctcgaaagctt

SEQ ID NO: 33004 - DNA, 25 bp, S. cerevisiae
gaaataattccactattggtgactt

SEQ ID NO: 33005 - DNA, 25 bp, S. cerevisiae
gaaattctgtccattctggtcacta

SEQ ID NO: 33006 - DNA, 25 bp, S. cerevisiae
gacaaggtcgctggtaaggttcaac

SEQ ID NO: 33007 - DNA, 25 bp, S. cerevisiae
gacaaggctagaagattgggttaca

SEQ ID NO: 33008 - DNA, 25 bp, S. cerevisiae
gacaacacgaacagtggcctgcata

SEQ ID NO: 33009 - DNA, 25 bp, S. cerevisiae
gacaactccgtcaggtcattcaagt

SEQ ID NO: 33010 - DNA, 25 bp, S. cerevisiae
gaaatctacgatgggttcactcaag

SEQ ID NO: 33011 - DNA, 25 bp, S. cerevisiae
gacaagtgggtcgaaatggctcaac

SEQ ID NO: 33012 - DNA, 25 bp, S. cerevisiae
gaccggtaagtcagccttggaagca

SEQ ID NO: 33013 - DNA, 25 bp, S. cerevisiae
gacggtttacactacgttcaaatga

SEQ ID NO: 33014 - DNA, 25 bp, S. cerevisiae
gacaagttccaagttcgttccactg

SEQ ID NO: 33015 - DNA, 25 bp, S. cerevisiae
gaaatttgcaccttatcgttccaag

SEQ ID NO: 33016 - DNA, 25 bp, S. cerevisiae
gaaattgggacacctacttggacag

SEQ ID NO: 33017 - DNA, 25 bp, S. cerevisiae
gaaattggtgaattctttgcaggaa

SEQ ID NO: 33018 - DNA, 25 bp, S. cerevisiae
gaaattgactacacgtctgaagagc

SEQ ID NO: 33019 - DNA, 25 bp, S. cerevisiae
gaaatcattctccagacccaatagg

SEQ ID NO: 33020 - DNA, 25 bp, S. cerevisiae
gacagagttatcagaccagcaaaag

SEQ ID NO: 33021 - DNA, 25 bp, S. cerevisiae
gacaggcctgaaagactcgcaatgg

SEQ ID NO: 33022 - DNA, 25 bp, S. cerevisiae
gaaattgccaagatacgatccgagc

SEQ ID NO: 33023 - DNA, 25 bp, S. cerevisiae
gaaattacaccaaactatcccagtg

SEQ ID NO: 33024 - DNA, 25 bp, S. cerevisiae
gaaattagaacagcgtatccaaact

SEQ ID NO: 33025 - DNA, 25 bp, S. cerevisiae
gaaattgcagaatctccttccttga

SEQ ID NO: 33026 - DNA, 25 bp, S. cerevisiae
gaaattcacacagcatctcttaccg

SEQ ID NO: 33027 - DNA, 25 bp, S. cerevisiae
gaaatatgaccaatgcattcgtgat

SEQ ID NO: 33028 - DNA, 25 bp, S. cerevisiae
gaaatctgctatatgatactgtgag

SEQ ID NO: 33029 - DNA, 25 bp, S. cerevisiae
gaaatttcattttgcacagggatct

SEQ ID NO: 33030 - DNA, 25 bp, S. cerevisiae
gaaattccattttccaaatgcgata

SEQ ID NO: 33031 - DNA, 25 bp, S. cerevisiae
gacaacttagtctacacggtttgga

SEQ ID NO: 33032 - DNA, 25 bp, S. cerevisiae
gacaaggtaagctagaagttccagg

SEQ ID NO: 33033 - DNA, 25 bp, S. cerevisiae
gacatcgattaacagttttcccagg

SEQ ID NO: 33034 - DNA, 25 bp, S. cerevisiae
gacaagaaatcaccgttttatccag

SEQ ID NO: 33035 - DNA, 25 bp, S. cerevisiae
gacaaggtacctgttcattatccac

SEQ ID NO: 33036 - DNA, 25 bp, S. cerevisiae
gacaaagttcccatcacaatagctc

SEQ ID NO: 33037 - DNA, 25 bp, S. cerevisiae
gacaaacttaaactggacacctctg

SEQ ID NO: 33038 - DNA, 25 bp, S. cerevisiae
gacaacactttaactggcgaagact

SEQ ID NO: 33039 - DNA, 25 bp, S. cerevisiae
gaaataaccgctatcgacaacagta

SEQ ID NO: 33040 - DNA, 25 bp, S. cerevisiae
gaaatcacaggcgaagtctacaaca

SEQ ID NO: 33041 - DNA, 25 bp, S. cerevisiae
gaaatctctagatgattctacagaa

SEQ ID NO: 33042 - DNA, 25 bp, S. cerevisiae
gacagatctttatttccaacaggtt

SEQ ID NO: 33043 - DNA, 25 bp, S. cerevisiae
gacaagatattattaaaacatggca

SEQ ID NO: 33044 - DNA, 25 bp, S. cerevisiae
gacacaatagtattatcaatcctga

SEQ ID NO: 33045 - DNA, 25 bp, S. cerevisiae
gaaattagcagaaatggcaccatga

SEQ ID NO: 33046 - DNA, 25 bp, S. cerevisiae
gacagaaacaagatccaccaatact

SEQ ID NO: 33047 - DNA, 25 bp, S. cerevisiae
gaaatcttacttccagcaaatcttt

SEQ ID NO: 33048 - DNA, 25 bp, S. cerevisiae
gacaagttcactcgtcactattttg

SEQ ID NO: 33049 - DNA, 25 bp, S. cerevisiae
gacaagttccttgcagccattgagt

SEQ ID NO: 33050 - DNA, 25 bp, S. cerevisiae
gacaagaacggtgcatgagctatca

SEQ ID NO: 33051 - DNA, 25 bp, S. cerevisiae
gacaaggacggtttcatatccaatg

SEQ ID NO: 33052 - DNA, 25 bp, S. cerevisiae
tgaaaggtcttttactaacgcggca

SEQ ID NO: 33053 - DNA, 25 bp, S. cerevisiae
gacaacaagctcctttagacccggg

SEQ ID NO: 33054 - DNA, 25 bp, S. cerevisiae
gaaatatcctcactttatacccgaa

SEQ ID NO: 33055 - DNA, 25 bp, S. cerevisiae
gaaatcatttgatcctttcgccgac

SEQ ID NO: 33056 - DNA, 25 bp, S. cerevisiae
gacaagtcgaattccattttgccgg

SEQ ID NO: 33057 - DNA, 25 bp, S. cerevisiae
gacaaggcactatcgtaattccgag

SEQ ID NO: 33058 - DNA, 25 bp, S. cerevisiae
gacaagccaggatcgtactacatgt

SEQ ID NO: 33059 - DNA, 25 bp, S. cerevisiae
gaaatcatcagttccgtactcagca

SEQ ID NO: 33060 - DNA, 25 bp, S. cerevisiae
gacaagatggtcctcaggtcgacga

SEQ ID NO: 33061 - DNA, 25 bp, S. cerevisiae
gacaaattcgccatattccagtaag

SEQ ID NO: 33062 - DNA, 25 bp, S. cerevisiae
gaaatatctcgccttttacactagt

SEQ ID NO: 33063 - DNA, 25 bp, S. cerevisiae
gaaatcattcgccatctattcatcc

SEQ ID NO: 33064 - DNA, 25 bp, S. cerevisiae
gaaatcacatgccaactcattgcag

SEQ ID NO: 33065 - DNA, 25 bp, S. cerevisiae
gaaatctatcagcagtgcactgact

SEQ ID NO: 33066 - DNA, 25 bp, S. cerevisiae
gacacactacagtatggcagtcagt

SEQ ID NO: 33067 - DNA, 25 bp, S. cerevisiae
gacaagcctttttcgacagtttgaa

SEQ ID NO: 33068 - DNA, 25 bp, S. cerevisiae
gtaaaggtggtaaagctggttcagc

SEQ ID NO: 33069 - DNA, 25 bp, S. cerevisiae
gacaacccagggtacaaggcgtcaa

SEQ ID NO: 33070 - DNA, 25 bp, S. cerevisiae
gaaattattcggtctttgtcagatg

SEQ ID NO: 33071 - DNA, 25 bp, S. cerevisiae
gacaaggtttatttgctatacccct

SEQ ID NO: 33072 - DNA, 25 bp, S. cerevisiae
gaaattgctaatattctctcatcgc

SEQ ID NO: 33073 - DNA, 25 bp, S. cerevisiae
gacaccgtaatagttccagccaaga

SEQ ID NO: 33074 - DNA, 25 bp, S. cerevisiae
gacacactgttcaactccacggaaa

SEQ ID NO: 33075 - DNA, 25 bp, S. cerevisiae
gaaatcatggaatcccaagcttatg

SEQ ID NO: 33076 - DNA, 25 bp, S. cerevisiae
gacatacccattccgaagattgcct

SEQ ID NO: 33077 - DNA, 25 bp, S. cerevisiae
gacaatcaccacagcgtattatcgt

SEQ ID NO: 33078 - DNA, 25 bp, S. cerevisiae
gaaatagccgctatgccatcttcgt

SEQ ID NO: 33079 - DNA, 25 bp, S. cerevisiae
gaaatacctgctcctgaatcttcat

SEQ ID NO: 33080 - DNA, 25 bp, S. cerevisiae
gacaacgttgcactgttcttaaagc

SEQ ID NO: 33081 - DNA, 25 bp, S. cerevisiae
gacaatgttatcatgcctttgaaga

SEQ ID NO: 33082 - DNA, 25 bp, S. cerevisiae
gaaatttcctgatctggctgatgaa

SEQ ID NO: 33083 - DNA, 25 bp, S. cerevisiae
gaaataccagctgccatggtgataa

SEQ ID NO: 33084 - DNA, 25 bp, S. cerevisiae
gaaatacatcgccatggattgtgaa

SEQ ID NO: 33085 - DNA, 25 bp, S. cerevisiae
gaaatcagcacctatcgtttggata

SEQ ID NO: 33086 - DNA, 25 bp, S. cerevisiae
gaaattcactgcatatcctctatgt

SEQ ID NO: 33087 - DNA, 25 bp, S. cerevisiae
gaaattgactgaatcctccgcagta

SEQ ID NO: 33088 - DNA, 25 bp, S. cerevisiae
gaaattgcgcaaagcctatccagaa

SEQ ID NO: 33089 - DNA, 25 bp, S. cerevisiae
gaaattgctcaatgctctagataag

SEQ ID NO: 33090 - DNA, 25 bp, S. cerevisiae
gaaatatgctgctgtctttggactg

SEQ ID NO: 33091 - DNA, 25 bp, S. cerevisiae
gacaatcggatgctcttgaaccaga

SEQ ID NO: 33092 - DNA, 25 bp, S. cerevisiae
gacaatggtaggtcgaagcccagat

SEQ ID NO: 33093 - DNA, 25 bp, S. cerevisiae
gacacgttctttggaatgccggtta

SEQ ID NO: 33094 - DNA, 25 bp, S. cerevisiae
gaaattgtttctcactccagaatta

SEQ ID NO: 33095 - DNA, 25 bp, S. cerevisiae
gaaattggctttctttcagcagttc

SEQ ID NO: 33096 - DNA, 25 bp, S. cerevisiae
gacaacgcgaataataccccagtgg

SEQ ID NO: 33097 - DNA, 25 bp, S. cerevisiae
gacaatggcgacttaactgctactg

SEQ ID NO: 33098 - DNA, 25 bp, S. cerevisiae
gacaatcgtccaataatctccaatg

SEQ ID NO: 33099 - DNA, 25 bp, S. cerevisiae
gacagtcatgtgctgatgaattcag

SEQ ID NO: 33100 - DNA, 25 bp, S. cerevisiae
gacagagcagtagtggagttcatag

SEQ ID NO: 33101 - DNA, 25 bp, S. cerevisiae
gacaaggtattggtatctgcaacta

SEQ ID NO: 33102 - DNA, 25 bp, S. cerevisiae
gacaatctaccaacttctaacgaaa

SEQ ID NO: 33103 - DNA, 25 bp, S. cerevisiae
gaaatattctcattcttctaactga

SEQ ID NO: 33104 - DNA, 25 bp, S. cerevisiae
gacaaacccgttattattatgcatg

SEQ ID NO: 33105 - DNA, 25 bp, S. cerevisiae
gaaattgccctattcattttcaaga

SEQ ID NO: 33106 - DNA, 25 bp, S. cerevisiae
gaaattgatcctttggtgttccatg

SEQ ID NO: 33107 - DNA, 25 bp, S. cerevisiae
gaaattaagctttgcggattacaga

SEQ ID NO: 33108 - DNA, 25 bp, S. cerevisiae
gaaattaggctatgcgcgtgataaa

SEQ ID NO: 33109 - DNA, 25 bp, S. cerevisiae
gaaatattcagatcgctgcatttag

SEQ ID NO: 33110 - DNA, 25 bp, S. cerevisiae
gacaatcagtcacaccctagaatta

SEQ ID NO: 33111 - DNA, 25 bp, S. cerevisiae
gacatggacccatattcacgagaat

SEQ ID NO: 33112 - DNA, 25 bp, S. cerevisiae
gacatgacaaccacattgccgagtt

SEQ ID NO: 33113 - DNA, 25 bp, S. cerevisiae
gacaacaagcctgttcctgcaggaa

SEQ ID NO: 33114 - DNA, 25 bp, S. cerevisiae
gacagaaaccttctcactgagggtg

SEQ ID NO: 33115 - DNA, 25 bp, S. cerevisiae
gaccaaattcgaagcttcccaagtt

SEQ ID NO: 33116 - DNA, 25 bp, S. cerevisiae
gacccaattaaagctaccgattcgt

SEQ ID NO: 33117 - DNA, 25 bp, S. cerevisiae
gacatcccagtcttggtggtcgggt

SEQ ID NO: 33118 - DNA, 25 bp, S. cerevisiae
gacacgaaggtcacttccagtgcat

SEQ ID NO: 33119 - DNA, 25 bp, S. cerevisiae
gacaatgacattccagttaccactg

SEQ ID NO: 33120 - DNA, 25 bp, S. cerevisiae
gaaattcgaagatcagggcgcccaa

SEQ ID NO: 33121 - DNA, 25 bp, S. cerevisiae
gaaatattgtaacttggccctgtag

SEQ ID NO: 33122 - DNA, 25 bp, S. cerevisiae
gacaaatacgaactcggccctgcat

SEQ ID NO: 33123 - DNA, 25 bp, S. cerevisiae
gaaattatccagttcgttaagtgct

SEQ ID NO: 33124 - DNA, 25 bp, S. cerevisiae
gacaatttgccaactccgtaacttg

SEQ ID NO: 33125 - DNA, 25 bp, S. cerevisiae
gaaatattccttgattgctgcttta

SEQ ID NO: 33126 - DNA, 25 bp, S. cerevisiae
gaaatagcctttggcgacgattctt

SEQ ID NO: 33127 - DNA, 25 bp, S. cerevisiae
gaaatttgtctctgatgtccttgaa

SEQ ID NO: 33128 - DNA, 25 bp, S. cerevisiae
gacaatgttgtcaagaggctacgta

SEQ ID NO: 33129 - DNA, 25 bp, S. cerevisiae
gacaaggtgctttaggctatgccca

SEQ ID NO: 33130 - DNA, 25 bp, S. cerevisiae
gacaacttcttttgggcagccgcag

SEQ ID NO: 33131 - DNA, 25 bp, S. cerevisiae
gacacctgtttttggtcaggatcaa

SEQ ID NO: 33132 - DNA, 25 bp, S. cerevisiae
gacaccgggtttggcacctgtagga

SEQ ID NO: 33133 - DNA, 25 bp, S. cerevisiae
gacacctgggtttaagtctccatta

SEQ ID NO: 33134 - DNA, 25 bp, S. cerevisiae
gacaccggcgtcatatggaatgcca

SEQ ID NO: 33135 - DNA, 25 bp, S. cerevisiae
gacaatttgcagctttacagggatt

SEQ ID NO: 33136 - DNA, 25 bp, S. cerevisiae
gacaatttttgtgaactgggattac

SEQ ID NO: 33137 - DNA, 25 bp, S. cerevisiae
gacacttccttgagaactgccgaaa

SEQ ID NO: 33138 - DNA, 25 bp, S. cerevisiae
gacaacgctgcattgattacactga

SEQ ID NO: 33139 - DNA, 25 bp, S. cerevisiae
gacaagggattactcgatgacatta

SEQ ID NO: 33140 - DNA, 25 bp, S. cerevisiae
gaaatatatgtcaactcggcccaag

SEQ ID NO: 33141 - DNA, 25 bp, S. cerevisiae
gaaattttctggacgcatgcttcga

SEQ ID NO: 33142 - DNA, 25 bp, S. cerevisiae
gaaatttctcggtcgctctcagaaa

SEQ ID NO: 33143 - DNA, 25 bp, S. cerevisiae
gttaatccaaggtgccatcagtagt

SEQ ID NO: 33144 - DNA, 25 bp, S. cerevisiae
gagtcaatccaacgtggaacgggtt

SEQ ID NO: 33145 - DNA, 25 bp, S. cerevisiae
gatctactcaacagtgggacgttat

SEQ ID NO: 33146 - DNA, 25 bp, S. cerevisiae
gacaatacacctttggagcacgttt

SEQ ID NO: 33147 - DNA, 25 bp, S. cerevisiae
gacaatcatcacatttcggacaagt

SEQ ID NO: 33148 - DNA, 25 bp, S. cerevisiae
gacaattgatgcagctatccatgat

SEQ ID NO: 33149 - DNA, 25 bp, S. cerevisiae
gacaattgtggagttctgctgaaaa

SEQ ID NO: 33150 - DNA, 25 bp, S. cerevisiae
gacaagcatctcagagcggtaatac

SEQ ID NO: 33151 - DNA, 25 bp, S. cerevisiae
gacaagttctcatgcatggtcgcaa

SEQ ID NO: 33152 - DNA, 25 bp, S. cerevisiae
gacaatgtttcatcgctatccgtat

SEQ ID NO: 33153 - DNA, 25 bp, S. cerevisiae
gacaatggttctttgcgacactact

SEQ ID NO: 33154 - DNA, 25 bp, S. cerevisiae
gaaatttttcctgggcttgtaatgc

SEQ ID NO: 33155 - DNA, 25 bp, S. cerevisiae
gaaattcaatcacccaggtctacct

SEQ ID NO: 33156 - DNA, 25 bp, S. cerevisiae
gacaatctaatcctgcaaactccac

SEQ ID NO: 33157 - DNA, 25 bp, S. cerevisiae
gaaattttccgcaaagcacgctctg

SEQ ID NO: 33158 - DNA, 25 bp, S. cerevisiae
gagaacctagggaacgcacctcgaa

SEQ ID NO: 33159 - DNA, 25 bp, S. cerevisiae
gacataacttcgcaagaatccttga

SEQ ID NO: 33160 - DNA, 25 bp, S. cerevisiae
gacaatacccaccacttttgtgagt

SEQ ID NO: 33161 - DNA, 25 bp, S. cerevisiae
gaaattccacttcgatcgttttgta

SEQ ID NO: 33162 - DNA, 25 bp, S. cerevisiae
gaaatttcattcagccctttctgta

SEQ ID NO: 33163 - DNA, 25 bp, S. cerevisiae
gacaattctttaatgcctgcgaggg

SEQ ID NO: 33164 - DNA, 25 bp, S. cerevisiae
gacaactctatttcatccatggaca

SEQ ID NO: 33165 - DNA, 25 bp, S. cerevisiae
gacaacgctgttttcgctggtgaaa

SEQ ID NO: 33166 - DNA, 25 bp, S. cerevisiae
gacaaactgaattttaggctcgaaa

SEQ ID NO: 33167 - DNA, 25 bp, S. cerevisiae
gaaattcaagatcgtttggccgaaa

SEQ ID NO: 33168 - DNA, 25 bp, S. cerevisiae
gaaattttcgatgactcctccagaa

SEQ ID NO: 33169 - DNA, 25 bp, S. cerevisiae
gaaattttcgtgctctcgctgtaat

SEQ ID NO: 33170 - DNA, 25 bp, S. cerevisiae
gaaattctcattcccttaattagag

SEQ ID NO: 33171 - DNA, 25 bp, S. cerevisiae
gaaattgcacttccgtatactttgt

SEQ ID NO: 33172 - DNA, 25 bp, S. cerevisiae
taaatagtgggctgttagtccgttc

SEQ ID NO: 33173 - DNA, 25 bp, S. cerevisiae
gactccaaagcggttactctagact

SEQ ID NO: 33174 - DNA, 25 bp, S. cerevisiae
gacgaaaaagaatcagcttaggcat

SEQ ID NO: 33175 - DNA, 25 bp, S. cerevisiae
gacgatgccaagttagacgcattga

SEQ ID NO: 33176 - DNA, 25 bp, S. cerevisiae
gacaatgcccatctcaatcgataag

SEQ ID NO: 33177 - DNA, 25 bp, S. cerevisiae
gacaataccatttcaagtgcacaag

SEQ ID NO: 33178 - DNA, 25 bp, S. cerevisiae
gacagtatcgcatgaccaacaagag

SEQ ID NO: 33179 - DNA, 25 bp, S. cerevisiae
gacagtatcgagcacataaccgcaa

SEQ ID NO: 33180 - DNA, 25 bp, S. cerevisiae
gacagctcaatcatcgatctagtag

SEQ ID NO: 33181 - DNA, 25 bp, S. cerevisiae
gacagccataaacatctcgatgagc

SEQ ID NO: 33182 - DNA, 25 bp, S. cerevisiae
gacagcaatgacaatacgccagaga

SEQ ID NO: 33183 - DNA, 25 bp, S. cerevisiae
gacatgcattcgtattcacaggaga

SEQ ID NO: 33184 - DNA, 25 bp, S. cerevisiae
gacaatccagttcccgcagatgatg

SEQ ID NO: 33185 - DNA, 25 bp, S. cerevisiae
gacaacgaatcacctgcgatgggat

SEQ ID NO: 33186 - DNA, 25 bp, S. cerevisiae
gacatggttccaaagcgaatcagat

SEQ ID NO: 33187 - DNA, 25 bp, S. cerevisiae
gacatggatcatctggacgtcatca

SEQ ID NO: 33188 - DNA, 25 bp, S. cerevisiae
gacacttcaaacagcttcgacacaa

SEQ ID NO: 33189 - DNA, 25 bp, S. cerevisiae
gacttcacgtacatggactatttag

SEQ ID NO: 33190 - DNA, 25 bp, S. cerevisiae
gaaattgtcgctaacgaagccgcta

SEQ ID NO: 33191 - DNA, 25 bp, S. cerevisiae
gacaatgtgagccttgacgaaccaa

SEQ ID NO: 33192 - DNA, 25 bp, S. cerevisiae
gacctggtacgtgcagaaacctttt

SEQ ID NO: 33193 - DNA, 25 bp, S. cerevisiae
gatcctggtccatgggaagcacctg

SEQ ID NO: 33194 - DNA, 25 bp, S. cerevisiae
gacaaacttgctctaatcgattatg

SEQ ID NO: 33195 - DNA, 25 bp, S. cerevisiae
gacaataccgataataaaggtgttc

SEQ ID NO: 33196 - DNA, 25 bp, S. cerevisiae
gacaattacgttcaaggagagcaga

SEQ ID NO: 33197 - DNA, 25 bp, S. cerevisiae
gacaatgaactgctgaccttggaaa

SEQ ID NO: 33198 - DNA, 25 bp, S. cerevisiae
gacaatgctattctacctgtttcga

SEQ ID NO: 33199 - DNA, 25 bp, S. cerevisiae
gacaccataacctggctattacata

SEQ ID NO: 33200 - DNA, 25 bp, S. cerevisiae
gacaatcatattgcatacccattaa

SEQ ID NO: 33201 - DNA, 25 bp, S. cerevisiae
gaaattgtttcttcccatgaaagca

SEQ ID NO: 33202 - DNA, 25 bp, S. cerevisiae
gaaattgttcgtccactgcagaaaa

SEQ ID NO: 33203 - DNA, 25 bp, S. cerevisiae
gaaattgattccttgccgcgtataa

SEQ ID NO: 33204 - DNA, 25 bp, S. cerevisiae
gaaattgatctcctttcggatacga

SEQ ID NO: 33205 - DNA, 25 bp, S. cerevisiae
gaaattgacgtgaatgaactgctga

SEQ ID NO: 33206 - DNA, 25 bp, S. cerevisiae
gacactttggcagttaatcttgaga

SEQ ID NO: 33207 - DNA, 25 bp, S. cerevisiae
gacacttggacaattcaatggcgta

SEQ ID NO: 33208 - DNA, 25 bp, S. cerevisiae
gactaaggaagttcaaggatctacc

SEQ ID NO: 33209 - DNA, 25 bp, S. cerevisiae
gactaacccagttcaattcaccaaa

SEQ ID NO: 33210 - DNA, 25 bp, S. cerevisiae
gaaattcattgttccttaggttact

SEQ ID NO: 33211 - DNA, 25 bp, S. cerevisiae
gaaattctttccaattttgctgggt

SEQ ID NO: 33212 - DNA, 25 bp, S. cerevisiae
gaaattcatctatcccaatgtctcc

SEQ ID NO: 33213 - DNA, 25 bp, S. cerevisiae
gacagctgtaattaccgatctactc

SEQ ID NO: 33214 - DNA, 25 bp, S. cerevisiae
gacaggattattaccgatttttgag

SEQ ID NO: 33215 - DNA, 25 bp, S. cerevisiae
gacaaagatgctaatggtgtttcct

SEQ ID NO: 33216 - DNA, 25 bp, S. cerevisiae
gacaagaaccgttattttgcagcta

SEQ ID NO: 33217 - DNA, 25 bp, S. cerevisiae
gacacaactgtcgaactctaatacg

SEQ ID NO: 33218 - DNA, 25 bp, S. cerevisiae
gacagaacgtcaaaagcttccatgg

SEQ ID NO: 33219 - DNA, 25 bp, S. cerevisiae
gacaagacacttcccgagctggaga

SEQ ID NO: 33220 - DNA, 25 bp, S. cerevisiae
gacaagatgatctccgctgcagtgg

SEQ ID NO: 33221 - DNA, 25 bp, S. cerevisiae
gacatcatggtctttgcgcacggac

SEQ ID NO: 33222 - DNA, 25 bp, S. cerevisiae
gaaattggctgctgctgtcagacaa

SEQ ID NO: 33223 - DNA, 25 bp, S. cerevisiae
gaaattgcgcattctcgcatcagaa

SEQ ID NO: 33224 - DNA, 25 bp, S. cerevisiae
gacaactgcgctggatgctctaaat

SEQ ID NO: 33225 - DNA, 25 bp, S. cerevisiae
gacatgaccattccacgaaattcga

SEQ ID NO: 33226 - DNA, 25 bp, S. cerevisiae
gacaccagtgttagcggagacgcaa

SEQ ID NO: 33227 - DNA, 25 bp, S. cerevisiae
gacactattacttcgaaagcgcagt

SEQ ID NO: 33228 - DNA, 25 bp, S. cerevisiae
gacactattagatccaaggcgcaat

SEQ ID NO: 33229 - DNA, 25 bp, S. cerevisiae
gacacgtatactgatttagcctcta

SEQ ID NO: 33230 - DNA, 25 bp, S. cerevisiae
gacaaggtatcacttttcctacgac

SEQ ID NO: 33231 - DNA, 25 bp, S. cerevisiae
gacacgataatccttttttcacaga

SEQ ID NO: 33232 - DNA, 25 bp, S. cerevisiae
gacaggaattgctattggtttaaac

SEQ ID NO: 33233 - DNA, 25 bp, S. cerevisiae
gacagcgtttgcttgggcatttatt

SEQ ID NO: 33234 - DNA, 25 bp, S. cerevisiae
gacaggttctgttggcgatgacaat

SEQ ID NO: 33235 - DNA, 25 bp, S. cerevisiae
gacaggttggaatttgctactatca

SEQ ID NO: 33236 - DNA, 25 bp, S. cerevisiae
gacagcttgggttaatgcagacgac

SEQ ID NO: 33237 - DNA, 25 bp, S. cerevisiae
gacactttcatttatgccgtctggg

SEQ ID NO: 33238 - DNA, 25 bp, S. cerevisiae
gacactatggtttagccgttgatat

SEQ ID NO: 33239 - DNA, 25 bp, S. cerevisiae
gacaaagcgttgtatccggctcatt

SEQ ID NO: 33240 - DNA, 25 bp, S. cerevisiae
gacaaacaaatcgaccaggcttatg

SEQ ID NO: 33241 - DNA, 25 bp, S. cerevisiae
gacaatactccatcactaatgcctt

SEQ ID NO: 33242 - DNA, 25 bp, S. cerevisiae
gacaatcctccaccaatcagaagat

SEQ ID NO: 33243 - DNA, 25 bp, S. cerevisiae
gacaacttcaataccatcagcaact

SEQ ID NO: 33244 - DNA, 25 bp, S. cerevisiae
gacaactctaatccagctgactatc

SEQ ID NO: 33245 - DNA, 25 bp, S. cerevisiae
gacaagtgcatcttctggttctcat

SEQ ID NO: 33246 - DNA, 25 bp, S. cerevisiae
gacatggcagtatgcttcaacaact

SEQ ID NO: 33247 - DNA, 25 bp, S. cerevisiae
gttcgttatggcatggacaacaccc

SEQ ID NO: 33248 - DNA, 25 bp, S. cerevisiae
gacaattttctgctggatggccatt

SEQ ID NO: 33249 - DNA, 25 bp, S. cerevisiae
gacaaaataatcaactctccgcata

SEQ ID NO: 33250 - DNA, 25 bp, S. cerevisiae
gacactagaattacgccttccaaag

SEQ ID NO: 33251 - DNA, 25 bp, S. cerevisiae
gacacctctccggatttgtaactaa

SEQ ID NO: 33252 - DNA, 25 bp, S. cerevisiae
gacaccgtttggaattcccattcaa

SEQ ID NO: 33253 - DNA, 25 bp, S. cerevisiae
gacaaatcttcaacaaccgcgtatc

SEQ ID NO: 33254 - DNA, 25 bp, S. cerevisiae
gacaactatataatcaagggcctct

SEQ ID NO: 33255 - DNA, 25 bp, S. cerevisiae
gacaatttgtttattcgtagatgat

SEQ ID NO: 33256 - DNA, 25 bp, S. cerevisiae
gacagatttgttcctgtacgtaaat

SEQ ID NO: 33257 - DNA, 25 bp, S. cerevisiae
gacaatcttttgtgctactttcata

SEQ ID NO: 33258 - DNA, 25 bp, S. cerevisiae
gacaattatttacccgctatttatt

SEQ ID NO: 33259 - DNA, 25 bp, S. cerevisiae
gacatttgacgatggtccttctgct

SEQ ID NO: 33260 - DNA, 25 bp, S. cerevisiae
gacagctctacgatgcgtactttca

SEQ ID NO: 33261 - DNA, 25 bp, S. cerevisiae
gacacatctaattctcgtacttgta

SEQ ID NO: 33262 - DNA, 25 bp, S. cerevisiae
gacagtacgtttgacacttttgggt

SEQ ID NO: 33263 - DNA, 25 bp, S. cerevisiae
gacttcgtcatatacccttttttgt

SEQ ID NO: 33264 - DNA, 25 bp, S. cerevisiae
gacaatagtgtacagcccatttttg

SEQ ID NO: 33265 - DNA, 25 bp, S. cerevisiae
gacaatacttcatatcccttcttat

SEQ ID NO: 33266 - DNA, 25 bp, S. cerevisiae
gacactcaaagcctatttacaccgt

SEQ ID NO: 33267 - DNA, 25 bp, S. cerevisiae
gacatctcccggtgcattgaacaat

SEQ ID NO: 33268 - DNA, 25 bp, S. cerevisiae
gactcaaagccagccattcaaggat

SEQ ID NO: 33269 - DNA, 25 bp, S. cerevisiae
gagcccaagtgagccatactacgaa

SEQ ID NO: 33270 - DNA, 25 bp, S. cerevisiae
gacaccattgtttcgctttacgaga

SEQ ID NO: 33271 - DNA, 25 bp, S. cerevisiae
gacacaatgctgtttccttatcaaa

SEQ ID NO: 33272 - DNA, 25 bp, S. cerevisiae
gacaattggcaacttattctcatta

SEQ ID NO: 33273 - DNA, 25 bp, S. cerevisiae
gacaattggctgtcttgtactatca

SEQ ID NO: 33274 - DNA, 25 bp, S. cerevisiae
gacaatttgcgaacttcatcgatga

SEQ ID NO: 33275 - DNA, 25 bp, S. cerevisiae
gacaattgtggtatcttgctgtaca

SEQ ID NO: 33276 - DNA, 25 bp, S. cerevisiae
gacagcatccgggttgtatttacct

SEQ ID NO: 33277 - DNA, 25 bp, S. cerevisiae
gacaaggaggatatcagccccgctt

SEQ ID NO: 33278 - DNA, 25 bp, S. cerevisiae
gacatgcggaaaacttggctccctt

SEQ ID NO: 33279 - DNA, 25 bp, S. cerevisiae
gacattagtatggtttggccctatg

SEQ ID NO: 33280 - DNA, 25 bp, S. cerevisiae
gacttactgtggagtgacccagacc

SEQ ID NO: 33281 - DNA, 25 bp, S. cerevisiae
gacttccgtgtaagaatcctacccg

SEQ ID NO: 33282 - DNA, 25 bp, S. cerevisiae
gacaacctgttcacgttatctgatt

SEQ ID NO: 33283 - DNA, 25 bp, S. cerevisiae
gacagaggtgtttctcgctactatg

SEQ ID NO: 33284 - DNA, 25 bp, S. cerevisiae
gacaacagtgttttcagtactacca

SEQ ID NO: 33285 - DNA, 25 bp, S. cerevisiae
gacaatcctgtctatgaaatcgagt

SEQ ID NO: 33286 - DNA, 25 bp, S. cerevisiae
gacaacctacattgatactccagat

SEQ ID NO: 33287 - DNA, 25 bp, S. cerevisiae
gacactctttctatgtatcctagga

SEQ ID NO: 33288 - DNA, 25 bp, S. cerevisiae
gacaatcgttgttttggccatggga

SEQ ID NO: 33289 - DNA, 25 bp, S. cerevisiae
gacaccagacttgtttcctgggata

SEQ ID NO: 33290 - DNA, 25 bp, S. cerevisiae
gacaccatatctcaaattcctgtgg

SEQ ID NO: 33291 - DNA, 25 bp, S. cerevisiae
gacaatgcttatattccacctgaac

SEQ ID NO: 33292 - DNA, 25 bp, S. cerevisiae
gacaactaattccattcaccagaga

SEQ ID NO: 33293 - DNA, 25 bp, S. cerevisiae
gacaggctagaaccaatacagaaga

SEQ ID NO: 33294 - DNA, 25 bp, S. cerevisiae
gacagcgctcagaaagatagctcaa

SEQ ID NO: 33295 - DNA, 25 bp, S. cerevisiae
gacagtcaagattttagcaatggtt

SEQ ID NO: 33296 - DNA, 25 bp, S. cerevisiae
gacaacctgttctttattggctcac

SEQ ID NO: 33297 - DNA, 25 bp, S. cerevisiae
gacaagtctccgtttttggtaagcg

SEQ ID NO: 33298 - DNA, 25 bp, S. cerevisiae
gacagtgaccagatctttagcttca

SEQ ID NO: 33299 - DNA, 25 bp, S. cerevisiae
gacactgtccttcttatagtcaaga

SEQ ID NO: 33300 - DNA, 25 bp, S. cerevisiae
gacagcgttattgcgtttgccaaaa

SEQ ID NO: 33301 - DNA, 25 bp, S. cerevisiae
gacagcagtgtagacgcgtttgaga

SEQ ID NO: 33302 - DNA, 25 bp, S. cerevisiae
gacagagttagctatacgtttgaat

SEQ ID NO: 33303 - DNA, 25 bp, S. cerevisiae
gacaggttgtcgaagcctttgcaag

SEQ ID NO: 33304 - DNA, 25 bp, S. cerevisiae
gacattggttacaagtccctaactt

SEQ ID NO: 33305 - DNA, 25 bp, S. cerevisiae
tgaattgggtgacagtttgcaaact

SEQ ID NO: 33306 - DNA, 25 bp, S. cerevisiae
gacttgggcgatgagtttgcaactt

SEQ ID NO: 33307 - DNA, 25 bp, S. cerevisiae
gactttttggagatcttaacgcatc

SEQ ID NO: 33308 - DNA, 25 bp, S. cerevisiae
gacttgactattatgactctagaca

SEQ ID NO: 33309 - DNA, 25 bp, S. cerevisiae
gacaaggctaacttccaaggtgcta

SEQ ID NO: 33310 - DNA, 25 bp, S. cerevisiae
gacaacgtcaacttaagagcccaca

SEQ ID NO: 33311 - DNA, 25 bp, S. cerevisiae
gacagactccggtaagatttctttg

SEQ ID NO: 33312 - DNA, 25 bp, S. cerevisiae
gacagcatgcaagctgctttcgatg

SEQ ID NO: 33313 - DNA, 25 bp, S. cerevisiae
gacaagattctcgatcaagacggtg

SEQ ID NO: 33314 - DNA, 25 bp, S. cerevisiae
gacaaagttgcttccagaatctctt

SEQ ID NO: 33315 - DNA, 25 bp, S. cerevisiae
gacagaccttgtttcaagcggattc

SEQ ID NO: 33316 - DNA, 25 bp, S. cerevisiae
gacaaagctgtcatctactcgagag

SEQ ID NO: 33317 - DNA, 25 bp, S. cerevisiae
gacaaagtatggagatcttgcggta

SEQ ID NO: 33318 - DNA, 25 bp, S. cerevisiae
gacaaatgtctctggtttcggtgcc

SEQ ID NO: 33319 - DNA, 25 bp, S. cerevisiae
gacaaatctgctttggttccaggtg

SEQ ID NO: 33320 - DNA, 25 bp, S. cerevisiae
gacaaacgctttatctctcagacga

SEQ ID NO: 33321 - DNA, 25 bp, S. cerevisiae
gacaaatcactcctgaaacccaaga

SEQ ID NO: 33322 - DNA, 25 bp, S. cerevisiae
gacaacattcggtatgcttcctgaa

SEQ ID NO: 33323 - DNA, 25 bp, S. cerevisiae
gacaacattctgcatttagccattg

SEQ ID NO: 33324 - DNA, 25 bp, S. cerevisiae
gacacaatttgcatgttggccaacg

SEQ ID NO: 33325 - DNA, 25 bp, S. cerevisiae
gacaagtacgattatctggccaaag

SEQ ID NO: 33326 - DNA, 25 bp, S. cerevisiae
gacaaacaatcctcccaaatggtga

SEQ ID NO: 33327 - DNA, 25 bp, S. cerevisiae
gacaaccaatcattacccaattctg

SEQ ID NO: 33328 - DNA, 25 bp, S. cerevisiae
gacaagtcttcctacacaagatttg

SEQ ID NO: 33329 - DNA, 25 bp, S. cerevisiae
gacatttctgtcgaccagcaagttg

SEQ ID NO: 33330 - DNA, 25 bp, S. cerevisiae
gacactgccttttctagtatctaca

SEQ ID NO: 33331 - DNA, 25 bp, S. cerevisiae
gacacccatatattctatcgatcca

SEQ ID NO: 33332 - DNA, 25 bp, S. cerevisiae
gacacctatgttagatacgtcatca

SEQ ID NO: 33333 - DNA, 25 bp, S. cerevisiae
gacaactacttggaattgatcgcat

SEQ ID NO: 33334 - DNA, 25 bp, S. cerevisiae
gacaactatctttactatctcgctg

SEQ ID NO: 33335 - DNA, 25 bp, S. cerevisiae
gacaaaattttccagtatgccgaag

SEQ ID NO: 33336 - DNA, 25 bp, S. cerevisiae
gacaaaatttaccttcgcagccaaa

SEQ ID NO: 33337 - DNA, 25 bp, S. cerevisiae
gacataaccgaagaagagcacccaa

SEQ ID NO: 33338 - DNA, 25 bp, S. cerevisiae
gacaaatttgaataacgcctccaga

SEQ ID NO: 33339 - DNA, 25 bp, S. cerevisiae
gacaaagctgcggaagattctcaca

SEQ ID NO: 33340 - DNA, 25 bp, S. cerevisiae
gacagcgaagctagcatcgacgaga

SEQ ID NO: 33341 - DNA, 25 bp, S. cerevisiae
gacaagccgctattagacagcatga

SEQ ID NO: 33342 - DNA, 25 bp, S. cerevisiae
gacaagcaggcttgggtgccagatt

SEQ ID NO: 33343 - DNA, 25 bp, S. cerevisiae
gacagcaatgttggctatgagcgct

SEQ ID NO: 33344 - DNA, 25 bp, S. cerevisiae
gacagcttttcctgatgagccaaaa

SEQ ID NO: 33345 - DNA, 25 bp, S. cerevisiae
gacagctctctcatcaagattgcaa

SEQ ID NO: 33346 - DNA, 25 bp, S. cerevisiae
gacagatgctcaccaatcctgatat

SEQ ID NO: 33347 - DNA, 25 bp, S. cerevisiae
gacactgccgatttcactgatatgg

SEQ ID NO: 33348 - DNA, 25 bp, S. cerevisiae
gacaccctgaagtatctgaacgtaa

SEQ ID NO: 33349 - DNA, 25 bp, S. cerevisiae
gagcaacaccgctgaaaacgtctat

SEQ ID NO: 33350 - DNA, 25 bp, S. cerevisiae
gacagcagctttggatgaaccccta

SEQ ID NO: 33351 - DNA, 25 bp, S. cerevisiae
gactaaagtcgacccttttgcagct

SEQ ID NO: 33352 - DNA, 25 bp, S. cerevisiae
gacaaaattctacgcctgtacttcc

SEQ ID NO: 33353 - DNA, 25 bp, S. cerevisiae
gacaaaaatcttcggctgagtttct

SEQ ID NO: 33354 - DNA, 25 bp, S. cerevisiae
gacaaactatgtctggccgcatctt

SEQ ID NO: 33355 - DNA, 25 bp, S. cerevisiae
gacaacctcattagttaccatcttg

SEQ ID NO: 33356 - DNA, 25 bp, S. cerevisiae
gacagccttgaagcttccaaaactt

SEQ ID NO: 33357 - DNA, 25 bp, S. cerevisiae
gacaccactctaccgtgcataaagg

SEQ ID NO: 33358 - DNA, 25 bp, S. cerevisiae
gactccatctctttgccaatgagaa

SEQ ID NO: 33359 - DNA, 25 bp, S. cerevisiae
gagcttatatcattggccctagatc

SEQ ID NO: 33360 - DNA, 25 bp, S. cerevisiae
gagtttgacagaccccaagctacta

SEQ ID NO: 33361 - DNA, 25 bp, S. cerevisiae
gagctttccggtcgcaatataacta

SEQ ID NO: 33362 - DNA, 25 bp, S. cerevisiae
gacactgactgggaaggagatctct

SEQ ID NO: 33363 - DNA, 25 bp, S. cerevisiae
gacactcctgtaatagaagtcgctg

SEQ ID NO: 33364 - DNA, 25 bp, S. cerevisiae
gacactggtgtctacagaattagca

SEQ ID NO: 33365 - DNA, 25 bp, S. cerevisiae
gacaccgtgatagcgaatttcaact

SEQ ID NO: 33366 - DNA, 25 bp, S. cerevisiae
gacagacgtgaagccatcttgagaa

SEQ ID NO: 33367 - DNA, 25 bp, S. cerevisiae
gacacttcgagaccagatcttgaat

SEQ ID NO: 33368 - DNA, 25 bp, S. cerevisiae
gacacttccgatgagtcttttgaca

SEQ ID NO: 33369 - DNA, 25 bp, S. cerevisiae
gacactgcctcccaaattttaaaat

SEQ ID NO: 33370 - DNA, 25 bp, S. cerevisiae
gacagtcgccattttcattttacag

SEQ ID NO: 33371 - DNA, 25 bp, S. cerevisiae
gacatcgtgaaaatcctaactacaa

SEQ ID NO: 33372 - DNA, 25 bp, S. cerevisiae
gactctgcggaagccacggaagctg

SEQ ID NO: 33373 - DNA, 25 bp, S. cerevisiae
gaccgaatagagtccaccggcgtgg

SEQ ID NO: 33374 - DNA, 25 bp, S. cerevisiae
gagcaggaaactctatcccggtcta

SEQ ID NO: 33375 - DNA, 25 bp, S. cerevisiae
tagcggaaccaggtacccatcggaa

SEQ ID NO: 33376 - DNA, 25 bp, S. cerevisiae
gacttccacaccttacgtgactgga

SEQ ID NO: 33377 - DNA, 25 bp, S. cerevisiae
gacttcccgcaaatgaccaaggcta

SEQ ID NO: 33378 - DNA, 25 bp, S. cerevisiae
gacactccatgcgtattgaccaagg

SEQ ID NO: 33379 - DNA, 25 bp, S. cerevisiae
gacaccgatgtatatggctccagag

SEQ ID NO: 33380 - DNA, 25 bp, S. cerevisiae
gacatctcagtgtcacaatctgctc

SEQ ID NO: 33381 - DNA, 25 bp, S. cerevisiae
gacacagcagctacaatttccactg

SEQ ID NO: 33382 - DNA, 25 bp, S. cerevisiae
gacagaggtagatcttccaagaaac

SEQ ID NO: 33383 - DNA, 25 bp, S. cerevisiae
gacagatggtcaagttgtgcctcaa

SEQ ID NO: 33384 - DNA, 25 bp, S. cerevisiae
gacagggtctaaatggtctcactaa

SEQ ID NO: 33385 - DNA, 25 bp, S. cerevisiae
gacagtttcaaaattttcctacgtg

SEQ ID NO: 33386 - DNA, 25 bp, S. cerevisiae
tgacaggtggcaaaattttttccct

SEQ ID NO: 33387 - DNA, 25 bp, S. cerevisiae
gacaggtttggatcttttctcacac

SEQ ID NO: 33388 - DNA, 25 bp, S. cerevisiae
gacagataagttctccggtaaccaa

SEQ ID NO: 33389 - DNA, 25 bp, S. cerevisiae
gatcaattacctcaccgtttaaaga

SEQ ID NO: 33390 - DNA, 25 bp, S. cerevisiae
gacacatgtatcgtggacggcctta

SEQ ID NO: 33391 - DNA, 25 bp, S. cerevisiae
gacagatttgcgtaacaggccctta

SEQ ID NO: 33392 - DNA, 25 bp, S. cerevisiae
gacaccgtcatttgaacctgttgag

SEQ ID NO: 33393 - DNA, 25 bp, S. cerevisiae
gacaccgacttttacatcctagaca

SEQ ID NO: 33394 - DNA, 25 bp, S. cerevisiae
gacaacaacattttaatagctcagc

SEQ ID NO: 33395 - DNA, 25 bp, S. cerevisiae
gacaaagacactttcttcgctgctg

SEQ ID NO: 33396 - DNA, 25 bp, S. cerevisiae
gacacagaagctttgttagccggta

SEQ ID NO: 33397 - DNA, 25 bp, S. cerevisiae
gacacaatactctttatcccacgat

SEQ ID NO: 33398 - DNA, 25 bp, S. cerevisiae
gacatcgatcaagaaaccacaggtg

SEQ ID NO: 33399 - DNA, 25 bp, S. cerevisiae
gacatggtcgtttattctatcggtt

SEQ ID NO: 33400 - DNA, 25 bp, S. cerevisiae
gacagcgccatttctttcttaggaa

SEQ ID NO: 33401 - DNA, 25 bp, S. cerevisiae
gacactgccatatattttctacaag

SEQ ID NO: 33402 - DNA, 25 bp, S. cerevisiae
gacacctattatcactgtcatgatc

SEQ ID NO: 33403 - DNA, 25 bp, S. cerevisiae
gacactgctactagacacgtcttga

SEQ ID NO: 33404 - DNA, 25 bp, S. cerevisiae
gacagattcctcatattgaccgttg

SEQ ID NO: 33405 - DNA, 25 bp, S. cerevisiae
gactattccattcacgatttgttgt

SEQ ID NO: 33406 - DNA, 25 bp, S. cerevisiae
gacacaatctgaatcctccattttt

SEQ ID NO: 33407 - DNA, 25 bp, S. cerevisiae
gacattgtcaagacctcttctggta

SEQ ID NO: 33408 - DNA, 25 bp, S. cerevisiae
gacttactggtctcattcaggtaga

SEQ ID NO: 33409 - DNA, 25 bp, S. cerevisiae
gacacagattttgcggaggttttac

SEQ ID NO: 33410 - DNA, 25 bp, S. cerevisiae
gacactttctccagtactcttgatt

SEQ ID NO: 33411 - DNA, 25 bp, S. cerevisiae
gacacatttgcaagatagaccgtat

SEQ ID NO: 33412 - DNA, 25 bp, S. cerevisiae
gacacttgatctgggataccgctaa

SEQ ID NO: 33413 - DNA, 25 bp, S. cerevisiae
gacactggattgcattcttcgttca

SEQ ID NO: 33414 - DNA, 25 bp, S. cerevisiae
gacacaggtgtcattttcggtaata

SEQ ID NO: 33415 - DNA, 25 bp, S. cerevisiae
gacatccgcgcaatactacgttaac

SEQ ID NO: 33416 - DNA, 25 bp, S. cerevisiae
gacaccgcaacactttttggagcat

SEQ ID NO: 33417 - DNA, 25 bp, S. cerevisiae
gacacttattcagtttccgggactc

SEQ ID NO: 33418 - DNA, 25 bp, S. cerevisiae
gacagttagttggtatcctcagaga

SEQ ID NO: 33419 - DNA, 25 bp, S. cerevisiae
gacattgtcatgatcactgactcaa

SEQ ID NO: 33420 - DNA, 25 bp, S. cerevisiae
gacatgatgtcaagtgcctgcgaaa

SEQ ID NO: 33421 - DNA, 25 bp, S. cerevisiae
gacagatggagactgcccgtactca

SEQ ID NO: 33422 - DNA, 25 bp, S. cerevisiae
gacactgttaagctcgctcacgaat

SEQ ID NO: 33423 - DNA, 25 bp, S. cerevisiae
gacaccttactggatggcacctgaa

SEQ ID NO: 33424 - DNA, 25 bp, S. cerevisiae
gacgcaatctacagggaacttacta

SEQ ID NO: 33425 - DNA, 25 bp, S. cerevisiae
gaccacatcgacagggagcgcagta

SEQ ID NO: 33426 - DNA, 25 bp, S. cerevisiae
gacactctggtcaagctgaagggta

SEQ ID NO: 33427 - DNA, 25 bp, S. cerevisiae
gacacctggacttctcagtggagaa

SEQ ID NO: 33428 - DNA, 25 bp, S. cerevisiae
gacagctgccataccagatcaggag

SEQ ID NO: 33429 - DNA, 25 bp, S. cerevisiae
gacatcatcatcaatccagtgcggg

SEQ ID NO: 33430 - DNA, 25 bp, S. cerevisiae
gacaccatctcatcatgtctgagga

SEQ ID NO: 33431 - DNA, 25 bp, S. cerevisiae
gacacagccgcaattttagcagatg

SEQ ID NO: 33432 - DNA, 25 bp, S. cerevisiae
gacagtcaattatcatccagttacc

SEQ ID NO: 33433 - DNA, 25 bp, S. cerevisiae
gacattaatttgcaaaggccatcca

SEQ ID NO: 33434 - DNA, 25 bp, S. cerevisiae
gactaaattggtcaatgccgcgccg

SEQ ID NO: 33435 - DNA, 25 bp, S. cerevisiae
gacagaagcattcggtaggctctcc

SEQ ID NO: 33436 - DNA, 25 bp, S. cerevisiae
gactcggtcggaaaggatacctttg

SEQ ID NO: 33437 - DNA, 25 bp, S. cerevisiae
gacagttggaagcatcggtttcata

SEQ ID NO: 33438 - DNA, 25 bp, S. cerevisiae
gacattgcttgatgaacgccgtact

SEQ ID NO: 33439 - DNA, 25 bp, S. cerevisiae
gacagatttttacccctaagaacat

SEQ ID NO: 33440 - DNA, 25 bp, S. cerevisiae
gacattactgttttcctttacgcaa

SEQ ID NO: 33441 - DNA, 25 bp, S. cerevisiae
gacataccaggctattcttttctaa

SEQ ID NO: 33442 - DNA, 25 bp, S. cerevisiae
gacaggcctgtggatttcgtgacaa

SEQ ID NO: 33443 - DNA, 25 bp, S. cerevisiae
gacagtctctgtcaggtccaataag

SEQ ID NO: 33444 - DNA, 25 bp, S. cerevisiae
gacacttctaggtcatatttggaca

SEQ ID NO: 33445 - DNA, 25 bp, S. cerevisiae
gacacttctgctttcttgtgagtat

SEQ ID NO: 33446 - DNA, 25 bp, S. cerevisiae
gacatcaagatcctggctctgttta

SEQ ID NO: 33447 - DNA, 25 bp, S. cerevisiae
gacagcataatcaccgtatcatata

SEQ ID NO: 33448 - DNA, 25 bp, S. cerevisiae
gacagcaagtcagtccgctaatctc

SEQ ID NO: 33449 - DNA, 25 bp, S. cerevisiae
gacagcttcatcgataccaagatct

SEQ ID NO: 33450 - DNA, 25 bp, S. cerevisiae
gaccgtacggccagagagcagatgt

SEQ ID NO: 33451 - DNA, 25 bp, S. cerevisiae
gacatcgtaccccataaaatcagct

SEQ ID NO: 33452 - DNA, 25 bp, S. cerevisiae
gacgcggaaaccgtttttgctagag

SEQ ID NO: 33453 - DNA, 25 bp, S. cerevisiae
gacacggaatatccttcttatttaa

SEQ ID NO: 33454 - DNA, 25 bp, S. cerevisiae
gacactggtcacacaatttcatatc

SEQ ID NO: 33455 - DNA, 25 bp, S. cerevisiae
gacatgtgggacgaaagcttactca

SEQ ID NO: 33456 - DNA, 25 bp, S. cerevisiae
gacagtgtggccaagacagctactt

SEQ ID NO: 33457 - DNA, 25 bp, S. cerevisiae
gacagctgtctggagaaatcttttt

SEQ ID NO: 33458 - DNA, 25 bp, S. cerevisiae
gacagttctggtggattcttctacg

SEQ ID NO: 33459 - DNA, 25 bp, S. cerevisiae
gacagcttcgagaattacttcaacc

SEQ ID NO: 33460 - DNA, 25 bp, S. cerevisiae
gacagctgtcgcagattgcactaca

SEQ ID NO: 33461 - DNA, 25 bp, S. cerevisiae
gacatggatcgaaatctccggcact

SEQ ID NO: 33462 - DNA, 25 bp, S. cerevisiae
gacattacgaatgcacacggtgtgg

SEQ ID NO: 33463 - DNA, 25 bp, S. cerevisiae
gacattcgatgcaaacggcgacgca

SEQ ID NO: 33464 - DNA, 25 bp, S. cerevisiae
gacagtaatcaactcggctgacgat

SEQ ID NO: 33465 - DNA, 25 bp, S. cerevisiae
gacagatgtctccacgcggcaaaat

SEQ ID NO: 33466 - DNA, 25 bp, S. cerevisiae
gacagtacctgctgctgtggtaaca

SEQ ID NO: 33467 - DNA, 25 bp, S. cerevisiae
gacattcctgtagcacatacgaaca

SEQ ID NO: 33468 - DNA, 25 bp, S. cerevisiae
gactatgccgtatatcaacccaatc

SEQ ID NO: 33469 - DNA, 25 bp, S. cerevisiae
gacattgacgcttacatagacacca

SEQ ID NO: 33470 - DNA, 25 bp, S. cerevisiae
gacacgcaactaaatgagcaccact

SEQ ID NO: 33471 - DNA, 25 bp, S. cerevisiae
gacaccagaacagatagaatactta

SEQ ID NO: 33472 - DNA, 25 bp, S. cerevisiae
gacacccaactcataagtagttcag

SEQ ID NO: 33473 - DNA, 25 bp, S. cerevisiae
gacagcccagtcaaggaatttttca

SEQ ID NO: 33474 - DNA, 25 bp, S. cerevisiae
gacacctttccatattgcttgttca

SEQ ID NO: 33475 - DNA, 25 bp, S. cerevisiae
gacattgttggttcatcctggagcc

SEQ ID NO: 33476 - DNA, 25 bp, S. cerevisiae
gagcttggcaaactaaccgaggatt

SEQ ID NO: 33477 - DNA, 25 bp, S. cerevisiae
gactttgcttaccaacagtgggcta

SEQ ID NO: 33478 - DNA, 25 bp, S. cerevisiae
gacactctttcagaagggacgctcc

SEQ ID NO: 33479 - DNA, 25 bp, S. cerevisiae
gacacgttctatgagcgaggccact

SEQ ID NO: 33480 - DNA, 25 bp, S. cerevisiae
gacacgttgtatgattttggcatct

SEQ ID NO: 33481 - DNA, 25 bp, S. cerevisiae
gacacctgtagtttaattgactctg

SEQ ID NO: 33482 - DNA, 25 bp, S. cerevisiae
gacattcgacgttaaattggtttct

SEQ ID NO: 33483 - DNA, 25 bp, S. cerevisiae
gacttggtccaatcacgtttcaaca

SEQ ID NO: 33484 - DNA, 25 bp, S. cerevisiae
gacatctgggtaatcaccacttctc

SEQ ID NO: 33485 - DNA, 25 bp, S. cerevisiae
gacacggatgtggtcatctccatta

SEQ ID NO: 33486 - DNA, 25 bp, S. cerevisiae
gacacgagagcctatttcctataag

SEQ ID NO: 33487 - DNA, 25 bp, S. cerevisiae
gacagcgtattcttagagatgccca

SEQ ID NO: 33488 - DNA, 25 bp, S. cerevisiae
gacatggtatcatttagggcccaaa

SEQ ID NO: 33489 - DNA, 25 bp, S. cerevisiae
gacggcgatacgttgggcccagtaa

SEQ ID NO: 33490 - DNA, 25 bp, S. cerevisiae
gttggtgacaagtgggaaagctact

SEQ ID NO: 33491 - DNA, 25 bp, S. cerevisiae
gactgggtcaggtgtaattacgagt

SEQ ID NO: 33492 - DNA, 25 bp, S. cerevisiae
gactaggcctagtgttcttgaagag

SEQ ID NO: 33493 - DNA, 25 bp, S. cerevisiae
gacttggccgagctgatacttgaaa

SEQ ID NO: 33494 - DNA, 25 bp, S. cerevisiae
gacagttacctatacatcgacccaa

SEQ ID NO: 33495 - DNA, 25 bp, S. cerevisiae
gactctttcgctgccaactggggtg

SEQ ID NO: 33496 - DNA, 25 bp, S. cerevisiae
gactactcattaagccctattcagg

SEQ ID NO: 33497 - DNA, 25 bp, S. cerevisiae
gacattgtattaccggattccgaat

SEQ ID NO: 33498 - DNA, 25 bp, S. cerevisiae
gacttggtttggtctgatccggaag

SEQ ID NO: 33499 - DNA, 25 bp, S. cerevisiae
gacattttctatcgtcagtttggaa

SEQ ID NO: 33500 - DNA, 25 bp, S. cerevisiae
gacattttttcaccgattctggcta

SEQ ID NO: 33501 - DNA, 25 bp, S. cerevisiae
gacatcgtcgctcaaggatttggct

SEQ ID NO: 33502 - DNA, 25 bp, S. cerevisiae
gactcgaggtggtaggttttctatc

SEQ ID NO: 33503 - DNA, 25 bp, S. cerevisiae
gactctccgggccagttattaagtg

SEQ ID NO: 33504 - DNA, 25 bp, S. cerevisiae
gactccggttcgcaattcttggagg

SEQ ID NO: 33505 - DNA, 25 bp, S. cerevisiae
gacagatattgccactcagggcttg

SEQ ID NO: 33506 - DNA, 25 bp, S. cerevisiae
gacgacttcagagagggtagatcca

SEQ ID NO: 33507 - DNA, 25 bp, S. cerevisiae
gacttcgtgctgacaagctctatga

SEQ ID NO: 33508 - DNA, 25 bp, S. cerevisiae
gacatcagtagtgtgctggctgaaa

SEQ ID NO: 33509 - DNA, 25 bp, S. cerevisiae
gagcttgtgcaatgggagtgccaat

SEQ ID NO: 33510 - DNA, 25 bp, S. cerevisiae
gacttggtccattgcaagtgccaat

SEQ ID NO: 33511 - DNA, 25 bp, S. cerevisiae
gacttcagaggattgccacatcgca

SEQ ID NO: 33512 - DNA, 25 bp, S. cerevisiae
gactctatctaagcaaccgcggttt

SEQ ID NO: 33513 - DNA, 25 bp, S. cerevisiae
gacagtattaagtaccacggcgatt

SEQ ID NO: 33514 - DNA, 25 bp, S. cerevisiae
gacagtacacaattatccaaccgga

SEQ ID NO: 33515 - DNA, 25 bp, S. cerevisiae
gacagagtcgccagtttccaagaga

SEQ ID NO: 33516 - DNA, 25 bp, S. cerevisiae
gacagcgaacattatggtagcgtac

SEQ ID NO: 33517 - DNA, 25 bp, S. cerevisiae
gacatcgaagcttggatgccaggaa

SEQ ID NO: 33518 - DNA, 25 bp, S. cerevisiae
gacagtatccgtttcgagcagttca

SEQ ID NO: 33519 - DNA, 25 bp, S. cerevisiae
gacgttgcggtaacgacttcgtata

SEQ ID NO: 33520 - DNA, 25 bp, S. cerevisiae
gactttcaagtgaccgactccaata

SEQ ID NO: 33521 - DNA, 25 bp, S. cerevisiae
gactttatgggcgtccagttcaatt

SEQ ID NO: 33522 - DNA, 25 bp, S. cerevisiae
gactctgagctatccgcaatgggta

SEQ ID NO: 33523 - DNA, 25 bp, S. cerevisiae
gacatcagctcaaacccaattaggg

SEQ ID NO: 33524 - DNA, 25 bp, S. cerevisiae
gacataccagtacttcatattgaga

SEQ ID NO: 33525 - DNA, 25 bp, S. cerevisiae
gacagagccctattggatattgaca

SEQ ID NO: 33526 - DNA, 25 bp, S. cerevisiae
gactaggtagactattttacgtcat

SEQ ID NO: 33527 - DNA, 25 bp, S. cerevisiae
gacggcaagtcaggtcgttacgtat

SEQ ID NO: 33528 - DNA, 25 bp, S. cerevisiae
gacaggcaatgtccttttaccagtt

SEQ ID NO: 33529 - DNA, 25 bp, S. cerevisiae
gacaggaggattctctcatcaccat

SEQ ID NO: 33530 - DNA, 25 bp, S. cerevisiae
gacaggcagagttttctgacgcaca

SEQ ID NO: 33531 - DNA, 25 bp, S. cerevisiae
gacaggcacagttttccatacaacc

SEQ ID NO: 33532 - DNA, 25 bp, S. cerevisiae
gacaggccactgtgactgctacaaa

SEQ ID NO: 33533 - DNA, 25 bp, S. cerevisiae
gacatactgcccttactgtaaagct

SEQ ID NO: 33534 - DNA, 25 bp, S. cerevisiae
gacatcactgcttcctacgataaag

SEQ ID NO: 33535 - DNA, 25 bp, S. cerevisiae
gactatgcttatgccaagttacttg

SEQ ID NO: 33536 - DNA, 25 bp, S. cerevisiae
gacatatcgttcaccgtacctgttg

SEQ ID NO: 33537 - DNA, 25 bp, S. cerevisiae
gacagagtacaacgatcaccgcctg

SEQ ID NO: 33538 - DNA, 25 bp, S. cerevisiae
gacagcatgtccaaaggcaccggtg

SEQ ID NO: 33539 - DNA, 25 bp, S. cerevisiae
gacagcatctgatcttgcagaccgg

SEQ ID NO: 33540 - DNA, 25 bp, S. cerevisiae
gacatgtctgatatctcggatctcg

SEQ ID NO: 33541 - DNA, 25 bp, S. cerevisiae
gacatgctctatttgcggtggctac

SEQ ID NO: 33542 - DNA, 25 bp, S. cerevisiae
gacattattgatacctctgcagcta

SEQ ID NO: 33543 - DNA, 25 bp, S. cerevisiae
gacattcgacacgtctttgctttat

SEQ ID NO: 33544 - DNA, 25 bp, S. cerevisiae
gacttcgaaattttatctcgtctac

SEQ ID NO: 33545 - DNA, 25 bp, S. cerevisiae
gacttcgtttggtattctattgccc

SEQ ID NO: 33546 - DNA, 25 bp, S. cerevisiae
gacttggtttcctttggtgtggctc

SEQ ID NO: 33547 - DNA, 25 bp, S. cerevisiae
gacttggatttcttacttggtacgg

SEQ ID NO: 33548 - DNA, 25 bp, S. cerevisiae
gaggttgtacctgacttagtatcgt

SEQ ID NO: 33549 - DNA, 25 bp, S. cerevisiae
gagattggctaacgttactaacttt

SEQ ID NO: 33550 - DNA, 25 bp, S. cerevisiae
gacagtgctcacttcgatgtcaagc

SEQ ID NO: 33551 - DNA, 25 bp, S. cerevisiae
gactagctgagatctaccgcaatag

SEQ ID NO: 33552 - DNA, 25 bp, S. cerevisiae
gacatagcattgtttcagcctccaa

SEQ ID NO: 33553 - DNA, 25 bp, S. cerevisiae
gacattaatctttgcttctacgaaa

SEQ ID NO: 33554 - DNA, 25 bp, S. cerevisiae
gacattggtagttgtttgattgcca

SEQ ID NO: 33555 - DNA, 25 bp, S. cerevisiae
gacattgggtagattggcttcagca

SEQ ID NO: 33556 - DNA, 25 bp, S. cerevisiae
gacatccatggcaacagtttcgaca

SEQ ID NO: 33557 - DNA, 25 bp, S. cerevisiae
gacttccttgtttatgtggagcacc

SEQ ID NO: 33558 - DNA, 25 bp, S. cerevisiae
gacattcctggcattactgatgaca

SEQ ID NO: 33559 - DNA, 25 bp, S. cerevisiae
gacatggtgctctatttgactatcc

SEQ ID NO: 33560 - DNA, 25 bp, S. cerevisiae
gacatcatgtcctaggctgagcgtt

SEQ ID NO: 33561 - DNA, 25 bp, S. cerevisiae
gacttgtctacgttgagggctttta

SEQ ID NO: 33562 - DNA, 25 bp, S. cerevisiae
gactatttggccaagacggttgctt

SEQ ID NO: 33563 - DNA, 25 bp, S. cerevisiae
gactacctggtatgactgtggcgct

SEQ ID NO: 33564 - DNA, 25 bp, S. cerevisiae
gactttctactacatttgccaggag

SEQ ID NO: 33565 - DNA, 25 bp, S. cerevisiae
gacttattgattcttattgccttgg

SEQ ID NO: 33566 - DNA, 25 bp, S. cerevisiae
gactttggaaccatttgtctacgag

SEQ ID NO: 33567 - DNA, 25 bp, S. cerevisiae
gactttaattgtcatttaccatgct

SEQ ID NO: 33568 - DNA, 25 bp, S. cerevisiae
gactctttaagtcagtgggctcctt

SEQ ID NO: 33569 - DNA, 25 bp, S. cerevisiae
gactttattcagtgatctgggcttt

SEQ ID NO: 33570 - DNA, 25 bp, S. cerevisiae
gacttctatgtggttttgacgttgt

SEQ ID NO: 33571 - DNA, 25 bp, S. cerevisiae
gacagttctgaaattctgggcttga

SEQ ID NO: 33572 - DNA, 25 bp, S. cerevisiae
gacagcaacttaatctggcaatgtt

SEQ ID NO: 33573 - DNA, 25 bp, S. cerevisiae
gacagaactatcttgaccatcgcgc

SEQ ID NO: 33574 - DNA, 25 bp, S. cerevisiae
gacatagactatgaggccaccgaag

SEQ ID NO: 33575 - DNA, 25 bp, S. cerevisiae
gacaggtgcttagtggtttctgcca

SEQ ID NO: 33576 - DNA, 25 bp, S. cerevisiae
gacagttgctgatctgttttcagac

SEQ ID NO: 33577 - DNA, 25 bp, S. cerevisiae
gactacgacccaattttgatgtttg

SEQ ID NO: 33578 - DNA, 25 bp, S. cerevisiae
gactcaacgcatcagttaactttta

SEQ ID NO: 33579 - DNA, 25 bp, S. cerevisiae
gacatccgtcagtaggtatccttct

SEQ ID NO: 33580 - DNA, 25 bp, S. cerevisiae
gacaggcgttgaaggctaccatgat

SEQ ID NO: 33581 - DNA, 25 bp, S. cerevisiae
gacatgttggccaagatgacaccag

SEQ ID NO: 33582 - DNA, 25 bp, S. cerevisiae
gacaggatgtccattgaacctcaat

SEQ ID NO: 33583 - DNA, 25 bp, S. cerevisiae
gacaggatagtcgttgaccgctatt

SEQ ID NO: 33584 - DNA, 25 bp, S. cerevisiae
gacagtaacttgatgacgcgcacga

SEQ ID NO: 33585 - DNA, 25 bp, S. cerevisiae
gacagtgtacggatatctgacatct

SEQ ID NO: 33586 - DNA, 25 bp, S. cerevisiae
gacagtgtaccatcttctgcaacga

SEQ ID NO: 33587 - DNA, 25 bp, S. cerevisiae
gacagtcgagtctacgttccaagat

SEQ ID NO: 33588 - DNA, 25 bp, S. cerevisiae
gacagtatagttacatctttgccaa

SEQ ID NO: 33589 - DNA, 25 bp, S. cerevisiae
gacagttacttttcttctggaaacg

SEQ ID NO: 33590 - DNA, 25 bp, S. cerevisiae
gacagtgaacttgacttcgctgaag

SEQ ID NO: 33591 - DNA, 25 bp, S. cerevisiae
gactcccacagtgatggcattctat

SEQ ID NO: 33592 - DNA, 25 bp, S. cerevisiae
gacatcgtggctattatgccctaaa

SEQ ID NO: 33593 - DNA, 25 bp, S. cerevisiae
gacaggtgacattattgattccgaa

SEQ ID NO: 33594 - DNA, 25 bp, S. cerevisiae
gacagttctgtcaattcttcggaag

SEQ ID NO: 33595 - DNA, 25 bp, S. cerevisiae
gacatggattggcatccttcctgaa

SEQ ID NO: 33596 - DNA, 25 bp, S. cerevisiae
gacagaagcgagtcatcctctcatt

SEQ ID NO: 33597 - DNA, 25 bp, S. cerevisiae
gacagtgactattgcatcctcttta

SEQ ID NO: 33598 - DNA, 25 bp, S. cerevisiae
gacagattcttatccctattcaaat

SEQ ID NO: 33599 - DNA, 25 bp, S. cerevisiae
gacatagttattaccctcgtcaata

SEQ ID NO: 33600 - DNA, 25 bp, S. cerevisiae
gacatctgctcaatactacgttaat

SEQ ID NO: 33601 - DNA, 25 bp, S. cerevisiae
gactttaatggcgaccttgttccac

SEQ ID NO: 33602 - DNA, 25 bp, S. cerevisiae
gacatgatatcgttattgccttggt

SEQ ID NO: 33603 - DNA, 25 bp, S. cerevisiae
gacaggtttccttctaagccataca

SEQ ID NO: 33604 - DNA, 25 bp, S. cerevisiae
gacaggattccgcttattattggat

SEQ ID NO: 33605 - DNA, 25 bp, S. cerevisiae
gacatggttccacaaatctttaaag

SEQ ID NO: 33606 - DNA, 25 bp, S. cerevisiae
gacagtgccatcatacaatcagtac

SEQ ID NO: 33607 - DNA, 25 bp, S. cerevisiae
gacatggccatccttaatgacttgc

SEQ ID NO: 33608 - DNA, 25 bp, S. cerevisiae
gacaggcattcaccacaatactttg

SEQ ID NO: 33609 - DNA, 25 bp, S. cerevisiae
gacaggatatccaaccattgctttg

SEQ ID NO: 33610 - DNA, 25 bp, S. cerevisiae
gacagtctataccagagctctttag

SEQ ID NO: 33611 - DNA, 25 bp, S. cerevisiae
gacgttctcgacaagactggcggca

SEQ ID NO: 33612 - DNA, 25 bp, S. cerevisiae
gactattgcagttccatggtgtttc

SEQ ID NO: 33613 - DNA, 25 bp, S. cerevisiae
gacttagaatcgtttctgccaggaa

SEQ ID NO: 33614 - DNA, 25 bp, S. cerevisiae
gactaacgtcgttgtcgcttacgaa

SEQ ID NO: 33615 - DNA, 25 bp, S. cerevisiae
gactagatcacttttgacgcctacg

SEQ ID NO: 33616 - DNA, 25 bp, S. cerevisiae
gacatcgtctttgcaatcgtctatg

SEQ ID NO: 33617 - DNA, 25 bp, S. cerevisiae
gacagattctttgctattttcatgg

SEQ ID NO: 33618 - DNA, 25 bp, S. cerevisiae
gacagtttctgtccttggtattgca

SEQ ID NO: 33619 - DNA, 25 bp, S. cerevisiae
gacatcgttcagttggtgggttcag

SEQ ID NO: 33620 - DNA, 25 bp, S. cerevisiae
gacatctttaaagttggcgtcaaga

SEQ ID NO: 33621 - DNA, 25 bp, S. cerevisiae
gacatctccaactgccatcaaaaat

SEQ ID NO: 33622 - DNA, 25 bp, S. cerevisiae
gacatatacgactccatcattcaca

SEQ ID NO: 33623 - DNA, 25 bp, S. cerevisiae
gacatatatatacccacacactctc

SEQ ID NO: 33624 - DNA, 25 bp, S. cerevisiae
gacatatatatacccacacactctc

SEQ ID NO: 33625 - DNA, 25 bp, S. cerevisiae
gacatatatatacaccacacccaca

SEQ ID NO: 33626 - DNA, 25 bp, S. cerevisiae
gacatatatatacaccacacccaca

SEQ ID NO: 33627 - DNA, 25 bp, S. cerevisiae
gacatttattcatctacaggctgca

SEQ ID NO: 33628 - DNA, 25 bp, S. cerevisiae
gacaggttgatcaaatcatctccat

SEQ ID NO: 33629 - DNA, 25 bp, S. cerevisiae
gacatggctgctactttcattgcta

SEQ ID NO: 33630 - DNA, 25 bp, S. cerevisiae
gacatgggcttcttcgatttcgata

SEQ ID NO: 33631 - DNA, 25 bp, S. cerevisiae
gacagtggtgattacgctttgcaga

SEQ ID NO: 33632 - DNA, 25 bp, S. cerevisiae
gacttctgctgttgccgctttgacc

SEQ ID NO: 33633 - DNA, 25 bp, S. cerevisiae
gacattacgcaggaagattcactac

SEQ ID NO: 33634 - DNA, 25 bp, S. cerevisiae
gacatataccgctcatcattcaaac

SEQ ID NO: 33635 - DNA, 25 bp, S. cerevisiae
gactagaccttcagcaggccaagaa

SEQ ID NO: 33636 - DNA, 25 bp, S. cerevisiae
gacttgagtgccgaggacattcctg

SEQ ID NO: 33637 - DNA, 25 bp, S. cerevisiae
gacttttgccaacgaatctgactat

SEQ ID NO: 33638 - DNA, 25 bp, S. cerevisiae
gactactctccgatgaatttctttt

SEQ ID NO: 33639 - DNA, 25 bp, S. cerevisiae
gactagactgccgatatctaatttg

SEQ ID NO: 33640 - DNA, 25 bp, S. cerevisiae
gactcgacgcacttacttgttagga

SEQ ID NO: 33641 - DNA, 25 bp, S. cerevisiae
gactctccgacttactggactggaa

SEQ ID NO: 33642 - DNA, 25 bp, S. cerevisiae
gactctcaaacgatgtgcccattgt

SEQ ID NO: 33643 - DNA, 25 bp, S. cerevisiae
gacttcaccaccattgaacacttgt

SEQ ID NO: 33644 - DNA, 25 bp, S. cerevisiae
gactatcgacctattcaatcatttt

SEQ ID NO: 33645 - DNA, 25 bp, S. cerevisiae
gactattggttcatggaacgtctct

SEQ ID NO: 33646 - DNA, 25 bp, S. cerevisiae
gactctggtgttgggaagacctcct

SEQ ID NO: 33647 - DNA, 25 bp, S. cerevisiae
gactgcggtaatggtaagcctattt

SEQ ID NO: 33648 - DNA, 25 bp, S. cerevisiae
gaccgtggaaagtgtgttgatctct

SEQ ID NO: 33649 - DNA, 25 bp, S. cerevisiae
gacttaaacatctgtcgtcaatgtt

SEQ ID NO: 33650 - DNA, 25 bp, S. cerevisiae
gactgtcaagaacactcctcattta

SEQ ID NO: 33651 - DNA, 25 bp, S. cerevisiae
gacttctcgaatccaggcttttcaa

SEQ ID NO: 33652 - DNA, 25 bp, S. cerevisiae
gacatcgattccagttcagcaaaat

SEQ ID NO: 33653 - DNA, 25 bp, S. cerevisiae
gacatcgatgactacgttcacagaa

SEQ ID NO: 33654 - DNA, 25 bp, S. cerevisiae
gactcttgccaagatccaagcgttt

SEQ ID NO: 33655 - DNA, 25 bp, S. cerevisiae
gacttgatgctcttggttactgacc

SEQ ID NO: 33656 - DNA, 25 bp, S. cerevisiae
gacttgcaagctcggttgaacactt

SEQ ID NO: 33657 - DNA, 25 bp, S. cerevisiae
gacattaggtactatttgctccgaa

SEQ ID NO: 33658 - DNA, 25 bp, S. cerevisiae
gactgtcaacccaaacgtcaatgaa

SEQ ID NO: 33659 - DNA, 25 bp, S. cerevisiae
gactttccgcacttgattgtttcga

SEQ ID NO: 33660 - DNA, 25 bp, S. cerevisiae
gacataccaagcattgtttctactg

SEQ ID NO: 33661 - DNA, 25 bp, S. cerevisiae
gacatattactgctgctttactcca

SEQ ID NO: 33662 - DNA, 25 bp, S. cerevisiae
gacttcgttggtatcaacccacatg

SEQ ID NO: 33663 - DNA, 25 bp, S. cerevisiae
gactcgcgattgtatcatggtagca

SEQ ID NO: 33664 - DNA, 25 bp, S. cerevisiae
gacatgctgcgaggctatcatttca

SEQ ID NO: 33665 - DNA, 25 bp, S. cerevisiae
gacatggaagactatctgttcaatc

SEQ ID NO: 33666 - DNA, 25 bp, S. cerevisiae
gacatcgacgattatatttccccta

SEQ ID NO: 33667 - DNA, 25 bp, S. cerevisiae
gactttagactatactgtcctgcta

SEQ ID NO: 33668 - DNA, 25 bp, S. cerevisiae
gacttataccactttgctctcaatt

SEQ ID NO: 33669 - DNA, 25 bp, S. cerevisiae
gactatgagtctccaattccacagg

SEQ ID NO: 33670 - DNA, 25 bp, S. cerevisiae
gacatatggtcctctggctgcgtaa

SEQ ID NO: 33671 - DNA, 25 bp, S. cerevisiae
gacatatggtcccttgagtgcctca

SEQ ID NO: 33672 - DNA, 25 bp, S. cerevisiae
gacatgtttttcaattcacgtttcg

SEQ ID NO: 33673 - DNA, 25 bp, S. cerevisiae
gacattttgttcgatatccctgaag

SEQ ID NO: 33674 - DNA, 25 bp, S. cerevisiae
gacatttgatttgcttcctctaaaa

SEQ ID NO: 33675 - DNA, 25 bp, S. cerevisiae
gacatttgttattaccgcactctaa

SEQ ID NO: 33676 - DNA, 25 bp, S. cerevisiae
gactcttgcaacttaatccggatat

SEQ ID NO: 33677 - DNA, 25 bp, S. cerevisiae
gacttattaactccactcgaatgtg

SEQ ID NO: 33678 - DNA, 25 bp, S. cerevisiae
gactttgtaatttcatcacctcagg

SEQ ID NO: 33679 - DNA, 25 bp, S. cerevisiae
gacgaaaacaagactagagtcagat

SEQ ID NO: 33680 - DNA, 25 bp, S. cerevisiae
gactctgacagagaagcttccagcg

SEQ ID NO: 33681 - DNA, 25 bp, S. cerevisiae
gacttgagcaatcaacttgtcagta

SEQ ID NO: 33682 - DNA, 25 bp, S. cerevisiae
gacattgcagcattcttgtttacat

SEQ ID NO: 33683 - DNA, 25 bp, S. cerevisiae
gacatatctcgttctgtttggcatg

SEQ ID NO: 33684 - DNA, 25 bp, S. cerevisiae
gacatactagattctatggcttgga

SEQ ID NO: 33685 - DNA, 25 bp, S. cerevisiae
gacatattcattgcgctctgtcatt

SEQ ID NO: 33686 - DNA, 25 bp, S. cerevisiae
gacatgtactgatcgttccactgag

SEQ ID NO: 33687 - DNA, 25 bp, S. cerevisiae
gacattcactgattttgtcgcccag

SEQ ID NO: 33688 - DNA, 25 bp, S. cerevisiae
gacatgctcttggattattcccaca

SEQ ID NO: 33689 - DNA, 25 bp, S. cerevisiae
gacatccagtattatttcacgcaat

SEQ ID NO: 33690 - DNA, 25 bp, S. cerevisiae
gactcaaatgagtgctatgacggaa

SEQ ID NO: 33691 - DNA, 25 bp, S. cerevisiae
gacgtcaaagacctgcatgagtgga

SEQ ID NO: 33692 - DNA, 25 bp, S. cerevisiae
gactgcagcagattatcccatgggt

SEQ ID NO: 33693 - DNA, 25 bp, S. cerevisiae
gacatgtttttgtgcccagaggtaa

SEQ ID NO: 33694 - DNA, 25 bp, S. cerevisiae
gacatgtttgccaagtaccgcttat

SEQ ID NO: 33695 - DNA, 25 bp, S. cerevisiae
gagctacctgctaggtttcggtaca

SEQ ID NO: 33696 - DNA, 25 bp, S. cerevisiae
gactctcatcttagaaccgctggaa

SEQ ID NO: 33697 - DNA, 25 bp, S. cerevisiae
gactacatatctgaccacatctgga

SEQ ID NO: 33698 - DNA, 25 bp, S. cerevisiae
gactacaacagcaccatcacataag

SEQ ID NO: 33699 - DNA, 25 bp, S. cerevisiae
gactatctaaccagcatccagacag

SEQ ID NO: 33700 - DNA, 25 bp, S. cerevisiae
gacttctatatcatcgtcaccagga

SEQ ID NO: 33701 - DNA, 25 bp, S. cerevisiae
gacatctgtaacatcttcaccaaag

SEQ ID NO: 33702 - DNA, 25 bp, S. cerevisiae
gacatttcgagcctttacttgagag

SEQ ID NO: 33703 - DNA, 25 bp, S. cerevisiae
gactccagaggcgttcttccaaaag

SEQ ID NO: 33704 - DNA, 25 bp, S. cerevisiae
gactcatgacgattacagcgatcag

SEQ ID NO: 33705 - DNA, 25 bp, S. cerevisiae
gacataattgacagcatcgacgatt

SEQ ID NO: 33706 - DNA, 25 bp, S. cerevisiae
gacatcgttaccgtcggccaatgta

SEQ ID NO: 33707 - DNA, 25 bp, S. cerevisiae
gacattttcacacagggctcaggat

SEQ ID NO: 33708 - DNA, 25 bp, S. cerevisiae
gactttatcatctacgggccggaaa

SEQ ID NO: 33709 - DNA, 25 bp, S. cerevisiae
gacattatgttcatccagttgcgaa

SEQ ID NO: 33710 - DNA, 25 bp, S. cerevisiae
gacattttccacttcattatcgatg

SEQ ID NO: 33711 - DNA, 25 bp, S. cerevisiae
gacttttctcaatcttaccagcaag

SEQ ID NO: 33712 - DNA, 25 bp, S. cerevisiae
gacattattcgcgatttgtggccaa

SEQ ID NO: 33713 - DNA, 25 bp, S. cerevisiae
gacattactgcagtgttttggcata

SEQ ID NO: 33714 - DNA, 25 bp, S. cerevisiae
gacatcaaagctcacccatggttta

SEQ ID NO: 33715 - DNA, 25 bp, S. cerevisiae
gacatacctcattgatgctctgcta

SEQ ID NO: 33716 - DNA, 25 bp, S. cerevisiae
gacttccatattatctctgatttca

SEQ ID NO: 33717 - DNA, 25 bp, S. cerevisiae
gactatcaaatcttacgttgctggt

SEQ ID NO: 33718 - DNA, 25 bp, S. cerevisiae
gactaagattattggtaaaagctgg

SEQ ID NO: 33719 - DNA, 25 bp, S. cerevisiae
gactcagtttttctacaaccatgga

SEQ ID NO: 33720 - DNA, 25 bp, S. cerevisiae
gaccatgggatatggcatactccgt

SEQ ID NO: 33721 - DNA, 25 bp, S. cerevisiae
gactttgaattggtatcgcccttcc

SEQ ID NO: 33722 - DNA, 25 bp, S. cerevisiae
gacgttgaagtttaccgtccatcct

SEQ ID NO: 33723 - DNA, 25 bp, S. cerevisiae
gacgttgaaaaatcaccaccgccat

SEQ ID NO: 33724 - DNA, 25 bp, S. cerevisiae
gacgtcttaaaatactgcccattcg

SEQ ID NO: 33725 - DNA, 25 bp, S. cerevisiae
gacattatccttttcaaagctccta

SEQ ID NO: 33726 - DNA, 25 bp, S. cerevisiae
gacatttgactttttcagaggccaa

SEQ ID NO: 33727 - DNA, 25 bp, S. cerevisiae
gacttagtctttagtttatcccagg

SEQ ID NO: 33728 - DNA, 25 bp, S. cerevisiae
gactatggtcgtatctttttgcaag

SEQ ID NO: 33729 - DNA, 25 bp, S. cerevisiae
gacattccgattatgttctgcagta

SEQ ID NO: 33730 - DNA, 25 bp, S. cerevisiae
gacattccttgttttcttcagcatt

SEQ ID NO: 33731 - DNA, 25 bp, S. cerevisiae
gacatcatctcttttacttcaacat

SEQ ID NO: 33732 - DNA, 25 bp, S. cerevisiae
gactacctgactccatgatgaattc

SEQ ID NO: 33733 - DNA, 25 bp, S. cerevisiae
gactagtgctgaaccattggatcct

SEQ ID NO: 33734 - DNA, 25 bp, S. cerevisiae
gacatttactgacccaccatttaga

SEQ ID NO: 33735 - DNA, 25 bp, S. cerevisiae
gactttgaggaccataccttcttga

SEQ ID NO: 33736 - DNA, 25 bp, S. cerevisiae
gactttgaccaccactgctttgtta

SEQ ID NO: 33737 - DNA, 25 bp, S. cerevisiae
gacttgctaggctacactggtattc

SEQ ID NO: 33738 - DNA, 25 bp, S. cerevisiae
gacatactgggctcagattctgatt

SEQ ID NO: 33739 - DNA, 25 bp, S. cerevisiae
gactacggctaaagactctattgca

SEQ ID NO: 33740 - DNA, 25 bp, S. cerevisiae
gactacgttctggaagcatcaatta

SEQ ID NO: 33741 - DNA, 25 bp, S. cerevisiae
gacttggctaatttggattctttgg

SEQ ID NO: 33742 - DNA, 25 bp, S. cerevisiae
gacttagcgcatcgagaaggtccgt

SEQ ID NO: 33743 - DNA, 25 bp, S. cerevisiae
gactgtattcaataggcggccatga

SEQ ID NO: 33744 - DNA, 25 bp, S. cerevisiae
gacgatctcgaagcacgcaggctat

SEQ ID NO: 33745 - DNA, 25 bp, S. cerevisiae
gactagtgcctgaagaacaacgcat

SEQ ID NO: 33746 - DNA, 25 bp, S. cerevisiae
gactttgcatctacgtgtcagacaa

SEQ ID NO: 33747 - DNA, 25 bp, S. cerevisiae
gactctatgttgactggtcgtacac

SEQ ID NO: 33748 - DNA, 25 bp, S. cerevisiae
gacatacacctgttgcagatcagat

SEQ ID NO: 33749 - DNA, 25 bp, S. cerevisiae
gacatagctgcagctctaagttgca

SEQ ID NO: 33750 - DNA, 25 bp, S. cerevisiae
gacattctccctccagaattcaatt

SEQ ID NO: 33751 - DNA, 25 bp, S. cerevisiae
gacattcataactactttcctcagc

SEQ ID NO: 33752 - DNA, 25 bp, S. cerevisiae
gactactttcatgaggaggaccgat

SEQ ID NO: 33753 - DNA, 25 bp, S. cerevisiae
gacttctctttacacttacctatgg

SEQ ID NO: 33754 - DNA, 25 bp, S. cerevisiae
gactttcttcaatgacatatacgta

SEQ ID NO: 33755 - DNA, 25 bp, S. cerevisiae
gacttagtggtcttcaaaggcactt

SEQ ID NO: 33756 - DNA, 25 bp, S. cerevisiae
gacattcaatggtactcaagggact

SEQ ID NO: 33757 - DNA, 25 bp, S. cerevisiae
gacttcaatgttatccatgggacta

SEQ ID NO: 33758 - DNA, 25 bp, S. cerevisiae
gacttctatttgatttgggatgcca

SEQ ID NO: 33759 - DNA, 25 bp, S. cerevisiae
gacttgcagaacagattcggtgata

SEQ ID NO: 33760 - DNA, 25 bp, S. cerevisiae
gactccttgcgttcatacgtaatcg

SEQ ID NO: 33761 - DNA, 25 bp, S. cerevisiae
gactctatgttaacagctcgctctg

SEQ ID NO: 33762 - DNA, 25 bp, S. cerevisiae
gacttcttatctttcgatgcgatga

SEQ ID NO: 33763 - DNA, 25 bp, S. cerevisiae
gacttcaaatcatgcatcggtcttt

SEQ ID NO: 33764 - DNA, 25 bp, S. cerevisiae
gacttgaaacagtacggcagccact

SEQ ID NO: 33765 - DNA, 25 bp, S. cerevisiae
gacattgacatgaactatcccagta

SEQ ID NO: 33766 - DNA, 25 bp, S. cerevisiae
gacattatccaaatatcgacagcta

SEQ ID NO: 33767 - DNA, 25 bp, S. cerevisiae
gacttgtgcccaaagcgacgtactt

SEQ ID NO: 33768 - DNA, 25 bp, S. cerevisiae
gaccgccgccatggaatacgaatga

SEQ ID NO: 33769 - DNA, 25 bp, S. cerevisiae
gacccgactatccaaacgtcattag

SEQ ID NO: 33770 - DNA, 25 bp, S. cerevisiae
gactccaacctcgataaccttttga

SEQ ID NO: 33771 - DNA, 25 bp, S. cerevisiae
gagggtacccaaaactcaactagat

SEQ ID NO: 33772 - DNA, 25 bp, S. cerevisiae
gacggtaaccacaccagaggtagct

SEQ ID NO: 33773 - DNA, 25 bp, S. cerevisiae
gactttttgttcaacgcaggcggca

SEQ ID NO: 33774 - DNA, 25 bp, S. cerevisiae
gactacttttcttacagaggctgga

SEQ ID NO: 33775 - DNA, 25 bp, S. cerevisiae
gactactattttggccaacgggaag

SEQ ID NO: 33776 - DNA, 25 bp, S. cerevisiae
gactttcttagtcgctaacgttaag

SEQ ID NO: 33777 - DNA, 25 bp, S. cerevisiae
gacatttttggtgctagacctccaa

SEQ ID NO: 33778 - DNA, 25 bp, S. cerevisiae
gactcaccaggtttcttcttgttat

SEQ ID NO: 33779 - DNA, 25 bp, S. cerevisiae
gactcccaagtattttgtccaaatt

SEQ ID NO: 33780 - DNA, 25 bp, S. cerevisiae
gactctgccggtattttctatggta

SEQ ID NO: 33781 - DNA, 25 bp, S. cerevisiae
gacttccggcttcagtttggacgaa

SEQ ID NO: 33782 - DNA, 25 bp, S. cerevisiae
gacttctggtttcagtttggaagaa

SEQ ID NO: 33783 - DNA, 25 bp, S. cerevisiae
gacttgtacagaaacccattgacgt

SEQ ID NO: 33784 - DNA, 25 bp, S. cerevisiae
gacttgtcaagaaatgcccctttgt

SEQ ID NO: 33785 - DNA, 25 bp, S. cerevisiae
gacttcttcgttaggcagcgtgaga

SEQ ID NO: 33786 - DNA, 25 bp, S. cerevisiae
gactcagcccattgacgtcgtaaaa

SEQ ID NO: 33787 - DNA, 25 bp, S. cerevisiae
gagctggtcgaataccgtaaccaaa

SEQ ID NO: 33788 - DNA, 25 bp, S. cerevisiae
gacttagttatacatcttcttcctg

SEQ ID NO: 33789 - DNA, 25 bp, S. cerevisiae
gacggttcaagtaccagtccagttg

SEQ ID NO: 33790 - DNA, 25 bp, S. cerevisiae
gacttgttgatcctgaccagatcga

SEQ ID NO: 33791 - DNA, 25 bp, S. cerevisiae
gactctactgactgattcattacgt

SEQ ID NO: 33792 - DNA, 25 bp, S. cerevisiae
gactcaggaccttatctttatcata

SEQ ID NO: 33793 - DNA, 25 bp, S. cerevisiae
gactctggacatgcaagatttgttc

SEQ ID NO: 33794 - DNA, 25 bp, S. cerevisiae
gacttcccagcaaggcgatgattct

SEQ ID NO: 33795 - DNA, 25 bp, S. cerevisiae
gactttcatggcctttgcagcacat

SEQ ID NO: 33796 - DNA, 25 bp, S. cerevisiae
gactttagactcatggcagccattg

SEQ ID NO: 33797 - DNA, 25 bp, S. cerevisiae
gacttgtcagggttcagagctcttg

SEQ ID NO: 33798 - DNA, 25 bp, S. cerevisiae
gactgctctagagatggcgtttcga

SEQ ID NO: 33799 - DNA, 25 bp, S. cerevisiae
gacttgtcacaactgggtgtatcga

SEQ ID NO: 33800 - DNA, 25 bp, S. cerevisiae
gactcttgccaagttagttgctaca

SEQ ID NO: 33801 - DNA, 25 bp, S. cerevisiae
gactttgtcgctgaaatctatggca

SEQ ID NO: 33802 - DNA, 25 bp, S. cerevisiae
gacttagatcctgaagacattgcct

SEQ ID NO: 33803 - DNA, 25 bp, S. cerevisiae
gacttcaatctgctaagacccacta

SEQ ID NO: 33804 - DNA, 25 bp, S. cerevisiae
gacgatggacaacttggaaaactta

SEQ ID NO: 33805 - DNA, 25 bp, S. cerevisiae
gacgaggaccctgagaagcaaatac

SEQ ID NO: 33806 - DNA, 25 bp, S. cerevisiae
gacggatgcgacatttaactgctta

SEQ ID NO: 33807 - DNA, 25 bp, S. cerevisiae
gacattgtgcttcccaacatatagg

SEQ ID NO: 33808 - DNA, 25 bp, S. cerevisiae
gacattgctgctacccagcgataaa

SEQ ID NO: 33809 - DNA, 25 bp, S. cerevisiae
gactattccatcgacagtgttgaga

SEQ ID NO: 33810 - DNA, 25 bp, S. cerevisiae
gacattggcttcgagggttgtgcaa

SEQ ID NO: 33811 - DNA, 25 bp, S. cerevisiae
gacttggtgctcgaagatgctttca

SEQ ID NO: 33812 - DNA, 25 bp, S. cerevisiae
gactatgttattcctgttcttcctg

SEQ ID NO: 33813 - DNA, 25 bp, S. cerevisiae
gacttatatgtcactgaacgcgcaa

SEQ ID NO: 33814 - DNA, 25 bp, S. cerevisiae
gacattgttctcaagctgggcggat

SEQ ID NO: 33815 - DNA, 25 bp, S. cerevisiae
gactgatcttcattatgctgcaacg

SEQ ID NO: 33816 - DNA, 25 bp, S. cerevisiae
gacgtgatacactttgaggatagtt

SEQ ID NO: 33817 - DNA, 25 bp, S. cerevisiae
gacttgcccattggtaacgtcgtta

SEQ ID NO: 33818 - DNA, 25 bp, S. cerevisiae
gacttcacgattccaaacaatagct

SEQ ID NO: 33819 - DNA, 25 bp, S. cerevisiae
gactactttgggtacgcaaatctac

SEQ ID NO: 33820 - DNA, 25 bp, S. cerevisiae
gacgtcattcagatgcttacccaag

SEQ ID NO: 33821 - DNA, 25 bp, S. cerevisiae
gactttggaacagttggcaagcaca

SEQ ID NO: 33822 - DNA, 25 bp, S. cerevisiae
gactacatggtgtcagtttcaaaaa

SEQ ID NO: 33823 - DNA, 25 bp, S. cerevisiae
gactcattggcgtcattgttcagtg

SEQ ID NO: 33824 - DNA, 25 bp, S. cerevisiae
gactatattgcctttttgtgtgatg

SEQ ID NO: 33825 - DNA, 25 bp, S. cerevisiae
gactatttctcatcatttgtgtcat

SEQ ID NO: 33826 - DNA, 25 bp, S. cerevisiae
gactattactacctttatgccatcg

SEQ ID NO: 33827 - DNA, 25 bp, S. cerevisiae
gactttactgcagtttatggccact

SEQ ID NO: 33828 - DNA, 25 bp, S. cerevisiae
gactagtctggcatcaacatggcaa

SEQ ID NO: 33829 - DNA, 25 bp, S. cerevisiae
gacttcctgcaaatggtttctacat

SEQ ID NO: 33830 - DNA, 25 bp, S. cerevisiae
gacttctagttctgcttttgtttca

SEQ ID NO: 33831 - DNA, 25 bp, S. cerevisiae
gactctcgatttgccggagttttca

SEQ ID NO: 33832 - DNA, 25 bp, S. cerevisiae
gactgcactattaactgggaatttt

SEQ ID NO: 33833 - DNA, 25 bp, S. cerevisiae
gacttccttttcaaagcactgcatg

SEQ ID NO: 33834 - DNA, 25 bp, S. cerevisiae
gactctatgctgaggctaattccat

SEQ ID NO: 33835 - DNA, 25 bp, S. cerevisiae
gactgctatcaaaccttttgcctgg

SEQ ID NO: 33836 - DNA, 25 bp, S. cerevisiae
gactcttcaagaacgctttccatcg

SEQ ID NO: 33837 - DNA, 25 bp, S. cerevisiae
gacttcttgtcgattcgttattcca

SEQ ID NO: 33838 - DNA, 25 bp, S. cerevisiae
gacttatttatttcgctctttgctt

SEQ ID NO: 33839 - DNA, 25 bp, S. cerevisiae
gacttatttcattcaggctctgttg

SEQ ID NO: 33840 - DNA, 25 bp, S. cerevisiae
gacgaggtcaagcacatcggcagat

SEQ ID NO: 33841 - DNA, 25 bp, S. cerevisiae
gactaagtgcaactacatcttcgat

SEQ ID NO: 33842 - DNA, 25 bp, S. cerevisiae
gactacgtcgccaacatttctaata

SEQ ID NO: 33843 - DNA, 25 bp, S. cerevisiae
gactgcctatccgaatcttttaatt

SEQ ID NO: 33844 - DNA, 25 bp, S. cerevisiae
gactatcaccatggtatatatatat

SEQ ID NO: 33845 - DNA, 25 bp, S. cerevisiae
gactctcccatggatgcgttaagga

SEQ ID NO: 33846 - DNA, 25 bp, S. cerevisiae
gactcgctgtatgatggcagcccaa

SEQ ID NO: 33847 - DNA, 25 bp, S. cerevisiae
gactggaatccaagaggcactgcac

SEQ ID NO: 33848 - DNA, 25 bp, S. cerevisiae
gactgcagaaaccaagacgccatta

SEQ ID NO: 33849 - DNA, 25 bp, S. cerevisiae
gacttatcccgattgacacgcatta

SEQ ID NO: 33850 - DNA, 25 bp, S. cerevisiae
gactgaatcaccgttgatgccttta

SEQ ID NO: 33851 - DNA, 25 bp, S. cerevisiae
gacgagtttcacaccggcgaagcct

SEQ ID NO: 33852 - DNA, 25 bp, S. cerevisiae
tgaccggtatccccgctgaccaagt

SEQ ID NO: 33853 - DNA, 25 bp, S. cerevisiae
gactagtgtttccacgctacataat

SEQ ID NO: 33854 - DNA, 25 bp, S. cerevisiae
gacttgcatactttactgctacaga

SEQ ID NO: 33855 - DNA, 25 bp, S. cerevisiae
gacttccctgtcgtttatgcaagtg

SEQ ID NO: 33856 - DNA, 25 bp, S. cerevisiae
gattcgtccacttttaccaaggttg

SEQ ID NO: 33857 - DNA, 25 bp, S. cerevisiae
gacttttcactgtttatccgacgct

SEQ ID NO: 33858 - DNA, 25 bp, S. cerevisiae
gacttttggctattttccaagctat

SEQ ID NO: 33859 - DNA, 25 bp, S. cerevisiae
gactgatgatctggacaacctcgta

SEQ ID NO: 33860 - DNA, 25 bp, S. cerevisiae
gacgatgacgttaacctcagtaaac

SEQ ID NO: 33861 - DNA, 25 bp, S. cerevisiae
gactggagtgttgttcctggaacgt

SEQ ID NO: 33862 - DNA, 25 bp, S. cerevisiae
gactaacttattattcgagaccgct

SEQ ID NO: 33863 - DNA, 25 bp, S. cerevisiae
gactattgttagcatcgcgcacagg

SEQ ID NO: 33864 - DNA, 25 bp, S. cerevisiae
gactaccgttgtaccaagggctaca

SEQ ID NO: 33865 - DNA, 25 bp, S. cerevisiae
gactctccgttatccaaggtgcaaa

SEQ ID NO: 33866 - DNA, 25 bp, S. cerevisiae
gactctcccttgttcaaatccgaag

SEQ ID NO: 33867 - DNA, 25 bp, S. cerevisiae
gactatttctcggatcacactcatt

SEQ ID NO: 33868 - DNA, 25 bp, S. cerevisiae
gactgcgtctatgctaattccattt

SEQ ID NO: 33869 - DNA, 25 bp, S. cerevisiae
gactctcccttgtttttgatagtat

SEQ ID NO: 33870 - DNA, 25 bp, S. cerevisiae
gactccgcctgtcaagctaagaagt

SEQ ID NO: 33871 - DNA, 25 bp, S. cerevisiae
gactactgcccatcaatgtcaacaa

SEQ ID NO: 33872 - DNA, 25 bp, S. cerevisiae
gactgaccaccgtcgatgaacacag

SEQ ID NO: 33873 - DNA, 25 bp, S. cerevisiae
gactcctccagaatagttaaccata

SEQ ID NO: 33874 - DNA, 25 bp, S. cerevisiae
gacttatcacgcacgattcatgttc

SEQ ID NO: 33875 - DNA, 25 bp, S. cerevisiae
gactgtcgccactgcggacattaaa

SEQ ID NO: 33876 - DNA, 25 bp, S. cerevisiae
gactaaccagttactaccatcagca

SEQ ID NO: 33877 - DNA, 25 bp, S. cerevisiae
gactataccgttgatgtgcctcatg

SEQ ID NO: 33878 - DNA, 25 bp, S. cerevisiae
gactatactctcttcaatgggttca

SEQ ID NO: 33879 - DNA, 25 bp, S. cerevisiae
gacttcattgcctttatggaatctc

SEQ ID NO: 33880 - DNA, 25 bp, S. cerevisiae
gacttcttctcattttactcattgc

SEQ ID NO: 33881 - DNA, 25 bp, S. cerevisiae
gacggtaaacttcacgttgcagcaa

SEQ ID NO: 33882 - DNA, 25 bp, S. cerevisiae
gactttgacagctcctacgttagca

SEQ ID NO: 33883 - DNA, 25 bp, S. cerevisiae
gactggagtcaatcctacgttgaag

SEQ ID NO: 33884 - DNA, 25 bp, S. cerevisiae
gacgggtccttgctatggctaaacg

SEQ ID NO: 33885 - DNA, 25 bp, S. cerevisiae
gagagtggattcgagggtttcaaac

SEQ ID NO: 33886 - DNA, 25 bp, S. cerevisiae
gagacggaacttgcctttgaaattt

SEQ ID NO: 33887 - DNA, 25 bp, S. cerevisiae
gatcgaaaagttggtcttaaacatt

SEQ ID NO: 33888 - DNA, 25 bp, S. cerevisiae
gacgaacaggattctaccctaactt

SEQ ID NO: 33889 - DNA, 25 bp, S. cerevisiae
gacttaaccccaactactacattat

SEQ ID NO: 33890 - DNA, 25 bp, S. cerevisiae
gacgaactaccaaacgaccacttat

SEQ ID NO: 33891 - DNA, 25 bp, S. cerevisiae
gactaaattactaactgcgggtggt

SEQ ID NO: 33892 - DNA, 25 bp, S. cerevisiae
gactactttcaatactggtggtgct

SEQ ID NO: 33893 - DNA, 25 bp, S. cerevisiae
gactgaccagggttttatctaccca

SEQ ID NO: 33894 - DNA, 25 bp, S. cerevisiae
gactttctcatcgatgttgtgccta

SEQ ID NO: 33895 - DNA, 25 bp, S. cerevisiae
gagcttattatctcctttgaaaagg

SEQ ID NO: 33896 - DNA, 25 bp, S. cerevisiae
gactagttcatcctcttttaagcaa

SEQ ID NO: 33897 - DNA, 25 bp, S. cerevisiae
gactattccattcgttctaatcgca

SEQ ID NO: 33898 - DNA, 25 bp, S. cerevisiae
gataacctcccggtaatacttgtgg

SEQ ID NO: 33899 - DNA, 25 bp, S. cerevisiae
gataccttgccacggtcagattttg

SEQ ID NO: 33900 - DNA, 25 bp, S. cerevisiae
gactacttgtcgcagatcacttttg

SEQ ID NO: 33901 - DNA, 25 bp, S. cerevisiae
gactctgtcatcaaaacatgggcgt

SEQ ID NO: 33902 - DNA, 25 bp, S. cerevisiae
gagctcgtcgagaatcacatggata

SEQ ID NO: 33903 - DNA, 25 bp, S. cerevisiae
gactcttcaccaatcagggacatat

SEQ ID NO: 33904 - DNA, 25 bp, S. cerevisiae
gactgatcgaaaatccctacatcct

SEQ ID NO: 33905 - DNA, 25 bp, S. cerevisiae
gacgatctggtactacgaacaccta

SEQ ID NO: 33906 - DNA, 25 bp, S. cerevisiae
gacgatgtcgtcctacaagacactt

SEQ ID NO: 33907 - DNA, 25 bp, S. cerevisiae
gacgttcaactcaccatataagctt

SEQ ID NO: 33908 - DNA, 25 bp, S. cerevisiae
gacgtccagcataattcccaagagt

SEQ ID NO: 33909 - DNA, 25 bp, S. cerevisiae
gactatgtcgatctataccttttgc

SEQ ID NO: 33910 - DNA, 25 bp, S. cerevisiae
gactctacagatgcttcttgcactg

SEQ ID NO: 33911 - DNA, 25 bp, S. cerevisiae
gactcaactgtcatatccgatgcag

SEQ ID NO: 33912 - DNA, 25 bp, S. cerevisiae
gactacatctgcagtatctcgagag

SEQ ID NO: 33913 - DNA, 25 bp, S. cerevisiae
gactacagacacgtttgttcttgga

SEQ ID NO: 33914 - DNA, 25 bp, S. cerevisiae
gactcacaagtcatttttctcggcg

SEQ ID NO: 33915 - DNA, 25 bp, S. cerevisiae
gactcctgactacttctgtactaga

SEQ ID NO: 33916 - DNA, 25 bp, S. cerevisiae
gactctctggctgtgggccctcata

SEQ ID NO: 33917 - DNA, 25 bp, S. cerevisiae
gactctaagtcattacgttccatat

SEQ ID NO: 33918 - DNA, 25 bp, S. cerevisiae
gactttacccttgatgatgacattg

SEQ ID NO: 33919 - DNA, 25 bp, S. cerevisiae
gactttccaggttccggatcatctt

SEQ ID NO: 33920 - DNA, 25 bp, S. cerevisiae
gacttttacagaccagaaggctctt

SEQ ID NO: 33921 - DNA, 25 bp, S. cerevisiae
gactttctcctacaagagaccttcc

SEQ ID NO: 33922 - DNA, 25 bp, S. cerevisiae
gactttctcttacaagagaccatca

SEQ ID NO: 33923 - DNA, 25 bp, S. cerevisiae
gacggcgattttcaagaagccaaat

SEQ ID NO: 33924 - DNA, 25 bp, S. cerevisiae
gacggtagggtcttcagtgatcata

SEQ ID NO: 33925 - DNA, 25 bp, S. cerevisiae
gacggtcgtggtactggcttcaaag

SEQ ID NO: 33926 - DNA, 25 bp, S. cerevisiae
gacggtaacgttagtttccaatctg

SEQ ID NO: 33927 - DNA, 25 bp, S. cerevisiae
tccgttaccaatgcctttgttctaa

SEQ ID NO: 33928 - DNA, 25 bp, S. cerevisiae
gacgacgttcgaaaccataattagt

SEQ ID NO: 33929 - DNA, 25 bp, S. cerevisiae
gacgaacctaccaccaatttagatg

SEQ ID NO: 33930 - DNA, 25 bp, S. cerevisiae
gacgaaattgactgttcctttagac

SEQ ID NO: 33931 - DNA, 25 bp, S. cerevisiae
gacgacaacttacgttacttccaag

SEQ ID NO: 33932 - DNA, 25 bp, S. cerevisiae
gactatccgtcgatttctcatttaa

SEQ ID NO: 33933 - DNA, 25 bp, S. cerevisiae
gactacattttctctttgttgaccg

SEQ ID NO: 33934 - DNA, 25 bp, S. cerevisiae
gatctttacgtatgccgataggtca

SEQ ID NO: 33935 - DNA, 25 bp, S. cerevisiae
gacgttgaaattgaggctactgcgc

SEQ ID NO: 33936 - DNA, 25 bp, S. cerevisiae
gagctgttaccaagtactcttcctc

SEQ ID NO: 33937 - DNA, 25 bp, S. cerevisiae
gactgctaagccatgtatctatttg

SEQ ID NO: 33938 - DNA, 25 bp, S. cerevisiae
gactcatagaacacgatcctgtgga

SEQ ID NO: 33939 - DNA, 25 bp, S. cerevisiae
gagcttaagaaacgccaggacacaa

SEQ ID NO: 33940 - DNA, 25 bp, S. cerevisiae
gactacaagcgaacctagatcactt

SEQ ID NO: 33941 - DNA, 25 bp, S. cerevisiae
gactactatggtacctagctcgtga

SEQ ID NO: 33942 - DNA, 25 bp, S. cerevisiae
gacgtacgtttcgtattcggcgatg

SEQ ID NO: 33943 - DNA, 25 bp, S. cerevisiae
gagcggacccctctatttgggaaag

SEQ ID NO: 33944 - DNA, 25 bp, S. cerevisiae
gacgtaagatcgctatcgaagtcaa

SEQ ID NO: 33945 - DNA, 25 bp, S. cerevisiae
gactggaaatccctcacgaatcaag

SEQ ID NO: 33946 - DNA, 25 bp, S. cerevisiae
gacgaagaaggcctccaattcaata

SEQ ID NO: 33947 - DNA, 25 bp, S. cerevisiae
gacgatgaagatagagcccaactga

SEQ ID NO: 33948 - DNA, 25 bp, S. cerevisiae
gacgatcatcgtagtgcccaattgg

SEQ ID NO: 33949 - DNA, 25 bp, S. cerevisiae
gactgattgctgctactccgactgg

SEQ ID NO: 33950 - DNA, 25 bp, S. cerevisiae
gactttgagcaatttctcttcgcag

SEQ ID NO: 33951 - DNA, 25 bp, S. cerevisiae
gactcttatgcaattgatccttaca

SEQ ID NO: 33952 - DNA, 25 bp, S. cerevisiae
gactcatcaattgtcatctccatgc

SEQ ID NO: 33953 - DNA, 25 bp, S. cerevisiae
gactatcatattatcttcagctggc

SEQ ID NO: 33954 - DNA, 25 bp, S. cerevisiae
gactatcgagtcatctgccagtgaa

SEQ ID NO: 33955 - DNA, 25 bp, S. cerevisiae
gactacgactcttaccagtatttgg

SEQ ID NO: 33956 - DNA, 25 bp, S. cerevisiae
gactgtgttttaaggtcctggaatt

SEQ ID NO: 33957 - DNA, 25 bp, S. cerevisiae
gactgactcaaacgatattcttgga

SEQ ID NO: 33958 - DNA, 25 bp, S. cerevisiae
gacgaagctactggaaggcggtatt

SEQ ID NO: 33959 - DNA, 25 bp, S. cerevisiae
gacggcgatagcaatagcatctcag

SEQ ID NO: 33960 - DNA, 25 bp, S. cerevisiae
gacggctatgaggtcgatacaaaga

SEQ ID NO: 33961 - DNA, 25 bp, S. cerevisiae
gactcgttcacttctgctacagaaa

SEQ ID NO: 33962 - DNA, 25 bp, S. cerevisiae
gagccacaagcgaggttattagagt

SEQ ID NO: 33963 - DNA, 25 bp, S. cerevisiae
gacgtatggacattgccttattaca

SEQ ID NO: 33964 - DNA, 25 bp, S. cerevisiae
gactggatcgcgaaacgttttgcaa

SEQ ID NO: 33965 - DNA, 25 bp, S. cerevisiae
gactgaattcaaggccggttctgct

SEQ ID NO: 33966 - DNA, 25 bp, S. cerevisiae
gactccaccaacgtcgaggatgcgt

SEQ ID NO: 33967 - DNA, 25 bp, S. cerevisiae
gactgctaagatttgccatttgttt

SEQ ID NO: 33968 - DNA, 25 bp, S. cerevisiae
gactggctccgaacctatcaaggaa

SEQ ID NO: 33969 - DNA, 25 bp, S. cerevisiae
gactgtactaatgcttggttcgaaa

SEQ ID NO: 33970 - DNA, 25 bp, S. cerevisiae
gactgtcaactaatggtactaggca

SEQ ID NO: 33971 - DNA, 25 bp, S. cerevisiae
gactacaacattgcccatggtggag

SEQ ID NO: 33972 - DNA, 25 bp, S. cerevisiae
gactacaacatatttatctcaggga

SEQ ID NO: 33973 - DNA, 25 bp, S. cerevisiae
gactcaactaggttggccacacgaa

SEQ ID NO: 33974 - DNA, 25 bp, S. cerevisiae
gactaacattgacatgtgcgaacca

SEQ ID NO: 33975 - DNA, 25 bp, S. cerevisiae
gactgaattgtgtcctgtctacgcc

SEQ ID NO: 33976 - DNA, 25 bp, S. cerevisiae
gactatctttatcatatctacggct

SEQ ID NO: 33977 - DNA, 25 bp, S. cerevisiae
gactatgacatgatggcttctccaa

SEQ ID NO: 33978 - DNA, 25 bp, S. cerevisiae
gactctgctgtcagattaacccata

SEQ ID NO: 33979 - DNA, 25 bp, S. cerevisiae
gactcttgtcattgtgggagcacct

SEQ ID NO: 33980 - DNA, 25 bp, S. cerevisiae
gactgattatgctgttccaactact

SEQ ID NO: 33981 - DNA, 25 bp, S. cerevisiae
gactgcattaatggttacctccctg

SEQ ID NO: 33982 - DNA, 25 bp, S. cerevisiae
gaccattcaaggtgacttccaagat

SEQ ID NO: 33983 - DNA, 25 bp, S. cerevisiae
tgaccttagggttagtgtggcaatt

SEQ ID NO: 33984 - DNA, 25 bp, S. cerevisiae
gactctaacgtcattggtggttcaa

SEQ ID NO: 33985 - DNA, 25 bp, S. cerevisiae
gacgttactgtgatgttgtggccca

SEQ ID NO: 33986 - DNA, 25 bp, S. cerevisiae
gactgttttactttatttctcaata

SEQ ID NO: 33987 - DNA, 25 bp, S. cerevisiae
gacctgtttcaatgtcctttaaagg

SEQ ID NO: 33988 - DNA, 25 bp, S. cerevisiae
gactcgttgtctatacctttaattg

SEQ ID NO: 33989 - DNA, 25 bp, S. cerevisiae
gacgattttgttatcccactaacga

SEQ ID NO: 33990 - DNA, 25 bp, S. cerevisiae
gactcgtttaatatcccaattctcg

SEQ ID NO: 33991 - DNA, 25 bp, S. cerevisiae
gactcgattctagttaccaattgca

SEQ ID NO: 33992 - DNA, 25 bp, S. cerevisiae
gactctggttctagctctgaattgg

SEQ ID NO: 33993 - DNA, 25 bp, S. cerevisiae
gactgtggacctgttgaatttctac

SEQ ID NO: 33994 - DNA, 25 bp, S. cerevisiae
gacggtaccatacatgttttccatg

SEQ ID NO: 33995 - DNA, 25 bp, S. cerevisiae
gacgcatccaactgtacactgatta

SEQ ID NO: 33996 - DNA, 25 bp, S. cerevisiae
gactcaggcgatcgtgatagacttt

SEQ ID NO: 33997 - DNA, 25 bp, S. cerevisiae
gactcgaggtcatttcagatcttct

SEQ ID NO: 33998 - DNA, 25 bp, S. cerevisiae
gactctgagctggttcaagaactat

SEQ ID NO: 33999 - DNA, 25 bp, S. cerevisiae
gactgccactggacctgaagacatg

SEQ ID NO: 34000 - DNA, 25 bp, S. cerevisiae
gactccacggtgttagcgcatatgc

SEQ ID NO: 34001 - DNA, 25 bp, S. cerevisiae
gactccctgatcaaagacgagccat

SEQ ID NO: 34002 - DNA, 25 bp, S. cerevisiae
gactgttgttcaagagacaagcctt

SEQ ID NO: 34003 - DNA, 25 bp, S. cerevisiae
gactctcgttctgggacattctatt

SEQ ID NO: 34004 - DNA, 25 bp, S. cerevisiae
gactctgttgaggatcgtatttctg

SEQ ID NO: 34005 - DNA, 25 bp, S. cerevisiae
gacgtcattgcggaagcctttgctg

SEQ ID NO: 34006 - DNA, 25 bp, S. cerevisiae
gacggcaagccaaagcacttctgtg

SEQ ID NO: 34007 - DNA, 25 bp, S. cerevisiae
gactggcaagcctgaactggaatcc

SEQ ID NO: 34008 - DNA, 25 bp, S. cerevisiae
gacgctgacaagttgcttcgggtat

SEQ ID NO: 34009 - DNA, 25 bp, S. cerevisiae
gactctgtattatgaggctctacgt

SEQ ID NO: 34010 - DNA, 25 bp, S. cerevisiae
gacgaatcctgtcttgttggctagg

SEQ ID NO: 34011 - DNA, 25 bp, S. cerevisiae
gactaaccatttcatgtccacgttg

SEQ ID NO: 34012 - DNA, 25 bp, S. cerevisiae
gactacagcttaatctttccacaat

SEQ ID NO: 34013 - DNA, 25 bp, S. cerevisiae
gacgaaactttggtacattcttcct

SEQ ID NO: 34014 - DNA, 25 bp, S. cerevisiae
gacgataccggttctgaattctcct

SEQ ID NO: 34015 - DNA, 25 bp, S. cerevisiae
gactgtacctgtcaaaagtatcctg

SEQ ID NO: 34016 - DNA, 25 bp, S. cerevisiae
gactgtacttttcaaggttgctctg

SEQ ID NO: 34017 - DNA, 25 bp, S. cerevisiae
gacgtcaccatttccacagatgatt

SEQ ID NO: 34018 - DNA, 25 bp, S. cerevisiae
gactgccccattagcattctgatga

SEQ ID NO: 34019 - DNA, 25 bp, S. cerevisiae
gactcctatcatttctgtcatgatt

SEQ ID NO: 34020 - DNA, 25 bp, S. cerevisiae
gactcctattattgctgtcatgatc

SEQ ID NO: 34021 - DNA, 25 bp, S. cerevisiae
gactcacccatttactgcaagcaaa

SEQ ID NO: 34022 - DNA, 25 bp, S. cerevisiae
gactgacccatatatcgaccaaact

SEQ ID NO: 34023 - DNA, 25 bp, S. cerevisiae
gactgcaaactaaactgcgcgcata

SEQ ID NO: 34024 - DNA, 25 bp, S. cerevisiae
gactaatactgctagaaggcccagc

SEQ ID NO: 34025 - DNA, 25 bp, S. cerevisiae
gactaactggctggaacgccatcaa

SEQ ID NO: 34026 - DNA, 25 bp, S. cerevisiae
gactacacattccaaaaagctcaag

SEQ ID NO: 34027 - DNA, 25 bp, S. cerevisiae
gagcggacacaccaagaaaccaagt

SEQ ID NO: 34028 - DNA, 25 bp, S. cerevisiae
gacgatggccctaagaatactccct

SEQ ID NO: 34029 - DNA, 25 bp, S. cerevisiae
gacgacgacttcaggatctttgggt

SEQ ID NO: 34030 - DNA, 25 bp, S. cerevisiae
gacgccaacctaaatgatttgccgg

SEQ ID NO: 34031 - DNA, 25 bp, S. cerevisiae
gacggatacctcgaattttgaccca

SEQ ID NO: 34032 - DNA, 25 bp, S. cerevisiae
gacgtttttccggtctgtacaacat

SEQ ID NO: 34033 - DNA, 25 bp, S. cerevisiae
gacgaccctagtcaagttttcgaca

SEQ ID NO: 34034 - DNA, 25 bp, S. cerevisiae
gacgaccttggtctaacttggataa

SEQ ID NO: 34035 - DNA, 25 bp, S. cerevisiae
gacggttggtgagctaactatacat

SEQ ID NO: 34036 - DNA, 25 bp, S. cerevisiae
gacggtcaaggttacactatccatt

SEQ ID NO: 34037 - DNA, 25 bp, S. cerevisiae
gacgttcacggacttactagcttat

SEQ ID NO: 34038 - DNA, 25 bp, S. cerevisiae
gacggcggtaacatctatttatcca

SEQ ID NO: 34039 - DNA, 25 bp, S. cerevisiae
gacggccgttaagcaattgccacaa

SEQ ID NO: 34040 - DNA, 25 bp, S. cerevisiae
gacggccttgatgaccagtttctaa

SEQ ID NO: 34041 - DNA, 25 bp, S. cerevisiae
gactggtgtgccttattctgatgtg

SEQ ID NO: 34042 - DNA, 25 bp, S. cerevisiae
gactggagttctgttcaaatgcgat

SEQ ID NO: 34043 - DNA, 25 bp, S. cerevisiae
gacgggtacgattctaattcaagca

SEQ ID NO: 34044 - DNA, 25 bp, S. cerevisiae
gactgggtactgcttgactgacaaa

SEQ ID NO: 34045 - DNA, 25 bp, S. cerevisiae
gacgggatggcgattactgataaac

SEQ ID NO: 34046 - DNA, 25 bp, S. cerevisiae
gacggcctaagagacactgctgaaa

SEQ ID NO: 34047 - DNA, 25 bp, S. cerevisiae
gacgagttaaatgacgatgcttcca

SEQ ID NO: 34048 - DNA, 25 bp, S. cerevisiae
gacggctccaatttcgaggtcatcg

SEQ ID NO: 34049 - DNA, 25 bp, S. cerevisiae
gacgagcctaattacgagacgactg

SEQ ID NO: 34050 - DNA, 25 bp, S. cerevisiae
gacgatgactacaatccgggcttat

SEQ ID NO: 34051 - DNA, 25 bp, S. cerevisiae
gactgctgcactatggacgaggtta

SEQ ID NO: 34052 - DNA, 25 bp, S. cerevisiae
gacgctgctttttacaagttggatg

SEQ ID NO: 34053 - DNA, 25 bp, S. cerevisiae
gactcttattgtcgatagcgcggtt

SEQ ID NO: 34054 - DNA, 25 bp, S. cerevisiae
gacggctacagcacaatgggcaaaa

SEQ ID NO: 34055 - DNA, 25 bp, S. cerevisiae
gacggctaagtcctacgtgcataga

SEQ ID NO: 34056 - DNA, 25 bp, S. cerevisiae
gacgtatccagtctgcaatgtgcaa

SEQ ID NO: 34057 - DNA, 25 bp, S. cerevisiae
gacgatttagttgccatgtccaaaa

SEQ ID NO: 34058 - DNA, 25 bp, S. cerevisiae
gacgatcttcacagggagtacgaca

SEQ ID NO: 34059 - DNA, 25 bp, S. cerevisiae
gacgttgtcaactgcgctgaacgaa

SEQ ID NO: 34060 - DNA, 25 bp, S. cerevisiae
gacgggctgaacttaccacacaaaa

SEQ ID NO: 34061 - DNA, 25 bp, S. cerevisiae
gacggcgagaatattccactcagaa

SEQ ID NO: 34062 - DNA, 25 bp, S. cerevisiae
gacgtgcgataacattacatctagg

SEQ ID NO: 34063 - DNA, 25 bp, S. cerevisiae
gactgctgttcatgacaagatcttg

SEQ ID NO: 34064 - DNA, 25 bp, S. cerevisiae
gactgctttgtctatatccatccga

SEQ ID NO: 34065 - DNA, 25 bp, S. cerevisiae
gactctaatgacaatcccaccgaaa

SEQ ID NO: 34066 - DNA, 25 bp, S. cerevisiae
gacgtgagcaacctgaccctagtaa

SEQ ID NO: 34067 - DNA, 25 bp, S. cerevisiae
gacggatgatacttatacctcctag

SEQ ID NO: 34068 - DNA, 25 bp, S. cerevisiae
gacggtctgcgatcattgtggttat

SEQ ID NO: 34069 - DNA, 25 bp, S. cerevisiae
gacgtctttgattcttgggataacc

SEQ ID NO: 34070 - DNA, 25 bp, S. cerevisiae
gactcgctttcaatgctatgggata

SEQ ID NO: 34071 - DNA, 25 bp, S. cerevisiae
gacggtgcatgctctgtggaagata

SEQ ID NO: 34072 - DNA, 25 bp, S. cerevisiae
gactgctggtgaagcgacgccaata

SEQ ID NO: 34073 - DNA, 25 bp, S. cerevisiae
gacgatggctcacaatcgccaatta

SEQ ID NO: 34074 - DNA, 25 bp, S. cerevisiae
gactgtggtcatagaatcctgttga

SEQ ID NO: 34075 - DNA, 25 bp, S. cerevisiae
gactgtgttattgcgcagttgccgt

SEQ ID NO: 34076 - DNA, 25 bp, S. cerevisiae
gactgatttctcatcaagcattatt

SEQ ID NO: 34077 - DNA, 25 bp, S. cerevisiae
gacgagcctcatttcagatatgttt

SEQ ID NO: 34078 - DNA, 25 bp, S. cerevisiae
gacggcctactccatggtgtttcaa

SEQ ID NO: 34079 - DNA, 25 bp, S. cerevisiae
gacggtgccagtaagagttttcaaa

SEQ ID NO: 34080 - DNA, 25 bp, S. cerevisiae
gacggctgtgtcaatgcggttttgc

SEQ ID NO: 34081 - DNA, 25 bp, S. cerevisiae
gacggctggctccagctgatattta

SEQ ID NO: 34082 - DNA, 25 bp, S. cerevisiae
gacgtcgactctctatgtttcagta

SEQ ID NO: 34083 - DNA, 25 bp, S. cerevisiae
gagcccgtatctgaagcgttgcagc

SEQ ID NO: 34084 - DNA, 25 bp, S. cerevisiae
gacggcagaatacaacatcggctat

SEQ ID NO: 34085 - DNA, 25 bp, S. cerevisiae
gacgaagtgttggacatgctctacc

SEQ ID NO: 34086 - DNA, 25 bp, S. cerevisiae
gacgaagctgctgctgatatggccc

SEQ ID NO: 34087 - DNA, 25 bp, S. cerevisiae
gactggatcgtgttggatgtcccat

SEQ ID NO: 34088 - DNA, 25 bp, S. cerevisiae
gactgtattcgtcgtttcttcaaaa

SEQ ID NO: 34089 - DNA, 25 bp, S. cerevisiae
gacgaaatcgtcttatctggtaact

SEQ ID NO: 34090 - DNA, 25 bp, S. cerevisiae
gacgaattggtctctgtggtaaacg

SEQ ID NO: 34091 - DNA, 25 bp, S. cerevisiae
gacgatgcttcgagctttgcagacg

SEQ ID NO: 34092 - DNA, 25 bp, S. cerevisiae
gacgctactgcaaggcgacgacaaa

SEQ ID NO: 34093 - DNA, 25 bp, S. cerevisiae
gactgtgtccgatgtgtaggcaaac

SEQ ID NO: 34094 - DNA, 25 bp, S. cerevisiae
gactgttccgatattcttgcaaatg

SEQ ID NO: 34095 - DNA, 25 bp, S. cerevisiae
gactgtccatgcaccattgaaaagc

SEQ ID NO: 34096 - DNA, 25 bp, S. cerevisiae
gactgatctttggtttaatgacact

SEQ ID NO: 34097 - DNA, 25 bp, S. cerevisiae
gactgtgttctcgttagataaccct

SEQ ID NO: 34098 - DNA, 25 bp, S. cerevisiae
gactggttcccattcgaacacagtt

SEQ ID NO: 34099 - DNA, 25 bp, S. cerevisiae
gacgtttccttcaatgacagccagt

SEQ ID NO: 34100 - DNA, 25 bp, S. cerevisiae
gacgttaccattctacactgttttc

SEQ ID NO: 34101 - DNA, 25 bp, S. cerevisiae
gacgaggagcaaccagaagacgtta

SEQ ID NO: 34102 - DNA, 25 bp, S. cerevisiae
gacgacgtgctaccagttgaatttt

SEQ ID NO: 34103 - DNA, 25 bp, S. cerevisiae
gacgacgtgtactagcctttttact

SEQ ID NO: 34104 - DNA, 25 bp, S. cerevisiae
gactggtttagttcctattttgact

SEQ ID NO: 34105 - DNA, 25 bp, S. cerevisiae
gactccttgggtcttgatattctga

SEQ ID NO: 34106 - DNA, 25 bp, S. cerevisiae
gactcccttgtcgtattgttcctat

SEQ ID NO: 34107 - DNA, 25 bp, S. cerevisiae
gactccgctttactaagattctgca

SEQ ID NO: 34108 - DNA, 25 bp, S. cerevisiae
gggccgctttgagcaagaagtccta

SEQ ID NO: 34109 - DNA, 25 bp, S. cerevisiae
gacggcgcggcttctaaaaacgaca

SEQ ID NO: 34110 - DNA, 25 bp, S. cerevisiae
gacggccaggcaatttatgataaat

SEQ ID NO: 34111 - DNA, 25 bp, S. cerevisiae
gactcccttagttctagtatattgg

SEQ ID NO: 34112 - DNA, 25 bp, S. cerevisiae
gaccccttaggcaatttaattcgat

SEQ ID NO: 34113 - DNA, 25 bp, S. cerevisiae
gaccccttatggaacttcagcgttg

SEQ ID NO: 34114 - DNA, 25 bp, S. cerevisiae
gaccgcctggaacacgtatggattt

SEQ ID NO: 34115 - DNA, 25 bp, S. cerevisiae
gactccatcattcacaacttttgtt

SEQ ID NO: 34116 - DNA, 25 bp, S. cerevisiae
gactgcaatcagacaacgaaggtaa

SEQ ID NO: 34117 - DNA, 25 bp, S. cerevisiae
gactgaacggccaatgaacgctcaa

SEQ ID NO: 34118 - DNA, 25 bp, S. cerevisiae
gagcgggtccattaagccactgtta

SEQ ID NO: 34119 - DNA, 25 bp, S. cerevisiae
gacggatcccatgacagtaatgttt

SEQ ID NO: 34120 - DNA, 25 bp, S. cerevisiae
gacggccacggctactgtgaatgat

SEQ ID NO: 34121 - DNA, 25 bp, S. cerevisiae
gacgaaaccgttgcagataaagata

SEQ ID NO: 34122 - DNA, 25 bp, S. cerevisiae
gactgcaaaccgtctcacagcaaat

SEQ ID NO: 34123 - DNA, 25 bp, S. cerevisiae
gactgccaaagcttctcaagaactg

SEQ ID NO: 34124 - DNA, 25 bp, S. cerevisiae
gactcgccacattcagatcagacaa

SEQ ID NO: 34125 - DNA, 25 bp, S. cerevisiae
gactgagtctcatcaagcagcacca

SEQ ID NO: 34126 - DNA, 25 bp, S. cerevisiae
gacgagactgtagagcgacgcctta

SEQ ID NO: 34127 - DNA, 25 bp, S. cerevisiae
gacgatgacgaagagctacaagctc

SEQ ID NO: 34128 - DNA, 25 bp, S. cerevisiae
gactgaaccagtgcatagccaacct

SEQ ID NO: 34129 - DNA, 25 bp, S. cerevisiae
gacgaaggctctgtagacaacactt

SEQ ID NO: 34130 - DNA, 25 bp, S. cerevisiae
gaccataggttgctacaaactcggt

SEQ ID NO: 34131 - DNA, 25 bp, S. cerevisiae
gaccaaagttcttacagaggctaga

SEQ ID NO: 34132 - DNA, 25 bp, S. cerevisiae
gacgaaagtgtttccgaaccagctt

SEQ ID NO: 34133 - DNA, 25 bp, S. cerevisiae
gacgtggcgttttccaaaaagcagt

SEQ ID NO: 34134 - DNA, 25 bp, S. cerevisiae
gacggtccttcttcgaaaggtgcag

SEQ ID NO: 34135 - DNA, 25 bp, S. cerevisiae
gacggtccttcttcgaaaggtgcag

SEQ ID NO: 34136 - DNA, 25 bp, S. cerevisiae
gactgctgctcctgcaaaaagggta

SEQ ID NO: 34137 - DNA, 25 bp, S. cerevisiae
gactgtgtcaatgacttcacaacat

SEQ ID NO: 34138 - DNA, 25 bp, S. cerevisiae
gactgatttgacgagcttctaccaa

SEQ ID NO: 34139 - DNA, 25 bp, S. cerevisiae
gaccttgccggtgtaactgacggga

SEQ ID NO: 34140 - DNA, 25 bp, S. cerevisiae
gacggccctgggttgaacaattttg

SEQ ID NO: 34141 - DNA, 25 bp, S. cerevisiae
gacggcaattggctctcaatcattt

SEQ ID NO: 34142 - DNA, 25 bp, S. cerevisiae
gactgatactgttgctgtggaatac

SEQ ID NO: 34143 - DNA, 25 bp, S. cerevisiae
gacgactttcatttggatgcacgaa

SEQ ID NO: 34144 - DNA, 25 bp, S. cerevisiae
gactggttccgcaacactgaaacac

SEQ ID NO: 34145 - DNA, 25 bp, S. cerevisiae
gactgctgctttgagacaagagatt

SEQ ID NO: 34146 - DNA, 25 bp, S. cerevisiae
gactggatggttcctcaaagttgga

SEQ ID NO: 34147 - DNA, 25 bp, S. cerevisiae
gactgaacgttctttaactatcgaa

SEQ ID NO: 34148 - DNA, 25 bp, S. cerevisiae
gacggactttcatttgaccttcgag

SEQ ID NO: 34149 - DNA, 25 bp, S. cerevisiae
gactggacctacactacgcggtata

SEQ ID NO: 34150 - DNA, 25 bp, S. cerevisiae
gacgatgatgctctgaatagtccag

SEQ ID NO: 34151 - DNA, 25 bp, S. cerevisiae
gacgacttggcgtttgatctagacg

SEQ ID NO: 34152 - DNA, 25 bp, S. cerevisiae
gacgtcgaggtcattatgcactccc

SEQ ID NO: 34153 - DNA, 25 bp, S. cerevisiae
gaccctgcaggttattacgttggct

SEQ ID NO: 34154 - DNA, 25 bp, S. cerevisiae
gactccagagttccattcggtggtg

SEQ ID NO: 34155 - DNA, 25 bp, S. cerevisiae
gactgggagttcttcactggtgaat

SEQ ID NO: 34156 - DNA, 25 bp, S. cerevisiae
gacgggcttgcaacctgtagatatt

SEQ ID NO: 34157 - DNA, 25 bp, S. cerevisiae
gacggcaagagaatctatacattga

SEQ ID NO: 34158 - DNA, 25 bp, S. cerevisiae
gacggcaagagacctaccacagctg

SEQ ID NO: 34159 - DNA, 25 bp, S. cerevisiae
gactgcttctgctaataatccgttc

SEQ ID NO: 34160 - DNA, 25 bp, S. cerevisiae
gactgctcttcttattagactgttg

SEQ ID NO: 34161 - DNA, 25 bp, S. cerevisiae
gactgcttactattctttctacttg

SEQ ID NO: 34162 - DNA, 25 bp, S. cerevisiae
gacgttgccactttaactattgctt

SEQ ID NO: 34163 - DNA, 25 bp, S. cerevisiae
gacgggctcaaagctttggtactca

SEQ ID NO: 34164 - DNA, 25 bp, S. cerevisiae
gacgaaaacgttcctttgcaaagat

SEQ ID NO: 34165 - DNA, 25 bp, S. cerevisiae
gacgaattccgatcttccttaaata

SEQ ID NO: 34166 - DNA, 25 bp, S. cerevisiae
gacgatttaccactcttctttacaa

SEQ ID NO: 34167 - DNA, 25 bp, S. cerevisiae
gacgtaccaccaccatataatgatg

SEQ ID NO: 34168 - DNA, 25 bp, S. cerevisiae
gagcttaccaccgtataactctggg

SEQ ID NO: 34169 - DNA, 25 bp, S. cerevisiae
gacgaatcctccgtattgtactggg

SEQ ID NO: 34170 - DNA, 25 bp, S. cerevisiae
gacgaacttccgtatcagttgtgtt

SEQ ID NO: 34171 - DNA, 25 bp, S. cerevisiae
gacgaagattcacaacgctctgatg

SEQ ID NO: 34172 - DNA, 25 bp, S. cerevisiae
gacccagagggacaggctctcttaa

SEQ ID NO: 34173 - DNA, 25 bp, S. cerevisiae
gacggcagcggtaaatacttcctca

SEQ ID NO: 34174 - DNA, 25 bp, S. cerevisiae
gactgttccggtacaactaccaggt

SEQ ID NO: 34175 - DNA, 25 bp, S. cerevisiae
gactgcttttgcatctttaagagaa

SEQ ID NO: 34176 - DNA, 25 bp, S. cerevisiae
gacgttttgtccactaaagaagcta

SEQ ID NO: 34177 - DNA, 25 bp, S. cerevisiae
gacgatggttctatggttgccaaat

SEQ ID NO: 34178 - DNA, 25 bp, S. cerevisiae
gacgtggtcaggatccctggccaag

SEQ ID NO: 34179 - DNA, 25 bp, S. cerevisiae
gacgggctagagatcttgactgctg

SEQ ID NO: 34180 - DNA, 25 bp, S. cerevisiae
gacgagccatcagagtctggtgttg

SEQ ID NO: 34181 - DNA, 25 bp, S. cerevisiae
gacggcttccgccaataatgattgg

SEQ ID NO: 34182 - DNA, 25 bp, S. cerevisiae
gactggataccccatcatattttag

SEQ ID NO: 34183 - DNA, 25 bp, S. cerevisiae
gactgttacttctttggatgttgtt

SEQ ID NO: 34184 - DNA, 25 bp, S. cerevisiae
gacgttttcgagactggatgcttta

SEQ ID NO: 34185 - DNA, 25 bp, S. cerevisiae
gactgcttgtctcaatcggtgtttc

SEQ ID NO: 34186 - DNA, 25 bp, S. cerevisiae
gactgttcagaatctctggacgatt

SEQ ID NO: 34187 - DNA, 25 bp, S. cerevisiae
gactgttgaatgttcctggagtgtc

SEQ ID NO: 34188 - DNA, 25 bp, S. cerevisiae
gacggcttttatccaatctacatta

SEQ ID NO: 34189 - DNA, 25 bp, S. cerevisiae
gacgcgtttctacaacttttacaga

SEQ ID NO: 34190 - DNA, 25 bp, S. cerevisiae
gacgagttcttagatcctttgatgt

SEQ ID NO: 34191 - DNA, 25 bp, S. cerevisiae
gactgttgaattaggctccgattat

SEQ ID NO: 34192 - DNA, 25 bp, S. cerevisiae
gactgttgaatcttcttcctttgat

SEQ ID NO: 34193 - DNA, 25 bp, S. cerevisiae
gactgtagagatgtgtactgtcatg

SEQ ID NO: 34194 - DNA, 25 bp, S. cerevisiae
gactggatcagatttgtctctacca

SEQ ID NO: 34195 - DNA, 25 bp, S. cerevisiae
gactggctgctgtttgttaagcgca

SEQ ID NO: 34196 - DNA, 25 bp, S. cerevisiae
gacgcagctcgtttgcatggagacg

SEQ ID NO: 34197 - DNA, 25 bp, S. cerevisiae
gactgagcttgttcgtgcttatgta

SEQ ID NO: 34198 - DNA, 25 bp, S. cerevisiae
gacgaaatcaccattacgccaggag

SEQ ID NO: 34199 - DNA, 25 bp, S. cerevisiae
gacgccgactattatttccaaaggg

SEQ ID NO: 34200 - DNA, 25 bp, S. cerevisiae
gactggcgattttgccgtccaaaat

SEQ ID NO: 34201 - DNA, 25 bp, S. cerevisiae
gactgttgatcctacatttaagcat

SEQ ID NO: 34202 - DNA, 25 bp, S. cerevisiae
gacgttacgaacattaacactgatc

SEQ ID NO: 34203 - DNA, 25 bp, S. cerevisiae
gacggcttcctaattttacctgata

SEQ ID NO: 34204 - DNA, 25 bp, S. cerevisiae
gacggctaggtaaatttcagtgcat

SEQ ID NO: 34205 - DNA, 25 bp, S. cerevisiae
gacgcattcagagtctaattcgtta

SEQ ID NO: 34206 - DNA, 25 bp, S. cerevisiae
gagctggaagcatttaaatcggaaa

SEQ ID NO: 34207 - DNA, 25 bp, S. cerevisiae
gactggaacaattcacatctagtga

SEQ ID NO: 34208 - DNA, 25 bp, S. cerevisiae
gacgacgtccagaccatcaaggtag

SEQ ID NO: 34209 - DNA, 25 bp, S. cerevisiae
gacggttcttcaactgacaacgaaa

SEQ ID NO: 34210 - DNA, 25 bp, S. cerevisiae
gactggttctgttttcatcttcaca

SEQ ID NO: 34211 - DNA, 25 bp, S. cerevisiae
gacggtaccgtttatttgccatcca

SEQ ID NO: 34212 - DNA, 25 bp, S. cerevisiae
gactggtatcgctattggtttgaac

SEQ ID NO: 34213 - DNA, 25 bp, S. cerevisiae
gacgtcgaccaattcaattcctttg

SEQ ID NO: 34214 - DNA, 25 bp, S. cerevisiae
gacgccgtcgaagaagtcaattctg

SEQ ID NO: 34215 - DNA, 25 bp, S. cerevisiae
gacgtggcgcttgctaaggaattct

SEQ ID NO: 34216 - DNA, 25 bp, S. cerevisiae
gacggagcaattctgtgctacttta

SEQ ID NO: 34217 - DNA, 25 bp, S. cerevisiae
gacgtaaatgatcctttatcctcta

SEQ ID NO: 34218 - DNA, 25 bp, S. cerevisiae
gacggacaaactcatttcctcgaaa

SEQ ID NO: 34219 - DNA, 25 bp, S. cerevisiae
gacggagtttcgacttattctagat

SEQ ID NO: 34220 - DNA, 25 bp, S. cerevisiae
gacgaactgtctgtttctattagct

SEQ ID NO: 34221 - DNA, 25 bp, S. cerevisiae
gacgaacttaccttgactttcatgt

SEQ ID NO: 34222 - DNA, 25 bp, S. cerevisiae
gacgcctgggttaaacttatctatt

SEQ ID NO: 34223 - DNA, 25 bp, S. cerevisiae
gacgccggttctgactttgtaatac

SEQ ID NO: 34224 - DNA, 25 bp, S. cerevisiae
gacgggcgtctttccattggtaaag

SEQ ID NO: 34225 - DNA, 25 bp, S. cerevisiae
gacggcgatgatattctatctggat

SEQ ID NO: 34226 - DNA, 25 bp, S. cerevisiae
gacggcggatgattctacacggcta

SEQ ID NO: 34227 - DNA, 25 bp, S. cerevisiae
gactgtgtgggttcaacaactgcca

SEQ ID NO: 34228 - DNA, 25 bp, S. cerevisiae
gacggtcaattattccaccaactgc

SEQ ID NO: 34229 - DNA, 25 bp, S. cerevisiae
gacgggccaatcgatccattcaaag

SEQ ID NO: 34230 - DNA, 25 bp, S. cerevisiae
gacggagccacctactttaaatgtt

SEQ ID NO: 34231 - DNA, 25 bp, S. cerevisiae
gaccccgaccgacttaaatgatgca

SEQ ID NO: 34232 - DNA, 25 bp, S. cerevisiae
gaccaaggaccggattacgatctca

SEQ ID NO: 34233 - DNA, 25 bp, S. cerevisiae
gaccgcaacggatcagtttacatca

SEQ ID NO: 34234 - DNA, 25 bp, S. cerevisiae
gacctctgccgttgccgctttgact

SEQ ID NO: 34235 - DNA, 25 bp, S. cerevisiae
gacgacgcggatacaccgactttta

SEQ ID NO: 34236 - DNA, 25 bp, S. cerevisiae
gacggcccaatcaaactactattct

SEQ ID NO: 34237 - DNA, 25 bp, S. cerevisiae
gacggcggatccatctttgaatgtt

SEQ ID NO: 34238 - DNA, 25 bp, S. cerevisiae
gacgacaagttgaatccgttcgaga

SEQ ID NO: 34239 - DNA, 25 bp, S. cerevisiae
gacggtaacgtccataagggcttgt

SEQ ID NO: 34240 - DNA, 25 bp, S. cerevisiae
gacgacactacattgaatacggcgc

SEQ ID NO: 34241 - DNA, 25 bp, S. cerevisiae
gacggcactacgtatctaccaagta

SEQ ID NO: 34242 - DNA, 25 bp, S. cerevisiae
gacggcattatgctatcgcatccaa

SEQ ID NO: 34243 - DNA, 25 bp, S. cerevisiae
gacgcgtccgaaattcccaatatat

SEQ ID NO: 34244 - DNA, 25 bp, S. cerevisiae
gagcgagggcgtattaccgatcatt

SEQ ID NO: 34245 - DNA, 25 bp, S. cerevisiae
gacgagggcgtaggttcttataatt

SEQ ID NO: 34246 - DNA, 25 bp, S. cerevisiae
gacgtagtgggatgttctggacttt

SEQ ID NO: 34247 - DNA, 25 bp, S. cerevisiae
gacgaaaggagatgcttccaactta

SEQ ID NO: 34248 - DNA, 25 bp, S. cerevisiae
gacggaagcgagtcatcttgtgcaa

SEQ ID NO: 34249 - DNA, 25 bp, S. cerevisiae
gacctacaggaaagagttactcaag

SEQ ID NO: 34250 - DNA, 25 bp, S. cerevisiae
taccatacaaaccgtttactcggca

SEQ ID NO: 34251 - DNA, 25 bp, S. cerevisiae
gatcctactaatgttttccgggcag

SEQ ID NO: 34252 - DNA, 25 bp, S. cerevisiae
gatatccctaatgtttccttggtag

SEQ ID NO: 34253 - DNA, 25 bp, S. cerevisiae
gattcggtaaaggttcccgtcaatg

SEQ ID NO: 34254 - DNA, 25 bp, S. cerevisiae
taatacttaaaggtctatccggtga

SEQ ID NO: 34255 - DNA, 25 bp, S. cerevisiae
gttacttatactgttgagccggata

SEQ ID NO: 34256 - DNA, 25 bp, S. cerevisiae
gtttgtatattctcttacggtccac

SEQ ID NO: 34257 - DNA, 25 bp, S. cerevisiae
gttcttattgaaacgtcagggtcca

SEQ ID NO: 34258 - DNA, 25 bp, S. cerevisiae
gttccggaaacgctgatgggtccaa

SEQ ID NO: 34259 - DNA, 25 bp, S. cerevisiae
gtaccgacaaaccagtaaagcccag

SEQ ID NO: 34260 - DNA, 25 bp, S. cerevisiae
tgtaacgaaaacttggtaggccaat

SEQ ID NO: 34261 - DNA, 25 bp, S. cerevisiae
tggttcggaactttttagtgcctat

SEQ ID NO: 34262 - DNA, 25 bp, S. cerevisiae
tacttttaatcttttcttggtctag

SEQ ID NO: 34263 - DNA, 25 bp, S. cerevisiae
gacgtatcttcatcgctatcttgga

SEQ ID NO: 34264 - DNA, 25 bp, S. cerevisiae
gacggttctcattcgactattggaa

SEQ ID NO: 34265 - DNA, 25 bp, S. cerevisiae
gacgtctttagactcgccagggaaa

SEQ ID NO: 34266 - DNA, 25 bp, S. cerevisiae
gacgtttgcagagtattacgactac

SEQ ID NO: 34267 - DNA, 25 bp, S. cerevisiae
gacgatttggcagattcattcctcc

SEQ ID NO: 34268 - DNA, 25 bp, S. cerevisiae
gacgttatcgccaatatctacttcg

SEQ ID NO: 34269 - DNA, 25 bp, S. cerevisiae
gacgcattttatgctacccgtaatg

SEQ ID NO: 34270 - DNA, 25 bp, S. cerevisiae
gacgtttctaacttgccatctttgg

SEQ ID NO: 34271 - DNA, 25 bp, S. cerevisiae
gaccatttatctggagggaaaccct

SEQ ID NO: 34272 - DNA, 25 bp, S. cerevisiae
gacctaattggtccggtcaaagcat

SEQ ID NO: 34273 - DNA, 25 bp, S. cerevisiae
gaccaacatgttcccggtgcaggtt

SEQ ID NO: 34274 - DNA, 25 bp, S. cerevisiae
gacgcacaatttattgcctgggtta

SEQ ID NO: 34275 - DNA, 25 bp, S. cerevisiae
gacggtatcttctattttcctctca

SEQ ID NO: 34276 - DNA, 25 bp, S. cerevisiae
gacggtattctatttttttgctatt

SEQ ID NO: 34277 - DNA, 25 bp, S. cerevisiae
gaccgctttttagaatcgtacgaca

SEQ ID NO: 34278 - DNA, 25 bp, S. cerevisiae
gacggtattttattcgcacctacta

SEQ ID NO: 34279 - DNA, 25 bp, S. cerevisiae
gacggtttcttgtctttgatgaaca

SEQ ID NO: 34280 - DNA, 25 bp, S. cerevisiae
gacgaggtttttgcagactatggaa

SEQ ID NO: 34281 - DNA, 25 bp, S. cerevisiae
gacgaggttcttcaatttctggaga

SEQ ID NO: 34282 - DNA, 25 bp, S. cerevisiae
gacgtggaattcacacattttctca

SEQ ID NO: 34283 - DNA, 25 bp, S. cerevisiae
gacgatgtacgtgactgattcttta

SEQ ID NO: 34284 - DNA, 25 bp, S. cerevisiae
gacgttgatcctgatcttttctgga

SEQ ID NO: 34285 - DNA, 25 bp, S. cerevisiae
gacggctattccaaccacagttatt

SEQ ID NO: 34286 - DNA, 25 bp, S. cerevisiae
gacggatattccttggcatctgata

SEQ ID NO: 34287 - DNA, 25 bp, S. cerevisiae
gacgagagcccacttgtgcagagcc

SEQ ID NO: 34288 - DNA, 25 bp, S. cerevisiae
gacgatggcccatatgctgatgaca

SEQ ID NO: 34289 - DNA, 25 bp, S. cerevisiae
gacgaagctgaaatgcaaggattga

SEQ ID NO: 34290 - DNA, 25 bp, S. cerevisiae
gacgagagtggtaacagctgatcaa

SEQ ID NO: 34291 - DNA, 25 bp, S. cerevisiae
gacggcagctcgacaaacgtgctat

SEQ ID NO: 34292 - DNA, 25 bp, S. cerevisiae
gacgggttcccacgagattttgaga

SEQ ID NO: 34293 - DNA, 25 bp, S. cerevisiae
gacgttttcacctggttgttagcaa

SEQ ID NO: 34294 - DNA, 25 bp, S. cerevisiae
gacggtttagcttctgcattggcag

SEQ ID NO: 34295 - DNA, 25 bp, S. cerevisiae
gacggattctattcaatgttgcagg

SEQ ID NO: 34296 - DNA, 25 bp, S. cerevisiae
gacggatttctgatcaatgggcaca

SEQ ID NO: 34297 - DNA, 25 bp, S. cerevisiae
gacggacttctactattgacgcaaa

SEQ ID NO: 34298 - DNA, 25 bp, S. cerevisiae
gaccagtggtaagtacgcagagact

SEQ ID NO: 34299 - DNA, 25 bp, S. cerevisiae
gacggtggactagccagcattggta

SEQ ID NO: 34300 - DNA, 25 bp, S. cerevisiae
gacgaagtggctttattttcgcaaa

SEQ ID NO: 34301 - DNA, 25 bp, S. cerevisiae
gacggaaggtgagagccagatccaa

SEQ ID NO: 34302 - DNA, 25 bp, S. cerevisiae
gttggcagattttgaaccggcttct

SEQ ID NO: 34303 - DNA, 25 bp, S. cerevisiae
gacgagttttggacagaccttttca

SEQ ID NO: 34304 - DNA, 25 bp, S. cerevisiae
gacgtttatattccaagacctttca

SEQ ID NO: 34305 - DNA, 25 bp, S. cerevisiae
gacgtccttaatggtgatggtgaat

SEQ ID NO: 34306 - DNA, 25 bp, S. cerevisiae
gacgattacatattattcctgcaag

SEQ ID NO: 34307 - DNA, 25 bp, S. cerevisiae
gacgattatgtgtatgattctcccg

SEQ ID NO: 34308 - DNA, 25 bp, S. cerevisiae
gacggtgcatctatcaagatcgaca

SEQ ID NO: 34309 - DNA, 25 bp, S. cerevisiae
gacgatcgactgttccaattgtatt

SEQ ID NO: 34310 - DNA, 25 bp, S. cerevisiae
gacgagtgttttctactagtgccat

SEQ ID NO: 34311 - DNA, 25 bp, S. cerevisiae
gacggtattttcttatccaatggac

SEQ ID NO: 34312 - DNA, 25 bp, S. cerevisiae
gacggttctgtttctgaccatcaag

SEQ ID NO: 34313 - DNA, 25 bp, S. cerevisiae
gacgatgattcgattagactccaca

SEQ ID NO: 34314 - DNA, 25 bp, S. cerevisiae
gacgtcatttgcgaacaagctctca

SEQ ID NO: 34315 - DNA, 25 bp, S. cerevisiae
gacgttagtggaaaagctgcaactt

SEQ ID NO: 34316 - DNA, 25 bp, S. cerevisiae
gacgggcaaatgtattcagcaactt

SEQ ID NO: 34317 - DNA, 25 bp, S. cerevisiae
gacggtattttcttgatcacttctt

SEQ ID NO: 34318 - DNA, 25 bp, S. cerevisiae
gacggtgttgtaaataagctggcta

SEQ ID NO: 34319 - DNA, 25 bp, S. cerevisiae
gacgtttggtaatcaactctctaac

SEQ ID NO: 34320 - DNA, 25 bp, S. cerevisiae
gacgggtcctaaacataacgctaat

SEQ ID NO: 34321 - DNA, 25 bp, S. cerevisiae
gacgggtccgtcatgcaaagagtaa

SEQ ID NO: 34322 - DNA, 25 bp, S. cerevisiae
gacgggttcaacatcaaagcctcga

SEQ ID NO: 34323 - DNA, 25 bp, S. cerevisiae
gacggtgtccacagatcaaatggct

SEQ ID NO: 34324 - DNA, 25 bp, S. cerevisiae
gacggttataacttatctgctccaa

SEQ ID NO: 34325 - DNA, 25 bp, S. cerevisiae
gacggtctatgatataatggccctt

SEQ ID NO: 34326 - DNA, 25 bp, S. cerevisiae
gaccgctttaagaagactccctgaa

SEQ ID NO: 34327 - DNA, 25 bp, S. cerevisiae
gacgagtttgtcatcgaatccgtaa

SEQ ID NO: 34328 - DNA, 25 bp, S. cerevisiae
gacgttatcattggatgccagccac

SEQ ID NO: 34329 - DNA, 25 bp, S. cerevisiae
gacgtccatattgattacacctgat

SEQ ID NO: 34330 - DNA, 25 bp, S. cerevisiae
gacgtcctcattctcttacattgag

SEQ ID NO: 34331 - DNA, 25 bp, S. cerevisiae
gacgatatagcttcaggaacttcca

SEQ ID NO: 34332 - DNA, 25 bp, S. cerevisiae
gacgtgctacatttggattcgcgca

SEQ ID NO: 34333 - DNA, 25 bp, S. cerevisiae
gacgtcatgactgctggtactgcca

SEQ ID NO: 34334 - DNA, 25 bp, S. cerevisiae
gacgttgacgtcagattcagcacag

SEQ ID NO: 34335 - DNA, 25 bp, S. cerevisiae
gacgttcaagtagtttgcacacatg

SEQ ID NO: 34336 - DNA, 25 bp, S. cerevisiae
gacgctgtaaatgctactgccactg

SEQ ID NO: 34337 - DNA, 25 bp, S. cerevisiae
gacgtcttggatgatctttatcgca

SEQ ID NO: 34338 - DNA, 25 bp, S. cerevisiae
gaccttattatctttgcttacggcg

SEQ ID NO: 34339 - DNA, 25 bp, S. cerevisiae
gacgctaagaagtttcctctcgggt

SEQ ID NO: 34340 - DNA, 25 bp, S. cerevisiae
gacgttgctagatcaaattctctgc

SEQ ID NO: 34341 - DNA, 25 bp, S. cerevisiae
gacgacatattcttaactccaaaca

SEQ ID NO: 34342 - DNA, 25 bp, S. cerevisiae
gacgagtatagcttcaaccaatcaa

SEQ ID NO: 34343 - DNA, 25 bp, S. cerevisiae
gaccgacagcgttttttcatgtgaa

SEQ ID NO: 34344 - DNA, 25 bp, S. cerevisiae
gaccgtgtccttgtccaaagaatca

SEQ ID NO: 34345 - DNA, 25 bp, S. cerevisiae
gaccgggcgttgttccaagcgatta

SEQ ID NO: 34346 - DNA, 25 bp, S. cerevisiae
gacgcagaacgtctcgacaacaaaa

SEQ ID NO: 34347 - DNA, 25 bp, S. cerevisiae
gacgcaggacgtcatcggttcaaaa

SEQ ID NO: 34348 - DNA, 25 bp, S. cerevisiae
gacgtggccagtctcgtagctaaaa

SEQ ID NO: 34349 - DNA, 25 bp, S. cerevisiae
gacgcattgccagcacgtagtgcta

SEQ ID NO: 34350 - DNA, 25 bp, S. cerevisiae
gaccgtgttgcagcggattttaact

SEQ ID NO: 34351 - DNA, 25 bp, S. cerevisiae
gacccttgtgccctggactctgtaa

SEQ ID NO: 34352 - DNA, 25 bp, S. cerevisiae
gacgttccagtcaaggatatcctag

SEQ ID NO: 34353 - DNA, 25 bp, S. cerevisiae
gacgtatccactagcgaattccatt

SEQ ID NO: 34354 - DNA, 25 bp, S. cerevisiae
gacccgaacggatctctcgatatta

SEQ ID NO: 34355 - DNA, 25 bp, S. cerevisiae
gaccctgatatccagctttacgatg

SEQ ID NO: 34356 - DNA, 25 bp, S. cerevisiae
gacccactctgcgacgatatagcgg

SEQ ID NO: 34357 - DNA, 25 bp, S. cerevisiae
gacccaaataaccatcaagctcgtg

SEQ ID NO: 34358 - DNA, 25 bp, S. cerevisiae
gaccaaactaccttttgtgcggact

SEQ ID NO: 34359 - DNA, 25 bp, S. cerevisiae
gacgcaaattcggatactttcggtt

SEQ ID NO: 34360 - DNA, 25 bp, S. cerevisiae
gacgtccctggtgcgttcaagaaaa

SEQ ID NO: 34361 - DNA, 25 bp, S. cerevisiae
gacgtaccggtgctctatcaagaac

SEQ ID NO: 34362 - DNA, 25 bp, S. cerevisiae
gacgatgaccgcctatggctgaaaa

SEQ ID NO: 34363 - DNA, 25 bp, S. cerevisiae
gacgttcattcacacttgcaaccaa

SEQ ID NO: 34364 - DNA, 25 bp, S. cerevisiae
gacgtcatcacctctttgaaatcag

SEQ ID NO: 34365 - DNA, 25 bp, S. cerevisiae
gacgtcaccacaactgctcaaaaaa

SEQ ID NO: 34366 - DNA, 25 bp, S. cerevisiae
gacgctcttgactctgtaactaaag

SEQ ID NO: 34367 - DNA, 25 bp, S. cerevisiae
gacgagacctcgtggatccaagatc

SEQ ID NO: 34368 - DNA, 25 bp, S. cerevisiae
gacgatggcttcgaagtcactagaa

SEQ ID NO: 34369 - DNA, 25 bp, S. cerevisiae
gacgaggcgcctctgtgacaagaca

SEQ ID NO: 34370 - DNA, 25 bp, S. cerevisiae
gacgatcaccttcttaattgaaaaa

SEQ ID NO: 34371 - DNA, 25 bp, S. cerevisiae
gacgtactctatttatcatgggaaa

SEQ ID NO: 34372 - DNA, 25 bp, S. cerevisiae
gacgtttctcatcgatacatacaag

SEQ ID NO: 34373 - DNA, 25 bp, S. cerevisiae
gacgtaggcacatacaatcagcttt

SEQ ID NO: 34374 - DNA, 25 bp, S. cerevisiae
gacgccggccaaagtagcagcttat

SEQ ID NO: 34375 - DNA, 25 bp, S. cerevisiae
gacccggccaaatttgcggcttata

SEQ ID NO: 34376 - DNA, 25 bp, S. cerevisiae
gaccgccgcaatgaccatttttaag

SEQ ID NO: 34377 - DNA, 25 bp, S. cerevisiae
tacgcctcctttaacgatacctttg

SEQ ID NO: 34378 - DNA, 25 bp, S. cerevisiae
tcctccaggtggtcaacgtactttg

SEQ ID NO: 34379 - DNA, 25 bp, S. cerevisiae
ggtccagcgtggttacagttttgtg

SEQ ID NO: 34380 - DNA, 25 bp, S. cerevisiae
gagcaccccgttaccaaaagtctat

SEQ ID NO: 34381 - DNA, 25 bp, S. cerevisiae
gacccagcggtaaccaagaagcttt

SEQ ID NO: 34382 - DNA, 25 bp, S. cerevisiae
gacgcaccagattcctgttggacga

SEQ ID NO: 34383 - DNA, 25 bp, S. cerevisiae
gacccaaaagtgttaatgaacctat

SEQ ID NO: 34384 - DNA, 25 bp, S. cerevisiae
gaccccaaccacaagatctgtttat

SEQ ID NO: 34385 - DNA, 25 bp, S. cerevisiae
gaccccatcaacagagtacgatctt

SEQ ID NO: 34386 - DNA, 25 bp, S. cerevisiae
gacgacgctattgctgagttggaca

SEQ ID NO: 34387 - DNA, 25 bp, S. cerevisiae
gacgaccattccctgagagttaaag

SEQ ID NO: 34388 - DNA, 25 bp, S. cerevisiae
gacgaaattgtcttgataactacca

SEQ ID NO: 34389 - DNA, 25 bp, S. cerevisiae
gacgaaactcatatcggtcagccat

SEQ ID NO: 34390 - DNA, 25 bp, S. cerevisiae
gacgatgaacctaagctggacgcaa

SEQ ID NO: 34391 - DNA, 25 bp, S. cerevisiae
gagccaagaccaaccaagacactga

SEQ ID NO: 34392 - DNA, 25 bp, S. cerevisiae
tgcccaagaggacacaaggacgatt

SEQ ID NO: 34393 - DNA, 25 bp, S. cerevisiae
tgccccaaaatttcttggccgtcgt

SEQ ID NO: 34394 - DNA, 25 bp, S. cerevisiae
gacccaacactttcagtagaatact

SEQ ID NO: 34395 - DNA, 25 bp, S. cerevisiae
gacccttaagcttcaacgaatcacg

SEQ ID NO: 34396 - DNA, 25 bp, S. cerevisiae
gacgctttgccagcgcgtagtgctt

SEQ ID NO: 34397 - DNA, 25 bp, S. cerevisiae
gacgctatgaaatcgctctggtatt

SEQ ID NO: 34398 - DNA, 25 bp, S. cerevisiae
gacgtacagtgatgtctctcaattt

SEQ ID NO: 34399 - DNA, 25 bp, S. cerevisiae
gacgttcgtgatttctgtgaatttg

SEQ ID NO: 34400 - DNA, 25 bp, S. cerevisiae
gacgtttatgatttgactggctccg

SEQ ID NO: 34401 - DNA, 25 bp, S. cerevisiae
gaccttctatggtcagaccctgacg

SEQ ID NO: 34402 - DNA, 25 bp, S. cerevisiae
gaccctggcaagagagctggttcca

SEQ ID NO: 34403 - DNA, 25 bp, S. cerevisiae
gaccctgccactaaggcgaaggcta

SEQ ID NO: 34404 - DNA, 25 bp, S. cerevisiae
gaccctgccatcgaactcaaaagtg

SEQ ID NO: 34405 - DNA, 25 bp, S. cerevisiae
gacgagttcaatccatacacaagag

SEQ ID NO: 34406 - DNA, 25 bp, S. cerevisiae
gacgttcgaatccttacaagaccag

SEQ ID NO: 34407 - DNA, 25 bp, S. cerevisiae
gacgattctgagacgctgaaccaac

SEQ ID NO: 34408 - DNA, 25 bp, S. cerevisiae
gagctgttcacagtgttgacgaaaa

SEQ ID NO: 34409 - DNA, 25 bp, S. cerevisiae
gagcttacacttctcacaaaatttg

SEQ ID NO: 34410 - DNA, 25 bp, S. cerevisiae
gagcaggaacttgacccagaatcgg

SEQ ID NO: 34411 - DNA, 25 bp, S. cerevisiae
gacgatgcaactccgtccaatgact

SEQ ID NO: 34412 - DNA, 25 bp, S. cerevisiae
gacgaattcgacttgcaactgattg

SEQ ID NO: 34413 - DNA, 25 bp, S. cerevisiae
gacctagttttggaagggccgcaag

SEQ ID NO: 34414 - DNA, 25 bp, S. cerevisiae
gacgacagtcttgaaagcggccaaa

SEQ ID NO: 34415 - DNA, 25 bp, S. cerevisiae
gacgaagtctacgttcagaattcca

SEQ ID NO: 34416 - DNA, 25 bp, S. cerevisiae
gaccgagggaggaacaagctgcttt

SEQ ID NO: 34417 - DNA, 25 bp, S. cerevisiae
gacgctgaagatggttaaacgttct

SEQ ID NO: 34418 - DNA, 25 bp, S. cerevisiae
gacctggaagagacaaaacactttg

SEQ ID NO: 34419 - DNA, 25 bp, S. cerevisiae
gacccaagctgtatgaacatccctt

SEQ ID NO: 34420 - DNA, 25 bp, S. cerevisiae
gacccaaattttgcatacgcgtata

SEQ ID NO: 34421 - DNA, 25 bp, S. cerevisiae
gaccccgattttggtatgtgcgcat

SEQ ID NO: 34422 - DNA, 25 bp, S. cerevisiae
gacgacggtgacattgaagctgctg

SEQ ID NO: 34423 - DNA, 25 bp, S. cerevisiae
gacgcgcccatatcctgtaaatgta

SEQ ID NO: 34424 - DNA, 25 bp, S. cerevisiae
gacgagatccgtaccattatagaga

SEQ ID NO: 34425 - DNA, 25 bp, S. cerevisiae
gacgctagcggtaacatttacacca

SEQ ID NO: 34426 - DNA, 25 bp, S. cerevisiae
gacgctaaagtatctctcgagtcca

SEQ ID NO: 34427 - DNA, 25 bp, S. cerevisiae
gaccaaatagcgttgcattcagcgt

SEQ ID NO: 34428 - DNA, 25 bp, S. cerevisiae
gacccgatattgacatcatgtgcgg

SEQ ID NO: 34429 - DNA, 25 bp, S. cerevisiae
gacccggacatcaatatggcctcgt

SEQ ID NO: 34430 - DNA, 25 bp, S. cerevisiae
gacctctggaaccatacgagcatcg

SEQ ID NO: 34431 - DNA, 25 bp, S. cerevisiae
gacgcatttgccttagatcctttag

SEQ ID NO: 34432 - DNA, 25 bp, S. cerevisiae
gacgatggtataaccttcgcaagat

SEQ ID NO: 34433 - DNA, 25 bp, S. cerevisiae
gacgagctccttaaggtttctacaa

SEQ ID NO: 34434 - DNA, 25 bp, S. cerevisiae
gacgattttcgcaagatgtttctag

SEQ ID NO: 34435 - DNA, 25 bp, S. cerevisiae
gacgattattctcttttctctagtt

SEQ ID NO: 34436 - DNA, 25 bp, S. cerevisiae
gacgatgaaagcctccataagctct

SEQ ID NO: 34437 - DNA, 25 bp, S. cerevisiae
gacgatattgacaccatgtaccatg

SEQ ID NO: 34438 - DNA, 25 bp, S. cerevisiae
gacgagttgatttcactggctacag

SEQ ID NO: 34439 - DNA, 25 bp, S. cerevisiae
gacgatgcagatttacacggctttg

SEQ ID NO: 34440 - DNA, 25 bp, S. cerevisiae
gacgccagatcagatagcggcttat

SEQ ID NO: 34441 - DNA, 25 bp, S. cerevisiae
gacgcaatgtttcactatggcttca

SEQ ID NO: 34442 - DNA, 25 bp, S. cerevisiae
gacgttccattgtatcaagctgata

SEQ ID NO: 34443 - DNA, 25 bp, S. cerevisiae
gacgctatcgcaaatcaagagtact

SEQ ID NO: 34444 - DNA, 25 bp, S. cerevisiae
gacctttccgatgggagtggccaag

SEQ ID NO: 34445 - DNA, 25 bp, S. cerevisiae
gacgctttgctaaaggaagacgctt

SEQ ID NO: 34446 - DNA, 25 bp, S. cerevisiae
gacgttcttctataaaaccgctgca

SEQ ID NO: 34447 - DNA, 25 bp, S. cerevisiae
gacccggtatcatcacattaatcaa

SEQ ID NO: 34448 - DNA, 25 bp, S. cerevisiae
gacccgttccatacgttaccaatag

SEQ ID NO: 34449 - DNA, 25 bp, S. cerevisiae
gacccagttggctcctacgaaagag

SEQ ID NO: 34450 - DNA, 25 bp, S. cerevisiae
gacccctattgcacttgttctgaaa

SEQ ID NO: 34451 - DNA, 25 bp, S. cerevisiae
gaccaactaggcgacgtttctacat

SEQ ID NO: 34452 - DNA, 25 bp, S. cerevisiae
gaccggcaccccatctgatgaaaag

SEQ ID NO: 34453 - DNA, 25 bp, S. cerevisiae
gaccgccaccctagtaatttgatgt

SEQ ID NO: 34454 - DNA, 25 bp, S. cerevisiae
gacgctatatccaggcctttaatta

SEQ ID NO: 34455 - DNA, 25 bp, S. cerevisiae
gacgatacagacagtgcctcttctt

SEQ ID NO: 34456 - DNA, 25 bp, S. cerevisiae
gacgaagaagcaaccgccatgttta

SEQ ID NO: 34457 - DNA, 25 bp, S. cerevisiae
gacgaagaagatatcagcgacctta

SEQ ID NO: 34458 - DNA, 25 bp, S. cerevisiae
gacgaagcatatgcccgagagcaat

SEQ ID NO: 34459 - DNA, 25 bp, S. cerevisiae
gacgacgatttcaccaatgaattga

SEQ ID NO: 34460 - DNA, 25 bp, S. cerevisiae
gacgaaatcaatctccgtttatacc

SEQ ID NO: 34461 - DNA, 25 bp, S. cerevisiae
gacccttgtatcctatccttttaag

SEQ ID NO: 34462 - DNA, 25 bp, S. cerevisiae
gaccgtgaggtctgttttcgtcatc

SEQ ID NO: 34463 - DNA, 25 bp, S. cerevisiae
gaccgtgggagatgctatttcagac

SEQ ID NO: 34464 - DNA, 25 bp, S. cerevisiae
gaccgatgtaacaactttaggatct

SEQ ID NO: 34465 - DNA, 25 bp, S. cerevisiae
gacgcaatgagatactactacccag

SEQ ID NO: 34466 - DNA, 25 bp, S. cerevisiae
gacgcagacgttttatatgacccaa

SEQ ID NO: 34467 - DNA, 25 bp, S. cerevisiae
gacgatgtctttcgatcataagcca

SEQ ID NO: 34468 - DNA, 25 bp, S. cerevisiae
gacgagtctcacgatgatgttaaca

SEQ ID NO: 34469 - DNA, 25 bp, S. cerevisiae
gacgagttgatcgatgacttgcaca

SEQ ID NO: 34470 - DNA, 25 bp, S. cerevisiae
gacgattcttcctctacagatactg

SEQ ID NO: 34471 - DNA, 25 bp, S. cerevisiae
gacctggtccacatgattgacgaat

SEQ ID NO: 34472 - DNA, 25 bp, S. cerevisiae
gacctccaccaaggttaagcaattg

SEQ ID NO: 34473 - DNA, 25 bp, S. cerevisiae
gaccccacgaagagaatcaccattg

SEQ ID NO: 34474 - DNA, 25 bp, S. cerevisiae
gaccgcttaaaaactatcgcttcta

SEQ ID NO: 34475 - DNA, 25 bp, S. cerevisiae
gacgccccaaattaatgacaccttt

SEQ ID NO: 34476 - DNA, 25 bp, S. cerevisiae
gacgcatcccatctaaaaccggtaa

SEQ ID NO: 34477 - DNA, 25 bp, S. cerevisiae
gacgcatctccaccaaggataacga

SEQ ID NO: 34478 - DNA, 25 bp, S. cerevisiae
gacgccttccagtagcgataacaca

SEQ ID NO: 34479 - DNA, 25 bp, S. cerevisiae
gacgccgcccatgatcgtagataat

SEQ ID NO: 34480 - DNA, 25 bp, S. cerevisiae
gacgacttcgtcaacgttatactgg

SEQ ID NO: 34481 - DNA, 25 bp, S. cerevisiae
gacgatcttcgtcgccgtaaaagag

SEQ ID NO: 34482 - DNA, 25 bp, S. cerevisiae
gacgagtactcattccaagatttta

SEQ ID NO: 34483 - DNA, 25 bp, S. cerevisiae
gacgaggaccacgaccatgatgaat

SEQ ID NO: 34484 - DNA, 25 bp, S. cerevisiae
gacgaggcacctactacatgatgca

SEQ ID NO: 34485 - DNA, 25 bp, S. cerevisiae
gacgatggctgcttacttgcaatat

SEQ ID NO: 34486 - DNA, 25 bp, S. cerevisiae
gacgcgcagcgattttttaataggt

SEQ ID NO: 34487 - DNA, 25 bp, S. cerevisiae
gacgctgcagggatacttattgggt

SEQ ID NO: 34488 - DNA, 25 bp, S. cerevisiae
gaccgcgttcaatgatttgctggat

SEQ ID NO: 34489 - DNA, 25 bp, S. cerevisiae
gacgcacgtcgatgaatttgttatt

SEQ ID NO: 34490 - DNA, 25 bp, S. cerevisiae
tgagccgggcgataattggtattct

SEQ ID NO: 34491 - DNA, 25 bp, S. cerevisiae
gacctagactgggatttgcgccttc

SEQ ID NO: 34492 - DNA, 25 bp, S. cerevisiae
gatcctagaagtccatgtcgaacca

SEQ ID NO: 34493 - DNA, 25 bp, S. cerevisiae
gacctacggcgttgatagaacttaa

SEQ ID NO: 34494 - DNA, 25 bp, S. cerevisiae
gaccccggctgatcaagaactattc

SEQ ID NO: 34495 - DNA, 25 bp, S. cerevisiae
gacctgcagggttttgaaactttca

SEQ ID NO: 34496 - DNA, 25 bp, S. cerevisiae
gacgaaggtttcaatgcgttctttt

SEQ ID NO: 34497 - DNA, 25 bp, S. cerevisiae
gacgacatactctctcctatagatt

SEQ ID NO: 34498 - DNA, 25 bp, S. cerevisiae
gacgaatattctttctcataagctt

SEQ ID NO: 34499 - DNA, 25 bp, S. cerevisiae
gaccccttatctttgttagcattgg

SEQ ID NO: 34500 - DNA, 25 bp, S. cerevisiae
gacccaatgggtgctttggccaaat

SEQ ID NO: 34501 - DNA, 25 bp, S. cerevisiae
gacccttgaggtctacgaggaaaag

SEQ ID NO: 34502 - DNA, 25 bp, S. cerevisiae
gacgacgatgagtttgttctggcat

SEQ ID NO: 34503 - DNA, 25 bp, S. cerevisiae
gacgcaattattacgactgccgctg

SEQ ID NO: 34504 - DNA, 25 bp, S. cerevisiae
gacgagtgttttcatgttcacctat

SEQ ID NO: 34505 - DNA, 25 bp, S. cerevisiae
gaccctgatgtctgttttcaacatg

SEQ ID NO: 34506 - DNA, 25 bp, S. cerevisiae
gaccaccgtctacttattcgaatat

SEQ ID NO: 34507 - DNA, 25 bp, S. cerevisiae
gaccacccctaatgcattaaacaac

SEQ ID NO: 34508 - DNA, 25 bp, S. cerevisiae
gaccccaagtcgctattagatgcta

SEQ ID NO: 34509 - DNA, 25 bp, S. cerevisiae
gacctccggtcaagctgttaagtac

SEQ ID NO: 34510 - DNA, 25 bp, S. cerevisiae
gaccccagcgtatctggactttgaa

SEQ ID NO: 34511 - DNA, 25 bp, S. cerevisiae
gaccccacggactatcgatttttag

SEQ ID NO: 34512 - DNA, 25 bp, S. cerevisiae
gacgaccaaggctacatctttgatt

SEQ ID NO: 34513 - DNA, 25 bp, S. cerevisiae
gaccagtaaggcctcaatttatttt

SEQ ID NO: 34514 - DNA, 25 bp, S. cerevisiae
gaccggaatggacctttattttgat

SEQ ID NO: 34515 - DNA, 25 bp, S. cerevisiae
gacgctgttactatccgtactagaa

SEQ ID NO: 34516 - DNA, 25 bp, S. cerevisiae
gaccgtggctgacaccgttatgaga

SEQ ID NO: 34517 - DNA, 25 bp, S. cerevisiae
gaccggagtttaacacctcaatctt

SEQ ID NO: 34518 - DNA, 25 bp, S. cerevisiae
gatccgaaccgtaaggcacttttct

SEQ ID NO: 34519 - DNA, 25 bp, S. cerevisiae
gagcctttccagtataccttgggtt

SEQ ID NO: 34520 - DNA, 25 bp, S. cerevisiae
gagcgctttcaataacggtggaagt

SEQ ID NO: 34521 - DNA, 25 bp, S. cerevisiae
gacgctttaaggtcactagacgata

SEQ ID NO: 34522 - DNA, 25 bp, S. cerevisiae
gacgcaagtatcatcactggtgagc

SEQ ID NO: 34523 - DNA, 25 bp, S. cerevisiae
gacgcaaactcttatctgtgtcttg

SEQ ID NO: 34524 - DNA, 25 bp, S. cerevisiae
gacgctgaatctgcaatttctattg

SEQ ID NO: 34525 - DNA, 25 bp, S. cerevisiae
gagcgctgaacgtgattttccattg

SEQ ID NO: 34526 - DNA, 25 bp, S. cerevisiae
gataccgaggacacttacgtagttg

SEQ ID NO: 34527 - DNA, 25 bp, S. cerevisiae
gtttgggtaaccacgtcatgggtat

SEQ ID NO: 34528 - DNA, 25 bp, S. cerevisiae
gtcttggttaaacaccttggcagtc

SEQ ID NO: 34529 - DNA, 25 bp, S. cerevisiae
gttacggtaaggctctcttggaact

SEQ ID NO: 34530 - DNA, 25 bp, S. cerevisiae
gggtctgcgtactgtttcgggtact

SEQ ID NO: 34531 - DNA, 25 bp, S. cerevisiae
gagagtttgaactcttcccggtcaa

SEQ ID NO: 34532 - DNA, 25 bp, S. cerevisiae
gacctttatattgcgtactcgacat

SEQ ID NO: 34533 - DNA, 25 bp, S. cerevisiae
tgacacttttatacggaacctggtt

SEQ ID NO: 34534 - DNA, 25 bp, S. cerevisiae
gagttcgttaccattccgtgtgctt

SEQ ID NO: 34535 - DNA, 25 bp, S. cerevisiae
gacgacgctcttatttacggtatca

SEQ ID NO: 34536 - DNA, 25 bp, S. cerevisiae
gacctttttgagattgcagccgtac

SEQ ID NO: 34537 - DNA, 25 bp, S. cerevisiae
gacctcttgccggtggaagggacaa

SEQ ID NO: 34538 - DNA, 25 bp, S. cerevisiae
gacccgtcgtttaagattggacaca

SEQ ID NO: 34539 - DNA, 25 bp, S. cerevisiae
gaccggacgttattttgatgggcaa

SEQ ID NO: 34540 - DNA, 25 bp, S. cerevisiae
gacctggtccttaaaactgtgcgat

SEQ ID NO: 34541 - DNA, 25 bp, S. cerevisiae
gacgcttggtctgaaatcctaggat

SEQ ID NO: 34542 - DNA, 25 bp, S. cerevisiae
gacgcttcttacagaatccattgga

SEQ ID NO: 34543 - DNA, 25 bp, S. cerevisiae
gacgcattcattaccaacaccaagt

SEQ ID NO: 34544 - DNA, 25 bp, S. cerevisiae
gaccattattcccaaacgcaagtat

SEQ ID NO: 34545 - DNA, 25 bp, S. cerevisiae
gacccttttccaaacatgtgtgctg

SEQ ID NO: 34546 - DNA, 25 bp, S. cerevisiae
gacccttatttgaggcgtgtcttaa

SEQ ID NO: 34547 - DNA, 25 bp, S. cerevisiae
gaccttggtttcagtcgagtctttt

SEQ ID NO: 34548 - DNA, 25 bp, S. cerevisiae
gaccttcttttccttgcaaatcttt

SEQ ID NO: 34549 - DNA, 25 bp, S. cerevisiae
gaccgctctactccaaaatcaaatg

SEQ ID NO: 34550 - DNA, 25 bp, S. cerevisiae
gaccatgaccatcgaatgagctatt

SEQ ID NO: 34551 - DNA, 25 bp, S. cerevisiae
gacgcttctatttctaatcctttta

SEQ ID NO: 34552 - DNA, 25 bp, S. cerevisiae
gaccgttgtttccaatcctggagat

SEQ ID NO: 34553 - DNA, 25 bp, S. cerevisiae
gagaagtattttggccattccggtc

SEQ ID NO: 34554 - DNA, 25 bp, S. cerevisiae
gaccctcttgtaggacctgtcaaaa

SEQ ID NO: 34555 - DNA, 25 bp, S. cerevisiae
gacgctatttgttgggcgttcaaac

SEQ ID NO: 34556 - DNA, 25 bp, S. cerevisiae
gacctcctttttcatttcaatggcg

SEQ ID NO: 34557 - DNA, 25 bp, S. cerevisiae
gacgactattttaccatcttacatg

SEQ ID NO: 34558 - DNA, 25 bp, S. cerevisiae
gacgaatttgtcgacgcatcggaat

SEQ ID NO: 34559 - DNA, 25 bp, S. cerevisiae
gacgaatatttgcacgatcccgact

SEQ ID NO: 34560 - DNA, 25 bp, S. cerevisiae
gacccaacttagctatcaacaacgt

SEQ ID NO: 34561 - DNA, 25 bp, S. cerevisiae
gaccgctacttcatctaaaacactt

SEQ ID NO: 34562 - DNA, 25 bp, S. cerevisiae
gaccgcgttccaacagaaatacgtt

SEQ ID NO: 34563 - DNA, 25 bp, S. cerevisiae
gtccaagcttcctggatccataagg

SEQ ID NO: 34564 - DNA, 25 bp, S. cerevisiae
ggacggtacttcaggtgttacgcga

SEQ ID NO: 34565 - DNA, 25 bp, S. cerevisiae
gaccagagttttcagcggcaattcc

SEQ ID NO: 34566 - DNA, 25 bp, S. cerevisiae
gacgaattttctcaggacatgctct

SEQ ID NO: 34567 - DNA, 25 bp, S. cerevisiae
gacgcgcttaagatctggtgactgt

SEQ ID NO: 34568 - DNA, 25 bp, S. cerevisiae
gacccattcaaactttctggtgctc

SEQ ID NO: 34569 - DNA, 25 bp, S. cerevisiae
gacgacataaaagttccgaagccat

SEQ ID NO: 34570 - DNA, 25 bp, S. cerevisiae
gacgaatacactatcaccgaattta

SEQ ID NO: 34571 - DNA, 25 bp, S. cerevisiae
gacgaatcacacattaccaatattg

SEQ ID NO: 34572 - DNA, 25 bp, S. cerevisiae
gacgaagaccgttatgctccaattg

SEQ ID NO: 34573 - DNA, 25 bp, S. cerevisiae
gaccgaggacttaagagcgcaacta

SEQ ID NO: 34574 - DNA, 25 bp, S. cerevisiae
gaccgaggaaacatggctagcacaa

SEQ ID NO: 34575 - DNA, 25 bp, S. cerevisiae
gaccagggaaccgaggatcagcaaa

SEQ ID NO: 34576 - DNA, 25 bp, S. cerevisiae
gagaaggatgcatctccagttccat

SEQ ID NO: 34577 - DNA, 25 bp, S. cerevisiae
gaccgtagagtcattgttcctggag

SEQ ID NO: 34578 - DNA, 25 bp, S. cerevisiae
gaccgcaagagagattttcgccgcc

SEQ ID NO: 34579 - DNA, 25 bp, S. cerevisiae
gaccttcctgatgaaagtgagccct

SEQ ID NO: 34580 - DNA, 25 bp, S. cerevisiae
gatccagttttagaagcttacctta

SEQ ID NO: 34581 - DNA, 25 bp, S. cerevisiae
gacccatattttctacccaatttca

SEQ ID NO: 34582 - DNA, 25 bp, S. cerevisiae
gagcgtcgttttttataagcctcca

SEQ ID NO: 34583 - DNA, 25 bp, S. cerevisiae
gagcccacttttgtaaatgccacga

SEQ ID NO: 34584 - DNA, 25 bp, S. cerevisiae
gacgccgttgatgcactaagtagaa

SEQ ID NO: 34585 - DNA, 25 bp, S. cerevisiae
gacgcgatgttaaattctcctatag

SEQ ID NO: 34586 - DNA, 25 bp, S. cerevisiae
gagcacgtactacaaactactaggg

SEQ ID NO: 34587 - DNA, 25 bp, S. cerevisiae
gagcggtaccaatcacactattagg

SEQ ID NO: 34588 - DNA, 25 bp, S. cerevisiae
gacgctttccaaccatacaattatt

SEQ ID NO: 34589 - DNA, 25 bp, S. cerevisiae
gacgcaatgtcatatcccatcatat

SEQ ID NO: 34590 - DNA, 25 bp, S. cerevisiae
gacgcgatttcaacccaccaaggga

SEQ ID NO: 34591 - DNA, 25 bp, S. cerevisiae
gacgccatgtttgccaatccaaagg

SEQ ID NO: 34592 - DNA, 25 bp, S. cerevisiae
gacgcatcaatgatagcggtccaaa

SEQ ID NO: 34593 - DNA, 25 bp, S. cerevisiae
gacgcatcaacggatcggcacgata

SEQ ID NO: 34594 - DNA, 25 bp, S. cerevisiae
gacgctggcgccctttgtaaagaaa

SEQ ID NO: 34595 - DNA, 25 bp, S. cerevisiae
gagccttccgttggtgtaaagacaa

SEQ ID NO: 34596 - DNA, 25 bp, S. cerevisiae
gacccaggtgttatttccgtcaaga

SEQ ID NO: 34597 - DNA, 25 bp, S. cerevisiae
gacgcgtattgttatgaggtctcgt

SEQ ID NO: 34598 - DNA, 25 bp, S. cerevisiae
gaccgaaattgcagcatccttacaa

SEQ ID NO: 34599 - DNA, 25 bp, S. cerevisiae
gacgcattgtccgtgttgtcacaga

SEQ ID NO: 34600 - DNA, 25 bp, S. cerevisiae
gagccctaaatgtgctggcttagta

SEQ ID NO: 34601 - DNA, 25 bp, S. cerevisiae
gacccagacaggcaattttcaagta

SEQ ID NO: 34602 - DNA, 25 bp, S. cerevisiae
gaccctgaaggtcgtgttgctcacg

SEQ ID NO: 34603 - DNA, 25 bp, S. cerevisiae
gaccttttggatctgtactacgacg

SEQ ID NO: 34604 - DNA, 25 bp, S. cerevisiae
gaccactgcaggacatttcagaact

SEQ ID NO: 34605 - DNA, 25 bp, S. cerevisiae
gacgcctacaccttgattatgatta

SEQ ID NO: 34606 - DNA, 25 bp, S. cerevisiae
gaccacagaaactctctttggaatg

SEQ ID NO: 34607 - DNA, 25 bp, S. cerevisiae
gagctctaaaaatttgtcgttctaa

SEQ ID NO: 34608 - DNA, 25 bp, S. cerevisiae
gaccaactaattactgctcaaccgc

SEQ ID NO: 34609 - DNA, 25 bp, S. cerevisiae
gaccaatttttgaatctgaaactag

SEQ ID NO: 34610 - DNA, 25 bp, S. cerevisiae
gacgctttattttatatccatccat

SEQ ID NO: 34611 - DNA, 25 bp, S. cerevisiae
gagctgctgaaagcctcggatttac

SEQ ID NO: 34612 - DNA, 25 bp, S. cerevisiae
gacgcaagacgtcgaaactattctg

SEQ ID NO: 34613 - DNA, 25 bp, S. cerevisiae
gacgctgagccgacgagaaaatgtt

SEQ ID NO: 34614 - DNA, 25 bp, S. cerevisiae
gacgctggaccagattacaggccta

SEQ ID NO: 34615 - DNA, 25 bp, S. cerevisiae
gaccttaaacatatacacgctctga

SEQ ID NO: 34616 - DNA, 25 bp, S. cerevisiae
gacccagagaatatcttcccttata

SEQ ID NO: 34617 - DNA, 25 bp, S. cerevisiae
gacccagtgcaagatttccagttga

SEQ ID NO: 34618 - DNA, 25 bp, S. cerevisiae
gaccacggtgacgtttctaaccaat

SEQ ID NO: 34619 - DNA, 25 bp, S. cerevisiae
gacctacgaagagttatccaagcca

SEQ ID NO: 34620 - DNA, 25 bp, S. cerevisiae
gacgcctacatttccaaatgccaac

SEQ ID NO: 34621 - DNA, 25 bp, S. cerevisiae
gagacctggtcaaaagcaacgtgca

SEQ ID NO: 34622 - DNA, 25 bp, S. cerevisiae
gaccgctggccgcaacaaatgatga

SEQ ID NO: 34623 - DNA, 25 bp, S. cerevisiae
gacgcagcgtccatattccaagata

SEQ ID NO: 34624 - DNA, 25 bp, S. cerevisiae
gacgccaactacttctccggtaaag

SEQ ID NO: 34625 - DNA, 25 bp, S. cerevisiae
gacgcaaactgggtccattttataa

SEQ ID NO: 34626 - DNA, 25 bp, S. cerevisiae
gacgctggccgctataattgacggt

SEQ ID NO: 34627 - DNA, 25 bp, S. cerevisiae
gacgctaggcgctacaatatccagt

SEQ ID NO: 34628 - DNA, 25 bp, S. cerevisiae
gacgctcatgtccaaaagttcgttg

SEQ ID NO: 34629 - DNA, 25 bp, S. cerevisiae
gaccacgctccattagaggatcctt

SEQ ID NO: 34630 - DNA, 25 bp, S. cerevisiae
gacgcgcacgtcgatagtgtactta

SEQ ID NO: 34631 - DNA, 25 bp, S. cerevisiae
gacccacccagcaggacatattaag

SEQ ID NO: 34632 - DNA, 25 bp, S. cerevisiae
gacgccacttcgataatctattcca

SEQ ID NO: 34633 - DNA, 25 bp, S. cerevisiae
gagccctccttactttcaattaata

SEQ ID NO: 34634 - DNA, 25 bp, S. cerevisiae
gaccctgtgttgaatgccattgtga

SEQ ID NO: 34635 - DNA, 25 bp, S. cerevisiae
gaccgcgattacaatcaccgtagtg

SEQ ID NO: 34636 - DNA, 25 bp, S. cerevisiae
gacctcaagtacaagaccgactgct

SEQ ID NO: 34637 - DNA, 25 bp, S. cerevisiae
gacctaattaccaaccatggcgcta

SEQ ID NO: 34638 - DNA, 25 bp, S. cerevisiae
gacgctcaagcaactcaaacactgg

SEQ ID NO: 34639 - DNA, 25 bp, S. cerevisiae
gacgctaccggtgttgcgattagac

SEQ ID NO: 34640 - DNA, 25 bp, S. cerevisiae
gacgctgacgccttgtttggtgaaa

SEQ ID NO: 34641 - DNA, 25 bp, S. cerevisiae
gacgctgtcactattcgtaccagaa

SEQ ID NO: 34642 - DNA, 25 bp, S. cerevisiae
gacgcgactttcatttacagcaaaa

SEQ ID NO: 34643 - DNA, 25 bp, S. cerevisiae
gagcctccttcgatctataacggga

SEQ ID NO: 34644 - DNA, 25 bp, S. cerevisiae
gacccctccgtttatggaagacgct

SEQ ID NO: 34645 - DNA, 25 bp, S. cerevisiae
gacctacattcagggctggcagaca

SEQ ID NO: 34646 - DNA, 25 bp, S. cerevisiae
gacgctgactttggtctcatatctg

SEQ ID NO: 34647 - DNA, 25 bp, S. cerevisiae
gacgctcactcaaagtcatctggta

SEQ ID NO: 34648 - DNA, 25 bp, S. cerevisiae
gacgccagctgcaaagaagccatta

SEQ ID NO: 34649 - DNA, 25 bp, S. cerevisiae
gacctatctgaagactgctgctttg

SEQ ID NO: 34650 - DNA, 25 bp, S. cerevisiae
gacctatccagagaggctgcagtgt

SEQ ID NO: 34651 - DNA, 25 bp, S. cerevisiae
gacccaagcagaagactcggcgtta

SEQ ID NO: 34652 - DNA, 25 bp, S. cerevisiae
gacccctcaatcaatacggcgtatg

SEQ ID NO: 34653 - DNA, 25 bp, S. cerevisiae
gaccgctccttttcgatggattaat

SEQ ID NO: 34654 - DNA, 25 bp, S. cerevisiae
gacgcgatgctggtttcgggatatt

SEQ ID NO: 34655 - DNA, 25 bp, S. cerevisiae
gaccaaccggactggagtgcatcta

SEQ ID NO: 34656 - DNA, 25 bp, S. cerevisiae
gaccaaagcttgttctggagttcca

SEQ ID NO: 34657 - DNA, 25 bp, S. cerevisiae
gaccacaactatgacggaccagaca

SEQ ID NO: 34658 - DNA, 25 bp, S. cerevisiae
gacccatactggtaaagcacaagag

SEQ ID NO: 34659 - DNA, 25 bp, S. cerevisiae
gaccacttatggtgccattatcatg

SEQ ID NO: 34660 - DNA, 25 bp, S. cerevisiae
gacgccactatggagaatctgtcct

SEQ ID NO: 34661 - DNA, 25 bp, S. cerevisiae
gacgctgcgttggaaattacctcta

SEQ ID NO: 34662 - DNA, 25 bp, S. cerevisiae
gacgccctgtctggaaatgtatttt

SEQ ID NO: 34663 - DNA, 25 bp, S. cerevisiae
gaccgtctgtcttggaagttttatc

SEQ ID NO: 34664 - DNA, 25 bp, S. cerevisiae
gaccgctgctgattgggaagccatc

SEQ ID NO: 34665 - DNA, 25 bp, S. cerevisiae
gaccgcatgatattccgagagtttc

SEQ ID NO: 34666 - DNA, 25 bp, S. cerevisiae
gacgccatcatgtgcggaagattat

SEQ ID NO: 34667 - DNA, 25 bp, S. cerevisiae
gacgccaatggcctcgaaaaatcac

SEQ ID NO: 34668 - DNA, 25 bp, S. cerevisiae
gagctacctgtcaaataccaactat

SEQ ID NO: 34669 - DNA, 25 bp, S. cerevisiae
gagcttactgtttaaggcacacggt

SEQ ID NO: 34670 - DNA, 25 bp, S. cerevisiae
gagcattttggaaactgccccgatt

SEQ ID NO: 34671 - DNA, 25 bp, S. cerevisiae
gagctaaagataacactccctccgg

SEQ ID NO: 34672 - DNA, 25 bp, S. cerevisiae
gatctacaacgtcatttaccggctg

SEQ ID NO: 34673 - DNA, 25 bp, S. cerevisiae
gacccgggacttatcatgtgcgaac

SEQ ID NO: 34674 - DNA, 25 bp, S. cerevisiae
gacgccggtgacttggtcatagaat

SEQ ID NO: 34675 - DNA, 25 bp, S. cerevisiae
gaccgtcgagatttggtccatgatt

SEQ ID NO: 34676 - DNA, 25 bp, S. cerevisiae
gacccgctaatgtgtcttcatttgg

SEQ ID NO: 34677 - DNA, 25 bp, S. cerevisiae
gacccagtagattcgtatgcatttt

SEQ ID NO: 34678 - DNA, 25 bp, S. cerevisiae
gaccgagcctattctgtctagattt

SEQ ID NO: 34679 - DNA, 25 bp, S. cerevisiae
gacctctgtgtgtgtggctcgaagc

SEQ ID NO: 34680 - DNA, 25 bp, S. cerevisiae
gaccccttgatggattctctgcaat

SEQ ID NO: 34681 - DNA, 25 bp, S. cerevisiae
gacgcgcatgtgttagctgcacaga

SEQ ID NO: 34682 - DNA, 25 bp, S. cerevisiae
gaccttctgctactgcttcagagaa

SEQ ID NO: 34683 - DNA, 25 bp, S. cerevisiae
gaccattccatgaccttaggagcgg

SEQ ID NO: 34684 - DNA, 25 bp, S. cerevisiae
gaccatgtacctcccatatcaaggg

SEQ ID NO: 34685 - DNA, 25 bp, S. cerevisiae
gagcttgtgaccattaataatcgga

SEQ ID NO: 34686 - DNA, 25 bp, S. cerevisiae
gagcttgcggctcaaataacctggc

SEQ ID NO: 34687 - DNA, 25 bp, S. cerevisiae
gagcgtagcctctcaattaggtagc

SEQ ID NO: 34688 - DNA, 25 bp, S. cerevisiae
gagcggtatctcaagacgttaggtt

SEQ ID NO: 34689 - DNA, 25 bp, S. cerevisiae
gagcagatgtccaacgacgattttc

SEQ ID NO: 34690 - DNA, 25 bp, S. cerevisiae
gacgccatagaccatgacgatagac

SEQ ID NO: 34691 - DNA, 25 bp, S. cerevisiae
gacgccattgcgcaggaattgagtt

SEQ ID NO: 34692 - DNA, 25 bp, S. cerevisiae
gagcccattggcagtacatgtggtt

SEQ ID NO: 34693 - DNA, 25 bp, S. cerevisiae
gacgcctatatgtcctcatactttg

SEQ ID NO: 34694 - DNA, 25 bp, S. cerevisiae
gaccgtatagccgaatactctctga

SEQ ID NO: 34695 - DNA, 25 bp, S. cerevisiae
gaccctggacttggttttgctaaga

SEQ ID NO: 34696 - DNA, 25 bp, S. cerevisiae
gatccctggtttattgcgttacgaa

SEQ ID NO: 34697 - DNA, 25 bp, S. cerevisiae
gaccctggtttattgtcgatggaaa

SEQ ID NO: 34698 - DNA, 25 bp, S. cerevisiae
gaccaagattttttcgttcctctca

SEQ ID NO: 34699 - DNA, 25 bp, S. cerevisiae
gaccatagattttttcgatcctgta

SEQ ID NO: 34700 - DNA, 25 bp, S. cerevisiae
gaccaaatatctgcggcttccttat

SEQ ID NO: 34701 - DNA, 25 bp, S. cerevisiae
gaccggtgacgtcattttatctgtg

SEQ ID NO: 34702 - DNA, 25 bp, S. cerevisiae
gaccaggctgaagtaatcttttcgt

SEQ ID NO: 34703 - DNA, 25 bp, S. cerevisiae
gaccaggctgagttcatgtcaactt

SEQ ID NO: 34704 - DNA, 25 bp, S. cerevisiae
gacctgggtcatttattagcgctgc

SEQ ID NO: 34705 - DNA, 25 bp, S. cerevisiae
gacctggttgtatctatatgggctt

SEQ ID NO: 34706 - DNA, 25 bp, S. cerevisiae
gacctactggattgtcttttcattt

SEQ ID NO: 34707 - DNA, 25 bp, S. cerevisiae
gaccaactgcgaatcttaggtaagt

SEQ ID NO: 34708 - DNA, 25 bp, S. cerevisiae
gaccgccgcagaactcttggaagat

SEQ ID NO: 34709 - DNA, 25 bp, S. cerevisiae
gaccgctcaattgtctttgcaagac

SEQ ID NO: 34710 - DNA, 25 bp, S. cerevisiae
gaccctgctgtagactttgtactca

SEQ ID NO: 34711 - DNA, 25 bp, S. cerevisiae
gaccatggaggctcaattgcgttga

SEQ ID NO: 34712 - DNA, 25 bp, S. cerevisiae
gaccatgctacgttctatatctgtg

SEQ ID NO: 34713 - DNA, 25 bp, S. cerevisiae
gacctctgcacacatgcttattagg

SEQ ID NO: 34714 - DNA, 25 bp, S. cerevisiae
gaccgtcactcgaaacagctggatc

SEQ ID NO: 34715 - DNA, 25 bp, S. cerevisiae
gaccctcagattatatgctgcttga

SEQ ID NO: 34716 - DNA, 25 bp, S. cerevisiae
gagccagaaaccatattgcctctac

SEQ ID NO: 34717 - DNA, 25 bp, S. cerevisiae
gaccaaggctatgtcgttgtcgatt

SEQ ID NO: 34718 - DNA, 25 bp, S. cerevisiae
gagctaacgaacttggttccgctta

SEQ ID NO: 34719 - DNA, 25 bp, S. cerevisiae
gagaatcctaactgtaagtctgtta

SEQ ID NO: 34720 - DNA, 25 bp, S. cerevisiae
gagctaatcaactccttgaacttag

SEQ ID NO: 34721 - DNA, 25 bp, S. cerevisiae
gagccagaaagccaaccgtgttaat

SEQ ID NO: 34722 - DNA, 25 bp, S. cerevisiae
gagcatcgataatgcaagcctggtt

SEQ ID NO: 34723 - DNA, 25 bp, S. cerevisiae
gaggcgtatagacaagcggcttcac

SEQ ID NO: 34724 - DNA, 25 bp, S. cerevisiae
gacccatcttatttcagaggctact

SEQ ID NO: 34725 - DNA, 25 bp, S. cerevisiae
gacccactcttacagaggtgtcgat

SEQ ID NO: 34726 - DNA, 25 bp, S. cerevisiae
gaccactctcgtgccaatggttcga

SEQ ID NO: 34727 - DNA, 25 bp, S. cerevisiae
gacctttgctctaccaagaggtgct

SEQ ID NO: 34728 - DNA, 25 bp, S. cerevisiae
gaccagttcatacttaaaggagcta

SEQ ID NO: 34729 - DNA, 25 bp, S. cerevisiae
gaccgttgtattcgagcaaggccaa

SEQ ID NO: 34730 - DNA, 25 bp, S. cerevisiae
gaccgttgtgtgtatggaaggccca

SEQ ID NO: 34731 - DNA, 25 bp, S. cerevisiae
gaccgttattgtttgcaaccactca

SEQ ID NO: 34732 - DNA, 25 bp, S. cerevisiae
gacctttacgagttggttcctgacg

SEQ ID NO: 34733 - DNA, 25 bp, S. cerevisiae
gacctttacgagtacctctgtaacg

SEQ ID NO: 34734 - DNA, 25 bp, S. cerevisiae
gagcgggttggcctactacatccaa

SEQ ID NO: 34735 - DNA, 25 bp, S. cerevisiae
gaccgtgttcacgtacagatctcaa

SEQ ID NO: 34736 - DNA, 25 bp, S. cerevisiae
gaccttgttcctgctcagttgaaaa

SEQ ID NO: 34737 - DNA, 25 bp, S. cerevisiae
gaccttatcgcctgttattgactac

SEQ ID NO: 34738 - DNA, 25 bp, S. cerevisiae
gacctgaatagcattgtctttccca

SEQ ID NO: 34739 - DNA, 25 bp, S. cerevisiae
gatctaaaagctctggatgaaacta

SEQ ID NO: 34740 - DNA, 25 bp, S. cerevisiae
gagtacgtacttttgcgaaatctat

SEQ ID NO: 34741 - DNA, 25 bp, S. cerevisiae
ggatacgtcgaatgttggaactgaa

SEQ ID NO: 34742 - DNA, 25 bp, S. cerevisiae
gagctaactaggttggtggacagta

SEQ ID NO: 34743 - DNA, 25 bp, S. cerevisiae
gaccaaccgggtgcattaagtgcca

SEQ ID NO: 34744 - DNA, 25 bp, S. cerevisiae
gaccactttgtcgagtttgacgata

SEQ ID NO: 34745 - DNA, 25 bp, S. cerevisiae
gaccagcttggtgatactttccata

SEQ ID NO: 34746 - DNA, 25 bp, S. cerevisiae
gacctgatttcattttctactccga

SEQ ID NO: 34747 - DNA, 25 bp, S. cerevisiae
gaccttgctgtcaaatctttatcat

SEQ ID NO: 34748 - DNA, 25 bp, S. cerevisiae
gacctgatatgattgatcctgctat

SEQ ID NO: 34749 - DNA, 25 bp, S. cerevisiae
gaccgatgcaaactgtgtctcctat

SEQ ID NO: 34750 - DNA, 25 bp, S. cerevisiae
gaccaggtagtattcgccaactgca

SEQ ID NO: 34751 - DNA, 25 bp, S. cerevisiae
gaccacaaagagcagcgtcacctga

SEQ ID NO: 34752 - DNA, 25 bp, S. cerevisiae
gaccaagagaagtacgacagaatct

SEQ ID NO: 34753 - DNA, 25 bp, S. cerevisiae
gaccaacgagattgccacgaaacta

SEQ ID NO: 34754 - DNA, 25 bp, S. cerevisiae
gaccagctaacaactaccatttcta

SEQ ID NO: 34755 - DNA, 25 bp, S. cerevisiae
gagcgataccacacttcttcaaatg

SEQ ID NO: 34756 - DNA, 25 bp, S. cerevisiae
gaccaagccatctctatcctaaatg

SEQ ID NO: 34757 - DNA, 25 bp, S. cerevisiae
gaccaaggcactgtcattgataatc

SEQ ID NO: 34758 - DNA, 25 bp, S. cerevisiae
gaccagatcacatttgtcggattat

SEQ ID NO: 34759 - DNA, 25 bp, S. cerevisiae
gagccacaagtactctcggataatt

SEQ ID NO: 34760 - DNA, 25 bp, S. cerevisiae
gagcgaacaatacttcccatattta

SEQ ID NO: 34761 - DNA, 25 bp, S. cerevisiae
gagctccctcaactttgtcatataa

SEQ ID NO: 34762 - DNA, 25 bp, S. cerevisiae
gaccacgtctgcttttggcttaaat

SEQ ID NO: 34763 - DNA, 25 bp, S. cerevisiae
gacccggccgtttacatgattaatc

SEQ ID NO: 34764 - DNA, 25 bp, S. cerevisiae
gaccaggagccgacaaacatattag

SEQ ID NO: 34765 - DNA, 25 bp, S. cerevisiae
gacctggatgtggatttcgattcta

SEQ ID NO: 34766 - DNA, 25 bp, S. cerevisiae
gagctcttgcaagggttcaattcca

SEQ ID NO: 34767 - DNA, 25 bp, S. cerevisiae
gagcatttggacagtaccttggcaa

SEQ ID NO: 34768 - DNA, 25 bp, S. cerevisiae
gagctggtcgacagatacaatcctg

SEQ ID NO: 34769 - DNA, 25 bp, S. cerevisiae
gagctggcctacaatgatacctttg

SEQ ID NO: 34770 - DNA, 25 bp, S. cerevisiae
gagcgttgtatctacagagactttt

SEQ ID NO: 34771 - DNA, 25 bp, S. cerevisiae
gagcttgaggttttatctgttatta

SEQ ID NO: 34772 - DNA, 25 bp, S. cerevisiae
gagccgacttcttatggtgggatta

SEQ ID NO: 34773 - DNA, 25 bp, S. cerevisiae
gagcccgtcttaaatgaggatgatt

SEQ ID NO: 34774 - DNA, 25 bp, S. cerevisiae
gacctcgttgtctttgtgaatatcg

SEQ ID NO: 34775 - DNA, 25 bp, S. cerevisiae
gaccgccttggcattgaaatatctg

SEQ ID NO: 34776 - DNA, 25 bp, S. cerevisiae
gaccgcacctcctttatttttgaat

SEQ ID NO: 34777 - DNA, 25 bp, S. cerevisiae
gaccagctctttgttacccaaatat

SEQ ID NO: 34778 - DNA, 25 bp, S. cerevisiae
gagcctgaaacgtttacccaattag

SEQ ID NO: 34779 - DNA, 25 bp, S. cerevisiae
gagcgtattgacgtggaatcccaat

SEQ ID NO: 34780 - DNA, 25 bp, S. cerevisiae
gaccatattgcaactggatacgcca

SEQ ID NO: 34781 - DNA, 25 bp, S. cerevisiae
gaccaaatcatgtctggatctctcc

SEQ ID NO: 34782 - DNA, 25 bp, S. cerevisiae
gaccaatataatagtgattccggta

SEQ ID NO: 34783 - DNA, 25 bp, S. cerevisiae
gaccagtatttgatgatcctctagt

SEQ ID NO: 34784 - DNA, 25 bp, S. cerevisiae
gagaactccgttgtttaatcctaca

SEQ ID NO: 34785 - DNA, 25 bp, S. cerevisiae
gagaactggtggtgctttgaataca

SEQ ID NO: 34786 - DNA, 25 bp, S. cerevisiae
gagctcaccaaggaaattaccgtaa

SEQ ID NO: 34787 - DNA, 25 bp, S. cerevisiae
gaccaccagaggacatattcgactt

SEQ ID NO: 34788 - DNA, 25 bp, S. cerevisiae
gatgccctgagagaaacattaccgt

SEQ ID NO: 34789 - DNA, 25 bp, S. cerevisiae
gaccagagattattccattgcaaga

SEQ ID NO: 34790 - DNA, 25 bp, S. cerevisiae
gaccagcagactagcatatttgaaa

SEQ ID NO: 34791 - DNA, 25 bp, S. cerevisiae
gaccaaaccgtcattcaagagcata

SEQ ID NO: 34792 - DNA, 25 bp, S. cerevisiae
gaccactaccgtctcaaagtcaaaa

SEQ ID NO: 34793 - DNA, 25 bp, S. cerevisiae
gaccactccggtcatagacgtcatt

SEQ ID NO: 34794 - DNA, 25 bp, S. cerevisiae
gagcacccacgaagatgtcaacgga

SEQ ID NO: 34795 - DNA, 25 bp, S. cerevisiae
gagcgcaacccacaatcgaaggtca

SEQ ID NO: 34796 - DNA, 25 bp, S. cerevisiae
gaggaaaccgtatcttcagggcaag

SEQ ID NO: 34797 - DNA, 25 bp, S. cerevisiae
gagccgataacgcagacttcagact

SEQ ID NO: 34798 - DNA, 25 bp, S. cerevisiae
gagccgaagacgaagctgctttggc

SEQ ID NO: 34799 - DNA, 25 bp, S. cerevisiae
gaccgaaataatacgcttgacagca

SEQ ID NO: 34800 - DNA, 25 bp, S. cerevisiae
gaccgcagcattttacgctagcaat

SEQ ID NO: 34801 - DNA, 25 bp, S. cerevisiae
gaccggattcgtgatatggctagac

SEQ ID NO: 34802 - DNA, 25 bp, S. cerevisiae
gacctatggtcttgcatttcaaatg

SEQ ID NO: 34803 - DNA, 25 bp, S. cerevisiae
gagcagtaagctccacatttaaacg

SEQ ID NO: 34804 - DNA, 25 bp, S. cerevisiae
gaccacgaatgtagttctggcacag

SEQ ID NO: 34805 - DNA, 25 bp, S. cerevisiae
gaccaggagtatacatgccacgaat

SEQ ID NO: 34806 - DNA, 25 bp, S. cerevisiae
gagccatggaattgattgccgaact

SEQ ID NO: 34807 - DNA, 25 bp, S. cerevisiae
gagcctggctatctttggaatctta

SEQ ID NO: 34808 - DNA, 25 bp, S. cerevisiae
gagccttctgaagttgagtcactgg

SEQ ID NO: 34809 - DNA, 25 bp, S. cerevisiae
tggcgtttgaactactgaccggtgc

SEQ ID NO: 34810 - DNA, 25 bp, S. cerevisiae
gagtcttttgactacagccggtggc

SEQ ID NO: 34811 - DNA, 25 bp, S. cerevisiae
gaccttattaggaatgccgttagat

SEQ ID NO: 34812 - DNA, 25 bp, S. cerevisiae
gagctatgctatatgccagatccct

SEQ ID NO: 34813 - DNA, 25 bp, S. cerevisiae
gagcgcctatcaatgttgttgttgg

SEQ ID NO: 34814 - DNA, 25 bp, S. cerevisiae
gagcctttacaagttttgcctccta

SEQ ID NO: 34815 - DNA, 25 bp, S. cerevisiae
gagcttttaccctttgatgtggtca

SEQ ID NO: 34816 - DNA, 25 bp, S. cerevisiae
gagagtttcccctaggtgggcataa

SEQ ID NO: 34817 - DNA, 25 bp, S. cerevisiae
gagccagttggtctttgtcaggtaa

SEQ ID NO: 34818 - DNA, 25 bp, S. cerevisiae
gaccagattggactatttatccggt

SEQ ID NO: 34819 - DNA, 25 bp, S. cerevisiae
gagcgcaattttacaatattccggt

SEQ ID NO: 34820 - DNA, 25 bp, S. cerevisiae
gagcagctgaaacccaaattccgtt

SEQ ID NO: 34821 - DNA, 25 bp, S. cerevisiae
gacctggtaatcctcaagatatctt

SEQ ID NO: 34822 - DNA, 25 bp, S. cerevisiae
gacctttcaactgcctgtgttacat

SEQ ID NO: 34823 - DNA, 25 bp, S. cerevisiae
gaccggctatttatcaccaattcaa

SEQ ID NO: 34824 - DNA, 25 bp, S. cerevisiae
gagccggatataaaccttctgaaac

SEQ ID NO: 34825 - DNA, 25 bp, S. cerevisiae
gagccctcgagagtaatgccttacg

SEQ ID NO: 34826 - DNA, 25 bp, S. cerevisiae
gagcccacggcagtagtcatcgata

SEQ ID NO: 34827 - DNA, 25 bp, S. cerevisiae
gaccaagcccataggatcatcatat

SEQ ID NO: 34828 - DNA, 25 bp, S. cerevisiae
gagctcgcagatgcacagcgtcaat

SEQ ID NO: 34829 - DNA, 25 bp, S. cerevisiae
gagctagatcatttgaccatcactg

SEQ ID NO: 34830 - DNA, 25 bp, S. cerevisiae
gagcattgtatattcctaactggat

SEQ ID NO: 34831 - DNA, 25 bp, S. cerevisiae
gagcccaacttgtttttgaggcagt

SEQ ID NO: 34832 - DNA, 25 bp, S. cerevisiae
gaccactttttctttctaggcgatt

SEQ ID NO: 34833 - DNA, 25 bp, S. cerevisiae
gaccatcattatttcttccaaggcc

SEQ ID NO: 34834 - DNA, 25 bp, S. cerevisiae
gagccaatttgtttatcactagagc

SEQ ID NO: 34835 - DNA, 25 bp, S. cerevisiae
gaccacgacggcgaatgcaccaagt

SEQ ID NO: 34836 - DNA, 25 bp, S. cerevisiae
gagcgttttttgttactacaattgg

SEQ ID NO: 34837 - DNA, 25 bp, S. cerevisiae
gacctcctgcccgtgagagaatcaa

SEQ ID NO: 34838 - DNA, 25 bp, S. cerevisiae
gacctggatgccgacggtgatcata

SEQ ID NO: 34839 - DNA, 25 bp, S. cerevisiae
gaccatggtgtcattggcgatgcaa

SEQ ID NO: 34840 - DNA, 25 bp, S. cerevisiae
gaccgtgtgtcattcattcctaaga

SEQ ID NO: 34841 - DNA, 25 bp, S. cerevisiae
gaccaatgtgatgttgtccacaaat

SEQ ID NO: 34842 - DNA, 25 bp, S. cerevisiae
gaccagagtttaatgagctgccgaa

SEQ ID NO: 34843 - DNA, 25 bp, S. cerevisiae
gaccacatctggaaaactagctccc

SEQ ID NO: 34844 - DNA, 25 bp, S. cerevisiae
gaccacattgtatctactatgatca

SEQ ID NO: 34845 - DNA, 25 bp, S. cerevisiae
gagcaaatgttctcgagtttccagg

SEQ ID NO: 34846 - DNA, 25 bp, S. cerevisiae
gatccgtttgggttggtgtgaatac

SEQ ID NO: 34847 - DNA, 25 bp, S. cerevisiae
gagccgttatgcgttgtgggaaata

SEQ ID NO: 34848 - DNA, 25 bp, S. cerevisiae
gagcctattgataagttcgggaacc

SEQ ID NO: 34849 - DNA, 25 bp, S. cerevisiae
gagcatggttgcttgtcaggacccg

SEQ ID NO: 34850 - DNA, 25 bp, S. cerevisiae
gagcattgttgggttgggcccacaa

SEQ ID NO: 34851 - DNA, 25 bp, S. cerevisiae
gagcttacaggagtgaccgccgcaa

SEQ ID NO: 34852 - DNA, 25 bp, S. cerevisiae
gagctgcaggagattcatgccttta

SEQ ID NO: 34853 - DNA, 25 bp, S. cerevisiae
gagctggtggactatcacgtattac

SEQ ID NO: 34854 - DNA, 25 bp, S. cerevisiae
gagcggttgacactcaatgctatgt

SEQ ID NO: 34855 - DNA, 25 bp, S. cerevisiae
gagccgattgacctaatatccatga

SEQ ID NO: 34856 - DNA, 25 bp, S. cerevisiae
gagcgcgtgaggatacatacaatga

SEQ ID NO: 34857 - DNA, 25 bp, S. cerevisiae
gagccagacggaaacatacatcagt

SEQ ID NO: 34858 - DNA, 25 bp, S. cerevisiae
gacctgcgtatccaagaagtttaat

SEQ ID NO: 34859 - DNA, 25 bp, S. cerevisiae
gagccaagttcgttgaagctttgaa

SEQ ID NO: 34860 - DNA, 25 bp, S. cerevisiae
gaccaagctgccctatcatattagt

SEQ ID NO: 34861 - DNA, 25 bp, S. cerevisiae
gaccagagtcgttcataatctcagt

SEQ ID NO: 34862 - DNA, 25 bp, S. cerevisiae
gagcctggagctgatgatatgacta

SEQ ID NO: 34863 - DNA, 25 bp, S. cerevisiae
gagcctcacactctaatttcattaa

SEQ ID NO: 34864 - DNA, 25 bp, S. cerevisiae
gacctcatccatttcactttgaaac

SEQ ID NO: 34865 - DNA, 25 bp, S. cerevisiae
gagccaacctagcattttcaaagag

SEQ ID NO: 34866 - DNA, 25 bp, S. cerevisiae
gagcctgacctcctttttcaagagg

SEQ ID NO: 34867 - DNA, 25 bp, S. cerevisiae
gagcggcagaaccatcttacagcaa

SEQ ID NO: 34868 - DNA, 25 bp, S. cerevisiae
gagccatcgaactttctatccataa

SEQ ID NO: 34869 - DNA, 25 bp, S. cerevisiae
gagcctgacggatctttatggaaca

SEQ ID NO: 34870 - DNA, 25 bp, S. cerevisiae
gagccaacggattttgtcaaaacat

SEQ ID NO: 34871 - DNA, 25 bp, S. cerevisiae
gaccaactgttgtttctcaagaacc

SEQ ID NO: 34872 - DNA, 25 bp, S. cerevisiae
gaccattgctgaaactttggccgaa

SEQ ID NO: 34873 - DNA, 25 bp, S. cerevisiae
gaccattcgatgtttttgtgggaac

SEQ ID NO: 34874 - DNA, 25 bp, S. cerevisiae
gaccatgtttggtgctgcttgtgcc

SEQ ID NO: 34875 - DNA, 25 bp, S. cerevisiae
gaccaggtttgttgtccatggccaa

SEQ ID NO: 34876 - DNA, 25 bp, S. cerevisiae
gacctatttcaatgatcctgaccag

SEQ ID NO: 34877 - DNA, 25 bp, S. cerevisiae
gaccaatgttactttgcctgacacc

SEQ ID NO: 34878 - DNA, 25 bp, S. cerevisiae
gaccatcttgcaagtttgtcttcat

SEQ ID NO: 34879 - DNA, 25 bp, S. cerevisiae
gagcgctccacgtgaggccatttta

SEQ ID NO: 34880 - DNA, 25 bp, S. cerevisiae
gagccactatggttgggacacctta

SEQ ID NO: 34881 - DNA, 25 bp, S. cerevisiae
gaccttctgcagagagatcgtactt

SEQ ID NO: 34882 - DNA, 25 bp, S. cerevisiae
gagccttgctgcgatagaatcctgg

SEQ ID NO: 34883 - DNA, 25 bp, S. cerevisiae
gaccttgtgctgaattatcccgtag

SEQ ID NO: 34884 - DNA, 25 bp, S. cerevisiae
gaccatgtccattgccaactgaagt

SEQ ID NO: 34885 - DNA, 25 bp, S. cerevisiae
gagcgcagagaatccattggtcgta

SEQ ID NO: 34886 - DNA, 25 bp, S. cerevisiae
gaccaagaaatccaaagcctgttaa

SEQ ID NO: 34887 - DNA, 25 bp, S. cerevisiae
gaccaagaatccttcaacggcgtga

SEQ ID NO: 34888 - DNA, 25 bp, S. cerevisiae
gaccttatcatttttacagcatcca

SEQ ID NO: 34889 - DNA, 25 bp, S. cerevisiae
gaccatttcgagtttgatacacaca

SEQ ID NO: 34890 - DNA, 25 bp, S. cerevisiae
gaccatttctgtcactgatactgaa

SEQ ID NO: 34891 - DNA, 25 bp, S. cerevisiae
gaccttattgctgacatgatgacca

SEQ ID NO: 34892 - DNA, 25 bp, S. cerevisiae
gagcctttagctcccggaaatgata

SEQ ID NO: 34893 - DNA, 25 bp, S. cerevisiae
gagccattcgcggtcgctgagtaag

SEQ ID NO: 34894 - DNA, 25 bp, S. cerevisiae
gagcgtccttgaagcattgacacaa

SEQ ID NO: 34895 - DNA, 25 bp, S. cerevisiae
gaccatccaggattctttgcaatat

SEQ ID NO: 34896 - DNA, 25 bp, S. cerevisiae
gaccagccaaatccttttcattttc

SEQ ID NO: 34897 - DNA, 25 bp, S. cerevisiae
gaccactacaaacttttcagctttt

SEQ ID NO: 34898 - DNA, 25 bp, S. cerevisiae
gagcccaagctgtttttatcgaatt

SEQ ID NO: 34899 - DNA, 25 bp, S. cerevisiae
gatccatttgaagcgtatagcacat

SEQ ID NO: 34900 - DNA, 25 bp, S. cerevisiae
gagcccatgaaagccaaagccttgc

SEQ ID NO: 34901 - DNA, 25 bp, S. cerevisiae
gagcccgcagttactaacactggat

SEQ ID NO: 34902 - DNA, 25 bp, S. cerevisiae
gagcgacctatcactcaaatcggaa

SEQ ID NO: 34903 - DNA, 25 bp, S. cerevisiae
gagccagctcctatcaaaatcgaaa

SEQ ID NO: 34904 - DNA, 25 bp, S. cerevisiae
gagccagatacaagttcccaggtca

SEQ ID NO: 34905 - DNA, 25 bp, S. cerevisiae
gagccgtcgtggttccaattgtcaa

SEQ ID NO: 34906 - DNA, 25 bp, S. cerevisiae
gagcctctcacatttacaaacagcg

SEQ ID NO: 34907 - DNA, 25 bp, S. cerevisiae
gagcaggctcactcaactgcaagag

SEQ ID NO: 34908 - DNA, 25 bp, S. cerevisiae
gagcaggcacagtacgaggagaaat

SEQ ID NO: 34909 - DNA, 25 bp, S. cerevisiae
gagcatagcaaaagcagcgtttcga

SEQ ID NO: 34910 - DNA, 25 bp, S. cerevisiae
gagctagaactccaggccaaatgca

SEQ ID NO: 34911 - DNA, 25 bp, S. cerevisiae
gagtcgacacgccagaggatactac

SEQ ID NO: 34912 - DNA, 25 bp, S. cerevisiae
gagccaacaacaaggttactaccaa

SEQ ID NO: 34913 - DNA, 25 bp, S. cerevisiae
gaccaacttcaatgttcctgtggaa

SEQ ID NO: 34914 - DNA, 25 bp, S. cerevisiae
gaccatcaagatgtctcccagttgg

SEQ ID NO: 34915 - DNA, 25 bp, S. cerevisiae
gagccttggttgaacacatcatcca

SEQ ID NO: 34916 - DNA, 25 bp, S. cerevisiae
gagcctgcaagcaacaacagtgatg

SEQ ID NO: 34917 - DNA, 25 bp, S. cerevisiae
gagctgctgaatgatcctaccatgc

SEQ ID NO: 34918 - DNA, 25 bp, S. cerevisiae
gagcctaacgatcctcaagatgcag

SEQ ID NO: 34919 - DNA, 25 bp, S. cerevisiae
gagctgttccagactccaagatcag

SEQ ID NO: 34920 - DNA, 25 bp, S. cerevisiae
gagctgttcttggatgagattgcga

SEQ ID NO: 34921 - DNA, 25 bp, S. cerevisiae
gagcattcaaaggtttctgagtcga

SEQ ID NO: 34922 - DNA, 25 bp, S. cerevisiae
gagcgtacctttttgtcgtggttga

SEQ ID NO: 34923 - DNA, 25 bp, S. cerevisiae
gagccccaatggcttctcgaagtag

SEQ ID NO: 34924 - DNA, 25 bp, S. cerevisiae
gagcctccagcggagtactcgaaaa

SEQ ID NO: 34925 - DNA, 25 bp, S. cerevisiae
gagcctggccatcagttcattgaaa

SEQ ID NO: 34926 - DNA, 25 bp, S. cerevisiae
gagcgcttgaaaatgtcatcaggca

SEQ ID NO: 34927 - DNA, 25 bp, S. cerevisiae
gagccagtgggtttctcagatgccc

SEQ ID NO: 34928 - DNA, 25 bp, S. cerevisiae
gagccatactcttacggatacatag

SEQ ID NO: 34929 - DNA, 25 bp, S. cerevisiae
gagcgcttccacaaagaccgtatcg

SEQ ID NO: 34930 - DNA, 25 bp, S. cerevisiae
gagccctccatataacctgatgtat

SEQ ID NO: 34931 - DNA, 25 bp, S. cerevisiae
gagcgccaccaatactcgtagatat

SEQ ID NO: 34932 - DNA, 25 bp, S. cerevisiae
gaccacctcaaatccgtctagtata

SEQ ID NO: 34933 - DNA, 25 bp, S. cerevisiae
gagccagtgcctttaccggaagacg

SEQ ID NO: 34934 - DNA, 25 bp, S. cerevisiae
gagccaaccttctacggcgaataat

SEQ ID NO: 34935 - DNA, 25 bp, S. cerevisiae
gaccaagatttaacagggataacaa

SEQ ID NO: 34936 - DNA, 25 bp, S. cerevisiae
gaccagcagtgaaaagaaggacaac

SEQ ID NO: 34937 - DNA, 25 bp, S. cerevisiae
gaccagcaaaacgagccaccaaatg

SEQ ID NO: 34938 - DNA, 25 bp, S. cerevisiae
gagctcacttagaaagccacccaac

SEQ ID NO: 34939 - DNA, 25 bp, S. cerevisiae
gagcccattgagaaaaacgccttta

SEQ ID NO: 34940 - DNA, 25 bp, S. cerevisiae
gagacggtaaatctgtccagccatt

SEQ ID NO: 34941 - DNA, 25 bp, S. cerevisiae
gagcctggattctcgaagactttag

SEQ ID NO: 34942 - DNA, 25 bp, S. cerevisiae
gagcctggtatttcagatcagtctt

SEQ ID NO: 34943 - DNA, 25 bp, S. cerevisiae
gagctgcctaatgcataccatgact

SEQ ID NO: 34944 - DNA, 25 bp, S. cerevisiae
gagcgcactactgagtccaaattca

SEQ ID NO: 34945 - DNA, 25 bp, S. cerevisiae
gagcaaactacgatctggtccttta

SEQ ID NO: 34946 - DNA, 25 bp, S. cerevisiae
gagctgtacttcatttactccagtt

SEQ ID NO: 34947 - DNA, 25 bp, S. cerevisiae
gagcgcaagagttcgttcatctacg

SEQ ID NO: 34948 - DNA, 25 bp, S. cerevisiae
gagccagtcccatcagttgcaagga

SEQ ID NO: 34949 - DNA, 25 bp, S. cerevisiae
gagccaacaaccgtggtcacatatt

SEQ ID NO: 34950 - DNA, 25 bp, S. cerevisiae
gaccaaattcatagctggccgtatt

SEQ ID NO: 34951 - DNA, 25 bp, S. cerevisiae
gaccagagattttgcattccagtat

SEQ ID NO: 34952 - DNA, 25 bp, S. cerevisiae
gagcctgtggatgaggtacctgaat

SEQ ID NO: 34953 - DNA, 25 bp, S. cerevisiae
gagctgggtggagacttcactatca

SEQ ID NO: 34954 - DNA, 25 bp, S. cerevisiae
gagtacgatggagcacacgcctgac

SEQ ID NO: 34955 - DNA, 25 bp, S. cerevisiae
gagctggcgatgtctccaacgaaga

SEQ ID NO: 34956 - DNA, 25 bp, S. cerevisiae
gagccagctatgtttgatatcgata

SEQ ID NO: 34957 - DNA, 25 bp, S. cerevisiae
gaccagctagctaatgacacagaaa

SEQ ID NO: 34958 - DNA, 25 bp, S. cerevisiae
gaccagcttgtcaagatcgtcaaag

SEQ ID NO: 34959 - DNA, 25 bp, S. cerevisiae
gagcggtttcgcatatcatgaactg

SEQ ID NO: 34960 - DNA, 25 bp, S. cerevisiae
gagcggtttcggtcatctatatgtc

SEQ ID NO: 34961 - DNA, 25 bp, S. cerevisiae
gagcgtttgtctaactcaagcgaca

SEQ ID NO: 34962 - DNA, 25 bp, S. cerevisiae
gagcggtgccgatatcttgatgtct

SEQ ID NO: 34963 - DNA, 25 bp, S. cerevisiae
gagcgaggccaattgatcctaatgc

SEQ ID NO: 34964 - DNA, 25 bp, S. cerevisiae
gagccaactgcaatctgtgccgata

SEQ ID NO: 34965 - DNA, 25 bp, S. cerevisiae
gaccagaatctggattgccgcaaat

SEQ ID NO: 34966 - DNA, 25 bp, S. cerevisiae
gagccagttctggacacaccacaat

SEQ ID NO: 34967 - DNA, 25 bp, S. cerevisiae
gaccaatttttccttcgactcgaat

SEQ ID NO: 34968 - DNA, 25 bp, S. cerevisiae
gagccatttacataagtgattcgga

SEQ ID NO: 34969 - DNA, 25 bp, S. cerevisiae
gagccaatgtactcaggtgctactg

SEQ ID NO: 34970 - DNA, 25 bp, S. cerevisiae
gagctggtgttaatgtcggtatcca

SEQ ID NO: 34971 - DNA, 25 bp, S. cerevisiae
gagccgctgctaatagtgcttttca

SEQ ID NO: 34972 - DNA, 25 bp, S. cerevisiae
gaggttgaaggttctttctgctcgt

SEQ ID NO: 34973 - DNA, 25 bp, S. cerevisiae
gagcagccgaagtgactatgtccct

SEQ ID NO: 34974 - DNA, 25 bp, S. cerevisiae
gagccatcaaaagtacatcttccct

SEQ ID NO: 34975 - DNA, 25 bp, S. cerevisiae
gagccaggtgagttcattcatactt

SEQ ID NO: 34976 - DNA, 25 bp, S. cerevisiae
gagccggtagaccattgattgccat

SEQ ID NO: 34977 - DNA, 25 bp, S. cerevisiae
gagcccactagaacttttgcagatt

SEQ ID NO: 34978 - DNA, 25 bp, S. cerevisiae
gagccctctcagaacttttcttaga

SEQ ID NO: 34979 - DNA, 25 bp, S. cerevisiae
gagctccatctagaattctttacaa

SEQ ID NO: 34980 - DNA, 25 bp, S. cerevisiae
gagaaggcttgcgtaccttttttgg

SEQ ID NO: 34981 - DNA, 25 bp, S. cerevisiae
gagcgatgggtgatcacacttattt

SEQ ID NO: 34982 - DNA, 25 bp, S. cerevisiae
gaccactttctgtacatgtgaagca

SEQ ID NO: 34983 - DNA, 25 bp, S. cerevisiae
gagccctcctcataaggatcagcat

SEQ ID NO: 34984 - DNA, 25 bp, S. cerevisiae
gagccctcagcttctcaagtgaaag

SEQ ID NO: 34985 - DNA, 25 bp, S. cerevisiae
gaccactgagccctatttgcaaaga

SEQ ID NO: 34986 - DNA, 25 bp, S. cerevisiae
gaggaaagttccatttgttcaatac

SEQ ID NO: 34987 - DNA, 25 bp, S. cerevisiae
gagcgacaaagaacctgtttccaag

SEQ ID NO: 34988 - DNA, 25 bp, S. cerevisiae
gagcgctttttcacctattttatca

SEQ ID NO: 34989 - DNA, 25 bp, S. cerevisiae
gagcttattcttatcctgactttag

SEQ ID NO: 34990 - DNA, 25 bp, S. cerevisiae
gagctgtcagtgaagatccccgtat

SEQ ID NO: 34991 - DNA, 25 bp, S. cerevisiae
gagaatcaggcgacaccggcgttga

SEQ ID NO: 34992 - DNA, 25 bp, S. cerevisiae
gagccatcggcagaccaagagttat

SEQ ID NO: 34993 - DNA, 25 bp, S. cerevisiae
gagccaccggtaagctatggtgtca

SEQ ID NO: 34994 - DNA, 25 bp, S. cerevisiae
gagcttttcttattgagcaaatcgc

SEQ ID NO: 34995 - DNA, 25 bp, S. cerevisiae
gagccagtttatctacacaacgtgt

SEQ ID NO: 34996 - DNA, 25 bp, S. cerevisiae
gagcatattttacaacagcgcaggt

SEQ ID NO: 34997 - DNA, 25 bp, S. cerevisiae
gagcttttaactactaacgccatct

SEQ ID NO: 34998 - DNA, 25 bp, S. cerevisiae
gagccccacctactataagcgtaaa

SEQ ID NO: 34999 - DNA, 25 bp, S. cerevisiae
gagccagtacctcctgtaagtaaaa

SEQ ID NO: 35000 - DNA, 25 bp, S. cerevisiae
gagccagctgactccgaaggcatta

SEQ ID NO: 35001 - DNA, 25 bp, S. cerevisiae
gagcgcctgatcaatgccaataaat

SEQ ID NO: 35002 - DNA, 25 bp, S. cerevisiae
gagccgataagcattcatccatcat

SEQ ID NO: 35003 - DNA, 25 bp, S. cerevisiae
gaccaataggttacgcttctctagt

SEQ ID NO: 35004 - DNA, 25 bp, S. cerevisiae
gaccaagaggatatcgtcttcacaa

SEQ ID NO: 35005 - DNA, 25 bp, S. cerevisiae
ggaagcgggtttctttgtatgcaaa

SEQ ID NO: 35006 - DNA, 25 bp, S. cerevisiae
gagcaacgatttcctggtgtcaagt

SEQ ID NO: 35007 - DNA, 25 bp, S. cerevisiae
gagccaggtttgactccattcagag

SEQ ID NO: 35008 - DNA, 25 bp, S. cerevisiae
gagctcgaatttatccagtcactgg

SEQ ID NO: 35009 - DNA, 25 bp, S. cerevisiae
gagccatccgtaactctgctaagga

SEQ ID NO: 35010 - DNA, 25 bp, S. cerevisiae
gagcaccattatcttctatttgagc

SEQ ID NO: 35011 - DNA, 25 bp, S. cerevisiae
gagcagcggtgacatttctttgagt

SEQ ID NO: 35012 - DNA, 25 bp, S. cerevisiae
gagcgcagttggattctgttcgaat

SEQ ID NO: 35013 - DNA, 25 bp, S. cerevisiae
gagcgagtctcggttttccttgatt

SEQ ID NO: 35014 - DNA, 25 bp, S. cerevisiae
gagctagtctcagatttcaacttag

SEQ ID NO: 35015 - DNA, 25 bp, S. cerevisiae
gagctatggctcacgttaactccaa

SEQ ID NO: 35016 - DNA, 25 bp, S. cerevisiae
gagcctgatgagtctggtgtttcta

SEQ ID NO: 35017 - DNA, 25 bp, S. cerevisiae
gagcctgcatggagatcattttcaa

SEQ ID NO: 35018 - DNA, 25 bp, S. cerevisiae
gagcctgtggtattttcttcaaatc

SEQ ID NO: 35019 - DNA, 25 bp, S. cerevisiae
gagcctgttttgagtacgcatattg

SEQ ID NO: 35020 - DNA, 25 bp, S. cerevisiae
gagccgcattttatgttgctgcaat

SEQ ID NO: 35021 - DNA, 25 bp, S. cerevisiae
gagcgtcattttatgcattgttttc

SEQ ID NO: 35022 - DNA, 25 bp, S. cerevisiae
gagcgtatcctttttactggtcacg

SEQ ID NO: 35023 - DNA, 25 bp, S. cerevisiae
gagcaaacgccaatagccgggatga

SEQ ID NO: 35024 - DNA, 25 bp, S. cerevisiae
gagaagattgccagacccgaaagtc

SEQ ID NO: 35025 - DNA, 25 bp, S. cerevisiae
gagctacatttgagaaccgaccaga

SEQ ID NO: 35026 - DNA, 25 bp, S. cerevisiae
gagccaaaccagtcatcgcaagcgg

SEQ ID NO: 35027 - DNA, 25 bp, S. cerevisiae
gagcgaaattgattccgcccaggat

SEQ ID NO: 35028 - DNA, 25 bp, S. cerevisiae
gagcgaaattcatcaagtcctatca

SEQ ID NO: 35029 - DNA, 25 bp, S. cerevisiae
gagcggaattgcactggacccatac

SEQ ID NO: 35030 - DNA, 25 bp, S. cerevisiae
gagctgataatacagtatccaccta

SEQ ID NO: 35031 - DNA, 25 bp, S. cerevisiae
gagccacaattgcagtaccagtctt

SEQ ID NO: 35032 - DNA, 25 bp, S. cerevisiae
gagcgcatatggcttctaagcgtca

SEQ ID NO: 35033 - DNA, 25 bp, S. cerevisiae
gagctgcaactactttaacgtcaag

SEQ ID NO: 35034 - DNA, 25 bp, S. cerevisiae
gagcgcgacatccttgagaattcca

SEQ ID NO: 35035 - DNA, 25 bp, S. cerevisiae
gagcccataatttcaaagttccaga

SEQ ID NO: 35036 - DNA, 25 bp, S. cerevisiae
gagccccaacttgagtttccagaaa

SEQ ID NO: 35037 - DNA, 25 bp, S. cerevisiae
gagcctcgttgccttgttataaagg

SEQ ID NO: 35038 - DNA, 25 bp, S. cerevisiae
gagcctcgttggttgtccgattaca

SEQ ID NO: 35039 - DNA, 25 bp, S. cerevisiae
gagccatcggtcgtattgccggtaa

SEQ ID NO: 35040 - DNA, 25 bp, S. cerevisiae
gagctcattgaacgctattccattg

SEQ ID NO: 35041 - DNA, 25 bp, S. cerevisiae
gagcttccgtcaatgaggcttctaa

SEQ ID NO: 35042 - DNA, 25 bp, S. cerevisiae
gagcctaatggtagcgatcccttga

SEQ ID NO: 35043 - DNA, 25 bp, S. cerevisiae
gagcctaatcccaatgacccgttaa

SEQ ID NO: 35044 - DNA, 25 bp, S. cerevisiae
gagccggccacgattgtaacatatt

SEQ ID NO: 35045 - DNA, 25 bp, S. cerevisiae
gagcccaccgtggtattagacactt

SEQ ID NO: 35046 - DNA, 25 bp, S. cerevisiae
gagcccttactacttttgcgaatat

SEQ ID NO: 35047 - DNA, 25 bp, S. cerevisiae
gagccctatatcttcttttgtaaat

SEQ ID NO: 35048 - DNA, 25 bp, S. cerevisiae
gagcccagaaatttatcttgctaaa

SEQ ID NO: 35049 - DNA, 25 bp, S. cerevisiae
gagcgtgaaaaatccacctcttatg

SEQ ID NO: 35050 - DNA, 25 bp, S. cerevisiae
gagcactttggtattgttcctttag

SEQ ID NO: 35051 - DNA, 25 bp, S. cerevisiae
gagctagggctttcttttcctacaa

SEQ ID NO: 35052 - DNA, 25 bp, S. cerevisiae
gagctacaccagtatatttcggaac

SEQ ID NO: 35053 - DNA, 25 bp, S. cerevisiae
gagctactccacagaattcgacaat

SEQ ID NO: 35054 - DNA, 25 bp, S. cerevisiae
gagcgtgtcgtcagaatctctacaa

SEQ ID NO: 35055 - DNA, 25 bp, S. cerevisiae
gagcgatgaacctatcctgttgcac

SEQ ID NO: 35056 - DNA, 25 bp, S. cerevisiae
gagctgttgtccgattggcctaatc

SEQ ID NO: 35057 - DNA, 25 bp, S. cerevisiae
gagcgcactccacatatataactag

SEQ ID NO: 35058 - DNA, 25 bp, S. cerevisiae
gagctatgctttctacattacttga

SEQ ID NO: 35059 - DNA, 25 bp, S. cerevisiae
gagcgatgttccttacttgcagtga

SEQ ID NO: 35060 - DNA, 25 bp, S. cerevisiae
gagctcttacggttcttctagcaac

SEQ ID NO: 35061 - DNA, 25 bp, S. cerevisiae
gagttggacgactgcctcatagaac

SEQ ID NO: 35062 - DNA, 25 bp, S. cerevisiae
gagacgtacgactagccaagaagca

SEQ ID NO: 35063 - DNA, 25 bp, S. cerevisiae
gagccgaatatccagtttctcagaa

SEQ ID NO: 35064 - DNA, 25 bp, S. cerevisiae
gagcgccgatgaagtactcgcagaa

SEQ ID NO: 35065 - DNA, 25 bp, S. cerevisiae
gagccctgatgaatctgtcgagcaa

SEQ ID NO: 35066 - DNA, 25 bp, S. cerevisiae
gagctcatccatttttcgcagatat

SEQ ID NO: 35067 - DNA, 25 bp, S. cerevisiae
gagcgcttatgaatttgctaacatt

SEQ ID NO: 35068 - DNA, 25 bp, S. cerevisiae
gagcttattttacatgacctgttgg

SEQ ID NO: 35069 - DNA, 25 bp, S. cerevisiae
gagcgtttttactagatcctgccgt

SEQ ID NO: 35070 - DNA, 25 bp, S. cerevisiae
gagcgttatttccaaatcgggcgta

SEQ ID NO: 35071 - DNA, 25 bp, S. cerevisiae
ggcctttttccaattcttaggctat

SEQ ID NO: 35072 - DNA, 25 bp, S. cerevisiae
gatcgttttaccaatttttgcactg

SEQ ID NO: 35073 - DNA, 25 bp, S. cerevisiae
gagcgatttatcacatttttctgca

SEQ ID NO: 35074 - DNA, 25 bp, S. cerevisiae
gagcggcttcaatgatggcttgtat

SEQ ID NO: 35075 - DNA, 25 bp, S. cerevisiae
gagcttttggtgacaagtgctgcaa

SEQ ID NO: 35076 - DNA, 25 bp, S. cerevisiae
gagcattggctgtgcgcaattctga

SEQ ID NO: 35077 - DNA, 25 bp, S. cerevisiae
gagcattggatgactcctgaaccac

SEQ ID NO: 35078 - DNA, 25 bp, S. cerevisiae
gagctgtgcgaatcattcactttaa

SEQ ID NO: 35079 - DNA, 25 bp, S. cerevisiae
gagcgttgaaactcctctgttacaa

SEQ ID NO: 35080 - DNA, 25 bp, S. cerevisiae
gggcctggaaactgccgttgaaagc

SEQ ID NO: 35081 - DNA, 25 bp, S. cerevisiae
gtacttctaaacagacggataaaga

SEQ ID NO: 35082 - DNA, 25 bp, S. cerevisiae
gagactcctgaagcggacccaaaga

SEQ ID NO: 35083 - DNA, 25 bp, S. cerevisiae
gagcagttagaaggcggagcaccca

SEQ ID NO: 35084 - DNA, 25 bp, S. cerevisiae
gagctttttaatatcaagtccgaaa

SEQ ID NO: 35085 - DNA, 25 bp, S. cerevisiae
gagcttcagggattggtagacatac

SEQ ID NO: 35086 - DNA, 25 bp, S. cerevisiae
gagcttcacgaactagtgagccaag

SEQ ID NO: 35087 - DNA, 25 bp, S. cerevisiae
gagcacgcagactatcatttagcat

SEQ ID NO: 35088 - DNA, 25 bp, S. cerevisiae
gagctcagaatctatcctctacaac

SEQ ID NO: 35089 - DNA, 25 bp, S. cerevisiae
gagctgaatcagtatccgaacaaga

SEQ ID NO: 35090 - DNA, 25 bp, S. cerevisiae
gatctaaaggctcttgacggtcaat

SEQ ID NO: 35091 - DNA, 25 bp, S. cerevisiae
gatattacagtcttttacgggcgat

SEQ ID NO: 35092 - DNA, 25 bp, S. cerevisiae
gagagtaagtccattggccccgatg

SEQ ID NO: 35093 - DNA, 25 bp, S. cerevisiae
gagcttacaacaatgtaacgctgaa

SEQ ID NO: 35094 - DNA, 25 bp, S. cerevisiae
gagagaggttcgttcccgctagacc

SEQ ID NO: 35095 - DNA, 25 bp, S. cerevisiae
gagcaggagttaaaccccacagatt

SEQ ID NO: 35096 - DNA, 25 bp, S. cerevisiae
gagcgacttagtttccgatgatgag

SEQ ID NO: 35097 - DNA, 25 bp, S. cerevisiae
gagcgacttttattccatgtatggc

SEQ ID NO: 35098 - DNA, 25 bp, S. cerevisiae
gagcccattgttatcgatagattgc

SEQ ID NO: 35099 - DNA, 25 bp, S. cerevisiae
gagcccgcttatcttaagatctctg

SEQ ID NO: 35100 - DNA, 25 bp, S. cerevisiae
gagcgcccaggacgttgaagaatct

SEQ ID NO: 35101 - DNA, 25 bp, S. cerevisiae
gagcgctcacggctttgatgataag

SEQ ID NO: 35102 - DNA, 25 bp, S. cerevisiae
gagccgctactgaattggtgcttaa

SEQ ID NO: 35103 - DNA, 25 bp, S. cerevisiae
gagccgctactgatgctttgatgaa

SEQ ID NO: 35104 - DNA, 25 bp, S. cerevisiae
gagcccttatacttacttgacgtgc

SEQ ID NO: 35105 - DNA, 25 bp, S. cerevisiae
gagaacgattttgacctgcgccatg

SEQ ID NO: 35106 - DNA, 25 bp, S. cerevisiae
gagagttcagttccgtggctaacaa

SEQ ID NO: 35107 - DNA, 25 bp, S. cerevisiae
gagacttagtccgtgtgtgtgaaaa

SEQ ID NO: 35108 - DNA, 25 bp, S. cerevisiae
gagcttggcgaatctcttgaataca

SEQ ID NO: 35109 - DNA, 25 bp, S. cerevisiae
gagagtagctaccttgtacttacaa

SEQ ID NO: 35110 - DNA, 25 bp, S. cerevisiae
gaggaactggaaaccacacccgctg

SEQ ID NO: 35111 - DNA, 25 bp, S. cerevisiae
gatgcaagaatccatagacgcaagg

SEQ ID NO: 35112 - DNA, 25 bp, S. cerevisiae
gagcataatgcccaacctgaagtag

SEQ ID NO: 35113 - DNA, 25 bp, S. cerevisiae
gagctatgactccaacaatcacatg

SEQ ID NO: 35114 - DNA, 25 bp, S. cerevisiae
gagcgaagcactcgacaatgccttt

SEQ ID NO: 35115 - DNA, 25 bp, S. cerevisiae
gagcgaagcagtaaacacgatccat

SEQ ID NO: 35116 - DNA, 25 bp, S. cerevisiae
gagcgccacttctgaaaatccattc

SEQ ID NO: 35117 - DNA, 25 bp, S. cerevisiae
gagctcacctgagtcgaaattccga

SEQ ID NO: 35118 - DNA, 25 bp, S. cerevisiae
gagccctctttcaatgacatttcgg

SEQ ID NO: 35119 - DNA, 25 bp, S. cerevisiae
gagctattgcgcttacacaactgtc

SEQ ID NO: 35120 - DNA, 25 bp, S. cerevisiae
gagcgaagcctttatttggcaatct

SEQ ID NO: 35121 - DNA, 25 bp, S. cerevisiae
gagcagcatgacttggttgtcccaa

SEQ ID NO: 35122 - DNA, 25 bp, S. cerevisiae
gagctatacattgtcgagccacaga

SEQ ID NO: 35123 - DNA, 25 bp, S. cerevisiae
gagctaacttgcatggttacggaaa

SEQ ID NO: 35124 - DNA, 25 bp, S. cerevisiae
gagcaaattcggaggactcgggaac

SEQ ID NO: 35125 - DNA, 25 bp, S. cerevisiae
ggcaaagtccgaagttcccgtgtgg

SEQ ID NO: 35126 - DNA, 25 bp, S. cerevisiae
gagcacatcactgtaacccaaggga

SEQ ID NO: 35127 - DNA, 25 bp, S. cerevisiae
gagcgatatgaaactagtcggcaat

SEQ ID NO: 35128 - DNA, 25 bp, S. cerevisiae
gagcgatatcaaacgaccactgcaa

SEQ ID NO: 35129 - DNA, 25 bp, S. cerevisiae
gagcgtctcaaccaacgattcagaa

SEQ ID NO: 35130 - DNA, 25 bp, S. cerevisiae
gagagccttactatcgctacgaaga

SEQ ID NO: 35131 - DNA, 25 bp, S. cerevisiae
gagcagctttacacttgtacaggga

SEQ ID NO: 35132 - DNA, 25 bp, S. cerevisiae
gagaacgtgttaactgaagggctaa

SEQ ID NO: 35133 - DNA, 25 bp, S. cerevisiae
gagaacggtatcactttccctaaag

SEQ ID NO: 35134 - DNA, 25 bp, S. cerevisiae
gagaacggtatcgttatccaggtaa

SEQ ID NO: 35135 - DNA, 25 bp, S. cerevisiae
gataccttatggtgttatccgtaca

SEQ ID NO: 35136 - DNA, 25 bp, S. cerevisiae
gatccctctttggagtttctgccat

SEQ ID NO: 35137 - DNA, 25 bp, S. cerevisiae
gagctgcttattttcattttggtcc

SEQ ID NO: 35138 - DNA, 25 bp, S. cerevisiae
gagctgcttatcagaagtcttcaca

SEQ ID NO: 35139 - DNA, 25 bp, S. cerevisiae
gagcttctatcaagaggttctgcct

SEQ ID NO: 35140 - DNA, 25 bp, S. cerevisiae
gagctttcacaaaggttatccctat

SEQ ID NO: 35141 - DNA, 25 bp, S. cerevisiae
gagaattagcatccggtctatcttt

SEQ ID NO: 35142 - DNA, 25 bp, S. cerevisiae
gagcattatagtgatgtaccagagg

SEQ ID NO: 35143 - DNA, 25 bp, S. cerevisiae
gagcatttcgatttggcactgagac

SEQ ID NO: 35144 - DNA, 25 bp, S. cerevisiae
gagctcgtaactccatttggttctt

SEQ ID NO: 35145 - DNA, 25 bp, S. cerevisiae
gagctaaaagctccttcgttggctt

SEQ ID NO: 35146 - DNA, 25 bp, S. cerevisiae
gagcagacgaactctacggtggata

SEQ ID NO: 35147 - DNA, 25 bp, S. cerevisiae
gatgctacgaacactaagggcccaa

SEQ ID NO: 35148 - DNA, 25 bp, S. cerevisiae
gagcacttaacgtaacgggcttgcc

SEQ ID NO: 35149 - DNA, 25 bp, S. cerevisiae
gagcattttacgtaccggagccaat

SEQ ID NO: 35150 - DNA, 25 bp, S. cerevisiae
gagcattttccattacttctacctc

SEQ ID NO: 35151 - DNA, 25 bp, S. cerevisiae
gagcgtattctttccaagttcatca

SEQ ID NO: 35152 - DNA, 25 bp, S. cerevisiae
gagctctctctggagtactattgta

SEQ ID NO: 35153 - DNA, 25 bp, S. cerevisiae
gagctctacgaaacgttccttgata

SEQ ID NO: 35154 - DNA, 25 bp, S. cerevisiae
gagctgatcctgtagccttatactt

SEQ ID NO: 35155 - DNA, 25 bp, S. cerevisiae
gagctgacactatcacatgcgattg

SEQ ID NO: 35156 - DNA, 25 bp, S. cerevisiae
gagcatgctccatacactgatgaat

SEQ ID NO: 35157 - DNA, 25 bp, S. cerevisiae
gagcgtctgggctatctgatacgga

SEQ ID NO: 35158 - DNA, 25 bp, S. cerevisiae
gagctgatctcgtctactacaatgg

SEQ ID NO: 35159 - DNA, 25 bp, S. cerevisiae
gagctcactctctgataacagcgtt

SEQ ID NO: 35160 - DNA, 25 bp, S. cerevisiae
gagcgtggattccttcaagacgtta

SEQ ID NO: 35161 - DNA, 25 bp, S. cerevisiae
gagcgggttcaattcaatgaccttt

SEQ ID NO: 35162 - DNA, 25 bp, S. cerevisiae
gagcactttgccattgaaacttttg

SEQ ID NO: 35163 - DNA, 25 bp, S. cerevisiae
gagcatgctcccaagtgtcagaatt

SEQ ID NO: 35164 - DNA, 25 bp, S. cerevisiae
gagcacccaatacatagagcatttt

SEQ ID NO: 35165 - DNA, 25 bp, S. cerevisiae
gagcaagaaaacgtaggcaagctta

SEQ ID NO: 35166 - DNA, 25 bp, S. cerevisiae
gagcaagaacgtttggcgcaactat

SEQ ID NO: 35167 - DNA, 25 bp, S. cerevisiae
gagcggcaacttttggagtactttg

SEQ ID NO: 35168 - DNA, 25 bp, S. cerevisiae
gagcgtgaacaattggacagtcctt

SEQ ID NO: 35169 - DNA, 25 bp, S. cerevisiae
gagcttagacagttgggcttctttg

SEQ ID NO: 35170 - DNA, 25 bp, S. cerevisiae
gagcatttacacgatgccgtttttg

SEQ ID NO: 35171 - DNA, 25 bp, S. cerevisiae
gagcatttaccctacagtttactcc

SEQ ID NO: 35172 - DNA, 25 bp, S. cerevisiae
gaggacctctacagtatcctgtgga

SEQ ID NO: 35173 - DNA, 25 bp, S. cerevisiae
gagcaacaccaagtttctacgggca

SEQ ID NO: 35174 - DNA, 25 bp, S. cerevisiae
gagctatacgaatatccggcccgag

SEQ ID NO: 35175 - DNA, 25 bp, S. cerevisiae
gagctcaattaatgaccgtgcccat

SEQ ID NO: 35176 - DNA, 25 bp, S. cerevisiae
gagcttatctagaacaccgtccaat

SEQ ID NO: 35177 - DNA, 25 bp, S. cerevisiae
gagcgtcattttaagcctgatccaa

SEQ ID NO: 35178 - DNA, 25 bp, S. cerevisiae
gagcgatagctatttccaatgactt

SEQ ID NO: 35179 - DNA, 25 bp, S. cerevisiae
gagcgtaatactgttcctttgaaaa

SEQ ID NO: 35180 - DNA, 25 bp, S. cerevisiae
gagcttataacactgtccgctctta

SEQ ID NO: 35181 - DNA, 25 bp, S. cerevisiae
gagcgtataccttaccttgttgtta

SEQ ID NO: 35182 - DNA, 25 bp, S. cerevisiae
gagaattcagcagaaccgtttcatt

SEQ ID NO: 35183 - DNA, 25 bp, S. cerevisiae
gagaccttgaactttcaggcgacac

SEQ ID NO: 35184 - DNA, 25 bp, S. cerevisiae
ggaggtctaaatttcgccaagaact

SEQ ID NO: 35185 - DNA, 25 bp, S. cerevisiae
gagcggtcctaaattcccagatata

SEQ ID NO: 35186 - DNA, 25 bp, S. cerevisiae
gagcggcaccaacaattcacatgat

SEQ ID NO: 35187 - DNA, 25 bp, S. cerevisiae
gagcaggtgcacagcgaattcaagt

SEQ ID NO: 35188 - DNA, 25 bp, S. cerevisiae
gagcggtgctcatcttttagaattc

SEQ ID NO: 35189 - DNA, 25 bp, S. cerevisiae
gagacattgtccgttccgagaatcc

SEQ ID NO: 35190 - DNA, 25 bp, S. cerevisiae
gagactattagccaatcctgaaact

SEQ ID NO: 35191 - DNA, 25 bp, S. cerevisiae
gagacgactgcccaacgagaaactt

SEQ ID NO: 35192 - DNA, 25 bp, S. cerevisiae
gagcaagcttgttatgcccgaaaac

SEQ ID NO: 35193 - DNA, 25 bp, S. cerevisiae
gagcataatatttcaccaccaaccc

SEQ ID NO: 35194 - DNA, 25 bp, S. cerevisiae
gagcaaaatgcaaattaccccactt

SEQ ID NO: 35195 - DNA, 25 bp, S. cerevisiae
gagctagtcaagagcgatccccact

SEQ ID NO: 35196 - DNA, 25 bp, S. cerevisiae
gatccgatcaaattggacccgagga

SEQ ID NO: 35197 - DNA, 25 bp, S. cerevisiae
tgctcccataaagataaccgctaga

SEQ ID NO: 35198 - DNA, 25 bp, S. cerevisiae
taccctgaattacgaacttgctaga

SEQ ID NO: 35199 - DNA, 25 bp, S. cerevisiae
ggacggaacaactcgctttaaccag

SEQ ID NO: 35200 - DNA, 25 bp, S. cerevisiae
ggcacccaaaaagagccctaacttg

SEQ ID NO: 35201 - DNA, 25 bp, S. cerevisiae
gtaccgaggaaagaccgcactgttt

SEQ ID NO: 35202 - DNA, 25 bp, S. cerevisiae
gagcaacccgaatagctttccggaa

SEQ ID NO: 35203 - DNA, 25 bp, S. cerevisiae
gagcaggaccttatatcttttggtt

SEQ ID NO: 35204 - DNA, 25 bp, S. cerevisiae
gagcttgttctcctttgtttgttac

SEQ ID NO: 35205 - DNA, 25 bp, S. cerevisiae
gagcggtctttcttcttgttctata

SEQ ID NO: 35206 - DNA, 25 bp, S. cerevisiae
gagcggtctctgacagttctgtcat

SEQ ID NO: 35207 - DNA, 25 bp, S. cerevisiae
gagcaagtgatcttcgattctacag

SEQ ID NO: 35208 - DNA, 25 bp, S. cerevisiae
gagcatattgacgtgtttatccggg

SEQ ID NO: 35209 - DNA, 25 bp, S. cerevisiae
gagcaagtgtcggtgcattggccct

SEQ ID NO: 35210 - DNA, 25 bp, S. cerevisiae
gagcaggtatgcctcattgtccgac

SEQ ID NO: 35211 - DNA, 25 bp, S. cerevisiae
gagcttgacgtcaaattctctcatt

SEQ ID NO: 35212 - DNA, 25 bp, S. cerevisiae
gagctatgatttacggtcctctcaa

SEQ ID NO: 35213 - DNA, 25 bp, S. cerevisiae
gagcttgtggatagggatctccgaa

SEQ ID NO: 35214 - DNA, 25 bp, S. cerevisiae
gagcatcaaggacgccaaagacgga

SEQ ID NO: 35215 - DNA, 25 bp, S. cerevisiae
gagcaaatggcgcacaacaactatt

SEQ ID NO: 35216 - DNA, 25 bp, S. cerevisiae
gagcatgatcttcaaaacccaaaag

SEQ ID NO: 35217 - DNA, 25 bp, S. cerevisiae
gagcagatgcttggaaaaacgcaat

SEQ ID NO: 35218 - DNA, 25 bp, S. cerevisiae
gagaatctaccaaggctttaaccag

SEQ ID NO: 35219 - DNA, 25 bp, S. cerevisiae
gagcagggcttatgacacttatgac

SEQ ID NO: 35220 - DNA, 25 bp, S. cerevisiae
gagcttctgttgtttatccaatcaa

SEQ ID NO: 35221 - DNA, 25 bp, S. cerevisiae
gagcacttctgaagcgtcattcaat

SEQ ID NO: 35222 - DNA, 25 bp, S. cerevisiae
gagcatgtagctatcagatccaaat

SEQ ID NO: 35223 - DNA, 25 bp, S. cerevisiae
gagcagacgctcatcaataaaatcg

SEQ ID NO: 35224 - DNA, 25 bp, S. cerevisiae
gagcatgggttgcagataactcata

SEQ ID NO: 35225 - DNA, 25 bp, S. cerevisiae
gagaatcgaatgcaatcaaccaagt

SEQ ID NO: 35226 - DNA, 25 bp, S. cerevisiae
gagcaactactccatacatgaccaa

SEQ ID NO: 35227 - DNA, 25 bp, S. cerevisiae
gagaactttcgaaatggcacaccag

SEQ ID NO: 35228 - DNA, 25 bp, S. cerevisiae
gagaaccgttaaattccccgtgctg

SEQ ID NO: 35229 - DNA, 25 bp, S. cerevisiae
gagcaaacaggatagttccgccgat

SEQ ID NO: 35230 - DNA, 25 bp, S. cerevisiae
gagaacatcggagatttgcccacgc

SEQ ID NO: 35231 - DNA, 25 bp, S. cerevisiae
gagaacggcgaaagcaggctcccac

SEQ ID NO: 35232 - DNA, 25 bp, S. cerevisiae
gagaagcttaaatcgcactaccaaa

SEQ ID NO: 35233 - DNA, 25 bp, S. cerevisiae
gagctactttattgagcgacatacc

SEQ ID NO: 35234 - DNA, 25 bp, S. cerevisiae
gagcatcacttttatagggaacata

SEQ ID NO: 35235 - DNA, 25 bp, S. cerevisiae
gagctacattttccatcggtgacta

SEQ ID NO: 35236 - DNA, 25 bp, S. cerevisiae
gagctcttagatacaacgcttataa

SEQ ID NO: 35237 - DNA, 25 bp, S. cerevisiae
gagctttgagaagagctttgaccaa

SEQ ID NO: 35238 - DNA, 25 bp, S. cerevisiae
gagaatcaaacccaagttcccaaga

SEQ ID NO: 35239 - DNA, 25 bp, S. cerevisiae
gagacataatagttcggttcccaca

SEQ ID NO: 35240 - DNA, 25 bp, S. cerevisiae
gagaatagttgaccttgttgcccaa

SEQ ID NO: 35241 - DNA, 25 bp, S. cerevisiae
gagcttcatcacctacggttgtaga

SEQ ID NO: 35242 - DNA, 25 bp, S. cerevisiae
gagcatttgcactcaggcttttcaa

SEQ ID NO: 35243 - DNA, 25 bp, S. cerevisiae
gagctgctagattctctcacttgta

SEQ ID NO: 35244 - DNA, 25 bp, S. cerevisiae
gagcattcatgatcttactagtcac

SEQ ID NO: 35245 - DNA, 25 bp, S. cerevisiae
gagcatgccagattactaccaggac

SEQ ID NO: 35246 - DNA, 25 bp, S. cerevisiae
gagcatctaatactctaccagaact

SEQ ID NO: 35247 - DNA, 25 bp, S. cerevisiae
gagcaagttatggtggccgtccaat

SEQ ID NO: 35248 - DNA, 25 bp, S. cerevisiae
gagcacttttggtaatgagcgacaa

SEQ ID NO: 35249 - DNA, 25 bp, S. cerevisiae
gagctccttcgatggtggcaaaaca

SEQ ID NO: 35250 - DNA, 25 bp, S. cerevisiae
gatgcccggtgctgttgattttaaa

SEQ ID NO: 35251 - DNA, 25 bp, S. cerevisiae
gagaccaatgttcaagtcggtgaaa

SEQ ID NO: 35252 - DNA, 25 bp, S. cerevisiae
gatcaacatttccactttggctggg

SEQ ID NO: 35253 - DNA, 25 bp, S. cerevisiae
gagaacttttggtttcttggctagg

SEQ ID NO: 35254 - DNA, 25 bp, S. cerevisiae
gagaattttgttttgctttcgacag

SEQ ID NO: 35255 - DNA, 25 bp, S. cerevisiae
gagaatgacgattccgtacgggagt

SEQ ID NO: 35256 - DNA, 25 bp, S. cerevisiae
gagcatagtaattccgatggcggta

SEQ ID NO: 35257 - DNA, 25 bp, S. cerevisiae
gagcacgattgttccgatgtcggta

SEQ ID NO: 35258 - DNA, 25 bp, S. cerevisiae
gagcataacgttccgatcatcagac

SEQ ID NO: 35259 - DNA, 25 bp, S. cerevisiae
gagacaacgcacctagctatgctga

SEQ ID NO: 35260 - DNA, 25 bp, S. cerevisiae
gagaatcccctaatggactttgctt

SEQ ID NO: 35261 - DNA, 25 bp, S. cerevisiae
gagcaactttaggtgctgcctttgc

SEQ ID NO: 35262 - DNA, 25 bp, S. cerevisiae
gagcaacatctctacggaacagcgt

SEQ ID NO: 35263 - DNA, 25 bp, S. cerevisiae
gagactttgccctcaacagtatcag

SEQ ID NO: 35264 - DNA, 25 bp, S. cerevisiae
gagactttgagggtccacacaataa

SEQ ID NO: 35265 - DNA, 25 bp, S. cerevisiae
gagaaggtgtcgcttccacaattaa

SEQ ID NO: 35266 - DNA, 25 bp, S. cerevisiae
gtagcagtaccgtcgtggaaagtaa

SEQ ID NO: 35267 - DNA, 25 bp, S. cerevisiae
gagaagaacccctgtaaatgtaact

SEQ ID NO: 35268 - DNA, 25 bp, S. cerevisiae
gagacgcatacaaccacgaaaatta

SEQ ID NO: 35269 - DNA, 25 bp, S. cerevisiae
gagcacgagaacaaaggccctgaat

SEQ ID NO: 35270 - DNA, 25 bp, S. cerevisiae
gagaaaacgccttctgtttcagaaa

SEQ ID NO: 35271 - DNA, 25 bp, S. cerevisiae
gagtacagacgtttcgcatttccga

SEQ ID NO: 35272 - DNA, 25 bp, S. cerevisiae
gagcaacgacgttacctttttcaag

SEQ ID NO: 35273 - DNA, 25 bp, S. cerevisiae
gagaacgggtccgtcattttacaag

SEQ ID NO: 35274 - DNA, 25 bp, S. cerevisiae
gagcaattgggctacgttgttttta

SEQ ID NO: 35275 - DNA, 25 bp, S. cerevisiae
gagcattggtggtttcctttgttta

SEQ ID NO: 35276 - DNA, 25 bp, S. cerevisiae
gagcaagagcagcatataccgcaat

SEQ ID NO: 35277 - DNA, 25 bp, S. cerevisiae
gagcagatcgagcaaattccaatgg

SEQ ID NO: 35278 - DNA, 25 bp, S. cerevisiae
gagcatccattttatattcttatcg

SEQ ID NO: 35279 - DNA, 25 bp, S. cerevisiae
gagaacctcttatatttcgaagcaa

SEQ ID NO: 35280 - DNA, 25 bp, S. cerevisiae
gagaaggatccggtaagccccgcct

SEQ ID NO: 35281 - DNA, 25 bp, S. cerevisiae
gagaaggtggctgtatatacgctac

SEQ ID NO: 35282 - DNA, 25 bp, S. cerevisiae
gagaatgggtctggcacactgatgc

SEQ ID NO: 35283 - DNA, 25 bp, S. cerevisiae
gagcaggtcatttgctttgcgataa

SEQ ID NO: 35284 - DNA, 25 bp, S. cerevisiae
gagcagctgtcaattatcgatcgat

SEQ ID NO: 35285 - DNA, 25 bp, S. cerevisiae
gagcatgatttcagcccatcagata

SEQ ID NO: 35286 - DNA, 25 bp, S. cerevisiae
gagtcaagactgtacggcgaagcac

SEQ ID NO: 35287 - DNA, 25 bp, S. cerevisiae
gagatcaagagcttcagtggttata

SEQ ID NO: 35288 - DNA, 25 bp, S. cerevisiae
gagaagtcttgttgaactcgaccga

SEQ ID NO: 35289 - DNA, 25 bp, S. cerevisiae
gagaaaccgtcaaatccaatccgct

SEQ ID NO: 35290 - DNA, 25 bp, S. cerevisiae
gagaaaaccttgaaacaggccgctt

SEQ ID NO: 35291 - DNA, 25 bp, S. cerevisiae
gagaaagacgtacataccgcgccct

SEQ ID NO: 35292 - DNA, 25 bp, S. cerevisiae
gagaaaatttggcattcccacctcg

SEQ ID NO: 35293 - DNA, 25 bp, S. cerevisiae
gagaaagtccttgcaaacgttatta

SEQ ID NO: 35294 - DNA, 25 bp, S. cerevisiae
gagaatagtcccaccaacgataatt

SEQ ID NO: 35295 - DNA, 25 bp, S. cerevisiae
gagaataatcgggttcaagcgtaag

SEQ ID NO: 35296 - DNA, 25 bp, S. cerevisiae
gagaaaccgacatctaagccgcaat

SEQ ID NO: 35297 - DNA, 25 bp, S. cerevisiae
gagcaaattcgtgccttgagcacta

SEQ ID NO: 35298 - DNA, 25 bp, S. cerevisiae
gagcttagctgtttcaatcatatct

SEQ ID NO: 35299 - DNA, 25 bp, S. cerevisiae
gagcttgccaaaattgatttcttcc

SEQ ID NO: 35300 - DNA, 25 bp, S. cerevisiae
gagaatcctacgtccttttacaata

SEQ ID NO: 35301 - DNA, 25 bp, S. cerevisiae
gagaacgttcctgttatgtacaaga

SEQ ID NO: 35302 - DNA, 25 bp, S. cerevisiae
gagaacgattctactactaatacag

SEQ ID NO: 35303 - DNA, 25 bp, S. cerevisiae
gagacggattgcacgactctaataa

SEQ ID NO: 35304 - DNA, 25 bp, S. cerevisiae
tgaaaaagagctcttcccttaccga

SEQ ID NO: 35305 - DNA, 25 bp, S. cerevisiae
gagacaaagatatcccgttctaccg

SEQ ID NO: 35306 - DNA, 25 bp, S. cerevisiae
gagcaaaacttgacggagttcatat

SEQ ID NO: 35307 - DNA, 25 bp, S. cerevisiae
gagaataatttccagcgaggtgcaa

SEQ ID NO: 35308 - DNA, 25 bp, S. cerevisiae
gagacaaaggcgtcgtgccgctcat

SEQ ID NO: 35309 - DNA, 25 bp, S. cerevisiae
gagacgaaggcctgttcaacttata

SEQ ID NO: 35310 - DNA, 25 bp, S. cerevisiae
gagcaggaaccattgggtcgtgtaa

SEQ ID NO: 35311 - DNA, 25 bp, S. cerevisiae
gagcatggtcccgattggtgtacga

SEQ ID NO: 35312 - DNA, 25 bp, S. cerevisiae
gagcacgtcacccacatttgaaaga

SEQ ID NO: 35313 - DNA, 25 bp, S. cerevisiae
gagacgatccaccagatatgctatg

SEQ ID NO: 35314 - DNA, 25 bp, S. cerevisiae
gagacccgccatcacgttaaaacaa

SEQ ID NO: 35315 - DNA, 25 bp, S. cerevisiae
gagaacgcctctcgtctaagaaatt

SEQ ID NO: 35316 - DNA, 25 bp, S. cerevisiae
gagacatcccttcttcaaaaaagtt

SEQ ID NO: 35317 - DNA, 25 bp, S. cerevisiae
gagacgtcgttgtaaccactctttt

SEQ ID NO: 35318 - DNA, 25 bp, S. cerevisiae
gagcacagggatgatttcattccat

SEQ ID NO: 35319 - DNA, 25 bp, S. cerevisiae
gagcacgtgaaatccttgcctatgg

SEQ ID NO: 35320 - DNA, 25 bp, S. cerevisiae
gagcacaaaacatccaagcttcatg

SEQ ID NO: 35321 - DNA, 25 bp, S. cerevisiae
gagcactaaactgttggcctcatta

SEQ ID NO: 35322 - DNA, 25 bp, S. cerevisiae
gagacgctttttactacctgactag

SEQ ID NO: 35323 - DNA, 25 bp, S. cerevisiae
gagcaacttgccgagtatcgttgaa

SEQ ID NO: 35324 - DNA, 25 bp, S. cerevisiae
gagcaacttgcgtgaatcgaagaca

SEQ ID NO: 35325 - DNA, 25 bp, S. cerevisiae
gagcaactaagcaacaatctggatg

SEQ ID NO: 35326 - DNA, 25 bp, S. cerevisiae
gagcaattgaacaagcagctgtctt

SEQ ID NO: 35327 - DNA, 25 bp, S. cerevisiae
gagcattgcgatacgatgggtcata

SEQ ID NO: 35328 - DNA, 25 bp, S. cerevisiae
gagcatcaagttacagtggccttat

SEQ ID NO: 35329 - DNA, 25 bp, S. cerevisiae
gagcatacgggcactggcacttata

SEQ ID NO: 35330 - DNA, 25 bp, S. cerevisiae
gagcaatcgtggtcggactctaata

SEQ ID NO: 35331 - DNA, 25 bp, S. cerevisiae
gagcaatcgttgttggagccagaca

SEQ ID NO: 35332 - DNA, 25 bp, S. cerevisiae
gagaatcgctctcatgggtcaagat

SEQ ID NO: 35333 - DNA, 25 bp, S. cerevisiae
gagcattgtctccttaattcacata

SEQ ID NO: 35334 - DNA, 25 bp, S. cerevisiae
gagaattacatgcttgttgctgtta

SEQ ID NO: 35335 - DNA, 25 bp, S. cerevisiae
gagaatgctccatacctagttaaat

SEQ ID NO: 35336 - DNA, 25 bp, S. cerevisiae
gagaatgcactctcaacttgaaaat

SEQ ID NO: 35337 - DNA, 25 bp, S. cerevisiae
gagacctccggagcaaccgaatttt

SEQ ID NO: 35338 - DNA, 25 bp, S. cerevisiae
gagaccacggaagacctcaacttaa

SEQ ID NO: 35339 - DNA, 25 bp, S. cerevisiae
gagaacacggtagattcgcaatact

SEQ ID NO: 35340 - DNA, 25 bp, S. cerevisiae
gagcaaacaggttccgctggagaca

SEQ ID NO: 35341 - DNA, 25 bp, S. cerevisiae
gagcatgtcgctactaaggtcacag

SEQ ID NO: 35342 - DNA, 25 bp, S. cerevisiae
gagcatgctccgataattgcgacag

SEQ ID NO: 35343 - DNA, 25 bp, S. cerevisiae
gagcatgccacggttgatcgagaca

SEQ ID NO: 35344 - DNA, 25 bp, S. cerevisiae
gagcagagaccctacattgtgcatt

SEQ ID NO: 35345 - DNA, 25 bp, S. cerevisiae
gagcagcattctccgactgttgaat

SEQ ID NO: 35346 - DNA, 25 bp, S. cerevisiae
gagcagcttatcaccatgggatctt

SEQ ID NO: 35347 - DNA, 25 bp, S. cerevisiae
gagcactagtgaccctgtagatgtt

SEQ ID NO: 35348 - DNA, 25 bp, S. cerevisiae
gagcaccagattccgcagttatttt

SEQ ID NO: 35349 - DNA, 25 bp, S. cerevisiae
gagcatctcgtttcagcatatctat

SEQ ID NO: 35350 - DNA, 25 bp, S. cerevisiae
gagcatgccatggttccaatacaag

SEQ ID NO: 35351 - DNA, 25 bp, S. cerevisiae
gagaattgcgttccaaaaagttgtt

SEQ ID NO: 35352 - DNA, 25 bp, S. cerevisiae
gagcaattgtttccaaagggatctg

SEQ ID NO: 35353 - DNA, 25 bp, S. cerevisiae
gagaggtgtaccagccagtttgtta

SEQ ID NO: 35354 - DNA, 25 bp, S. cerevisiae
gagcattgcttatcatcaccgttat

SEQ ID NO: 35355 - DNA, 25 bp, S. cerevisiae
gagcagatcattgttcatcctgtta

SEQ ID NO: 35356 - DNA, 25 bp, S. cerevisiae
gagcaatcatttcacactcgtctac

SEQ ID NO: 35357 - DNA, 25 bp, S. cerevisiae
gagcaggccactatcagaacgttga

SEQ ID NO: 35358 - DNA, 25 bp, S. cerevisiae
gagcagtacctcacaaatcgttgta

SEQ ID NO: 35359 - DNA, 25 bp, S. cerevisiae
gagcatgtacacaccatttctctat

SEQ ID NO: 35360 - DNA, 25 bp, S. cerevisiae
gagcagcctaatttttctagtcata

SEQ ID NO: 35361 - DNA, 25 bp, S. cerevisiae
gagcagcgtgagcaattccacagga

SEQ ID NO: 35362 - DNA, 25 bp, S. cerevisiae
gagcagtgttgcaaacgcccaagat

SEQ ID NO: 35363 - DNA, 25 bp, S. cerevisiae
gagcaggtagcccacgacaaagaac

SEQ ID NO: 35364 - DNA, 25 bp, S. cerevisiae
gagcaggtgcccaatctacagatga

SEQ ID NO: 35365 - DNA, 25 bp, S. cerevisiae
gagcatgtggccgaattccgagtta

SEQ ID NO: 35366 - DNA, 25 bp, S. cerevisiae
gatgctaacagagcttacggttcag

SEQ ID NO: 35367 - DNA, 25 bp, S. cerevisiae
gaggcaagggtcaatacgttctagt

SEQ ID NO: 35368 - DNA, 25 bp, S. cerevisiae
gagcaccacggtaatagcggtctca

SEQ ID NO: 35369 - DNA, 25 bp, S. cerevisiae
gagacctagcagacttagatggcct

SEQ ID NO: 35370 - DNA, 25 bp, S. cerevisiae
gagactgcctggtctatcgatagat

SEQ ID NO: 35371 - DNA, 25 bp, S. cerevisiae
gagcaaacatattcaacgtcttggt

SEQ ID NO: 35372 - DNA, 25 bp, S. cerevisiae
gagaatacaatatcccatttgatca

SEQ ID NO: 35373 - DNA, 25 bp, S. cerevisiae
gagaaaaatcccctcattggaatgt

SEQ ID NO: 35374 - DNA, 25 bp, S. cerevisiae
gagaaaaccccatcgcggttgataa

SEQ ID NO: 35375 - DNA, 25 bp, S. cerevisiae
gagaaggaccttatcacttttactt

SEQ ID NO: 35376 - DNA, 25 bp, S. cerevisiae
gagaaggccacaatttacatgattt

SEQ ID NO: 35377 - DNA, 25 bp, S. cerevisiae
gagaaagcccattaaagagcacttt

SEQ ID NO: 35378 - DNA, 25 bp, S. cerevisiae
gagaagacctccataagtcccacat

SEQ ID NO: 35379 - DNA, 25 bp, S. cerevisiae
gagaaggccctaaatcatgtccgag

SEQ ID NO: 35380 - DNA, 25 bp, S. cerevisiae
gagatatggtgggaaccgctcctag

SEQ ID NO: 35381 - DNA, 25 bp, S. cerevisiae
gagaactttatacctctgcgaaatt

SEQ ID NO: 35382 - DNA, 25 bp, S. cerevisiae
gagagaagcattcgtgtccttaaat

SEQ ID NO: 35383 - DNA, 25 bp, S. cerevisiae
gagcaaggcagacgcgtatttacaa

SEQ ID NO: 35384 - DNA, 25 bp, S. cerevisiae
gagcacatgggaccggattgcatat

SEQ ID NO: 35385 - DNA, 25 bp, S. cerevisiae
gagacattcgagaccagttgctaac

SEQ ID NO: 35386 - DNA, 25 bp, S. cerevisiae
gagacataccgacgctattgtaacg

SEQ ID NO: 35387 - DNA, 25 bp, S. cerevisiae
gagagcccctgcaatgttatatggt

SEQ ID NO: 35388 - DNA, 25 bp, S. cerevisiae
gagcatatttcagtttagtagtccc

SEQ ID NO: 35389 - DNA, 25 bp, S. cerevisiae
gagactaatccttcggctaacgttc

SEQ ID NO: 35390 - DNA, 25 bp, S. cerevisiae
gagacaaaccttcagaaccggaacg

SEQ ID NO: 35391 - DNA, 25 bp, S. cerevisiae
gagacacggttcttggcgttggaca

SEQ ID NO: 35392 - DNA, 25 bp, S. cerevisiae
gagaatccggtggttgctgtagaac

SEQ ID NO: 35393 - DNA, 25 bp, S. cerevisiae
gagcaggttttcctcttggaatgac

SEQ ID NO: 35394 - DNA, 25 bp, S. cerevisiae
gagcaatcttcctgccttagagaga

SEQ ID NO: 35395 - DNA, 25 bp, S. cerevisiae
gagaatattgccttgtggcccgaag

SEQ ID NO: 35396 - DNA, 25 bp, S. cerevisiae
gagaaatccatcgtgggacgccacc

SEQ ID NO: 35397 - DNA, 25 bp, S. cerevisiae
gagaacatcttcatcaaaccttcca

SEQ ID NO: 35398 - DNA, 25 bp, S. cerevisiae
gagaacgttcattaccaatttccga

SEQ ID NO: 35399 - DNA, 25 bp, S. cerevisiae
gagaaagtgctcacccaattgaccg

SEQ ID NO: 35400 - DNA, 25 bp, S. cerevisiae
gagaaagacgatccccaatatcaca

SEQ ID NO: 35401 - DNA, 25 bp, S. cerevisiae
gagaaaccgaccatgcaaatactga

SEQ ID NO: 35402 - DNA, 25 bp, S. cerevisiae
gagcaaggccaaactacgttatcga

SEQ ID NO: 35403 - DNA, 25 bp, S. cerevisiae
gagaccacgtgaccaaggctttttg

SEQ ID NO: 35404 - DNA, 25 bp, S. cerevisiae
gagactactgacttttttattgatt

SEQ ID NO: 35405 - DNA, 25 bp, S. cerevisiae
gagacctcctttgacgtcgctatta

SEQ ID NO: 35406 - DNA, 25 bp, S. cerevisiae
gagaacttgaccaccaatgactgct

SEQ ID NO: 35407 - DNA, 25 bp, S. cerevisiae
gagaacattacgattcaggacctgt

SEQ ID NO: 35408 - DNA, 25 bp, S. cerevisiae
gagcaagattcagcacttcgtctca

SEQ ID NO: 35409 - DNA, 25 bp, S. cerevisiae
gagcaagaattccacgatacagtag

SEQ ID NO: 35410 - DNA, 25 bp, S. cerevisiae
gagaaattccttcttctatattagg

SEQ ID NO: 35411 - DNA, 25 bp, S. cerevisiae
gagaaattccctgaccaatggctag

SEQ ID NO: 35412 - DNA, 25 bp, S. cerevisiae
gagaaatgctttcacaaaatccgga

SEQ ID NO: 35413 - DNA, 25 bp, S. cerevisiae
gagaatctttatatcccaactgcag

SEQ ID NO: 35414 - DNA, 25 bp, S. cerevisiae
gagaattttctatcaaaccgcagtt

SEQ ID NO: 35415 - DNA, 25 bp, S. cerevisiae
gagaattctgacaccaaacggccct

SEQ ID NO: 35416 - DNA, 25 bp, S. cerevisiae
gagaagattacaagccaaacgcctt

SEQ ID NO: 35417 - DNA, 25 bp, S. cerevisiae
gagacgtttcctcttagggtcaaat

SEQ ID NO: 35418 - DNA, 25 bp, S. cerevisiae
gagaattctttgcttgtcctggacc

SEQ ID NO: 35419 - DNA, 25 bp, S. cerevisiae
gagaacttaatgatattgcctgtga

SEQ ID NO: 35420 - DNA, 25 bp, S. cerevisiae
gagaatttcaacaaattgccctcga

SEQ ID NO: 35421 - DNA, 25 bp, S. cerevisiae
gagaacatatcccactaggccgttg

SEQ ID NO: 35422 - DNA, 25 bp, S. cerevisiae
gagacctttaccgaggccattattt

SEQ ID NO: 35423 - DNA, 25 bp, S. cerevisiae
gagcacctttttggcagggtcacag

SEQ ID NO: 35424 - DNA, 25 bp, S. cerevisiae
gagaaagtctctaacggtggcgtcg

SEQ ID NO: 35425 - DNA, 25 bp, S. cerevisiae
gagaatgtcctgactacgttggaat

SEQ ID NO: 35426 - DNA, 25 bp, S. cerevisiae
gagcaatgtttgtctaactgtgtga

SEQ ID NO: 35427 - DNA, 25 bp, S. cerevisiae
gagaatgtttatcgccacttatatg

SEQ ID NO: 35428 - DNA, 25 bp, S. cerevisiae
gagaacttaatgctgtgcttatatg

SEQ ID NO: 35429 - DNA, 25 bp, S. cerevisiae
gagaagcttcactgctcgagataat

SEQ ID NO: 35430 - DNA, 25 bp, S. cerevisiae
gagaattccgaattgccttccgaaa

SEQ ID NO: 35431 - DNA, 25 bp, S. cerevisiae
gagaactacgaacttcccgagcaaa

SEQ ID NO: 35432 - DNA, 25 bp, S. cerevisiae
gagaatctacgtcgatgtccctcat

SEQ ID NO: 35433 - DNA, 25 bp, S. cerevisiae
gagaaacgcagatgacccctcttat

SEQ ID NO: 35434 - DNA, 25 bp, S. cerevisiae
gagaatactgtttgaatgcccagat

SEQ ID NO: 35435 - DNA, 25 bp, S. cerevisiae
gagaagctcaacttgcaagcgaaac

SEQ ID NO: 35436 - DNA, 25 bp, S. cerevisiae
gagcaatccaggtgcaatgcagaat

SEQ ID NO: 35437 - DNA, 25 bp, S. cerevisiae
gagcaaccaggcactatatgagaaa

SEQ ID NO: 35438 - DNA, 25 bp, S. cerevisiae
gagcaaccaatcacttctgaaaccg

SEQ ID NO: 35439 - DNA, 25 bp, S. cerevisiae
gagacaacaaatttcttgaatgagc

SEQ ID NO: 35440 - DNA, 25 bp, S. cerevisiae
gagaacccactgaatcctgaagctg

SEQ ID NO: 35441 - DNA, 25 bp, S. cerevisiae
gagcaaactaccatccaaactgaaa

SEQ ID NO: 35442 - DNA, 25 bp, S. cerevisiae
gagattacctgaaatcccacctaaa

SEQ ID NO: 35443 - DNA, 25 bp, S. cerevisiae
gagacttctgtgaaaccaaccggca

SEQ ID NO: 35444 - DNA, 25 bp, S. cerevisiae
gagaagtctcgggtctacaagctct

SEQ ID NO: 35445 - DNA, 25 bp, S. cerevisiae
gagaatgctttggacctactggcgc

SEQ ID NO: 35446 - DNA, 25 bp, S. cerevisiae
gagcacacgaagttactgcactcat

SEQ ID NO: 35447 - DNA, 25 bp, S. cerevisiae
gagaccgacggttcgattgcatcta

SEQ ID NO: 35448 - DNA, 25 bp, S. cerevisiae
gagaccggcactagtttgggcagta

SEQ ID NO: 35449 - DNA, 25 bp, S. cerevisiae
gagacccacagctaattcgggagga

SEQ ID NO: 35450 - DNA, 25 bp, S. cerevisiae
gagacaaccagctcaaccaagagaa

SEQ ID NO: 35451 - DNA, 25 bp, S. cerevisiae
tgaaaattgtccctttaatttggca

SEQ ID NO: 35452 - DNA, 25 bp, S. cerevisiae
gagcaattgagatcctataatacca

SEQ ID NO: 35453 - DNA, 25 bp, S. cerevisiae
gagaactagaagacttaagagaaag

SEQ ID NO: 35454 - DNA, 25 bp, S. cerevisiae
gagcaacttgacaaaccaacagata

SEQ ID NO: 35455 - DNA, 25 bp, S. cerevisiae
gagaagtatgacaacctgcctaata

SEQ ID NO: 35456 - DNA, 25 bp, S. cerevisiae
gagacagccgcgtaaagcgccagtt

SEQ ID NO: 35457 - DNA, 25 bp, S. cerevisiae
gagacgcaccagcaagaccgagttc

SEQ ID NO: 35458 - DNA, 25 bp, S. cerevisiae
gagaccctagtggaagccgtgttgt

SEQ ID NO: 35459 - DNA, 25 bp, S. cerevisiae
gagcacctctctggtaaatcgtttg

SEQ ID NO: 35460 - DNA, 25 bp, S. cerevisiae
gagagcttgtaccagaaaacgttta

SEQ ID NO: 35461 - DNA, 25 bp, S. cerevisiae
gagcaccatttcttatttatctagt

SEQ ID NO: 35462 - DNA, 25 bp, S. cerevisiae
gagacagaccaatcccgaatcgttt

SEQ ID NO: 35463 - DNA, 25 bp, S. cerevisiae
gagcactcgatcttcccagaaaaag

SEQ ID NO: 35464 - DNA, 25 bp, S. cerevisiae
gagagccagttccactaggtatact

SEQ ID NO: 35465 - DNA, 25 bp, S. cerevisiae
gagacccttcaagactttcatctga

SEQ ID NO: 35466 - DNA, 25 bp, S. cerevisiae
gagaacttatcctcatctttctatg

SEQ ID NO: 35467 - DNA, 25 bp, S. cerevisiae
gagcaaactctacaatttcctgatg

SEQ ID NO: 35468 - DNA, 25 bp, S. cerevisiae
gagaacccatatctagataccaagg

SEQ ID NO: 35469 - DNA, 25 bp, S. cerevisiae
gagaccctagatacatcggaccaga

SEQ ID NO: 35470 - DNA, 25 bp, S. cerevisiae
gagaagatttaccaccgagccaata

SEQ ID NO: 35471 - DNA, 25 bp, S. cerevisiae
gagaaattcattaacctactactgg

SEQ ID NO: 35472 - DNA, 25 bp, S. cerevisiae
gagaagttattttccagttttgcaa

SEQ ID NO: 35473 - DNA, 25 bp, S. cerevisiae
gagacttaacctaatcgttgatcca

SEQ ID NO: 35474 - DNA, 25 bp, S. cerevisiae
gagactatggattgcgttccttgtc

SEQ ID NO: 35475 - DNA, 25 bp, S. cerevisiae
gagactgggaatcctcatcgaggct

SEQ ID NO: 35476 - DNA, 25 bp, S. cerevisiae
gagacttatagtatcgctggcgttt

SEQ ID NO: 35477 - DNA, 25 bp, S. cerevisiae
gagaatccaaggacccattctgttt

SEQ ID NO: 35478 - DNA, 25 bp, S. cerevisiae
gagaagatccgaatcaccgtcaatc

SEQ ID NO: 35479 - DNA, 25 bp, S. cerevisiae
gagaagagccaatattcccgtccct

SEQ ID NO: 35480 - DNA, 25 bp, S. cerevisiae
gagcaatgagcacagatggtcccgt

SEQ ID NO: 35481 - DNA, 25 bp, S. cerevisiae
gagcaatgacactaaggccaatgga

SEQ ID NO: 35482 - DNA, 25 bp, S. cerevisiae
gagaatggccaagactctatggagt

SEQ ID NO: 35483 - DNA, 25 bp, S. cerevisiae
gagaatcccaactatctttctcact

SEQ ID NO: 35484 - DNA, 25 bp, S. cerevisiae
gagcactccgaaaatcatgttccac

SEQ ID NO: 35485 - DNA, 25 bp, S. cerevisiae
gagacgtgcgacaacaagtggccca

SEQ ID NO: 35486 - DNA, 25 bp, S. cerevisiae
gagaagttgttgacggcaggccaca

SEQ ID NO: 35487 - DNA, 25 bp, S. cerevisiae
gagaatgagcagtttcggaacagta

SEQ ID NO: 35488 - DNA, 25 bp, S. cerevisiae
gagaaagagctacttgtggcacaat

SEQ ID NO: 35489 - DNA, 25 bp, S. cerevisiae
gagaagcacactttcgtcgcagaat

SEQ ID NO: 35490 - DNA, 25 bp, S. cerevisiae
gatgaggacatcaccgtccaagtgc

SEQ ID NO: 35491 - DNA, 25 bp, S. cerevisiae
gagacgaaggtttgcacaccgactt

SEQ ID NO: 35492 - DNA, 25 bp, S. cerevisiae
gagacaagacagtttcacccgtgtt

SEQ ID NO: 35493 - DNA, 25 bp, S. cerevisiae
gagaatgtagcaacccaacttgtgg

SEQ ID NO: 35494 - DNA, 25 bp, S. cerevisiae
gagactttaacgtactttggagatc

SEQ ID NO: 35495 - DNA, 25 bp, S. cerevisiae
gagacgtaaaaatgcatccttggat

SEQ ID NO: 35496 - DNA, 25 bp, S. cerevisiae
gagcaagtagctttgattcctccac

SEQ ID NO: 35497 - DNA, 25 bp, S. cerevisiae
gagaagctacatttaccaccaacgt

SEQ ID NO: 35498 - DNA, 25 bp, S. cerevisiae
gagattctcaaaaacgacgtactgt

SEQ ID NO: 35499 - DNA, 25 bp, S. cerevisiae
gagacaccaaaataccattcacgct

SEQ ID NO: 35500 - DNA, 25 bp, S. cerevisiae
gagaaacacaaatcccttcaagcaa

SEQ ID NO: 35501 - DNA, 25 bp, S. cerevisiae
gagaaacgcaactaccctagagcct

SEQ ID NO: 35502 - DNA, 25 bp, S. cerevisiae
gagaaacttagctaccttatgcggt

SEQ ID NO: 35503 - DNA, 25 bp, S. cerevisiae
gagtaccattagcacgtttatcaat

SEQ ID NO: 35504 - DNA, 25 bp, S. cerevisiae
gagcaagcaatcaattctggttcgt

SEQ ID NO: 35505 - DNA, 25 bp, S. cerevisiae
gagaacgatcaattgttggctttgt

SEQ ID NO: 35506 - DNA, 25 bp, S. cerevisiae
gagcaaccatgcaatcttacagaaa

SEQ ID NO: 35507 - DNA, 25 bp, S. cerevisiae
gagaacgcatgctatgctgaacgat

SEQ ID NO: 35508 - DNA, 25 bp, S. cerevisiae
gagaagttagcctctttacaaccaa

SEQ ID NO: 35509 - DNA, 25 bp, S. cerevisiae
gagaggttacctggttcatactaca

SEQ ID NO: 35510 - DNA, 25 bp, S. cerevisiae
gagacgtgtaccaatacctggctac

SEQ ID NO: 35511 - DNA, 25 bp, S. cerevisiae
gagacaggccccaagacggtgcatt

SEQ ID NO: 35512 - DNA, 25 bp, S. cerevisiae
gagagatggtcaagaaacacgcatt

SEQ ID NO: 35513 - DNA, 25 bp, S. cerevisiae
gagagcagatgtcaaacgagccaaa

SEQ ID NO: 35514 - DNA, 25 bp, S. cerevisiae
gagaatcatgactaagccaggccaa

SEQ ID NO: 35515 - DNA, 25 bp, S. cerevisiae
gagtagcatgaatggcatccctaga

SEQ ID NO: 35516 - DNA, 25 bp, S. cerevisiae
gagacagaatatccgggccccaatg

SEQ ID NO: 35517 - DNA, 25 bp, S. cerevisiae
gagactgatattgtggttcctaagg

SEQ ID NO: 35518 - DNA, 25 bp, S. cerevisiae
gagacgttatgaccgtaaacaatct

SEQ ID NO: 35519 - DNA, 25 bp, S. cerevisiae
gagactgttattcctgtgtcagagc

SEQ ID NO: 35520 - DNA, 25 bp, S. cerevisiae
gagacaagtccgtttatccactagt

SEQ ID NO: 35521 - DNA, 25 bp, S. cerevisiae
gagactggtcagtaaatcatcacca

SEQ ID NO: 35522 - DNA, 25 bp, S. cerevisiae
gagacgcagtcaagagttcgccacc

SEQ ID NO: 35523 - DNA, 25 bp, S. cerevisiae
gagaaccttgtcaatatcagcacgt

SEQ ID NO: 35524 - DNA, 25 bp, S. cerevisiae
gagaatccattgtcacttcaacacg

SEQ ID NO: 35525 - DNA, 25 bp, S. cerevisiae
gagaagcggccgacgttatcatcaa

SEQ ID NO: 35526 - DNA, 25 bp, S. cerevisiae
gagaagtcggctgcaaatttccatg

SEQ ID NO: 35527 - DNA, 25 bp, S. cerevisiae
gagagagcatcgacccagagagtac

SEQ ID NO: 35528 - DNA, 25 bp, S. cerevisiae
gagaactgactcctgcaaggctgac

SEQ ID NO: 35529 - DNA, 25 bp, S. cerevisiae
gagcaattcagtacttcttccaata

SEQ ID NO: 35530 - DNA, 25 bp, S. cerevisiae
gagaattcatcaacttcatcctcgc

SEQ ID NO: 35531 - DNA, 25 bp, S. cerevisiae
gagaatttctccgactttgtcttta

SEQ ID NO: 35532 - DNA, 25 bp, S. cerevisiae
gagaatttggttcgtcgtgcaagca

SEQ ID NO: 35533 - DNA, 25 bp, S. cerevisiae
gagaatcggcgttcttcaagctaga

SEQ ID NO: 35534 - DNA, 25 bp, S. cerevisiae
gagaatacacgttcccaggcgaaga

SEQ ID NO: 35535 - DNA, 25 bp, S. cerevisiae
gagaataaacgcttccacgctgaat

SEQ ID NO: 35536 - DNA, 25 bp, S. cerevisiae
gagaaaaaggctgctagggctgata

SEQ ID NO: 35537 - DNA, 25 bp, S. cerevisiae
tttcggatgtcctgcctaaacggag

SEQ ID NO: 35538 - DNA, 25 bp, S. cerevisiae
gagggaattctctcgttacctggag

SEQ ID NO: 35539 - DNA, 25 bp, S. cerevisiae
gataaacatggtgaaggctccttta

SEQ ID NO: 35540 - DNA, 25 bp, S. cerevisiae
gagagcttctttgcaaggttccgta

SEQ ID NO: 35541 - DNA, 25 bp, S. cerevisiae
gagagctacttacgacgattaccag

SEQ ID NO: 35542 - DNA, 25 bp, S. cerevisiae
gagagcttattcataccgctaaggc

SEQ ID NO: 35543 - DNA, 25 bp, S. cerevisiae
gagtcaactctcaatccggtaaggg

SEQ ID NO: 35544 - DNA, 25 bp, S. cerevisiae
gagaaatttcatgccgtcgagagca

SEQ ID NO: 35545 - DNA, 25 bp, S. cerevisiae
gagaatatttctacacgtcgctggt

SEQ ID NO: 35546 - DNA, 25 bp, S. cerevisiae
gagcaatgatgcctcaaacgtcctt

SEQ ID NO: 35547 - DNA, 25 bp, S. cerevisiae
gagaggagttttacttattgaccgt

SEQ ID NO: 35548 - DNA, 25 bp, S. cerevisiae
gagaagctattctggatttagcgaa

SEQ ID NO: 35549 - DNA, 25 bp, S. cerevisiae
gagaacttgtctgtgaccatcggaa

SEQ ID NO: 35550 - DNA, 25 bp, S. cerevisiae
gagacactcggatagtgccacgtaa

SEQ ID NO: 35551 - DNA, 25 bp, S. cerevisiae
gagaaccatctgagtactcgattgt

SEQ ID NO: 35552 - DNA, 25 bp, S. cerevisiae
gagacatactttcgtactcagttag

SEQ ID NO: 35553 - DNA, 25 bp, S. cerevisiae
gagaggacctgcattaagagcttac

SEQ ID NO: 35554 - DNA, 25 bp, S. cerevisiae
gagaagaccgctattgatacttgat

SEQ ID NO: 35555 - DNA, 25 bp, S. cerevisiae
gagaaatcctcgctttacttattat

SEQ ID NO: 35556 - DNA, 25 bp, S. cerevisiae
gagaagaccccgattggcttacagg

SEQ ID NO: 35557 - DNA, 25 bp, S. cerevisiae
gagaatggcccatattagaggtaag

SEQ ID NO: 35558 - DNA, 25 bp, S. cerevisiae
gagaagtactcatatccacaggata

SEQ ID NO: 35559 - DNA, 25 bp, S. cerevisiae
gagaagttctcatcctacaaatcaa

SEQ ID NO: 35560 - DNA, 25 bp, S. cerevisiae
gagaagaaccatcactaccaacaaa

SEQ ID NO: 35561 - DNA, 25 bp, S. cerevisiae
gagaataacctctgcttacaaaact

SEQ ID NO: 35562 - DNA, 25 bp, S. cerevisiae
gagaaaatgccctacatgcaacaaa

SEQ ID NO: 35563 - DNA, 25 bp, S. cerevisiae
gagaatcacagctaccacaagacaa

SEQ ID NO: 35564 - DNA, 25 bp, S. cerevisiae
gagaatcactgcaagtatccaacaa

SEQ ID NO: 35565 - DNA, 25 bp, S. cerevisiae
gagaatatcaccaaatccaagctaa

SEQ ID NO: 35566 - DNA, 25 bp, S. cerevisiae
gagaaggactacaagcgccgccggt

SEQ ID NO: 35567 - DNA, 25 bp, S. cerevisiae
gagaaataccatctgcgcttgccag

SEQ ID NO: 35568 - DNA, 25 bp, S. cerevisiae
gagaccgacaatacccactaaaatg

SEQ ID NO: 35569 - DNA, 25 bp, S. cerevisiae
gagacccaccattgacgacataaat

SEQ ID NO: 35570 - DNA, 25 bp, S. cerevisiae
gagaccttacagagctgggctattt

SEQ ID NO: 35571 - DNA, 25 bp, S. cerevisiae
gagaccttactatattagcttccgg

SEQ ID NO: 35572 - DNA, 25 bp, S. cerevisiae
gagaagttgtcctcttcaccaggag

SEQ ID NO: 35573 - DNA, 25 bp, S. cerevisiae
gagaacgaagattttgcccactgta

SEQ ID NO: 35574 - DNA, 25 bp, S. cerevisiae
gagagatcgtgagttcttcccaagt

SEQ ID NO: 35575 - DNA, 25 bp, S. cerevisiae
gagagatctatgaaccttctacaag

SEQ ID NO: 35576 - DNA, 25 bp, S. cerevisiae
gagagccttgaagatttcgcacgat

SEQ ID NO: 35577 - DNA, 25 bp, S. cerevisiae
gagacttctggaggttactgacgat

SEQ ID NO: 35578 - DNA, 25 bp, S. cerevisiae
gagacaggtctacttataggccaaa

SEQ ID NO: 35579 - DNA, 25 bp, S. cerevisiae
gagagcttttgagtcgtgatgattc

SEQ ID NO: 35580 - DNA, 25 bp, S. cerevisiae
gagacattgattcccgtcttgatgc

SEQ ID NO: 35581 - DNA, 25 bp, S. cerevisiae
gagagcaatgacaacgctttggtga

SEQ ID NO: 35582 - DNA, 25 bp, S. cerevisiae
gagaagagaccatgttctgcaacat

SEQ ID NO: 35583 - DNA, 25 bp, S. cerevisiae
gagaagattcataaggactgccaat

SEQ ID NO: 35584 - DNA, 25 bp, S. cerevisiae
gagaatgatgctttggatgacctac

SEQ ID NO: 35585 - DNA, 25 bp, S. cerevisiae
gagagaataccttgatacctacaat

SEQ ID NO: 35586 - DNA, 25 bp, S. cerevisiae
gagacagaagccatgaacagcgaaa

SEQ ID NO: 35587 - DNA, 25 bp, S. cerevisiae
gagaagaccatcatcacacacaagt

SEQ ID NO: 35588 - DNA, 25 bp, S. cerevisiae
gagacaagtcatagccccacaaaag

SEQ ID NO: 35589 - DNA, 25 bp, S. cerevisiae
gagagagactgcttcgtccatcaaa

SEQ ID NO: 35590 - DNA, 25 bp, S. cerevisiae
gagaatgactggttgccctaacggt

SEQ ID NO: 35591 - DNA, 25 bp, S. cerevisiae
gagaatgaccgtttgctcaaccaaa

SEQ ID NO: 35592 - DNA, 25 bp, S. cerevisiae
gagaaggccatttctaaaagccaat

SEQ ID NO: 35593 - DNA, 25 bp, S. cerevisiae
gagaagcgagctaattaaactgaac

SEQ ID NO: 35594 - DNA, 25 bp, S. cerevisiae
gagaagaaccttcacaactgtcagt

SEQ ID NO: 35595 - DNA, 25 bp, S. cerevisiae
gagaagaacctttactacatgtgct

SEQ ID NO: 35596 - DNA, 25 bp, S. cerevisiae
gagaaacacctcctactgagcatga

SEQ ID NO: 35597 - DNA, 25 bp, S. cerevisiae
gagactaacgatgctattactgcta

SEQ ID NO: 35598 - DNA, 25 bp, S. cerevisiae
gagacttgaagaacgcctcatatta

SEQ ID NO: 35599 - DNA, 25 bp, S. cerevisiae
gagagcttagagacaccttttttga

SEQ ID NO: 35600 - DNA, 25 bp, S. cerevisiae
gagaacgctatatcccttttgaaga

SEQ ID NO: 35601 - DNA, 25 bp, S. cerevisiae
gagacgggaatgatattcttttaca

SEQ ID NO: 35602 - DNA, 25 bp, S. cerevisiae
gagactccgataatgtgtcgcttcc

SEQ ID NO: 35603 - DNA, 25 bp, S. cerevisiae
gagactttattcaggcacttccatg

SEQ ID NO: 35604 - DNA, 25 bp, S. cerevisiae
gatgtctacaattgggcgatatggc

SEQ ID NO: 35605 - DNA, 25 bp, S. cerevisiae
gagattataggctcactgacccttg

SEQ ID NO: 35606 - DNA, 25 bp, S. cerevisiae
gagatttagagctgacaaccctggt

SEQ ID NO: 35607 - DNA, 25 bp, S. cerevisiae
gagagagctaatccggaattcatta

SEQ ID NO: 35608 - DNA, 25 bp, S. cerevisiae
gatgagactataccactgacgttgc

SEQ ID NO: 35609 - DNA, 25 bp, S. cerevisiae
gagagagctgatcctattggtttca

SEQ ID NO: 35610 - DNA, 25 bp, S. cerevisiae
gagagcactgacgatgttgactata

SEQ ID NO: 35611 - DNA, 25 bp, S. cerevisiae
gagacagccctcatgacgttatgtg

SEQ ID NO: 35612 - DNA, 25 bp, S. cerevisiae
gagaagcggccttagatgcagcaaa

SEQ ID NO: 35613 - DNA, 25 bp, S. cerevisiae
gagagaggcctcgaagtccaaaaac

SEQ ID NO: 35614 - DNA, 25 bp, S. cerevisiae
gagacagtccttgaacgctacagca

SEQ ID NO: 35615 - DNA, 25 bp, S. cerevisiae
gagagacgatattgccatccttcta

SEQ ID NO: 35616 - DNA, 25 bp, S. cerevisiae
gagaaactacgcacctacgaggaat

SEQ ID NO: 35617 - DNA, 25 bp, S. cerevisiae
gagagaaaacctgccacactctgtg

SEQ ID NO: 35618 - DNA, 25 bp, S. cerevisiae
gagaccagtaccaagaaggccttca

SEQ ID NO: 35619 - DNA, 25 bp, S. cerevisiae
gagaccaatttccagcatgggactt

SEQ ID NO: 35620 - DNA, 25 bp, S. cerevisiae
gagaccttcttccaaggttatcatc

SEQ ID NO: 35621 - DNA, 25 bp, S. cerevisiae
gagaacttcttcaaatgcggtattt

SEQ ID NO: 35622 - DNA, 25 bp, S. cerevisiae
gagaaattcttctacagcggcaaat

SEQ ID NO: 35623 - DNA, 25 bp, S. cerevisiae
gagaaattccacacgatggcgccat

SEQ ID NO: 35624 - DNA, 25 bp, S. cerevisiae
gagaaaggacttattggctgccata

SEQ ID NO: 35625 - DNA, 25 bp, S. cerevisiae
gagaaactggcgacctgggataaac

SEQ ID NO: 35626 - DNA, 25 bp, S. cerevisiae
gagatgatccggcaactcagaaaaa

SEQ ID NO: 35627 - DNA, 25 bp, S. cerevisiae
gagaaccattgccacagcgagaata

SEQ ID NO: 35628 - DNA, 25 bp, S. cerevisiae
gagtaccaacatccactgagtgcta

SEQ ID NO: 35629 - DNA, 25 bp, S. cerevisiae
gagaacaacactgcgaatgaccaat

SEQ ID NO: 35630 - DNA, 25 bp, S. cerevisiae
gagacctactccaaattgaccaata

SEQ ID NO: 35631 - DNA, 25 bp, S. cerevisiae
gagaagaccatctttgttgtcgaaa

SEQ ID NO: 35632 - DNA, 25 bp, S. cerevisiae
gagagacccagattattttcaggag

SEQ ID NO: 35633 - DNA, 25 bp, S. cerevisiae
gagaaccgcaatactggcgctggcg

SEQ ID NO: 35634 - DNA, 25 bp, S. cerevisiae
gagaacgcccatatgttgctggtga

SEQ ID NO: 35635 - DNA, 25 bp, S. cerevisiae
gagacacccgaaatgttgcaaggat

SEQ ID NO: 35636 - DNA, 25 bp, S. cerevisiae
gagaaacacgtccacttccagagtg

SEQ ID NO: 35637 - DNA, 25 bp, S. cerevisiae
gagacactacgttggtgtagcacca

SEQ ID NO: 35638 - DNA, 25 bp, S. cerevisiae
gagacactgatcgacgcgctgtaca

SEQ ID NO: 35639 - DNA, 25 bp, S. cerevisiae
gagactctatccgacagtgaacgta

SEQ ID NO: 35640 - DNA, 25 bp, S. cerevisiae
gagaccaagctttcaataccgttgt

SEQ ID NO: 35641 - DNA, 25 bp, S. cerevisiae
gagacaatgtgttatcctatccgat

SEQ ID NO: 35642 - DNA, 25 bp, S. cerevisiae
gagaacatctcccattgacaatgtc

SEQ ID NO: 35643 - DNA, 25 bp, S. cerevisiae
gagacatcctccaagttcaatgtaa

SEQ ID NO: 35644 - DNA, 25 bp, S. cerevisiae
gagaaagcttaccatatcaacccca

SEQ ID NO: 35645 - DNA, 25 bp, S. cerevisiae
gagttcgtctttcatatcgtaccca

SEQ ID NO: 35646 - DNA, 25 bp, S. cerevisiae
gagagatgttcacttcagggttatt

SEQ ID NO: 35647 - DNA, 25 bp, S. cerevisiae
gagattgaacactccgcgttacgta

SEQ ID NO: 35648 - DNA, 25 bp, S. cerevisiae
gagagtagacatcgctaccgtcggc

SEQ ID NO: 35649 - DNA, 25 bp, S. cerevisiae
gaggaaatcatagcacgccgctggc

SEQ ID NO: 35650 - DNA, 25 bp, S. cerevisiae
gagaagccataaggcctggccatga

SEQ ID NO: 35651 - DNA, 25 bp, S. cerevisiae
gagagacggcactaccatggaagaa

SEQ ID NO: 35652 - DNA, 25 bp, S. cerevisiae
gagacacgaagatttgcatacaggt

SEQ ID NO: 35653 - DNA, 25 bp, S. cerevisiae
gagacacatgcacatcctcaaatga

SEQ ID NO: 35654 - DNA, 25 bp, S. cerevisiae
gagagttgcattcgccttatttgta

SEQ ID NO: 35655 - DNA, 25 bp, S. cerevisiae
gagatcctactttttattttattca

SEQ ID NO: 35656 - DNA, 25 bp, S. cerevisiae
gagatcccaaagtctaattccttat

SEQ ID NO: 35657 - DNA, 25 bp, S. cerevisiae
gagacgctaacatcaattcccatat

SEQ ID NO: 35658 - DNA, 25 bp, S. cerevisiae
gagacgtacacattctacaacatca

SEQ ID NO: 35659 - DNA, 25 bp, S. cerevisiae
gagagctcagaacacgtcaagatca

SEQ ID NO: 35660 - DNA, 25 bp, S. cerevisiae
gagggcagcattctccgatagaact

SEQ ID NO: 35661 - DNA, 25 bp, S. cerevisiae
gagagggcactgatcgcaacgaatt

SEQ ID NO: 35662 - DNA, 25 bp, S. cerevisiae
gagagaacatgcattccaaggaact

SEQ ID NO: 35663 - DNA, 25 bp, S. cerevisiae
gagaacgctgcgtattccgtgctca

SEQ ID NO: 35664 - DNA, 25 bp, S. cerevisiae
gagatccaagtgtatgtccgttgca

SEQ ID NO: 35665 - DNA, 25 bp, S. cerevisiae
gagacctttgcaattcaagtccatc

SEQ ID NO: 35666 - DNA, 25 bp, S. cerevisiae
gagacgctcaaggtcacaagattca

SEQ ID NO: 35667 - DNA, 25 bp, S. cerevisiae
gagacagctcaattcaagcaggcat

SEQ ID NO: 35668 - DNA, 25 bp, S. cerevisiae
gagacagcatcatcacaaagtattg

SEQ ID NO: 35669 - DNA, 25 bp, S. cerevisiae
gagacaatcgcagacaagtttcaaa

SEQ ID NO: 35670 - DNA, 25 bp, S. cerevisiae
gagacaatagaccacattttccaaa

SEQ ID NO: 35671 - DNA, 25 bp, S. cerevisiae
gagaccccttctactgggtgtcaaa

SEQ ID NO: 35672 - DNA, 25 bp, S. cerevisiae
gagacaatcacttctttactgaaca

SEQ ID NO: 35673 - DNA, 25 bp, S. cerevisiae
gagacacgcgtttcaaattgcaaga

SEQ ID NO: 35674 - DNA, 25 bp, S. cerevisiae
gagagcaagctcaccaaattcaaaa

SEQ ID NO: 35675 - DNA, 25 bp, S. cerevisiae
gagaaagctctttaaatgtcccaaa

SEQ ID NO: 35676 - DNA, 25 bp, S. cerevisiae
gagaaacttcagaatcaggctttga

SEQ ID NO: 35677 - DNA, 25 bp, S. cerevisiae
gagagacacctctattcccgagtta

SEQ ID NO: 35678 - DNA, 25 bp, S. cerevisiae
gagacggcttttgtgccatcagcat

SEQ ID NO: 35679 - DNA, 25 bp, S. cerevisiae
gagactagaaatcgctgtttggcca

SEQ ID NO: 35680 - DNA, 25 bp, S. cerevisiae
gagactctatctgttattatgtgaa

SEQ ID NO: 35681 - DNA, 25 bp, S. cerevisiae
gagacagttccatttctggtgttaa

SEQ ID NO: 35682 - DNA, 25 bp, S. cerevisiae
gagtctcaaccagctcccaaagaag

SEQ ID NO: 35683 - DNA, 25 bp, S. cerevisiae
gagacaccaccatctttaattcaag

SEQ ID NO: 35684 - DNA, 25 bp, S. cerevisiae
gagaaactgctcaagctattaacgg

SEQ ID NO: 35685 - DNA, 25 bp, S. cerevisiae
gagagacctgtcactgttaatggac

SEQ ID NO: 35686 - DNA, 25 bp, S. cerevisiae
gatgaaccggcttctttagatttct

SEQ ID NO: 35687 - DNA, 25 bp, S. cerevisiae
gatgaaacgacgcttgtcgggctct

SEQ ID NO: 35688 - DNA, 25 bp, S. cerevisiae
gatctggacgttcttttgggcctaa

SEQ ID NO: 35689 - DNA, 25 bp, S. cerevisiae
gagagactgcgttcttttgagacgt

SEQ ID NO: 35690 - DNA, 25 bp, S. cerevisiae
gagatacctccgtgatgtggcacag

SEQ ID NO: 35691 - DNA, 25 bp, S. cerevisiae
gagaaattccttcatggcggcagag

SEQ ID NO: 35692 - DNA, 25 bp, S. cerevisiae
gagaaattcctccatatgtccaaga

SEQ ID NO: 35693 - DNA, 25 bp, S. cerevisiae
gagacatattctccgtacttcgata

SEQ ID NO: 35694 - DNA, 25 bp, S. cerevisiae
gagaaaactcccacatccatgataa

SEQ ID NO: 35695 - DNA, 25 bp, S. cerevisiae
gagttaaccccttcaaatatcagat

SEQ ID NO: 35696 - DNA, 25 bp, S. cerevisiae
gagttgaggccgttcattactgaaa

SEQ ID NO: 35697 - DNA, 25 bp, S. cerevisiae
gagactacataaaacatttatctgt

SEQ ID NO: 35698 - DNA, 25 bp, S. cerevisiae
gagttgtactatgagggccctgaga

SEQ ID NO: 35699 - DNA, 25 bp, S. cerevisiae
gagttggctcctcagataaaccttc

SEQ ID NO: 35700 - DNA, 25 bp, S. cerevisiae
gagatttttgcctgttctgttaata

SEQ ID NO: 35701 - DNA, 25 bp, S. cerevisiae
gagttgatttgccacaatacgttga

SEQ ID NO: 35702 - DNA, 25 bp, S. cerevisiae
gagacgattcgtactgctttcaagg

SEQ ID NO: 35703 - DNA, 25 bp, S. cerevisiae
gagacagattccacacttcaacaac

SEQ ID NO: 35704 - DNA, 25 bp, S. cerevisiae
gagacagatgttgtacagccaccaa

SEQ ID NO: 35705 - DNA, 25 bp, S. cerevisiae
gagagtacttcatatcaccacgaca

SEQ ID NO: 35706 - DNA, 25 bp, S. cerevisiae
gagagcttcatacgcatgccaaagg

SEQ ID NO: 35707 - DNA, 25 bp, S. cerevisiae
gagatgtctcttagcataccaaagg

SEQ ID NO: 35708 - DNA, 25 bp, S. cerevisiae
gagactgttcgcgtagaatgacaat

SEQ ID NO: 35709 - DNA, 25 bp, S. cerevisiae
gagacgttccgtttagtgcaatata

SEQ ID NO: 35710 - DNA, 25 bp, S. cerevisiae
gagatcgttcctagcgtaaaagcca

SEQ ID NO: 35711 - DNA, 25 bp, S. cerevisiae
gagaggtttccaccataccaaggac

SEQ ID NO: 35712 - DNA, 25 bp, S. cerevisiae
gagagcttcaaacgaatttacagga

SEQ ID NO: 35713 - DNA, 25 bp, S. cerevisiae
gagagcttcatgtcgggatctcaat

SEQ ID NO: 35714 - DNA, 25 bp, S. cerevisiae
gagactatttcaggctcggcagtta

SEQ ID NO: 35715 - DNA, 25 bp, S. cerevisiae
gagagccagttaagcgcgaagacta

SEQ ID NO: 35716 - DNA, 25 bp, S. cerevisiae
gagagaagttctacgcagagctagc

SEQ ID NO: 35717 - DNA, 25 bp, S. cerevisiae
gagaggagcttcttccagggaaact

SEQ ID NO: 35718 - DNA, 25 bp, S. cerevisiae
gagttgttaaccaccttatggagtt

SEQ ID NO: 35719 - DNA, 25 bp, S. cerevisiae
gagacgttcaatgctacagtaagag

SEQ ID NO: 35720 - DNA, 25 bp, S. cerevisiae
gagacatttcaagtgctcacaccaa

SEQ ID NO: 35721 - DNA, 25 bp, S. cerevisiae
gagacttccaattgtcaccagacgg

SEQ ID NO: 35722 - DNA, 25 bp, S. cerevisiae
gataagtccagatgtacacccagca

SEQ ID NO: 35723 - DNA, 25 bp, S. cerevisiae
gagagatgctcacggtgttacccaa

SEQ ID NO: 35724 - DNA, 25 bp, S. cerevisiae
gagatcacacacaaggtctactttg

SEQ ID NO: 35725 - DNA, 25 bp, S. cerevisiae
gagtcgcaatgcagcgatcgcactt

SEQ ID NO: 35726 - DNA, 25 bp, S. cerevisiae
gagagtccgacttgaaggcagatca

SEQ ID NO: 35727 - DNA, 25 bp, S. cerevisiae
gagagctacagcgttgcatcctaag

SEQ ID NO: 35728 - DNA, 25 bp, S. cerevisiae
gagtatgagcaacctgacgcaaata

SEQ ID NO: 35729 - DNA, 25 bp, S. cerevisiae
gagatatcacgatctgctgcgatga

SEQ ID NO: 35730 - DNA, 25 bp, S. cerevisiae
gagatctcaagttttcgcacaggaa

SEQ ID NO: 35731 - DNA, 25 bp, S. cerevisiae
gagactgacagttatacccaagaaa

SEQ ID NO: 35732 - DNA, 25 bp, S. cerevisiae
gagactggcgtgtataaaccaccaa

SEQ ID NO: 35733 - DNA, 25 bp, S. cerevisiae
gatgataaggctaaagtccctcctc

SEQ ID NO: 35734 - DNA, 25 bp, S. cerevisiae
gagatcctcgtaaattccagcatca

SEQ ID NO: 35735 - DNA, 25 bp, S. cerevisiae
gagacgtcaacaaattccattgcat

SEQ ID NO: 35736 - DNA, 25 bp, S. cerevisiae
gagacgcctctagcttgacgctgga

SEQ ID NO: 35737 - DNA, 25 bp, S. cerevisiae
gagaggtccaagaaactccagagaa

SEQ ID NO: 35738 - DNA, 25 bp, S. cerevisiae
gagagttgccaaagtgacccagtta

SEQ ID NO: 35739 - DNA, 25 bp, S. cerevisiae
gagatcagacactaaggaaccttta

SEQ ID NO: 35740 - DNA, 25 bp, S. cerevisiae
gagatggaactgtcttttattttaa

SEQ ID NO: 35741 - DNA, 25 bp, S. cerevisiae
gagagccaggcttcttttagattta

SEQ ID NO: 35742 - DNA, 25 bp, S. cerevisiae
gagaaattgctacctttaactctac

SEQ ID NO: 35743 - DNA, 25 bp, S. cerevisiae
gagtacgagaacctttcaaccacga

SEQ ID NO: 35744 - DNA, 25 bp, S. cerevisiae
gagagtcgggccatctgaacagaat

SEQ ID NO: 35745 - DNA, 25 bp, S. cerevisiae
gagaggctgaaaagcttgagaagtt

SEQ ID NO: 35746 - DNA, 25 bp, S. cerevisiae
gagactgtctattttggaagcgcta

SEQ ID NO: 35747 - DNA, 25 bp, S. cerevisiae
gagattgccgaagttggtcctagat

SEQ ID NO: 35748 - DNA, 25 bp, S. cerevisiae
gagactcaagattatctggcccttt

SEQ ID NO: 35749 - DNA, 25 bp, S. cerevisiae
gagagtcgactgcaatgtcccttat

SEQ ID NO: 35750 - DNA, 25 bp, S. cerevisiae
gagagctgctttcaactaccaattt

SEQ ID NO: 35751 - DNA, 25 bp, S. cerevisiae
gagactttgggatgcgtcaacacat

SEQ ID NO: 35752 - DNA, 25 bp, S. cerevisiae
gaggcgttttacactctagcacgtt

SEQ ID NO: 35753 - DNA, 25 bp, S. cerevisiae
gagaggttgtgttcttctgaagcgc

SEQ ID NO: 35754 - DNA, 25 bp, S. cerevisiae
gagatacttctttgtccgaatcctc

SEQ ID NO: 35755 - DNA, 25 bp, S. cerevisiae
gagatgagtttcagccccaatggta

SEQ ID NO: 35756 - DNA, 25 bp, S. cerevisiae
gagacatatgttccaaaccgtacgg

SEQ ID NO: 35757 - DNA, 25 bp, S. cerevisiae
gagtcgattctggaaagctttccgg

SEQ ID NO: 35758 - DNA, 25 bp, S. cerevisiae
gagatcgttcaagagcctttactga

SEQ ID NO: 35759 - DNA, 25 bp, S. cerevisiae
gagagacttcaagggtctgccaccc

SEQ ID NO: 35760 - DNA, 25 bp, S. cerevisiae
gagagacgtcaagcggaatcaccaa

SEQ ID NO: 35761 - DNA, 25 bp, S. cerevisiae
gagagactgcaatccacgaacccga

SEQ ID NO: 35762 - DNA, 25 bp, S. cerevisiae
gagagactctaaaaccgatcccttg

SEQ ID NO: 35763 - DNA, 25 bp, S. cerevisiae
gagagccctgataaagtcgacctta

SEQ ID NO: 35764 - DNA, 25 bp, S. cerevisiae
gagagcctttaagttatgacccctt

SEQ ID NO: 35765 - DNA, 25 bp, S. cerevisiae
gagactgtttaaggacgagcccaaa

SEQ ID NO: 35766 - DNA, 25 bp, S. cerevisiae
gagagtaactcaggcgcaaacccaa

SEQ ID NO: 35767 - DNA, 25 bp, S. cerevisiae
gagactcaactctatcgatcatgac

SEQ ID NO: 35768 - DNA, 25 bp, S. cerevisiae
gagacatacattgcatctgccagtt

SEQ ID NO: 35769 - DNA, 25 bp, S. cerevisiae
gagatcaacttcctctgtggattgt

SEQ ID NO: 35770 - DNA, 25 bp, S. cerevisiae
gagactatttcttgcattggtatta

SEQ ID NO: 35771 - DNA, 25 bp, S. cerevisiae
gagactatctgcagaattgcgctct

SEQ ID NO: 35772 - DNA, 25 bp, S. cerevisiae
gagagcttcatgagattctgcgaca

SEQ ID NO: 35773 - DNA, 25 bp, S. cerevisiae
gagagttggcgtttccagtgaacaa

SEQ ID NO: 35774 - DNA, 25 bp, S. cerevisiae
gagaggtgtcacttatccacataga

SEQ ID NO: 35775 - DNA, 25 bp, S. cerevisiae
gagactgagatactttcagccatag

SEQ ID NO: 35776 - DNA, 25 bp, S. cerevisiae
gagagctggtgaattgacccaagaa

SEQ ID NO: 35777 - DNA, 25 bp, S. cerevisiae
gagacgatgttgatatcccaatgga

SEQ ID NO: 35778 - DNA, 25 bp, S. cerevisiae
gagagacagttgataccaatttaca

SEQ ID NO: 35779 - DNA, 25 bp, S. cerevisiae
gagagattgtcttatccatcgtcct

SEQ ID NO: 35780 - DNA, 25 bp, S. cerevisiae
gagagttctcaattcctcgacgtgt

SEQ ID NO: 35781 - DNA, 25 bp, S. cerevisiae
gagagttgcacacacttaccgatcg

SEQ ID NO: 35782 - DNA, 25 bp, S. cerevisiae
gagactcaaagatgctgtaccgttc

SEQ ID NO: 35783 - DNA, 25 bp, S. cerevisiae
gagacggtattactgagggccataa

SEQ ID NO: 35784 - DNA, 25 bp, S. cerevisiae
gagactcagcatattgttggacgta

SEQ ID NO: 35785 - DNA, 25 bp, S. cerevisiae
gagacgcgctcgacgttagacgaac

SEQ ID NO: 35786 - DNA, 25 bp, S. cerevisiae
gagacgcctctgaagctgttaattc

SEQ ID NO: 35787 - DNA, 25 bp, S. cerevisiae
gagagcagcccatcacagattacat

SEQ ID NO: 35788 - DNA, 25 bp, S. cerevisiae
gagagcatgggactcacccaacttt

SEQ ID NO: 35789 - DNA, 25 bp, S. cerevisiae
gagacgagatcgttcttacctgcct

SEQ ID NO: 35790 - DNA, 25 bp, S. cerevisiae
gagacgtactgttcactatctgtgc

SEQ ID NO: 35791 - DNA, 25 bp, S. cerevisiae
gagacttgatctccaacatatctat

SEQ ID NO: 35792 - DNA, 25 bp, S. cerevisiae
gattttaaagattccccactcggct

SEQ ID NO: 35793 - DNA, 25 bp, S. cerevisiae
gagatacttcaactatatgccttcg

SEQ ID NO: 35794 - DNA, 25 bp, S. cerevisiae
gagtacgttacctacgctttgtccg

SEQ ID NO: 35795 - DNA, 25 bp, S. cerevisiae
gagtacaaaccacagcgttggccac

SEQ ID NO: 35796 - DNA, 25 bp, S. cerevisiae
gagtctcgaaaacaccattgggtca

SEQ ID NO: 35797 - DNA, 25 bp, S. cerevisiae
gatgtatcctagcaaaggacccctt

SEQ ID NO: 35798 - DNA, 25 bp, S. cerevisiae
gagttccttggagaagatcttcccg

SEQ ID NO: 35799 - DNA, 25 bp, S. cerevisiae
gagttcgagactaaagaccttgcag

SEQ ID NO: 35800 - DNA, 25 bp, S. cerevisiae
gagactgccaattcgcactctaaga

SEQ ID NO: 35801 - DNA, 25 bp, S. cerevisiae
gagatcagcatctattgtagcggat

SEQ ID NO: 35802 - DNA, 25 bp, S. cerevisiae
gagttcatgaatgttgtcatcgatg

SEQ ID NO: 35803 - DNA, 25 bp, S. cerevisiae
gagatcgaaatcctttcccatggaa

SEQ ID NO: 35804 - DNA, 25 bp, S. cerevisiae
gagacgtgcctatttgtttcatatt

SEQ ID NO: 35805 - DNA, 25 bp, S. cerevisiae
gagactcccctgctgtattgaaaga

SEQ ID NO: 35806 - DNA, 25 bp, S. cerevisiae
gagactcccaaggtgatcatctaca

SEQ ID NO: 35807 - DNA, 25 bp, S. cerevisiae
gagacctccacaggctggtgacaga

SEQ ID NO: 35808 - DNA, 25 bp, S. cerevisiae
gagagttcgcatgcaaactgctata

SEQ ID NO: 35809 - DNA, 25 bp, S. cerevisiae
gagagatccatgtcctatagtcata

SEQ ID NO: 35810 - DNA, 25 bp, S. cerevisiae
gagagttgctattatcgtttacgac

SEQ ID NO: 35811 - DNA, 25 bp, S. cerevisiae
gagagcgtcgatttcctttacaagg

SEQ ID NO: 35812 - DNA, 25 bp, S. cerevisiae
gagatcattcgtgcactttaacgag

SEQ ID NO: 35813 - DNA, 25 bp, S. cerevisiae
gagatctgcaacgtttgcctattcc

SEQ ID NO: 35814 - DNA, 25 bp, S. cerevisiae
gagatcatccattgtgtctgaaagc

SEQ ID NO: 35815 - DNA, 25 bp, S. cerevisiae
gagatatctcatttccctgaagcag

SEQ ID NO: 35816 - DNA, 25 bp, S. cerevisiae
gagagttctactgctgctaggcgac

SEQ ID NO: 35817 - DNA, 25 bp, S. cerevisiae
gagagtatatgatcgccgtctcgat

SEQ ID NO: 35818 - DNA, 25 bp, S. cerevisiae
gagttgagaaagtcaaaccctgggt

SEQ ID NO: 35819 - DNA, 25 bp, S. cerevisiae
ttttgagttgcacacaaacactggg

SEQ ID NO: 35820 - DNA, 25 bp, S. cerevisiae
tgattcggttgtcaattcgcacgcg

SEQ ID NO: 35821 - DNA, 25 bp, S. cerevisiae
gattcggatattcataacgctacgc

SEQ ID NO: 35822 - DNA, 25 bp, S. cerevisiae
gatgtcgaaactgaacgatctccag

SEQ ID NO: 35823 - DNA, 25 bp, S. cerevisiae
gagggacaaacatacgcttcacgaa

SEQ ID NO: 35824 - DNA, 25 bp, S. cerevisiae
gagggaactttcaccattatgggaa

SEQ ID NO: 35825 - DNA, 25 bp, S. cerevisiae
gagggaactcttgcgtttatagtaa

SEQ ID NO: 35826 - DNA, 25 bp, S. cerevisiae
gatggaaccatctgccgactttact

SEQ ID NO: 35827 - DNA, 25 bp, S. cerevisiae
gagttatgcaaactgctgccttttc

SEQ ID NO: 35828 - DNA, 25 bp, S. cerevisiae
gagttcatcaaacgtgttggattgc

SEQ ID NO: 35829 - DNA, 25 bp, S. cerevisiae
gagagcttgttcagtatttaccagt

SEQ ID NO: 35830 - DNA, 25 bp, S. cerevisiae
gagacctttggcgtttactctaaga

SEQ ID NO: 35831 - DNA, 25 bp, S. cerevisiae
gagagccttggttgaacacatcatc

SEQ ID NO: 35832 - DNA, 25 bp, S. cerevisiae
gagagctttggttgaacacattatt

SEQ ID NO: 35833 - DNA, 25 bp, S. cerevisiae
gagagttatcgctgaagcacgttta

SEQ ID NO: 35834 - DNA, 25 bp, S. cerevisiae
gagagtcatgacttggagccacgtt

SEQ ID NO: 35835 - DNA, 25 bp, S. cerevisiae
gagataaacttaccaccagttggca

SEQ ID NO: 35836 - DNA, 25 bp, S. cerevisiae
gagttagccgctagtactactggtg

SEQ ID NO: 35837 - DNA, 25 bp, S. cerevisiae
gagtcaaggcggacatacttcgtga

SEQ ID NO: 35838 - DNA, 25 bp, S. cerevisiae
gagagagttgcccaatctttgattg

SEQ ID NO: 35839 - DNA, 25 bp, S. cerevisiae
gagagtgccatcgaagtctgttcat

SEQ ID NO: 35840 - DNA, 25 bp, S. cerevisiae
ggttcattgagctccggaaatcgca

SEQ ID NO: 35841 - DNA, 25 bp, S. cerevisiae
gagttatggactccttggaaccaca

SEQ ID NO: 35842 - DNA, 25 bp, S. cerevisiae
gagttcatgcgtggtcgatgcgaaa

SEQ ID NO: 35843 - DNA, 25 bp, S. cerevisiae
gagtttcaccccaacgataaggctg

SEQ ID NO: 35844 - DNA, 25 bp, S. cerevisiae
gagatcgtcaaaaaaggtccacctg

SEQ ID NO: 35845 - DNA, 25 bp, S. cerevisiae
gagaccataaaagttgttgcccgca

SEQ ID NO: 35846 - DNA, 25 bp, S. cerevisiae
gagaccaaattagctgttcctgaag

SEQ ID NO: 35847 - DNA, 25 bp, S. cerevisiae
gagattccaattatctagctacaga

SEQ ID NO: 35848 - DNA, 25 bp, S. cerevisiae
gagagtcctcaccagtctcacaaaa

SEQ ID NO: 35849 - DNA, 25 bp, S. cerevisiae
gagagactgttcacatgcctgagga

SEQ ID NO: 35850 - DNA, 25 bp, S. cerevisiae
gagatgaattaagtcggctgcgtaa

SEQ ID NO: 35851 - DNA, 25 bp, S. cerevisiae
gagagctttactgaatgtcgccaaa

SEQ ID NO: 35852 - DNA, 25 bp, S. cerevisiae
gagagacattccattattcagcaaa

SEQ ID NO: 35853 - DNA, 25 bp, S. cerevisiae
gagagccctatgattcatggcaaat

SEQ ID NO: 35854 - DNA, 25 bp, S. cerevisiae
gagagccctgagttatccactacat

SEQ ID NO: 35855 - DNA, 25 bp, S. cerevisiae
gagagcttatcgtctttcaagaggg

SEQ ID NO: 35856 - DNA, 25 bp, S. cerevisiae
gagacctatcgccatcttcaaatag

SEQ ID NO: 35857 - DNA, 25 bp, S. cerevisiae
gagatgccaacgctcttgtgaataa

SEQ ID NO: 35858 - DNA, 25 bp, S. cerevisiae
gagagagcagaccatcaagagaatc

SEQ ID NO: 35859 - DNA, 25 bp, S. cerevisiae
gagatgactggccaacagcagaaga

SEQ ID NO: 35860 - DNA, 25 bp, S. cerevisiae
gagtcactgaggaagccgaagcatt

SEQ ID NO: 35861 - DNA, 25 bp, S. cerevisiae
gagtcactgttaagcactttgcctg

SEQ ID NO: 35862 - DNA, 25 bp, S. cerevisiae
gagtattttgaaccgttgcgtaccg

SEQ ID NO: 35863 - DNA, 25 bp, S. cerevisiae
gagatgttttgatgccgtttgtgaa

SEQ ID NO: 35864 - DNA, 25 bp, S. cerevisiae
gagattgaacttgagagttgaacac

SEQ ID NO: 35865 - DNA, 25 bp, S. cerevisiae
gagatgctacacaatttggtcgatg

SEQ ID NO: 35866 - DNA, 25 bp, S. cerevisiae
gagagctgatgtacatttcctggat

SEQ ID NO: 35867 - DNA, 25 bp, S. cerevisiae
gagagcttgatgatgctccctcagt

SEQ ID NO: 35868 - DNA, 25 bp, S. cerevisiae
gagatcaagatcatcctcacctgtg

SEQ ID NO: 35869 - DNA, 25 bp, S. cerevisiae
gagatcataagagttggaccgcaag

SEQ ID NO: 35870 - DNA, 25 bp, S. cerevisiae
gagattgcccatttgatgacccagg

SEQ ID NO: 35871 - DNA, 25 bp, S. cerevisiae
gagatctgcgtatttagccgccgtg

SEQ ID NO: 35872 - DNA, 25 bp, S. cerevisiae
gagtcggctactaagcccaacataa

SEQ ID NO: 35873 - DNA, 25 bp, S. cerevisiae
gagtatggcctttgcgttaagacta

SEQ ID NO: 35874 - DNA, 25 bp, S. cerevisiae
gagttaatcgttcctatattccaat

SEQ ID NO: 35875 - DNA, 25 bp, S. cerevisiae
gagagcagtacttcaccttacgata

SEQ ID NO: 35876 - DNA, 25 bp, S. cerevisiae
gagtacaactgtcccggttgtgcaa

SEQ ID NO: 35877 - DNA, 25 bp, S. cerevisiae
gagttgatacaattcgggttcctac

SEQ ID NO: 35878 - DNA, 25 bp, S. cerevisiae
gagagtctcacttattgagcgcttt

SEQ ID NO: 35879 - DNA, 25 bp, S. cerevisiae
gagagacgccttagaagcccttgat

SEQ ID NO: 35880 - DNA, 25 bp, S. cerevisiae
gagatggcgcctttatggaacttct

SEQ ID NO: 35881 - DNA, 25 bp, S. cerevisiae
gagagggactttgatgtgacatacg

SEQ ID NO: 35882 - DNA, 25 bp, S. cerevisiae
gagagcgtggcaattcttaaccagg

SEQ ID NO: 35883 - DNA, 25 bp, S. cerevisiae
gatatcctagcatcgttaaccgctc

SEQ ID NO: 35884 - DNA, 25 bp, S. cerevisiae
gagacctactatcaagaatccgctg

SEQ ID NO: 35885 - DNA, 25 bp, S. cerevisiae
gagaccatctcattcggagaaccgt

SEQ ID NO: 35886 - DNA, 25 bp, S. cerevisiae
gagagctcacaattcggaaaacgat

SEQ ID NO: 35887 - DNA, 25 bp, S. cerevisiae
gagagccacgtaatgactaccagga

SEQ ID NO: 35888 - DNA, 25 bp, S. cerevisiae
gagatccacgaatactaccacaggt

SEQ ID NO: 35889 - DNA, 25 bp, S. cerevisiae
gagagccaagaagaccagagctttg

SEQ ID NO: 35890 - DNA, 25 bp, S. cerevisiae
gagagccacaaggaactagacttac

SEQ ID NO: 35891 - DNA, 25 bp, S. cerevisiae
gagagcaccaacgatcatctcatgc

SEQ ID NO: 35892 - DNA, 25 bp, S. cerevisiae
gagagcatctcatggtacatctatt

SEQ ID NO: 35893 - DNA, 25 bp, S. cerevisiae
gaggcttacggttcagtcattttct

SEQ ID NO: 35894 - DNA, 25 bp, S. cerevisiae
gagattctgtctcaacaacttcctc

SEQ ID NO: 35895 - DNA, 25 bp, S. cerevisiae
gagagacggtagacatcacacttat

SEQ ID NO: 35896 - DNA, 25 bp, S. cerevisiae
gagttagggctaccaagattctcta

SEQ ID NO: 35897 - DNA, 25 bp, S. cerevisiae
gagatttggcaccacgagcggttta

SEQ ID NO: 35898 - DNA, 25 bp, S. cerevisiae
gagagttgtcaccaaggccatgtct

SEQ ID NO: 35899 - DNA, 25 bp, S. cerevisiae
gagatgctcttttcaaactcatgtc

SEQ ID NO: 35900 - DNA, 25 bp, S. cerevisiae
gagattctgtataaatattgcaaac

SEQ ID NO: 35901 - DNA, 25 bp, S. cerevisiae
gagagattggtcaccactgacccca

SEQ ID NO: 35902 - DNA, 25 bp, S. cerevisiae
gagagttggagcacacggttcctca

SEQ ID NO: 35903 - DNA, 25 bp, S. cerevisiae
gagtacttcaggagcgctaatttcg

SEQ ID NO: 35904 - DNA, 25 bp, S. cerevisiae
gagatagctcctcctggagacttat

SEQ ID NO: 35905 - DNA, 25 bp, S. cerevisiae
gagaggtccactcaaacttcagacg

SEQ ID NO: 35906 - DNA, 25 bp, S. cerevisiae
gagaggctaccattaaacaacgaca

SEQ ID NO: 35907 - DNA, 25 bp, S. cerevisiae
gagagcctaccgcaagtgaacaatc

SEQ ID NO: 35908 - DNA, 25 bp, S. cerevisiae
gagagtcgcctcatatatggaaaat

SEQ ID NO: 35909 - DNA, 25 bp, S. cerevisiae
gagagatgccctttcaatggtcaaa

SEQ ID NO: 35910 - DNA, 25 bp, S. cerevisiae
gagagatcccgaacaattttcagaa

SEQ ID NO: 35911 - DNA, 25 bp, S. cerevisiae
gagagtccaagtccaattttcatat

SEQ ID NO: 35912 - DNA, 25 bp, S. cerevisiae
gagtccggagatttaccattcagaa

SEQ ID NO: 35913 - DNA, 25 bp, S. cerevisiae
gagatccgtaacttattcacacaaa

SEQ ID NO: 35914 - DNA, 25 bp, S. cerevisiae
gagtcacgtagtttttcaactttgt

SEQ ID NO: 35915 - DNA, 25 bp, S. cerevisiae
tgaatacggcgtgtttaaccttatt

SEQ ID NO: 35916 - DNA, 25 bp, S. cerevisiae
gagtaccggtgagttttaccagatt

SEQ ID NO: 35917 - DNA, 25 bp, S. cerevisiae
gagattccggatgagttacagccaa

SEQ ID NO: 35918 - DNA, 25 bp, S. cerevisiae
gatgtcaccggtaaggctcacgaaa

SEQ ID NO: 35919 - DNA, 25 bp, S. cerevisiae
gagagactgtttagcgagaatccaa

SEQ ID NO: 35920 - DNA, 25 bp, S. cerevisiae
gagatcaatttccacgacaacaaag

SEQ ID NO: 35921 - DNA, 25 bp, S. cerevisiae
gagagatctccttacgaaccaatag

SEQ ID NO: 35922 - DNA, 25 bp, S. cerevisiae
gagagtggcttgtcacgtaaccata

SEQ ID NO: 35923 - DNA, 25 bp, S. cerevisiae
gagatctggctttgccgttgaacaa

SEQ ID NO: 35924 - DNA, 25 bp, S. cerevisiae
gagtttgctgcgtcacaggtagtaa

SEQ ID NO: 35925 - DNA, 25 bp, S. cerevisiae
gagattctgcgccagcaagtcgtct

SEQ ID NO: 35926 - DNA, 25 bp, S. cerevisiae
gagttcccgcagaagtcgttaagca

SEQ ID NO: 35927 - DNA, 25 bp, S. cerevisiae
gagagtcctccgaaatctgttaaca

SEQ ID NO: 35928 - DNA, 25 bp, S. cerevisiae
gagttcgcgattccaacgattccaa

SEQ ID NO: 35929 - DNA, 25 bp, S. cerevisiae
gagattgcccttttagacttggact

SEQ ID NO: 35930 - DNA, 25 bp, S. cerevisiae
gagatctcgccttcgtaatatgctg

SEQ ID NO: 35931 - DNA, 25 bp, S. cerevisiae
gagagtcctcaaacgcagaatctga

SEQ ID NO: 35932 - DNA, 25 bp, S. cerevisiae
gagagttgccaaaccaattgctgtg

SEQ ID NO: 35933 - DNA, 25 bp, S. cerevisiae
gagatctacctgcatagagttggtc

SEQ ID NO: 35934 - DNA, 25 bp, S. cerevisiae
gagttgcccgaaacagactgtgatc

SEQ ID NO: 35935 - DNA, 25 bp, S. cerevisiae
gagtgatggcacacccagcgtgcgt

SEQ ID NO: 35936 - DNA, 25 bp, S. cerevisiae
gagattgcaagactacggattccat

SEQ ID NO: 35937 - DNA, 25 bp, S. cerevisiae
gagattcaaagattcctgtgctagt

SEQ ID NO: 35938 - DNA, 25 bp, S. cerevisiae
gagatacaacgttcctgtgctaagt

SEQ ID NO: 35939 - DNA, 25 bp, S. cerevisiae
gagatcaacccatacttatctgaat

SEQ ID NO: 35940 - DNA, 25 bp, S. cerevisiae
gagatggacgcctcatttgattgat

SEQ ID NO: 35941 - DNA, 25 bp, S. cerevisiae
gagattggcgacttgaatttcttca

SEQ ID NO: 35942 - DNA, 25 bp, S. cerevisiae
gagaggaaacctccatttagccacc

SEQ ID NO: 35943 - DNA, 25 bp, S. cerevisiae
gagatcccagaagtttttgactctt

SEQ ID NO: 35944 - DNA, 25 bp, S. cerevisiae
gagtctgccaaatttaccaacgtta

SEQ ID NO: 35945 - DNA, 25 bp, S. cerevisiae
ggcctaaattcgaatggcagggttt

SEQ ID NO: 35946 - DNA, 25 bp, S. cerevisiae
gggctaatacccaataaggcggcta

SEQ ID NO: 35947 - DNA, 25 bp, S. cerevisiae
gagttattccccaaaagagctgctg

SEQ ID NO: 35948 - DNA, 25 bp, S. cerevisiae
gagagtatgctggtatccctgaaaa

SEQ ID NO: 35949 - DNA, 25 bp, S. cerevisiae
gagagattttattgcgcttgatgaa

SEQ ID NO: 35950 - DNA, 25 bp, S. cerevisiae
gagatgctgctcttgtcgatcatgg

SEQ ID NO: 35951 - DNA, 25 bp, S. cerevisiae
gagatgcccagaagtatcagtttga

SEQ ID NO: 35952 - DNA, 25 bp, S. cerevisiae
gagatttccaccatttttcaacgaa

SEQ ID NO: 35953 - DNA, 25 bp, S. cerevisiae
gagtttccgtttctctttcagagca

SEQ ID NO: 35954 - DNA, 25 bp, S. cerevisiae
gaggaatccatgctttaccttcaaa

SEQ ID NO: 35955 - DNA, 25 bp, S. cerevisiae
gagaggatactcctttatcccaaaa

SEQ ID NO: 35956 - DNA, 25 bp, S. cerevisiae
gagataattcttcttaccgcgacaa

SEQ ID NO: 35957 - DNA, 25 bp, S. cerevisiae
gagaggtttgctattggtaccataa

SEQ ID NO: 35958 - DNA, 25 bp, S. cerevisiae
gagagagcctctaaatctggaagat

SEQ ID NO: 35959 - DNA, 25 bp, S. cerevisiae
gagagatttctctaacgcggcgatc

SEQ ID NO: 35960 - DNA, 25 bp, S. cerevisiae
gagagatattgttttcgccgcaagt

SEQ ID NO: 35961 - DNA, 25 bp, S. cerevisiae
gagttacagctattatcccagaagt

SEQ ID NO: 35962 - DNA, 25 bp, S. cerevisiae
gagttacagatacattacatcgtct

SEQ ID NO: 35963 - DNA, 25 bp, S. cerevisiae
gagttgtcagataccttcaaggacc

SEQ ID NO: 35964 - DNA, 25 bp, S. cerevisiae
gagagttttgcttgcaagcctggaa

SEQ ID NO: 35965 - DNA, 25 bp, S. cerevisiae
gagttgtagcattatctccggcttt

SEQ ID NO: 35966 - DNA, 25 bp, S. cerevisiae
gagttccactcagggtatgcaattg

SEQ ID NO: 35967 - DNA, 25 bp, S. cerevisiae
gagattgcctcattcaggttgtatt

SEQ ID NO: 35968 - DNA, 25 bp, S. cerevisiae
gagattacatcttgcagtctgctga

SEQ ID NO: 35969 - DNA, 25 bp, S. cerevisiae
gagattagctgcttaccatgctcaa

SEQ ID NO: 35970 - DNA, 25 bp, S. cerevisiae
gagatcaatctcaatacagcagtag

SEQ ID NO: 35971 - DNA, 25 bp, S. cerevisiae
gagatctctgattacgagttggacg

SEQ ID NO: 35972 - DNA, 25 bp, S. cerevisiae
gagatcttatggtggcggtcaccca

SEQ ID NO: 35973 - DNA, 25 bp, S. cerevisiae
gagttatttgccgacgttccagtca

SEQ ID NO: 35974 - DNA, 25 bp, S. cerevisiae
gagttgtttcgtcagattctttgga

SEQ ID NO: 35975 - DNA, 25 bp, S. cerevisiae
gagtttcccctctcattttgggagg

SEQ ID NO: 35976 - DNA, 25 bp, S. cerevisiae
gagtttcctaccatcttttatctta

SEQ ID NO: 35977 - DNA, 25 bp, S. cerevisiae
gagattttttggatcgttgcttgct

SEQ ID NO: 35978 - DNA, 25 bp, S. cerevisiae
gagatttattagcactctgtatcga

SEQ ID NO: 35979 - DNA, 25 bp, S. cerevisiae
gagagtttctaccacttatccgaag

SEQ ID NO: 35980 - DNA, 25 bp, S. cerevisiae
gagaggttctgcagctattgtccca

SEQ ID NO: 35981 - DNA, 25 bp, S. cerevisiae
gagagttcttctagggatgcccaat

SEQ ID NO: 35982 - DNA, 25 bp, S. cerevisiae
gagattattttacggagtgcagcta

SEQ ID NO: 35983 - DNA, 25 bp, S. cerevisiae
gagatttgctcttgcgggatgtcac

SEQ ID NO: 35984 - DNA, 25 bp, S. cerevisiae
gagatttccatcttgctaaacgtta

SEQ ID NO: 35985 - DNA, 25 bp, S. cerevisiae
gagttgttcctggttatggccatgc

SEQ ID NO: 35986 - DNA, 25 bp, S. cerevisiae
gagatgctgttcctgagttactaat

SEQ ID NO: 35987 - DNA, 25 bp, S. cerevisiae
gagatcagattgctcttcatacaag

SEQ ID NO: 35988 - DNA, 25 bp, S. cerevisiae
gagatatctgtccattccaacaaga

SEQ ID NO: 35989 - DNA, 25 bp, S. cerevisiae
gagatatctttattggcagcgacga

SEQ ID NO: 35990 - DNA, 25 bp, S. cerevisiae
gagtaatggtgctttcgatgacgaa

SEQ ID NO: 35991 - DNA, 25 bp, S. cerevisiae
gagtagtgaacgttcgtacgatctt

SEQ ID NO: 35992 - DNA, 25 bp, S. cerevisiae
gagtttgagctccattcctaagtct

SEQ ID NO: 35993 - DNA, 25 bp, S. cerevisiae
gagttgacgcacttactcgatcctg

SEQ ID NO: 35994 - DNA, 25 bp, S. cerevisiae
gagttggtgggtttcactgagtcaa

SEQ ID NO: 35995 - DNA, 25 bp, S. cerevisiae
gagattgttgcgttttccgatgccg

SEQ ID NO: 35996 - DNA, 25 bp, S. cerevisiae
gagagtgcttactttttccaactac

SEQ ID NO: 35997 - DNA, 25 bp, S. cerevisiae
gagttgcttagggtttccagacgaa

SEQ ID NO: 35998 - DNA, 25 bp, S. cerevisiae
gagttctgataacgaatcacctgaa

SEQ ID NO: 35999 - DNA, 25 bp, S. cerevisiae
gagatttggatatctcttcctccac

SEQ ID NO: 36000 - DNA, 25 bp, S. cerevisiae
gagatatctccagtgtgacctggca

SEQ ID NO: 36001 - DNA, 25 bp, S. cerevisiae
gagtcattctaattgcaccagggct

SEQ ID NO: 36002 - DNA, 25 bp, S. cerevisiae
gagttagtgcaaccaaagggcccct

SEQ ID NO: 36003 - DNA, 25 bp, S. cerevisiae
gagttttcaacggaggaagtacctg

SEQ ID NO: 36004 - DNA, 25 bp, S. cerevisiae
gagttttctcaagtcgcaaagtaca

SEQ ID NO: 36005 - DNA, 25 bp, S. cerevisiae
gagagtttccaagcagcaatcaagg

SEQ ID NO: 36006 - DNA, 25 bp, S. cerevisiae
gagatgctttggaagcctgtcataa

SEQ ID NO: 36007 - DNA, 25 bp, S. cerevisiae
gagatggcattctcctatgctagat

SEQ ID NO: 36008 - DNA, 25 bp, S. cerevisiae
gagaggacccatggaatgctatcat

SEQ ID NO: 36009 - DNA, 25 bp, S. cerevisiae
gagaggatcttgcacaactatctat

SEQ ID NO: 36010 - DNA, 25 bp, S. cerevisiae
gagatgatcccgcattttcttgaaa

SEQ ID NO: 36011 - DNA, 25 bp, S. cerevisiae
gagttgcacaagtttcctgatgaaa

SEQ ID NO: 36012 - DNA, 25 bp, S. cerevisiae
gagattcatcaactcattgctggag

SEQ ID NO: 36013 - DNA, 25 bp, S. cerevisiae
gagatcactgttgaccatggcgcaa

SEQ ID NO: 36014 - DNA, 25 bp, S. cerevisiae
gagaggttttgcttgtatcccatta

SEQ ID NO: 36015 - DNA, 25 bp, S. cerevisiae
gagaggtattaaatccactgctatg

SEQ ID NO: 36016 - DNA, 25 bp, S. cerevisiae
gagatcagcttctacgtcaaacttg

SEQ ID NO: 36017 - DNA, 25 bp, S. cerevisiae
gagatggttcctggtcaacctctga

SEQ ID NO: 36018 - DNA, 25 bp, S. cerevisiae
gagtttggcctgcttacaatctgaa

SEQ ID NO: 36019 - DNA, 25 bp, S. cerevisiae
gagattgtcccctattcgaattaga

SEQ ID NO: 36020 - DNA, 25 bp, S. cerevisiae
gagttttacacaatgacccttcaag

SEQ ID NO: 36021 - DNA, 25 bp, S. cerevisiae
gagatttctaattctgacctttaca

SEQ ID NO: 36022 - DNA, 25 bp, S. cerevisiae
gagattccatttccgcaccagtaaa

SEQ ID NO: 36023 - DNA, 25 bp, S. cerevisiae
gagttgtcattttggctagagctaa

SEQ ID NO: 36024 - DNA, 25 bp, S. cerevisiae
gagatcgcttctctattgaggctca

SEQ ID NO: 36025 - DNA, 25 bp, S. cerevisiae
gagttgcgtctacatcattattcgt

SEQ ID NO: 36026 - DNA, 25 bp, S. cerevisiae
gagttagcttccatgttcaagtcac

SEQ ID NO: 36027 - DNA, 25 bp, S. cerevisiae
gagatattgttcgttctgaaaatcc

SEQ ID NO: 36028 - DNA, 25 bp, S. cerevisiae
gagatatcccaaattgccccaatta

SEQ ID NO: 36029 - DNA, 25 bp, S. cerevisiae
gagtatactacaattgctaacttga

SEQ ID NO: 36030 - DNA, 25 bp, S. cerevisiae
gagatcatacttgactgttcttttg

SEQ ID NO: 36031 - DNA, 25 bp, S. cerevisiae
gagatgtcactagcaagttcctttg

SEQ ID NO: 36032 - DNA, 25 bp, S. cerevisiae
gagttgaaggccaagaccattgcaa

SEQ ID NO: 36033 - DNA, 25 bp, S. cerevisiae
gagttcgtgacgatactgccgcaat

SEQ ID NO: 36034 - DNA, 25 bp, S. cerevisiae
gagatctggtcacagaactgctcca

SEQ ID NO: 36035 - DNA, 25 bp, S. cerevisiae
gagatgggctcgtgatactcctaga

SEQ ID NO: 36036 - DNA, 25 bp, S. cerevisiae
gagatggttttgtccaccttagatt

SEQ ID NO: 36037 - DNA, 25 bp, S. cerevisiae
gatgaacctttaactacttacgtct

SEQ ID NO: 36038 - DNA, 25 bp, S. cerevisiae
gagatttccttcaatttttactgca

SEQ ID NO: 36039 - DNA, 25 bp, S. cerevisiae
gagtttcgactcttcatacgatacc

SEQ ID NO: 36040 - DNA, 25 bp, S. cerevisiae
gagattcgctactcgtacacctgta

SEQ ID NO: 36041 - DNA, 25 bp, S. cerevisiae
gagttggaaccagaacaccctgtat

SEQ ID NO: 36042 - DNA, 25 bp, S. cerevisiae
gagtctaaaaaggatagcccctcta

SEQ ID NO: 36043 - DNA, 25 bp, S. cerevisiae
gagattgaccgaaccaattgcccga

SEQ ID NO: 36044 - DNA, 25 bp, S. cerevisiae
gagttgacccaagaattcccattat

SEQ ID NO: 36045 - DNA, 25 bp, S. cerevisiae
gattaacccaaaggatccgcgctta

SEQ ID NO: 36046 - DNA, 25 bp, S. cerevisiae
gttcacacgccctgtaacgtttata

SEQ ID NO: 36047 - DNA, 25 bp, S. cerevisiae
gttgtcggtttcgtacgttgattct

SEQ ID NO: 36048 - DNA, 25 bp, S. cerevisiae
gagatttgctgcatcatcaccgatg

SEQ ID NO: 36049 - DNA, 25 bp, S. cerevisiae
gagatctgttcactctaacgaacga

SEQ ID NO: 36050 - DNA, 25 bp, S. cerevisiae
gagatctcatttcctaccgatattg

SEQ ID NO: 36051 - DNA, 25 bp, S. cerevisiae
gagattgcggcctttcgaattttta

SEQ ID NO: 36052 - DNA, 25 bp, S. cerevisiae
gagattacccatttcgcaattcgtt

SEQ ID NO: 36053 - DNA, 25 bp, S. cerevisiae
gagattcctcacaccaaatacttgt

SEQ ID NO: 36054 - DNA, 25 bp, S. cerevisiae
gagatccgaatatgcccaagaggcc

SEQ ID NO: 36055 - DNA, 25 bp, S. cerevisiae
gagatgacgatgatggagcttccag

SEQ ID NO: 36056 - DNA, 25 bp, S. cerevisiae
gagattctgatgacgtgcatcccca

SEQ ID NO: 36057 - DNA, 25 bp, S. cerevisiae
gagattctcatgaagctgctggccg

SEQ ID NO: 36058 - DNA, 25 bp, S. cerevisiae
gagatagtgcacttgccatggcgtc

SEQ ID NO: 36059 - DNA, 25 bp, S. cerevisiae
gagatgcagctgactattcgctcga

SEQ ID NO: 36060 - DNA, 25 bp, S. cerevisiae
gagttggtatcaggctctccagcga

SEQ ID NO: 36061 - DNA, 25 bp, S. cerevisiae
gagattaccataccattctttgagg

SEQ ID NO: 36062 - DNA, 25 bp, S. cerevisiae
gagattgaccaattccataatctgg

SEQ ID NO: 36063 - DNA, 25 bp, S. cerevisiae
gagttgattcagttgctcatccagc

SEQ ID NO: 36064 - DNA, 25 bp, S. cerevisiae
gagttgatactgttccataagctac

SEQ ID NO: 36065 - DNA, 25 bp, S. cerevisiae
gagatgatgtacgttccttagctat

SEQ ID NO: 36066 - DNA, 25 bp, S. cerevisiae
gagatgcttacgtcatgcactatcc

SEQ ID NO: 36067 - DNA, 25 bp, S. cerevisiae
gagatccaaatgtcagcacgtcaat

SEQ ID NO: 36068 - DNA, 25 bp, S. cerevisiae
gagtttacaggtatttctgccccat

SEQ ID NO: 36069 - DNA, 25 bp, S. cerevisiae
gagttcacaacgaatttctctccgc

SEQ ID NO: 36070 - DNA, 25 bp, S. cerevisiae
gagtcactaaatattgctcctccca

SEQ ID NO: 36071 - DNA, 25 bp, S. cerevisiae
gagtcactagtatcttgccgttaac

SEQ ID NO: 36072 - DNA, 25 bp, S. cerevisiae
gagttaaaaatcgtgccatggccat

SEQ ID NO: 36073 - DNA, 25 bp, S. cerevisiae
gagttacaggtttggctacctcact

SEQ ID NO: 36074 - DNA, 25 bp, S. cerevisiae
gagtttcgcgtatggtcacccacta

SEQ ID NO: 36075 - DNA, 25 bp, S. cerevisiae
gagttcctgggtcagtatttcctac

SEQ ID NO: 36076 - DNA, 25 bp, S. cerevisiae
gagattggctgtttcgagcacctac

SEQ ID NO: 36077 - DNA, 25 bp, S. cerevisiae
gagtcggtgtattcaagcatgccat

SEQ ID NO: 36078 - DNA, 25 bp, S. cerevisiae
gatgtcagttttgcaaccagagcgt

SEQ ID NO: 36079 - DNA, 25 bp, S. cerevisiae
gagtctctagaagaacagttgtcct

SEQ ID NO: 36080 - DNA, 25 bp, S. cerevisiae
gatgaatctaaagaacgtatttcca

SEQ ID NO: 36081 - DNA, 25 bp, S. cerevisiae
gagttgccgatatcgtctatatagt

SEQ ID NO: 36082 - DNA, 25 bp, S. cerevisiae
gaggtggagctagcgctttaattga

SEQ ID NO: 36083 - DNA, 25 bp, S. cerevisiae
gagtcgtgccataccagtaaatttg

SEQ ID NO: 36084 - DNA, 25 bp, S. cerevisiae
gagatctgcgaaatccgtcctgtat

SEQ ID NO: 36085 - DNA, 25 bp, S. cerevisiae
gagtattgtgtcaaagccaccgcca

SEQ ID NO: 36086 - DNA, 25 bp, S. cerevisiae
gagatattggtggttcctcttctac

SEQ ID NO: 36087 - DNA, 25 bp, S. cerevisiae
gagtttggtggcttgccttttcaat

SEQ ID NO: 36088 - DNA, 25 bp, S. cerevisiae
gagattctttgggtgctttgtctaa

SEQ ID NO: 36089 - DNA, 25 bp, S. cerevisiae
gagattatcttcatcttcctgtgtt

SEQ ID NO: 36090 - DNA, 25 bp, S. cerevisiae
gatgtcagttttgctgtttacccag

SEQ ID NO: 36091 - DNA, 25 bp, S. cerevisiae
gagtcccgatggtagcattatcaag

SEQ ID NO: 36092 - DNA, 25 bp, S. cerevisiae
gagttatcgcatcaagatttagagc

SEQ ID NO: 36093 - DNA, 25 bp, S. cerevisiae
gagttgatcactctaatgcatttga

SEQ ID NO: 36094 - DNA, 25 bp, S. cerevisiae
gagattgcatgctcctatatcggta

SEQ ID NO: 36095 - DNA, 25 bp, S. cerevisiae
gagttctattcacgcaatcggtagt

SEQ ID NO: 36096 - DNA, 25 bp, S. cerevisiae
gagtttgatccaagacccgtagata

SEQ ID NO: 36097 - DNA, 25 bp, S. cerevisiae
gagtttgccgagcaactcgttgaag

SEQ ID NO: 36098 - DNA, 25 bp, S. cerevisiae
gagatattccttcaaactgcttgat

SEQ ID NO: 36099 - DNA, 25 bp, S. cerevisiae
gagattttgctctcagcaactgtta

SEQ ID NO: 36100 - DNA, 25 bp, S. cerevisiae
gagattccgcaaggctattttctac

SEQ ID NO: 36101 - DNA, 25 bp, S. cerevisiae
gagattctcgaacattttctcaaaa

SEQ ID NO: 36102 - DNA, 25 bp, S. cerevisiae
gagtcttctagctcctctgaaagtt

SEQ ID NO: 36103 - DNA, 25 bp, S. cerevisiae
gagttactacacgttatgccaagga

SEQ ID NO: 36104 - DNA, 25 bp, S. cerevisiae
gagttgattaccgataggctactgg

SEQ ID NO: 36105 - DNA, 25 bp, S. cerevisiae
tgacttgttgacctttcagtacggg

SEQ ID NO: 36106 - DNA, 25 bp, S. cerevisiae
gagattgttactggttcgtacgata

SEQ ID NO: 36107 - DNA, 25 bp, S. cerevisiae
gagttgatcggttcttcgttcaaaa

SEQ ID NO: 36108 - DNA, 25 bp, S. cerevisiae
gagatttaactcactgggcttcaca

SEQ ID NO: 36109 - DNA, 25 bp, S. cerevisiae
gagttaatacccttcttcacaatag

SEQ ID NO: 36110 - DNA, 25 bp, S. cerevisiae
gagattaaaccttcttctggcacaa

SEQ ID NO: 36111 - DNA, 25 bp, S. cerevisiae
gagatacaaacaatacagccgggat

SEQ ID NO: 36112 - DNA, 25 bp, S. cerevisiae
gagtcaaattcatgtacacggctga

SEQ ID NO: 36113 - DNA, 25 bp, S. cerevisiae
gatgctcagctatttgggaaatacc

SEQ ID NO: 36114 - DNA, 25 bp, S. cerevisiae
gagtctgatatttcggtcaacacca

SEQ ID NO: 36115 - DNA, 25 bp, S. cerevisiae
gagttaccaaaaatccatcacccag

SEQ ID NO: 36116 - DNA, 25 bp, S. cerevisiae
gagtaacgaaacacccatctttgaa

SEQ ID NO: 36117 - DNA, 25 bp, S. cerevisiae
gaggaaaactcccaggtttcactgg

SEQ ID NO: 36118 - DNA, 25 bp, S. cerevisiae
gagggcaaccacaccaattggacat

SEQ ID NO: 36119 - DNA, 25 bp, S. cerevisiae
gggccacaaactgggcgagttcgca

SEQ ID NO: 36120 - DNA, 25 bp, S. cerevisiae
gggccaacaatggttaggtccgcgc

SEQ ID NO: 36121 - DNA, 25 bp, S. cerevisiae
ggtgctacgaaggttatttccgaat

SEQ ID NO: 36122 - DNA, 25 bp, S. cerevisiae
ggtcaaaataccgtacgtctcgagt

SEQ ID NO: 36123 - DNA, 25 bp, S. cerevisiae
gagtcgcgtcttattagttccaggg

SEQ ID NO: 36124 - DNA, 25 bp, S. cerevisiae
gagttacttgatatccatgttcctg

SEQ ID NO: 36125 - DNA, 25 bp, S. cerevisiae
gagttcctcggctttgaagtgttga

SEQ ID NO: 36126 - DNA, 25 bp, S. cerevisiae
gagtcttccgaagttagcttgttag

SEQ ID NO: 36127 - DNA, 25 bp, S. cerevisiae
gagattttccaagctatacctcagg

SEQ ID NO: 36128 - DNA, 25 bp, S. cerevisiae
gagatattgctttatacttaggtga

SEQ ID NO: 36129 - DNA, 25 bp, S. cerevisiae
gagatttgattctacaccaacgtga

SEQ ID NO: 36130 - DNA, 25 bp, S. cerevisiae
gagttgcctaaggactttgcgtcgc

SEQ ID NO: 36131 - DNA, 25 bp, S. cerevisiae
gagttctttgatgctcagctaccat

SEQ ID NO: 36132 - DNA, 25 bp, S. cerevisiae
gagattcattgggtgctctttcaaa

SEQ ID NO: 36133 - DNA, 25 bp, S. cerevisiae
gagattgaatccagctgacagacca

SEQ ID NO: 36134 - DNA, 25 bp, S. cerevisiae
gagttttcattacctgacttggaag

SEQ ID NO: 36135 - DNA, 25 bp, S. cerevisiae
gagtcacttcctatcgacttgagaa

SEQ ID NO: 36136 - DNA, 25 bp, S. cerevisiae
gagttcctcctggtgcagcaaagaa

SEQ ID NO: 36137 - DNA, 25 bp, S. cerevisiae
gagtactctactgatgacgacgaaa

SEQ ID NO: 36138 - DNA, 25 bp, S. cerevisiae
gagatttcctcctgcagtatgctaa

SEQ ID NO: 36139 - DNA, 25 bp, S. cerevisiae
gagattatattcttgggtgcccaaa

SEQ ID NO: 36140 - DNA, 25 bp, S. cerevisiae
gagattattgcctttactgcgccat

SEQ ID NO: 36141 - DNA, 25 bp, S. cerevisiae
gagattatgtcttgtttgctgccaa

SEQ ID NO: 36142 - DNA, 25 bp, S. cerevisiae
gagattgtcagcatgttacctcatt

SEQ ID NO: 36143 - DNA, 25 bp, S. cerevisiae
gagatttccaagatgaccaatgtga

SEQ ID NO: 36144 - DNA, 25 bp, S. cerevisiae
gagattgtcacgcttacgcaaagaa

SEQ ID NO: 36145 - DNA, 25 bp, S. cerevisiae
gagattgggcagttcttcatacaaa

SEQ ID NO: 36146 - DNA, 25 bp, S. cerevisiae
gaggatgggccatgtcttcccactg

SEQ ID NO: 36147 - DNA, 25 bp, S. cerevisiae
gagtagttgccatttcattcggttt

SEQ ID NO: 36148 - DNA, 25 bp, S. cerevisiae
gagttttccaatcgattagagcatg

SEQ ID NO: 36149 - DNA, 25 bp, S. cerevisiae
gagattttcatcaaggtgcgcgagg

SEQ ID NO: 36150 - DNA, 25 bp, S. cerevisiae
gagtatttctctggcgctgggtgta

SEQ ID NO: 36151 - DNA, 25 bp, S. cerevisiae
gagtctatcgttgcggtaggctcag

SEQ ID NO: 36152 - DNA, 25 bp, S. cerevisiae
gagttgaagcttgcggtctcctctg

SEQ ID NO: 36153 - DNA, 25 bp, S. cerevisiae
gaggattttgtctggccactttagc

SEQ ID NO: 36154 - DNA, 25 bp, S. cerevisiae
gagtgattttggcagaccaccgaac

SEQ ID NO: 36155 - DNA, 25 bp, S. cerevisiae
gagtaaaggcgccatgaccccgcaa

SEQ ID NO: 36156 - DNA, 25 bp, S. cerevisiae
gatccaaagaagttccgggccgctg

SEQ ID NO: 36157 - DNA, 25 bp, S. cerevisiae
gagggaatggtctgcccaattcgaa

SEQ ID NO: 36158 - DNA, 25 bp, S. cerevisiae
gagttgatttgttcgtaccgttcga

SEQ ID NO: 36159 - DNA, 25 bp, S. cerevisiae
gagttgtttctgtggacggtacatt

SEQ ID NO: 36160 - DNA, 25 bp, S. cerevisiae
gagtttaccgtctcaatttcacaag

SEQ ID NO: 36161 - DNA, 25 bp, S. cerevisiae
gagggtaccgttccaacagacctag

SEQ ID NO: 36162 - DNA, 25 bp, S. cerevisiae
gaggagtgacttcttcgtcgaaatt

SEQ ID NO: 36163 - DNA, 25 bp, S. cerevisiae
gatgggaacttgcttcgccgtaaaa

SEQ ID NO: 36164 - DNA, 25 bp, S. cerevisiae
gaggcagaacctgttaccgtagaaa

SEQ ID NO: 36165 - DNA, 25 bp, S. cerevisiae
gagtataacgcgttcggttcaacca

SEQ ID NO: 36166 - DNA, 25 bp, S. cerevisiae
gagattgtatccgttgctggtataa

SEQ ID NO: 36167 - DNA, 25 bp, S. cerevisiae
gagttcttcactgtgggtgatcaat

SEQ ID NO: 36168 - DNA, 25 bp, S. cerevisiae
gagttcgatcctgtagttactgcat

SEQ ID NO: 36169 - DNA, 25 bp, S. cerevisiae
gagtacgtcccgaagatcgttgact

SEQ ID NO: 36170 - DNA, 25 bp, S. cerevisiae
gaggccgtggacaggatcgtctcac

SEQ ID NO: 36171 - DNA, 25 bp, S. cerevisiae
gagtagtgtcgttagtattccattg

SEQ ID NO: 36172 - DNA, 25 bp, S. cerevisiae
gagtacaaggccattttggtccctt

SEQ ID NO: 36173 - DNA, 25 bp, S. cerevisiae
ggtccaagccttattagaaaactgt

SEQ ID NO: 36174 - DNA, 25 bp, S. cerevisiae
gaggcccagccagatttaaaagaaa

SEQ ID NO: 36175 - DNA, 25 bp, S. cerevisiae
gagtccaagtacgtttaccgatgaa

SEQ ID NO: 36176 - DNA, 25 bp, S. cerevisiae
gagattaaccctacttacacgacaa

SEQ ID NO: 36177 - DNA, 25 bp, S. cerevisiae
gagttaccacttattcacaatgttg

SEQ ID NO: 36178 - DNA, 25 bp, S. cerevisiae
gagttactcatcaaacttccgaagg

SEQ ID NO: 36179 - DNA, 25 bp, S. cerevisiae
gaggatgacaatgccctttcgttgg

SEQ ID NO: 36180 - DNA, 25 bp, S. cerevisiae
gtgggacaaacaaaccttcttggct

SEQ ID NO: 36181 - DNA, 25 bp, S. cerevisiae
gatgggaccccacaaacttggtggt

SEQ ID NO: 36182 - DNA, 25 bp, S. cerevisiae
gaggagaccctagagtttttgaagt

SEQ ID NO: 36183 - DNA, 25 bp, S. cerevisiae
gagtagaccactagacggttcttca

SEQ ID NO: 36184 - DNA, 25 bp, S. cerevisiae
gagttcttcagcagattggttttca

SEQ ID NO: 36185 - DNA, 25 bp, S. cerevisiae
gagattccgtcaaacttccgatgtt

SEQ ID NO: 36186 - DNA, 25 bp, S. cerevisiae
gagattcctttgatattccgtgctt

SEQ ID NO: 36187 - DNA, 25 bp, S. cerevisiae
gagtaccgtagctatgatgcaacac

SEQ ID NO: 36188 - DNA, 25 bp, S. cerevisiae
gagtcaccgtcgtcattctagatga

SEQ ID NO: 36189 - DNA, 25 bp, S. cerevisiae
gagttctctgatgtttgctaatatg

SEQ ID NO: 36190 - DNA, 25 bp, S. cerevisiae
gagtcttcgttccattctgaatctt

SEQ ID NO: 36191 - DNA, 25 bp, S. cerevisiae
gagtcattggactgtctcgcagaat

SEQ ID NO: 36192 - DNA, 25 bp, S. cerevisiae
gagtacgtgcattggtccgattgtc

SEQ ID NO: 36193 - DNA, 25 bp, S. cerevisiae
gagtacctgatagatccgtttctga

SEQ ID NO: 36194 - DNA, 25 bp, S. cerevisiae
gagggctcaacaacacgcgtttgga

SEQ ID NO: 36195 - DNA, 25 bp, S. cerevisiae
gagtttttagtttcgctatcccatg

SEQ ID NO: 36196 - DNA, 25 bp, S. cerevisiae
gagtttttcagcgtttgcgttccat

SEQ ID NO: 36197 - DNA, 25 bp, S. cerevisiae
gagtctctttgtgaagtggtcgtca

SEQ ID NO: 36198 - DNA, 25 bp, S. cerevisiae
gagttctcttttggtgatttctatc

SEQ ID NO: 36199 - DNA, 25 bp, S. cerevisiae
gagtttacatgttacgttcccattc

SEQ ID NO: 36200 - DNA, 25 bp, S. cerevisiae
gagtattgaattcgcatctttgaca

SEQ ID NO: 36201 - DNA, 25 bp, S. cerevisiae
gagttcaaatctgcattttcttgct

SEQ ID NO: 36202 - DNA, 25 bp, S. cerevisiae
gagtctacaacttctttttcgtcat

SEQ ID NO: 36203 - DNA, 25 bp, S. cerevisiae
gagttacccaagttttctgctgtca

SEQ ID NO: 36204 - DNA, 25 bp, S. cerevisiae
gagtttcccaactttcttcgatata

SEQ ID NO: 36205 - DNA, 25 bp, S. cerevisiae
gagttgacacttactgttcttcaag

SEQ ID NO: 36206 - DNA, 25 bp, S. cerevisiae
gagtatacggatgcgttcctgagaa

SEQ ID NO: 36207 - DNA, 25 bp, S. cerevisiae
gagtttgctgacaacgttatgccat

SEQ ID NO: 36208 - DNA, 25 bp, S. cerevisiae
gagttctctgaagtggtcaatgcta

SEQ ID NO: 36209 - DNA, 25 bp, S. cerevisiae
gagttgcatcattagatcccacaaa

SEQ ID NO: 36210 - DNA, 25 bp, S. cerevisiae
gagattgatctgctgagcgccacaa

SEQ ID NO: 36211 - DNA, 25 bp, S. cerevisiae
gagttctcgatgaccttttttacca

SEQ ID NO: 36212 - DNA, 25 bp, S. cerevisiae
gagttgcttataggccattgtttca

SEQ ID NO: 36213 - DNA, 25 bp, S. cerevisiae
gagttgttatcttcgattgctgaaa

SEQ ID NO: 36214 - DNA, 25 bp, S. cerevisiae
gagttagttgcagtcttgcgggaca

SEQ ID NO: 36215 - DNA, 25 bp, S. cerevisiae
gagtttggttcatctttgctgttta

SEQ ID NO: 36216 - DNA, 25 bp, S. cerevisiae
gagttagccctgatagtttggaaca

SEQ ID NO: 36217 - DNA, 25 bp, S. cerevisiae
gagttccacgtaaagatgttccaaa

SEQ ID NO: 36218 - DNA, 25 bp, S. cerevisiae
gagttgctacttctggtgttgctaa

SEQ ID NO: 36219 - DNA, 25 bp, S. cerevisiae
gagtacctggacgtttatgctttat

SEQ ID NO: 36220 - DNA, 25 bp, S. cerevisiae
gagtcaccactacaatcattctgca

SEQ ID NO: 36221 - DNA, 25 bp, S. cerevisiae
gagtaacgctgctcctgctttgcac

SEQ ID NO: 36222 - DNA, 25 bp, S. cerevisiae
gagtacttaagcgattttcacccag

SEQ ID NO: 36223 - DNA, 25 bp, S. cerevisiae
gagtacctaacaactttgatacgag

SEQ ID NO: 36224 - DNA, 25 bp, S. cerevisiae
gagttccattcctcaaagagcttcc

SEQ ID NO: 36225 - DNA, 25 bp, S. cerevisiae
gagtatcagtcagtcctcaagcata

SEQ ID NO: 36226 - DNA, 25 bp, S. cerevisiae
gagttcgcttgattctctcaatgaa

SEQ ID NO: 36227 - DNA, 25 bp, S. cerevisiae
gagttgactcatcatttactgccaa

SEQ ID NO: 36228 - DNA, 25 bp, S. cerevisiae
gagttgactgatttgtttggctaca

SEQ ID NO: 36229 - DNA, 25 bp, S. cerevisiae
gagtatctcagcattgttaggtgac

SEQ ID NO: 36230 - DNA, 25 bp, S. cerevisiae
gagtcactccttaagaattgctacc

SEQ ID NO: 36231 - DNA, 25 bp, S. cerevisiae
gagtttattaatttcaccttcgacg

SEQ ID NO: 36232 - DNA, 25 bp, S. cerevisiae
gagtttattggtttacgagtcgacg

SEQ ID NO: 36233 - DNA, 25 bp, S. cerevisiae
gagtctgttacctgagagggccagt

SEQ ID NO: 36234 - DNA, 25 bp, S. cerevisiae
gagttcttaccatgcatatggccac

SEQ ID NO: 36235 - DNA, 25 bp, S. cerevisiae
gagtcagcctttttagggacgagat

SEQ ID NO: 36236 - DNA, 25 bp, S. cerevisiae
gagtacgctttaatcggcggtggta

SEQ ID NO: 36237 - DNA, 25 bp, S. cerevisiae
gagtacgttaacgatgtcgcgattt

SEQ ID NO: 36238 - DNA, 25 bp, S. cerevisiae
gagtatgcaattcacactgacggag

SEQ ID NO: 36239 - DNA, 25 bp, S. cerevisiae
gagtacgtgtcgaagctccgcgagt

SEQ ID NO: 36240 - DNA, 25 bp, S. cerevisiae
gagtttttcttcttatactgctctg

SEQ ID NO: 36241 - DNA, 25 bp, S. cerevisiae
gagtttctaattcacgctgcagacg

SEQ ID NO: 36242 - DNA, 25 bp, S. cerevisiae
gagtatgcccatattgatgtcctat

SEQ ID NO: 36243 - DNA, 25 bp, S. cerevisiae
gagtatacatttattgcaagtcgaa

SEQ ID NO: 36244 - DNA, 25 bp, S. cerevisiae
gagttgctatctgtcatagtcgact

SEQ ID NO: 36245 - DNA, 25 bp, S. cerevisiae
gagttttctacagggagtcagacat

SEQ ID NO: 36246 - DNA, 25 bp, S. cerevisiae
gagtgttacttgttggagccagcct

SEQ ID NO: 36247 - DNA, 25 bp, S. cerevisiae
gagtacagtcactttgagaaccttc

SEQ ID NO: 36248 - DNA, 25 bp, S. cerevisiae
gagttctttcactggtaacttctcc

SEQ ID NO: 36249 - DNA, 25 bp, S. cerevisiae
gagttctgatgatccggtaacgtat

SEQ ID NO: 36250 - DNA, 25 bp, S. cerevisiae
gatgttgttgaagcgggccacgtta

SEQ ID NO: 36251 - DNA, 25 bp, S. cerevisiae
gagttttagatcatgggcccgcgaa

SEQ ID NO: 36252 - DNA, 25 bp, S. cerevisiae
gaggtttacgttctgcctggtgaaa

SEQ ID NO: 36253 - DNA, 25 bp, S. cerevisiae
gagttttgcatctactaagcttgcg

SEQ ID NO: 36254 - DNA, 25 bp, S. cerevisiae
gagttattccagacttcatgttgca

SEQ ID NO: 36255 - DNA, 25 bp, S. cerevisiae
gagttcatttcagttccagatggta

SEQ ID NO: 36256 - DNA, 25 bp, S. cerevisiae
gagtttctctctgatatcattggta

SEQ ID NO: 36257 - DNA, 25 bp, S. cerevisiae
gagtgttaccatctatcggcaatga

SEQ ID NO: 36258 - DNA, 25 bp, S. cerevisiae
gagtttgccgatcgtatattccaag

SEQ ID NO: 36259 - DNA, 25 bp, S. cerevisiae
gagttcaattgttatccaccacaca

SEQ ID NO: 36260 - DNA, 25 bp, S. cerevisiae
gagttaatcataccatctaaacaag

SEQ ID NO: 36261 - DNA, 25 bp, S. cerevisiae
gagttcgatctttcttcatcatcaa

SEQ ID NO: 36262 - DNA, 25 bp, S. cerevisiae
gaggttggaggctcagttaaaacta

SEQ ID NO: 36263 - DNA, 25 bp, S. cerevisiae
gagtttgaagccacctctgcaaaac

SEQ ID NO: 36264 - DNA, 25 bp, S. cerevisiae
gagttcaatagccatttcgagctta

SEQ ID NO: 36265 - DNA, 25 bp, S. cerevisiae
gagttcttggagttcttggactata

SEQ ID NO: 36266 - DNA, 25 bp, S. cerevisiae
gagttcttcttctattttcgacata

SEQ ID NO: 36267 - DNA, 25 bp, S. cerevisiae
gagttattatcgatgtcccaagtct

SEQ ID NO: 36268 - DNA, 25 bp, S. cerevisiae
gagttatcgacaaagactgcccaga

SEQ ID NO: 36269 - DNA, 25 bp, S. cerevisiae
gagttaagagaaaatccgccagcaa

SEQ ID NO: 36270 - DNA, 25 bp, S. cerevisiae
gagttaatgagatccctttgcaaga

SEQ ID NO: 36271 - DNA, 25 bp, S. cerevisiae
gagtataatagctgccatctgggca

SEQ ID NO: 36272 - DNA, 25 bp, S. cerevisiae
gagttacatgcttgcacttggcagt

SEQ ID NO: 36273 - DNA, 25 bp, S. cerevisiae
gagttcatctgttccattacagtta

SEQ ID NO: 36274 - DNA, 25 bp, S. cerevisiae
gagttatattgtccctacgctatca

SEQ ID NO: 36275 - DNA, 25 bp, S. cerevisiae
gagtttacttgcactaccacaattt

SEQ ID NO: 36276 - DNA, 25 bp, S. cerevisiae
gagtttgacagcaacgcgagacgaa

SEQ ID NO: 36277 - DNA, 25 bp, S. cerevisiae
gagtggttgtcatcgccaaaaggta

SEQ ID NO: 36278 - DNA, 25 bp, S. cerevisiae
gagtggatgtttccccataacgaaa

SEQ ID NO: 36279 - DNA, 25 bp, S. cerevisiae
tcaaggttaccgtccaattaaagat

SEQ ID NO: 36280 - DNA, 25 bp, S. cerevisiae
gagggctttgtgctgaaaaccaacg

SEQ ID NO: 36281 - DNA, 25 bp, S. cerevisiae
gagtgcgacgttgcttcttataaca

SEQ ID NO: 36282 - DNA, 25 bp, S. cerevisiae
gagtgcaatacgtacttctttgaag

SEQ ID NO: 36283 - DNA, 25 bp, S. cerevisiae
gagtcctctcagtatattcactgtg

SEQ ID NO: 36284 - DNA, 25 bp, S. cerevisiae
gagtactcatcaagtgcacctgttg

SEQ ID NO: 36285 - DNA, 25 bp, S. cerevisiae
gagtagcttcacaacacctgaatgg

SEQ ID NO: 36286 - DNA, 25 bp, S. cerevisiae
gagtatctcttcaaacctcaactga

SEQ ID NO: 36287 - DNA, 25 bp, S. cerevisiae
gagtatcttcgaattcttgacagct

SEQ ID NO: 36288 - DNA, 25 bp, S. cerevisiae
gagtacttcgccacttacaatggga

SEQ ID NO: 36289 - DNA, 25 bp, S. cerevisiae
gagtttcatcctagactcttccaag

SEQ ID NO: 36290 - DNA, 25 bp, S. cerevisiae
gagtttagtcattacgctccaacag

SEQ ID NO: 36291 - DNA, 25 bp, S. cerevisiae
gagtttgattcttacagccgttccc

SEQ ID NO: 36292 - DNA, 25 bp, S. cerevisiae
gagttacacgacatatcgccatctt

SEQ ID NO: 36293 - DNA, 25 bp, S. cerevisiae
gagtcccatcgttggcatacaaaga

SEQ ID NO: 36294 - DNA, 25 bp, S. cerevisiae
gagtgctgccgcttaggtaaagata

SEQ ID NO: 36295 - DNA, 25 bp, S. cerevisiae
gagtctgctccacagttgtatgaca

SEQ ID NO: 36296 - DNA, 25 bp, S. cerevisiae
gagtatttttgttatccacgatcca

SEQ ID NO: 36297 - DNA, 25 bp, S. cerevisiae
gagttactactgctactcggatgta

SEQ ID NO: 36298 - DNA, 25 bp, S. cerevisiae
gagtgtaatttaacgtgtgctttct

SEQ ID NO: 36299 - DNA, 25 bp, S. cerevisiae
gaggtcaaacaaagcgtcgctctcg

SEQ ID NO: 36300 - DNA, 25 bp, S. cerevisiae
gaggttaatgccgaagtcttcctat

SEQ ID NO: 36301 - DNA, 25 bp, S. cerevisiae
gagtctataacctattcgtctatta

SEQ ID NO: 36302 - DNA, 25 bp, S. cerevisiae
gagtgggctttataaatccgtatca

SEQ ID NO: 36303 - DNA, 25 bp, S. cerevisiae
gaggcccatttaaatgagttgtttc

SEQ ID NO: 36304 - DNA, 25 bp, S. cerevisiae
gagtcccaaatattcaaggctacca

SEQ ID NO: 36305 - DNA, 25 bp, S. cerevisiae
gagggctctacaaatccagggacta

SEQ ID NO: 36306 - DNA, 25 bp, S. cerevisiae
gagtagcttagcatcttcggaaacg

SEQ ID NO: 36307 - DNA, 25 bp, S. cerevisiae
gagtagcattacgtttagccaacaa

SEQ ID NO: 36308 - DNA, 25 bp, S. cerevisiae
gagttttcacgcagtatacaagcaa

SEQ ID NO: 36309 - DNA, 25 bp, S. cerevisiae
gagtctcttgctgtctattttactg

SEQ ID NO: 36310 - DNA, 25 bp, S. cerevisiae
gagtttcgctgcaatttacattcct

SEQ ID NO: 36311 - DNA, 25 bp, S. cerevisiae
gagtactccctgtacgacatgtact

SEQ ID NO: 36312 - DNA, 25 bp, S. cerevisiae
gagtacgccgctgatgaagtggttt

SEQ ID NO: 36313 - DNA, 25 bp, S. cerevisiae
gagtacctcacggattttagattta

SEQ ID NO: 36314 - DNA, 25 bp, S. cerevisiae
gaggacgactctaactacgttctta

SEQ ID NO: 36315 - DNA, 25 bp, S. cerevisiae
gaggacgatccacaaccggtattat

SEQ ID NO: 36316 - DNA, 25 bp, S. cerevisiae
gaggctcgaccaaatagccgcggta

SEQ ID NO: 36317 - DNA, 25 bp, S. cerevisiae
gaggccgagaaaaagcatgctgaga

SEQ ID NO: 36318 - DNA, 25 bp, S. cerevisiae
gagtgatcggaaaccagcagagcaa

SEQ ID NO: 36319 - DNA, 25 bp, S. cerevisiae
gagtattatcgagcacgcagcagaa

SEQ ID NO: 36320 - DNA, 25 bp, S. cerevisiae
gagtgcaatatcacctcgaggtcgt

SEQ ID NO: 36321 - DNA, 25 bp, S. cerevisiae
gatggcctaagtttcaagatacgct

SEQ ID NO: 36322 - DNA, 25 bp, S. cerevisiae
gagtctctcaaagtatagcgttcaa

SEQ ID NO: 36323 - DNA, 25 bp, S. cerevisiae
gagtccacacatactgtacagcttc

SEQ ID NO: 36324 - DNA, 25 bp, S. cerevisiae
gagtcgaccaatccatacgtgatga

SEQ ID NO: 36325 - DNA, 25 bp, S. cerevisiae
gaggacacgtcactcagcaacgagc

SEQ ID NO: 36326 - DNA, 25 bp, S. cerevisiae
gagtgaccgacgactggaacgcaac

SEQ ID NO: 36327 - DNA, 25 bp, S. cerevisiae
gagtcagatcagagattggaaaaat

SEQ ID NO: 36328 - DNA, 25 bp, S. cerevisiae
gagtacctcaatcgcatggaatttc

SEQ ID NO: 36329 - DNA, 25 bp, S. cerevisiae
gagtagctgctttggctgacaagtt

SEQ ID NO: 36330 - DNA, 25 bp, S. cerevisiae
gagtcgcggttcttgatcatatctt

SEQ ID NO: 36331 - DNA, 25 bp, S. cerevisiae
gagtctggagtcgatcttcatgaat

SEQ ID NO: 36332 - DNA, 25 bp, S. cerevisiae
gagtgctgctgttaagtcggcgcta

SEQ ID NO: 36333 - DNA, 25 bp, S. cerevisiae
gagtgctctggttagacagctcctg

SEQ ID NO: 36334 - DNA, 25 bp, S. cerevisiae
gagggctcctggaccatatatgatt

SEQ ID NO: 36335 - DNA, 25 bp, S. cerevisiae
gagtggactcgttcatcaaagtctt

SEQ ID NO: 36336 - DNA, 25 bp, S. cerevisiae
gagtgagcacggtattctaactact

SEQ ID NO: 36337 - DNA, 25 bp, S. cerevisiae
gagtcctatgctccaagcttagtga

SEQ ID NO: 36338 - DNA, 25 bp, S. cerevisiae
gagtctaactagcatcttagtcatt

SEQ ID NO: 36339 - DNA, 25 bp, S. cerevisiae
gagtctgaacttgatattgcaccat

SEQ ID NO: 36340 - DNA, 25 bp, S. cerevisiae
gagtgtatacatcgcacatagactg

SEQ ID NO: 36341 - DNA, 25 bp, S. cerevisiae
gagtgattcagacagcttatcccgc

SEQ ID NO: 36342 - DNA, 25 bp, S. cerevisiae
gagtttcaatttattcagcctgcaa

SEQ ID NO: 36343 - DNA, 25 bp, S. cerevisiae
gagtgaatctacacgttcagcccaa

SEQ ID NO: 36344 - DNA, 25 bp, S. cerevisiae
gagtatttgagcgactttcatccct

SEQ ID NO: 36345 - DNA, 25 bp, S. cerevisiae
gagtatctcgaaacatctcgtccac

SEQ ID NO: 36346 - DNA, 25 bp, S. cerevisiae
gagtattcagcaaatccacctaaca

SEQ ID NO: 36347 - DNA, 25 bp, S. cerevisiae
gagtcatgcagatctgaaccccaat

SEQ ID NO: 36348 - DNA, 25 bp, S. cerevisiae
gagtacaattctcatcaccatcatt

SEQ ID NO: 36349 - DNA, 25 bp, S. cerevisiae
gagtagcatttttattcacgatcgc

SEQ ID NO: 36350 - DNA, 25 bp, S. cerevisiae
gagtatccttttatgcagaagcgca

SEQ ID NO: 36351 - DNA, 25 bp, S. cerevisiae
gagtattactttatcctgaggaccc

SEQ ID NO: 36352 - DNA, 25 bp, S. cerevisiae
gagggtccttttagtagacgttctg

SEQ ID NO: 36353 - DNA, 25 bp, S. cerevisiae
gaggtctgcgttgtacaagtcgtac

SEQ ID NO: 36354 - DNA, 25 bp, S. cerevisiae
gaggtgggttcctaccaggtatagc

SEQ ID NO: 36355 - DNA, 25 bp, S. cerevisiae
gagggcgaatttgaacctaatacct

SEQ ID NO: 36356 - DNA, 25 bp, S. cerevisiae
gaggacttactagaaccatttgttt

SEQ ID NO: 36357 - DNA, 25 bp, S. cerevisiae
gagtgcgcaacagacgacaccttta

SEQ ID NO: 36358 - DNA, 25 bp, S. cerevisiae
gagtccccatcaggtcaatggtaga

SEQ ID NO: 36359 - DNA, 25 bp, S. cerevisiae
gagtcattcccggttatggtcatgc

SEQ ID NO: 36360 - DNA, 25 bp, S. cerevisiae
gagtactcccagtgatatggcacaa

SEQ ID NO: 36361 - DNA, 25 bp, S. cerevisiae
gagtttctaagtacacatccagcaa

SEQ ID NO: 36362 - DNA, 25 bp, S. cerevisiae
gagtactttgcgtccatttataaaa

SEQ ID NO: 36363 - DNA, 25 bp, S. cerevisiae
gagtccgttgcacccattagaagca

SEQ ID NO: 36364 - DNA, 25 bp, S. cerevisiae
gagtacttcactttcatctttttca

SEQ ID NO: 36365 - DNA, 25 bp, S. cerevisiae
gagtcatttacgttctttttccaag

SEQ ID NO: 36366 - DNA, 25 bp, S. cerevisiae
gagtattttcgctttcattttcgtt

SEQ ID NO: 36367 - DNA, 25 bp, S. cerevisiae
gagtctttgacgaaggtcctacggg

SEQ ID NO: 36368 - DNA, 25 bp, S. cerevisiae
gagtagatcccttagttgtgttgtt

SEQ ID NO: 36369 - DNA, 25 bp, S. cerevisiae
gagtaggatccaaagctgccattta

SEQ ID NO: 36370 - DNA, 25 bp, S. cerevisiae
gagtttgattcagatgcggctttaa

SEQ ID NO: 36371 - DNA, 25 bp, S. cerevisiae
gagtatcattcccaaagacttcttt

SEQ ID NO: 36372 - DNA, 25 bp, S. cerevisiae
gagtctaccggagattttgcctttg

SEQ ID NO: 36373 - DNA, 25 bp, S. cerevisiae
gatgtcgatcggtaccggttccttt

SEQ ID NO: 36374 - DNA, 25 bp, S. cerevisiae
gagtcaacggcaacgatcgttcaat

SEQ ID NO: 36375 - DNA, 25 bp, S. cerevisiae
gagtctgtgtctacgatgtggtcaa

SEQ ID NO: 36376 - DNA, 25 bp, S. cerevisiae
gagtcatgtggtgaagcttatgcaa

SEQ ID NO: 36377 - DNA, 25 bp, S. cerevisiae
gagtacatacctatcttggcagaac

SEQ ID NO: 36378 - DNA, 25 bp, S. cerevisiae
gagtacaagctcaaccattggcgat

SEQ ID NO: 36379 - DNA, 25 bp, S. cerevisiae
gagtcaatgacttacctaccgcaat

SEQ ID NO: 36380 - DNA, 25 bp, S. cerevisiae
gagtacataaagtcgcttcccatgt

SEQ ID NO: 36381 - DNA, 25 bp, S. cerevisiae
gagtgagaaaatcgctgcttccctg

SEQ ID NO: 36382 - DNA, 25 bp, S. cerevisiae
gatctaactaactttggcatgcctg

SEQ ID NO: 36383 - DNA, 25 bp, S. cerevisiae
gagggactaatcgttcctgacgttt

SEQ ID NO: 36384 - DNA, 25 bp, S. cerevisiae
gagggacatcgcctgaacgaatgta

SEQ ID NO: 36385 - DNA, 25 bp, S. cerevisiae
gagggatacgccgtctgcaaataac

SEQ ID NO: 36386 - DNA, 25 bp, S. cerevisiae
gagggaaagctcctattactgagaa

SEQ ID NO: 36387 - DNA, 25 bp, S. cerevisiae
gagtccaggacatcttatcagttct

SEQ ID NO: 36388 - DNA, 25 bp, S. cerevisiae
gagtgccatggataccttcaagtcg

SEQ ID NO: 36389 - DNA, 25 bp, S. cerevisiae
gatgtcgcgacaccgttaaaacagc

SEQ ID NO: 36390 - DNA, 25 bp, S. cerevisiae
gagggccgacacttggaagttcgat

SEQ ID NO: 36391 - DNA, 25 bp, S. cerevisiae
gagggcacttactctaagttcattt

SEQ ID NO: 36392 - DNA, 25 bp, S. cerevisiae
gagggccgtaaatcgcacattgtcg

SEQ ID NO: 36393 - DNA, 25 bp, S. cerevisiae
gattgggttaaatccaccagtggga

SEQ ID NO: 36394 - DNA, 25 bp, S. cerevisiae
gagtgttttaccttagaccttgcaa

SEQ ID NO: 36395 - DNA, 25 bp, S. cerevisiae
gatggtttgttcgaggaacccagaa

SEQ ID NO: 36396 - DNA, 25 bp, S. cerevisiae
gagtatcttctggaggcaatagcat

SEQ ID NO: 36397 - DNA, 25 bp, S. cerevisiae
gagtctcgacagatacaaagcagtt

SEQ ID NO: 36398 - DNA, 25 bp, S. cerevisiae
gagggatgtaaccactttaccgcca

SEQ ID NO: 36399 - DNA, 25 bp, S. cerevisiae
gagggtgttaccttattgccacctg

SEQ ID NO: 36400 - DNA, 25 bp, S. cerevisiae
gatggtcgttacatatgttcaggcg

SEQ ID NO: 36401 - DNA, 25 bp, S. cerevisiae
gagtacagtaacctagatctatcga

SEQ ID NO: 36402 - DNA, 25 bp, S. cerevisiae
gagtaatgtctctgcattgttagca

SEQ ID NO: 36403 - DNA, 25 bp, S. cerevisiae
gagtgacatgtttgactttctcatc

SEQ ID NO: 36404 - DNA, 25 bp, S. cerevisiae
gagtcatgcagtgttgttcttgatt

SEQ ID NO: 36405 - DNA, 25 bp, S. cerevisiae
gagtactctgcttcttatggatttg

SEQ ID NO: 36406 - DNA, 25 bp, S. cerevisiae
gagtcctcatcgtctctttatgaaa

SEQ ID NO: 36407 - DNA, 25 bp, S. cerevisiae
gagtcacttccatctgaattcaaca

SEQ ID NO: 36408 - DNA, 25 bp, S. cerevisiae
gagtcatttccgaatactattccag

SEQ ID NO: 36409 - DNA, 25 bp, S. cerevisiae
gagtcattcgctcaagacttagcta

SEQ ID NO: 36410 - DNA, 25 bp, S. cerevisiae
gagtcatccattaacgattgctgct

SEQ ID NO: 36411 - DNA, 25 bp, S. cerevisiae
gagtcatcaaatcctgacctgccta

SEQ ID NO: 36412 - DNA, 25 bp, S. cerevisiae
gagtccatgatcaagttccacactg

SEQ ID NO: 36413 - DNA, 25 bp, S. cerevisiae
gagtcgcatactatttctcaagcag

SEQ ID NO: 36414 - DNA, 25 bp, S. cerevisiae
gagtcggtggtagcatcactgaatt

SEQ ID NO: 36415 - DNA, 25 bp, S. cerevisiae
gaggcggtgaaagccacttcatggc

SEQ ID NO: 36416 - DNA, 25 bp, S. cerevisiae
gaggttcttgacagccgctgagatc

SEQ ID NO: 36417 - DNA, 25 bp, S. cerevisiae
gagtggtgttcagaccgcatatata

SEQ ID NO: 36418 - DNA, 25 bp, S. cerevisiae
gagtctattgtgctgacgtttatac

SEQ ID NO: 36419 - DNA, 25 bp, S. cerevisiae
gaggtttttggaagcaattgccctt

SEQ ID NO: 36420 - DNA, 25 bp, S. cerevisiae
gaggatccggtgatagcaatgcccc

SEQ ID NO: 36421 - DNA, 25 bp, S. cerevisiae
gagtggccaagtgtacactgcccta

SEQ ID NO: 36422 - DNA, 25 bp, S. cerevisiae
gaggagaacagagctacaccagtaa

SEQ ID NO: 36423 - DNA, 25 bp, S. cerevisiae
gaggacaatactcttctgggtaatt

SEQ ID NO: 36424 - DNA, 25 bp, S. cerevisiae
gaggaaatggatctctcctgcctaa

SEQ ID NO: 36425 - DNA, 25 bp, S. cerevisiae
gatggaaattatgctttctgcccaa

SEQ ID NO: 36426 - DNA, 25 bp, S. cerevisiae
gagtcatggagtaccaattccccaa

SEQ ID NO: 36427 - DNA, 25 bp, S. cerevisiae
gagtggtcgttacatgtccggatct

SEQ ID NO: 36428 - DNA, 25 bp, S. cerevisiae
gagtcttctacagtactaacgcaac

SEQ ID NO: 36429 - DNA, 25 bp, S. cerevisiae
gagtctgttccctctaaaaacgcct

SEQ ID NO: 36430 - DNA, 25 bp, S. cerevisiae
gagtcttttcatggttctcagaaaa

SEQ ID NO: 36431 - DNA, 25 bp, S. cerevisiae
gagtgttttgtcctctatcaaatca

SEQ ID NO: 36432 - DNA, 25 bp, S. cerevisiae
gagtgcttacgtgggtatctaacaa

SEQ ID NO: 36433 - DNA, 25 bp, S. cerevisiae
gagtactggcactacatgtctttta

SEQ ID NO: 36434 - DNA, 25 bp, S. cerevisiae
gatgtgactggccaacaaatcgatt

SEQ ID NO: 36435 - DNA, 25 bp, S. cerevisiae
gaggacggcggtgatatcgattacc

SEQ ID NO: 36436 - DNA, 25 bp, S. cerevisiae
gaggaggtcgctgaatttttcggta

SEQ ID NO: 36437 - DNA, 25 bp, S. cerevisiae
gagtgcttcctcctttttggtaggt

SEQ ID NO: 36438 - DNA, 25 bp, S. cerevisiae
gagtctacgtccttcatttgatgaa

SEQ ID NO: 36439 - DNA, 25 bp, S. cerevisiae
gagtctcacagctcctttaggaaaa

SEQ ID NO: 36440 - DNA, 25 bp, S. cerevisiae
gagtgctaatgctcctttactaaaa

SEQ ID NO: 36441 - DNA, 25 bp, S. cerevisiae
gaggtacagcgcctttatccggtag

SEQ ID NO: 36442 - DNA, 25 bp, S. cerevisiae
gaggtactattcattcaccgggcat

SEQ ID NO: 36443 - DNA, 25 bp, S. cerevisiae
gaggtacatgatcagacaaatttgg

SEQ ID NO: 36444 - DNA, 25 bp, S. cerevisiae
gaggtacatctctggaagcttttat

SEQ ID NO: 36445 - DNA, 25 bp, S. cerevisiae
gaggtaccacgttgaatgtccattt

SEQ ID NO: 36446 - DNA, 25 bp, S. cerevisiae
gatggtgccaccgagaaggaacttg

SEQ ID NO: 36447 - DNA, 25 bp, S. cerevisiae
gaggtgccaacgattattctttaga

SEQ ID NO: 36448 - DNA, 25 bp, S. cerevisiae
gagtgatccaactttcaagtcgtta

SEQ ID NO: 36449 - DNA, 25 bp, S. cerevisiae
gagtgaccaagctactgcgacatca

SEQ ID NO: 36450 - DNA, 25 bp, S. cerevisiae
gagtgacctcgctagtaagcacagc

SEQ ID NO: 36451 - DNA, 25 bp, S. cerevisiae
gagtgagtgacttacccgatgcagt

SEQ ID NO: 36452 - DNA, 25 bp, S. cerevisiae
gagtggtatattggcttccatcgat

SEQ ID NO: 36453 - DNA, 25 bp, S. cerevisiae
gagggtgatattgtttgccgttcta

SEQ ID NO: 36454 - DNA, 25 bp, S. cerevisiae
gaggtttcatatatcccgcttttag

SEQ ID NO: 36455 - DNA, 25 bp, S. cerevisiae
gagtgtcacccctaacttatatgat

SEQ ID NO: 36456 - DNA, 25 bp, S. cerevisiae
gagtgagcatcgatttcagctggtt

SEQ ID NO: 36457 - DNA, 25 bp, S. cerevisiae
gagtgacgcgtttgttgctatgcct

SEQ ID NO: 36458 - DNA, 25 bp, S. cerevisiae
gaggaccatctattaacgagcccgc

SEQ ID NO: 36459 - DNA, 25 bp, S. cerevisiae
gaggttactgacgatgaccgcctat

SEQ ID NO: 36460 - DNA, 25 bp, S. cerevisiae
gaggttacagattggttcggtgcta

SEQ ID NO: 36461 - DNA, 25 bp, S. cerevisiae
gagtccatacgctattaactttaat

SEQ ID NO: 36462 - DNA, 25 bp, S. cerevisiae
gagtctcattcctattctttttatt

SEQ ID NO: 36463 - DNA, 25 bp, S. cerevisiae
gagtccatttagttcttcatttatc

SEQ ID NO: 36464 - DNA, 25 bp, S. cerevisiae
gagtctccggagttgaccaagtcat

SEQ ID NO: 36465 - DNA, 25 bp, S. cerevisiae
gaggctccggaatgacaatactgtt

SEQ ID NO: 36466 - DNA, 25 bp, S. cerevisiae
gaggcatagggctttgaccaacttt

SEQ ID NO: 36467 - DNA, 25 bp, S. cerevisiae
gagtgtacctgctaatggaatactt

SEQ ID NO: 36468 - DNA, 25 bp, S. cerevisiae
gagtcagagtcatccaaatcacaag

SEQ ID NO: 36469 - DNA, 25 bp, S. cerevisiae
gagtgccttctgacgacagtacaag

SEQ ID NO: 36470 - DNA, 25 bp, S. cerevisiae
gaggatttttcgacggcaccagtga

SEQ ID NO: 36471 - DNA, 25 bp, S. cerevisiae
gagggtaccagtttctttgctgaaa

SEQ ID NO: 36472 - DNA, 25 bp, S. cerevisiae
gagggtatcgatgttttcgacacca

SEQ ID NO: 36473 - DNA, 25 bp, S. cerevisiae
gagtgtctcaagaccttcttcaaga

SEQ ID NO: 36474 - DNA, 25 bp, S. cerevisiae
gaggtctcggatacttgatgatgct

SEQ ID NO: 36475 - DNA, 25 bp, S. cerevisiae
gagggttggatctttgacgttgaaa

SEQ ID NO: 36476 - DNA, 25 bp, S. cerevisiae
gatgggttctttgtcgctaaattcc

SEQ ID NO: 36477 - DNA, 25 bp, S. cerevisiae
gaggttattagctcacgaaaacaat

SEQ ID NO: 36478 - DNA, 25 bp, S. cerevisiae
gaggttctcgtaccaattactgaag

SEQ ID NO: 36479 - DNA, 25 bp, S. cerevisiae
gaggttctaacgaatttcactggga

SEQ ID NO: 36480 - DNA, 25 bp, S. cerevisiae
gagtgtccagtggtgtttcattctg

SEQ ID NO: 36481 - DNA, 25 bp, S. cerevisiae
gagtcgcgcagtttactttcaagca

SEQ ID NO: 36482 - DNA, 25 bp, S. cerevisiae
gaggtgcagttaccaacttggccaa

SEQ ID NO: 36483 - DNA, 25 bp, S. cerevisiae
gagggtgggctcagattattttaca

SEQ ID NO: 36484 - DNA, 25 bp, S. cerevisiae
gagggtgagttcactttgcccataa

SEQ ID NO: 36485 - DNA, 25 bp, S. cerevisiae
gagggtcagttcattttcgatcaaa

SEQ ID NO: 36486 - DNA, 25 bp, S. cerevisiae
gatggaacccctattgatccaaaag

SEQ ID NO: 36487 - DNA, 25 bp, S. cerevisiae
gaggtacactgaagctttggagaaa

SEQ ID NO: 36488 - DNA, 25 bp, S. cerevisiae
gagtgctcaacaactgtttttccta

SEQ ID NO: 36489 - DNA, 25 bp, S. cerevisiae
gagtcctagctgtggcatctgataa

SEQ ID NO: 36490 - DNA, 25 bp, S. cerevisiae
gatggccttggctgaacgtagagaa

SEQ ID NO: 36491 - DNA, 25 bp, S. cerevisiae
gatgcccatggaggaagttgcccta

SEQ ID NO: 36492 - DNA, 25 bp, S. cerevisiae
gagtccgccatcgatgaacacgtta

SEQ ID NO: 36493 - DNA, 25 bp, S. cerevisiae
tggcggcctgcatcagcgaacgtaa

SEQ ID NO: 36494 - DNA, 25 bp, S. cerevisiae
gaggtcgtccgcctcacaagctgag

SEQ ID NO: 36495 - DNA, 25 bp, S. cerevisiae
gagtgaatcctgcagctgacgatga

SEQ ID NO: 36496 - DNA, 25 bp, S. cerevisiae
gagtgcaattcgatgcgatgtgctc

SEQ ID NO: 36497 - DNA, 25 bp, S. cerevisiae
gagtgcatctattggtgctgacatt

SEQ ID NO: 36498 - DNA, 25 bp, S. cerevisiae
gagtctcccatgtcaaattaacgat

SEQ ID NO: 36499 - DNA, 25 bp, S. cerevisiae
gaggtggtttggatgatgtctccaa

SEQ ID NO: 36500 - DNA, 25 bp, S. cerevisiae
gagtgacgattttctcctctgggag

SEQ ID NO: 36501 - DNA, 25 bp, S. cerevisiae
tagttccttattgtacggtagcgac

SEQ ID NO: 36502 - DNA, 25 bp, S. cerevisiae
ggtacgttactcatacggccaggac

SEQ ID NO: 36503 - DNA, 25 bp, S. cerevisiae
gggagtggttccgatatccccggat

SEQ ID NO: 36504 - DNA, 25 bp, S. cerevisiae
ggtagttttccaagattccgggcat

SEQ ID NO: 36505 - DNA, 25 bp, S. cerevisiae
ggtcgtgttttaacttccagcggag

SEQ ID NO: 36506 - DNA, 25 bp, S. cerevisiae
gagtgagcctcttttagatcttgaa

SEQ ID NO: 36507 - DNA, 25 bp, S. cerevisiae
gagtcgctatctcatctgaactaca

SEQ ID NO: 36508 - DNA, 25 bp, S. cerevisiae
gaggcagttgatctcggacgaaaac

SEQ ID NO: 36509 - DNA, 25 bp, S. cerevisiae
gaggctttcgaccacaatcgacgta

SEQ ID NO: 36510 - DNA, 25 bp, S. cerevisiae
gaggtttcaaggtcagaacatctgt

SEQ ID NO: 36511 - DNA, 25 bp, S. cerevisiae
gaggatgggccagatgagaacttaa

SEQ ID NO: 36512 - DNA, 25 bp, S. cerevisiae
gagtgtactgagatcgtgacgcgat

SEQ ID NO: 36513 - DNA, 25 bp, S. cerevisiae
gagtgtcattgaattctggtccaag

SEQ ID NO: 36514 - DNA, 25 bp, S. cerevisiae
gagtgtctgattggttggcctccat

SEQ ID NO: 36515 - DNA, 25 bp, S. cerevisiae
gagtccttatgctattggtgttgat

SEQ ID NO: 36516 - DNA, 25 bp, S. cerevisiae
gagtcctaccatgagcctgttatga

SEQ ID NO: 36517 - DNA, 25 bp, S. cerevisiae
gaggccctacattatccagtttaca

SEQ ID NO: 36518 - DNA, 25 bp, S. cerevisiae
gagtgacctccataaagtacttcat

SEQ ID NO: 36519 - DNA, 25 bp, S. cerevisiae
gagtgattctttagctccacttcaa

SEQ ID NO: 36520 - DNA, 25 bp, S. cerevisiae
gatgagcccactggaatccaacagt

SEQ ID NO: 36521 - DNA, 25 bp, S. cerevisiae
gagtgcctcactagctaccagaaga

SEQ ID NO: 36522 - DNA, 25 bp, S. cerevisiae
gagtgcatcgactttgggcaatacc

SEQ ID NO: 36523 - DNA, 25 bp, S. cerevisiae
gagtgctaccaattcgcagagtatc

SEQ ID NO: 36524 - DNA, 25 bp, S. cerevisiae
gaggcaagagacattcagttacatt

SEQ ID NO: 36525 - DNA, 25 bp, S. cerevisiae
gaggacgaggtcttcacttggcttt

SEQ ID NO: 36526 - DNA, 25 bp, S. cerevisiae
gaggtgctaactacgatgctgatgc

SEQ ID NO: 36527 - DNA, 25 bp, S. cerevisiae
gagtgtgctgttatcgttgtgttga

SEQ ID NO: 36528 - DNA, 25 bp, S. cerevisiae
gagtgccttatctggtttatcgaca

SEQ ID NO: 36529 - DNA, 25 bp, S. cerevisiae
gagtggcttccattgtatttacgag

SEQ ID NO: 36530 - DNA, 25 bp, S. cerevisiae
gagtgttaccaagtttgtagctcaa

SEQ ID NO: 36531 - DNA, 25 bp, S. cerevisiae
gagtgcgtactatgtctttcaccca

SEQ ID NO: 36532 - DNA, 25 bp, S. cerevisiae
gaggcagtttggtttgttcacacct

SEQ ID NO: 36533 - DNA, 25 bp, S. cerevisiae
gaggaatttggctctcctcaagtgc

SEQ ID NO: 36534 - DNA, 25 bp, S. cerevisiae
gagggaaatttgtggcccagttcta

SEQ ID NO: 36535 - DNA, 25 bp, S. cerevisiae
gaggtttagctttagccccagagga

SEQ ID NO: 36536 - DNA, 25 bp, S. cerevisiae
gaggtggtggtcaaatcatcccaac

SEQ ID NO: 36537 - DNA, 25 bp, S. cerevisiae
gagtgtgaagtgacggctatgccca

SEQ ID NO: 36538 - DNA, 25 bp, S. cerevisiae
gagggagtccctacatggcggccaa

SEQ ID NO: 36539 - DNA, 25 bp, S. cerevisiae
gagggattgccctagtggccaacta

SEQ ID NO: 36540 - DNA, 25 bp, S. cerevisiae
gagggttgtatcagggcactaccaa

SEQ ID NO: 36541 - DNA, 25 bp, S. cerevisiae
gaggcccaatttctatttcgagacc

SEQ ID NO: 36542 - DNA, 25 bp, S. cerevisiae
gagtgtctctttgggaatctgggtt

SEQ ID NO: 36543 - DNA, 25 bp, S. cerevisiae
gagtgctttaccatagtcgcaggtt

SEQ ID NO: 36544 - DNA, 25 bp, S. cerevisiae
gagtggcttatcgatcctgaggacg

SEQ ID NO: 36545 - DNA, 25 bp, S. cerevisiae
gaggtttgtcacgtctaggacgcca

SEQ ID NO: 36546 - DNA, 25 bp, S. cerevisiae
gagggttctcactcaagatggccgc

SEQ ID NO: 36547 - DNA, 25 bp, S. cerevisiae
gagggtatgcccagaaattgcagca

SEQ ID NO: 36548 - DNA, 25 bp, S. cerevisiae
gagggatctggcttggacccacata

SEQ ID NO: 36549 - DNA, 25 bp, S. cerevisiae
gagtgagttcacaggtgccgcacaa

SEQ ID NO: 36550 - DNA, 25 bp, S. cerevisiae
gagtgcacagcttcaaattaccaaa

SEQ ID NO: 36551 - DNA, 25 bp, S. cerevisiae
gatggtgcgttctatggtccaaagt

SEQ ID NO: 36552 - DNA, 25 bp, S. cerevisiae
gaggtgccattgttggtccagattt

SEQ ID NO: 36553 - DNA, 25 bp, S. cerevisiae
gaggtgccaaggtcatgttcagatc

SEQ ID NO: 36554 - DNA, 25 bp, S. cerevisiae
gagtgatgcaaacctcgatcatttt

SEQ ID NO: 36555 - DNA, 25 bp, S. cerevisiae
gaggcttataacaacagatcgcttt

SEQ ID NO: 36556 - DNA, 25 bp, S. cerevisiae
gaggacaaaactttatactgcttct

SEQ ID NO: 36557 - DNA, 25 bp, S. cerevisiae
gagtgaaacccttctgcaactatgt

SEQ ID NO: 36558 - DNA, 25 bp, S. cerevisiae
gaggcaaggctggaccacatcgtat

SEQ ID NO: 36559 - DNA, 25 bp, S. cerevisiae
gagtgattggccgaatgctgttaag

SEQ ID NO: 36560 - DNA, 25 bp, S. cerevisiae
gaggttcctcactatggttaaacga

SEQ ID NO: 36561 - DNA, 25 bp, S. cerevisiae
gaggtttttgcaatggtaccatctc

SEQ ID NO: 36562 - DNA, 25 bp, S. cerevisiae
gaggtttgtgtcacatgtaccgccc

SEQ ID NO: 36563 - DNA, 25 bp, S. cerevisiae
gaggagtccatatcaggcattctag

SEQ ID NO: 36564 - DNA, 25 bp, S. cerevisiae
gagtgagccaaatgctggtcctaaa

SEQ ID NO: 36565 - DNA, 25 bp, S. cerevisiae
gagggcaagaattcggtccaaatca

SEQ ID NO: 36566 - DNA, 25 bp, S. cerevisiae
gaggcaacagtttcgggccacgtat

SEQ ID NO: 36567 - DNA, 25 bp, S. cerevisiae
gaggaaatgtcctgggtcactgttt

SEQ ID NO: 36568 - DNA, 25 bp, S. cerevisiae
gaggaagtacaactggtccctgcct

SEQ ID NO: 36569 - DNA, 25 bp, S. cerevisiae
gaggaagagaccatgggccgcccta

SEQ ID NO: 36570 - DNA, 25 bp, S. cerevisiae
gaggaagagtccaaactggccccta

SEQ ID NO: 36571 - DNA, 25 bp, S. cerevisiae
gaggaaggctccaacacgaacacta

SEQ ID NO: 36572 - DNA, 25 bp, S. cerevisiae
gagggacgcaaatgatctatcttaa

SEQ ID NO: 36573 - DNA, 25 bp, S. cerevisiae
gaggaagcccacagatttagataac

SEQ ID NO: 36574 - DNA, 25 bp, S. cerevisiae
gaggatgccctatggtactaggtaa

SEQ ID NO: 36575 - DNA, 25 bp, S. cerevisiae
gaggtgccctttttcaatacgcaaa

SEQ ID NO: 36576 - DNA, 25 bp, S. cerevisiae
gaggtactggtttgccagggcccat

SEQ ID NO: 36577 - DNA, 25 bp, S. cerevisiae
gaggttccaatttccaaggctcttc

SEQ ID NO: 36578 - DNA, 25 bp, S. cerevisiae
gagggtgcgcaagatctcaacgcca

SEQ ID NO: 36579 - DNA, 25 bp, S. cerevisiae
gagtgggctcaaattctacacgaaa

SEQ ID NO: 36580 - DNA, 25 bp, S. cerevisiae
gagggacagcttctgcagactgtat

SEQ ID NO: 36581 - DNA, 25 bp, S. cerevisiae
gagtggttaaacttgcacatcaaca

SEQ ID NO: 36582 - DNA, 25 bp, S. cerevisiae
gagtgcgtttcatgcatgtaacata

SEQ ID NO: 36583 - DNA, 25 bp, S. cerevisiae
gagggctactgctgtggaactactg

SEQ ID NO: 36584 - DNA, 25 bp, S. cerevisiae
gagggttctgagtttaatcatactg

SEQ ID NO: 36585 - DNA, 25 bp, S. cerevisiae
gaggcgcttctagagctactgtaat

SEQ ID NO: 36586 - DNA, 25 bp, S. cerevisiae
gagggaccaatccacgatcatggaa

SEQ ID NO: 36587 - DNA, 25 bp, S. cerevisiae
gagggagaactatcgcatcagagaa

SEQ ID NO: 36588 - DNA, 25 bp, S. cerevisiae
gagggaagcacgtaccacaaattgg

SEQ ID NO: 36589 - DNA, 25 bp, S. cerevisiae
gagggaatccattactctcaagttc

SEQ ID NO: 36590 - DNA, 25 bp, S. cerevisiae
gagggagtccttaaccaagctgtga

SEQ ID NO: 36591 - DNA, 25 bp, S. cerevisiae
gagggagcttttaaatctacatgat

SEQ ID NO: 36592 - DNA, 25 bp, S. cerevisiae
gaggagcgttgaacttagcgaacta

SEQ ID NO: 36593 - DNA, 25 bp, S. cerevisiae
gagggcctcgatattgaagactatt

SEQ ID NO: 36594 - DNA, 25 bp, S. cerevisiae
gagggcacggaatttgttgacacat

SEQ ID NO: 36595 - DNA, 25 bp, S. cerevisiae
gaggcaccgcagtgaacttggccat

SEQ ID NO: 36596 - DNA, 25 bp, S. cerevisiae
gagggtggcagtactacctgagaat

SEQ ID NO: 36597 - DNA, 25 bp, S. cerevisiae
gaggcaggtgtttctacaatggaat

SEQ ID NO: 36598 - DNA, 25 bp, S. cerevisiae
gagtggcaagttttgttacaccaac

SEQ ID NO: 36599 - DNA, 25 bp, S. cerevisiae
gaggagcaattcagtggtaacaaac

SEQ ID NO: 36600 - DNA, 25 bp, S. cerevisiae
gaggatgactcaaagctggccagta

SEQ ID NO: 36601 - DNA, 25 bp, S. cerevisiae
gagtgcacagccttgagactttatt

SEQ ID NO: 36602 - DNA, 25 bp, S. cerevisiae
gagtgtattgaccttttctatctat

SEQ ID NO: 36603 - DNA, 25 bp, S. cerevisiae
gagggctccttggaaagttctattg

SEQ ID NO: 36604 - DNA, 25 bp, S. cerevisiae
gatgggaaagaacttctgtccaccc

SEQ ID NO: 36605 - DNA, 25 bp, S. cerevisiae
gagtggcaaagctcacattctcaac

SEQ ID NO: 36606 - DNA, 25 bp, S. cerevisiae
gagtggctcactcaatggcagttga

SEQ ID NO: 36607 - DNA, 25 bp, S. cerevisiae
gagtggcacactcatataactgcag

SEQ ID NO: 36608 - DNA, 25 bp, S. cerevisiae
gagtgtcagccttgagcaaacgctc

SEQ ID NO: 36609 - DNA, 25 bp, S. cerevisiae
gagtgtcacttctgaacatacccat

SEQ ID NO: 36610 - DNA, 25 bp, S. cerevisiae
gagtggcagcttttgtgaccaccgc

SEQ ID NO: 36611 - DNA, 25 bp, S. cerevisiae
gagtggtcttcaggtattcctcatc

SEQ ID NO: 36612 - DNA, 25 bp, S. cerevisiae
gagtggtcagccatatattatcccc

SEQ ID NO: 36613 - DNA, 25 bp, S. cerevisiae
gaggtatcaggttgagcttctctaa

SEQ ID NO: 36614 - DNA, 25 bp, S. cerevisiae
gagggactctgttttgcagctagcc

SEQ ID NO: 36615 - DNA, 25 bp, S. cerevisiae
gatggaaacgtcctgatccttggtg

SEQ ID NO: 36616 - DNA, 25 bp, S. cerevisiae
gagggctacttctttagctgggttt

SEQ ID NO: 36617 - DNA, 25 bp, S. cerevisiae
gaggtttattttttgcatgggactt

SEQ ID NO: 36618 - DNA, 25 bp, S. cerevisiae
gagtgtggtacttctattgatggta

SEQ ID NO: 36619 - DNA, 25 bp, S. cerevisiae
gaggtcgaactacgcatattggata

SEQ ID NO: 36620 - DNA, 25 bp, S. cerevisiae
gaggtcgccagcaatgtattcagga

SEQ ID NO: 36621 - DNA, 25 bp, S. cerevisiae
gaggttgccaatacaaatcggagat

SEQ ID NO: 36622 - DNA, 25 bp, S. cerevisiae
gaggccgcaccattcaaattaactt

SEQ ID NO: 36623 - DNA, 25 bp, S. cerevisiae
gaggcccagtcagctaaagaattac

SEQ ID NO: 36624 - DNA, 25 bp, S. cerevisiae
gaggcaacgacgacttgcaggaatt

SEQ ID NO: 36625 - DNA, 25 bp, S. cerevisiae
gaggaaccacaactgcgggcaatgc

SEQ ID NO: 36626 - DNA, 25 bp, S. cerevisiae
gaggttgaagtcgacatcccagaac

SEQ ID NO: 36627 - DNA, 25 bp, S. cerevisiae
gaggttatggattttgtcaatacac

SEQ ID NO: 36628 - DNA, 25 bp, S. cerevisiae
gagggtgtcgctgatttcgtacatc

SEQ ID NO: 36629 - DNA, 25 bp, S. cerevisiae
ttcggtactgtggaattcgtcccca

SEQ ID NO: 36630 - DNA, 25 bp, S. cerevisiae
gatcggtccattgggtttatcccca

SEQ ID NO: 36631 - DNA, 25 bp, S. cerevisiae
gatcgggtttgacttttcgaccaag

SEQ ID NO: 36632 - DNA, 25 bp, S. cerevisiae
gatctgggttctttacttcttggta

SEQ ID NO: 36633 - DNA, 25 bp, S. cerevisiae
gattgggttccgctgatttagttga

SEQ ID NO: 36634 - DNA, 25 bp, S. cerevisiae
gatccgttacgtgttttaggtgaat

SEQ ID NO: 36635 - DNA, 25 bp, S. cerevisiae
gatcttttacgtatatttccgccga

SEQ ID NO: 36636 - DNA, 25 bp, S. cerevisiae
gatgtcttctaccaatgtttgtccg

SEQ ID NO: 36637 - DNA, 25 bp, S. cerevisiae
gaggttctattcaagtttttctgtt

SEQ ID NO: 36638 - DNA, 25 bp, S. cerevisiae
gatgggttccagcacgactttgcac

SEQ ID NO: 36639 - DNA, 25 bp, S. cerevisiae
gaggttgactactacgagctatacg

SEQ ID NO: 36640 - DNA, 25 bp, S. cerevisiae
gaggtcggtactccaagattaccta

SEQ ID NO: 36641 - DNA, 25 bp, S. cerevisiae
gaggtctggtttacgaattttcaca

SEQ ID NO: 36642 - DNA, 25 bp, S. cerevisiae
gagggcctttgttgcgtatatttgc

SEQ ID NO: 36643 - DNA, 25 bp, S. cerevisiae
gagggcctggtcaaaactatttcta

SEQ ID NO: 36644 - DNA, 25 bp, S. cerevisiae
gagggtggctctttgtcaggaaata

SEQ ID NO: 36645 - DNA, 25 bp, S. cerevisiae
gaggtgggctttttctacagatgat

SEQ ID NO: 36646 - DNA, 25 bp, S. cerevisiae
gagggcggtgtcgtgtacacaatta

SEQ ID NO: 36647 - DNA, 25 bp, S. cerevisiae
gaggataaggctagcgaaccaatta

SEQ ID NO: 36648 - DNA, 25 bp, S. cerevisiae
gaggattgtggcatgtaactcaaaa

SEQ ID NO: 36649 - DNA, 25 bp, S. cerevisiae
gaggcatatgggtcgttttcaaatt

SEQ ID NO: 36650 - DNA, 25 bp, S. cerevisiae
gagggaatgcaactccacttggtat

SEQ ID NO: 36651 - DNA, 25 bp, S. cerevisiae
gaggaacaaagaccattacccgcta

SEQ ID NO: 36652 - DNA, 25 bp, S. cerevisiae
gaggaagcgtactcaaacctggaag

SEQ ID NO: 36653 - DNA, 25 bp, S. cerevisiae
gaggaactatactcgctacagtcga

SEQ ID NO: 36654 - DNA, 25 bp, S. cerevisiae
gatggatccatataacggacttctg

SEQ ID NO: 36655 - DNA, 25 bp, S. cerevisiae
gagggtttaccatgctacaattaag

SEQ ID NO: 36656 - DNA, 25 bp, S. cerevisiae
gagggattctctgaagtgcatcaaa

SEQ ID NO: 36657 - DNA, 25 bp, S. cerevisiae
gagggctattccaaacatgcatgta

SEQ ID NO: 36658 - DNA, 25 bp, S. cerevisiae
gagggctttctcgaatcatcataaa

SEQ ID NO: 36659 - DNA, 25 bp, S. cerevisiae
gagggactaccaaatatctgcgaac

SEQ ID NO: 36660 - DNA, 25 bp, S. cerevisiae
gaggagaccttagtatacgtgacac

SEQ ID NO: 36661 - DNA, 25 bp, S. cerevisiae
gaggaggccatctgtaactgctgct

SEQ ID NO: 36662 - DNA, 25 bp, S. cerevisiae
gaggaggttactctatctcatgccc

SEQ ID NO: 36663 - DNA, 25 bp, S. cerevisiae
gagggcgacgccatctttagatcca

SEQ ID NO: 36664 - DNA, 25 bp, S. cerevisiae
gagggcgagagcatttttggatctt

SEQ ID NO: 36665 - DNA, 25 bp, S. cerevisiae
gaggtgtatgccatctacgttactt

SEQ ID NO: 36666 - DNA, 25 bp, S. cerevisiae
gaggttcagaacctacttcttctgt

SEQ ID NO: 36667 - DNA, 25 bp, S. cerevisiae
gagggtcagatctttcaccttttga

SEQ ID NO: 36668 - DNA, 25 bp, S. cerevisiae
gaggtcataattctatcattggtca

SEQ ID NO: 36669 - DNA, 25 bp, S. cerevisiae
gaggctttttcgcatctggtctaaa

SEQ ID NO: 36670 - DNA, 25 bp, S. cerevisiae
gaggaattttcggtcgacgtccaag

SEQ ID NO: 36671 - DNA, 25 bp, S. cerevisiae
gaggacattctgaccgaaatcccgg

SEQ ID NO: 36672 - DNA, 25 bp, S. cerevisiae
gaggtgcatactgatccaaacgatg

SEQ ID NO: 36673 - DNA, 25 bp, S. cerevisiae
gaggtctagatattccaaacgtcac

SEQ ID NO: 36674 - DNA, 25 bp, S. cerevisiae
gagggctaaatttcaaccagattgc

SEQ ID NO: 36675 - DNA, 25 bp, S. cerevisiae
gagggctgctaaatacgctatcaag

SEQ ID NO: 36676 - DNA, 25 bp, S. cerevisiae
gaggtaaatccagtgcatcaatagc

SEQ ID NO: 36677 - DNA, 25 bp, S. cerevisiae
gaggtaactacagtgccgtatcaaa

SEQ ID NO: 36678 - DNA, 25 bp, S. cerevisiae
gaggtatactctgttctcttatgga

SEQ ID NO: 36679 - DNA, 25 bp, S. cerevisiae
gaggtattacctagtggcaagttaa

SEQ ID NO: 36680 - DNA, 25 bp, S. cerevisiae
gatgtacggaacattccaagctgta

SEQ ID NO: 36681 - DNA, 25 bp, S. cerevisiae
gaggctcaaaactttctaagcggat

SEQ ID NO: 36682 - DNA, 25 bp, S. cerevisiae
gaggcaggcaaatcgattcgttaca

SEQ ID NO: 36683 - DNA, 25 bp, S. cerevisiae
gaggattcaatatcgcacacaggta

SEQ ID NO: 36684 - DNA, 25 bp, S. cerevisiae
gaggtcttagacaagcttctttcca

SEQ ID NO: 36685 - DNA, 25 bp, S. cerevisiae
gaggaccctgaatccagtctgacaa

SEQ ID NO: 36686 - DNA, 25 bp, S. cerevisiae
gaggccgatcatcatgttagtcaaa

SEQ ID NO: 36687 - DNA, 25 bp, S. cerevisiae
gaggtcgatctcaattctttcaaaa

SEQ ID NO: 36688 - DNA, 25 bp, S. cerevisiae
gagggtctatgagctcgtcatcagg

SEQ ID NO: 36689 - DNA, 25 bp, S. cerevisiae
gagggattaccattttctagtgtga

SEQ ID NO: 36690 - DNA, 25 bp, S. cerevisiae
gagggattacgttcttcttgatgac

SEQ ID NO: 36691 - DNA, 25 bp, S. cerevisiae
gagggatgtagccaacgtatatgat

SEQ ID NO: 36692 - DNA, 25 bp, S. cerevisiae
gagggattcatccaacgagtaattc

SEQ ID NO: 36693 - DNA, 25 bp, S. cerevisiae
gaggtggtattcttctgagataatc

SEQ ID NO: 36694 - DNA, 25 bp, S. cerevisiae
gaggaggctcttttcaagatttccg

SEQ ID NO: 36695 - DNA, 25 bp, S. cerevisiae
gatggagtgattgacgacgttctga

SEQ ID NO: 36696 - DNA, 25 bp, S. cerevisiae
gaggataactcgctgcactttatat

SEQ ID NO: 36697 - DNA, 25 bp, S. cerevisiae
gaggattttcaggtcagctctgata

SEQ ID NO: 36698 - DNA, 25 bp, S. cerevisiae
gaggtttgaatgtctcactatccac

SEQ ID NO: 36699 - DNA, 25 bp, S. cerevisiae
gaggagcttgaatcacttggcgaag

SEQ ID NO: 36700 - DNA, 25 bp, S. cerevisiae
gaggaggcttctcatttgaactcta

SEQ ID NO: 36701 - DNA, 25 bp, S. cerevisiae
gaggtcatctttgaatctacttatg

SEQ ID NO: 36702 - DNA, 25 bp, S. cerevisiae
gaggcttactattccccagaagttt

SEQ ID NO: 36703 - DNA, 25 bp, S. cerevisiae
gaggtaacatctctcaaccaaagat

SEQ ID NO: 36704 - DNA, 25 bp, S. cerevisiae
gaggatctcgcaggctttacgtaaa

SEQ ID NO: 36705 - DNA, 25 bp, S. cerevisiae
gaggattcatatcttgctatctttc

SEQ ID NO: 36706 - DNA, 25 bp, S. cerevisiae
gaggatttagttactcagtttcaag

SEQ ID NO: 36707 - DNA, 25 bp, S. cerevisiae
gaggtgattcagttatcgttgtgtt

SEQ ID NO: 36708 - DNA, 25 bp, S. cerevisiae
gaggtataactttccctgtgctgat

SEQ ID NO: 36709 - DNA, 25 bp, S. cerevisiae
gaggtgaaaattccgctcccgttgg

SEQ ID NO: 36710 - DNA, 25 bp, S. cerevisiae
gaggtaaaattttctcctccacttg

SEQ ID NO: 36711 - DNA, 25 bp, S. cerevisiae
gaggtaactgccatactaccactgt

SEQ ID NO: 36712 - DNA, 25 bp, S. cerevisiae
gaggtagattccattgccacaaagc

SEQ ID NO: 36713 - DNA, 25 bp, S. cerevisiae
gaggatacacttaacccactagagt

SEQ ID NO: 36714 - DNA, 25 bp, S. cerevisiae
gaggaacacagtaacagccatttga

SEQ ID NO: 36715 - DNA, 25 bp, S. cerevisiae
gaggatcaacggtcaacgattctag

SEQ ID NO: 36716 - DNA, 25 bp, S. cerevisiae
gaggtcagacaactcgaatttcttg

SEQ ID NO: 36717 - DNA, 25 bp, S. cerevisiae
gaggtcaacacaccaagaccactgg

SEQ ID NO: 36718 - DNA, 25 bp, S. cerevisiae
gaggtcagtacacttcaaagacggt

SEQ ID NO: 36719 - DNA, 25 bp, S. cerevisiae
gaggctttaagtatcaaactgacac

SEQ ID NO: 36720 - DNA, 25 bp, S. cerevisiae
gaggccttatagtaaaaattattcg

SEQ ID NO: 36721 - DNA, 25 bp, S. cerevisiae
gagggttcgcaattgctcgatagtt

SEQ ID NO: 36722 - DNA, 25 bp, S. cerevisiae
gaggttgtcaagcatgattccgttg

SEQ ID NO: 36723 - DNA, 25 bp, S. cerevisiae
gaggtttcttaacttctctgaatgg

SEQ ID NO: 36724 - DNA, 25 bp, S. cerevisiae
gaggaggtcttcaatttcaatgagg

SEQ ID NO: 36725 - DNA, 25 bp, S. cerevisiae
gaggaagccaccaaaatacatgagg

SEQ ID NO: 36726 - DNA, 25 bp, S. cerevisiae
gatggaatctcccaacgataatagt

SEQ ID NO: 36727 - DNA, 25 bp, S. cerevisiae
gaggagttggatgacacccatcttt

SEQ ID NO: 36728 - DNA, 25 bp, S. cerevisiae
gaggcatccggtgaatgggttccaa

SEQ ID NO: 36729 - DNA, 25 bp, S. cerevisiae
gaggaccttggatatggacaccgta

SEQ ID NO: 36730 - DNA, 25 bp, S. cerevisiae
gaggattgcaagacaaacccaccgt

SEQ ID NO: 36731 - DNA, 25 bp, S. cerevisiae
gaggatctaaaatatactaccgcca

SEQ ID NO: 36732 - DNA, 25 bp, S. cerevisiae
gaggacataaaatacacaccgagat

SEQ ID NO: 36733 - DNA, 25 bp, S. cerevisiae
gagggtcctttaacattcgagatat

SEQ ID NO: 36734 - DNA, 25 bp, S. cerevisiae
gaggtgctttctgaacattgcgaga

SEQ ID NO: 36735 - DNA, 25 bp, S. cerevisiae
gaggtccattagttgtctacgctga

SEQ ID NO: 36736 - DNA, 25 bp, S. cerevisiae
gaggcaggatacgaaagccaactga

SEQ ID NO: 36737 - DNA, 25 bp, S. cerevisiae
gaggaggaccaagtggcaccactgt

SEQ ID NO: 36738 - DNA, 25 bp, S. cerevisiae
gaggcggccaacgtggaaactacca

SEQ ID NO: 36739 - DNA, 25 bp, S. cerevisiae
gaggccagtcaactcatggatatac

SEQ ID NO: 36740 - DNA, 25 bp, S. cerevisiae
gaggcgcaagtaggcaatgattcaa

SEQ ID NO: 36741 - DNA, 25 bp, S. cerevisiae
gaggattaactccttggttgcctta

SEQ ID NO: 36742 - DNA, 25 bp, S. cerevisiae
gaggatattcctgtttgttgcttgt

SEQ ID NO: 36743 - DNA, 25 bp, S. cerevisiae
gaggtgctggatttcttttcggtaa

SEQ ID NO: 36744 - DNA, 25 bp, S. cerevisiae
gaggttattgatcatctgctggtta

SEQ ID NO: 36745 - DNA, 25 bp, S. cerevisiae
gaggtccatctgtgcactgggtgaa

SEQ ID NO: 36746 - DNA, 25 bp, S. cerevisiae
gaggactacgttacttgggtggaca

SEQ ID NO: 36747 - DNA, 25 bp, S. cerevisiae
gaggaacgcgttgctcggttaaaca

SEQ ID NO: 36748 - DNA, 25 bp, S. cerevisiae
gatggaactagtgcctcttttcaaa

SEQ ID NO: 36749 - DNA, 25 bp, S. cerevisiae
gaggttgctaatttgcttttttgaa

SEQ ID NO: 36750 - DNA, 25 bp, S. cerevisiae
gaggccaatacttgttttcttgtgc

SEQ ID NO: 36751 - DNA, 25 bp, S. cerevisiae
gaggtcggccttgttacatcaggta

SEQ ID NO: 36752 - DNA, 25 bp, S. cerevisiae
gaggtttcactccagattaccaggt

SEQ ID NO: 36753 - DNA, 25 bp, S. cerevisiae
gaggtatctgccgatcagttacaca

SEQ ID NO: 36754 - DNA, 25 bp, S. cerevisiae
gaggtatggccggtggtcaacatca

SEQ ID NO: 36755 - DNA, 25 bp, S. cerevisiae
gaggtatgtccgatgatctgcaaat

SEQ ID NO: 36756 - DNA, 25 bp, S. cerevisiae
gaggttgctaggctatccagtttat

SEQ ID NO: 36757 - DNA, 25 bp, S. cerevisiae
gaggtccccgactattatgatttta

SEQ ID NO: 36758 - DNA, 25 bp, S. cerevisiae
gaggtccgtcgagtagtagaagatt

SEQ ID NO: 36759 - DNA, 25 bp, S. cerevisiae
gatgagtaccccttagtagttgaat

SEQ ID NO: 36760 - DNA, 25 bp, S. cerevisiae
tgaagttcccaaagagttttaattg

SEQ ID NO: 36761 - DNA, 25 bp, S. cerevisiae
gaggtgcctttgacttgtgtttgaa

SEQ ID NO: 36762 - DNA, 25 bp, S. cerevisiae
gaggctgagatgttttttgtttcca

SEQ ID NO: 36763 - DNA, 25 bp, S. cerevisiae
gatggtagtgtggttctttcctcca

SEQ ID NO: 36764 - DNA, 25 bp, S. cerevisiae
gatgagccatttttggatttcccca

SEQ ID NO: 36765 - DNA, 25 bp, S. cerevisiae
gaggccatcgtactgtggtaagcca

SEQ ID NO: 36766 - DNA, 25 bp, S. cerevisiae
gaggtgctcctcaaggtggacacaa

SEQ ID NO: 36767 - DNA, 25 bp, S. cerevisiae
gaggatggatcacaagtatcaccta

SEQ ID NO: 36768 - DNA, 25 bp, S. cerevisiae
gaggattatcctgccatttccaaat

SEQ ID NO: 36769 - DNA, 25 bp, S. cerevisiae
gatggttacccacaatgctttagag

SEQ ID NO: 36770 - DNA, 25 bp, S. cerevisiae
gaggttaacccagatgatccatatg

SEQ ID NO: 36771 - DNA, 25 bp, S. cerevisiae
gatggttcaccctccaaaacaaaat

SEQ ID NO: 36772 - DNA, 25 bp, S. cerevisiae
gaggtattacctgcctaagaaatca

SEQ ID NO: 36773 - DNA, 25 bp, S. cerevisiae
gaggatgctccaggcaacaacggta

SEQ ID NO: 36774 - DNA, 25 bp, S. cerevisiae
gaggattcggacatgttcagcgtaa

SEQ ID NO: 36775 - DNA, 25 bp, S. cerevisiae
gaggttcttgatttattgagcgtta

SEQ ID NO: 36776 - DNA, 25 bp, S. cerevisiae
gaggtctttctgtttctagcgttaa

SEQ ID NO: 36777 - DNA, 25 bp, S. cerevisiae
gaggatttgtcttcttctgacattt

SEQ ID NO: 36778 - DNA, 25 bp, S. cerevisiae
gaggtcatattcactgatctcacag

SEQ ID NO: 36779 - DNA, 25 bp, S. cerevisiae
gaggtcatctctaacctctatgacg

SEQ ID NO: 36780 - DNA, 25 bp, S. cerevisiae
gaggtctcgtggtatcttaaaagtc

SEQ ID NO: 36781 - DNA, 25 bp, S. cerevisiae
gaggtcactttgctcttcaaaagat

SEQ ID NO: 36782 - DNA, 25 bp, S. cerevisiae
gaggtccgcttgctgtaaatattcc

SEQ ID NO: 36783 - DNA, 25 bp, S. cerevisiae
gaggtatgcgggtctgtattttgtc

SEQ ID NO: 36784 - DNA, 25 bp, S. cerevisiae
gaggttctttattctgtgtggcaat

SEQ ID NO: 36785 - DNA, 25 bp, S. cerevisiae
gaggatactgtttccggtgacaacg

SEQ ID NO: 36786 - DNA, 25 bp, S. cerevisiae
gaggcgctctattcctgggttctat

SEQ ID NO: 36787 - DNA, 25 bp, S. cerevisiae
ggagggtttacatgacccaagcaaa

SEQ ID NO: 36788 - DNA, 25 bp, S. cerevisiae
gatgaaatgttatccccagggtcca

SEQ ID NO: 36789 - DNA, 25 bp, S. cerevisiae
gatgaacgttcaacccacaggattt

SEQ ID NO: 36790 - DNA, 25 bp, S. cerevisiae
gataacgttacctcacaggacaatg

SEQ ID NO: 36791 - DNA, 25 bp, S. cerevisiae
gtgaagttggactcgttcgacacga

SEQ ID NO: 36792 - DNA, 25 bp, S. cerevisiae
gatgaagggtatgccgtaccagaaa

SEQ ID NO: 36793 - DNA, 25 bp, S. cerevisiae
tgcaattgggtggttggtaccgcta

SEQ ID NO: 36794 - DNA, 25 bp, S. cerevisiae
gatcaaggcgatgttgggctcccga

SEQ ID NO: 36795 - DNA, 25 bp, S. cerevisiae
gaggatctctattgtgtggcagtta

SEQ ID NO: 36796 - DNA, 25 bp, S. cerevisiae
gaggttctgctatgaatgccagtgc

SEQ ID NO: 36797 - DNA, 25 bp, S. cerevisiae
gaggatttgccttttcacaggctga

SEQ ID NO: 36798 - DNA, 25 bp, S. cerevisiae
gaggatctatgccttgtaccaccaa

SEQ ID NO: 36799 - DNA, 25 bp, S. cerevisiae
gaggttcgattttgatgcatccaga

SEQ ID NO: 36800 - DNA, 25 bp, S. cerevisiae
gaggctgtgcactgttatgaccaac

SEQ ID NO: 36801 - DNA, 25 bp, S. cerevisiae
gaggaaacctcctaacgcagatgtt

SEQ ID NO: 36802 - DNA, 25 bp, S. cerevisiae
gaggatgtacgcactcaagcccatg

SEQ ID NO: 36803 - DNA, 25 bp, S. cerevisiae
gaggattaccccaagacatctgcaa

SEQ ID NO: 36804 - DNA, 25 bp, S. cerevisiae
gaggtttatcgattgtgacttcttc

SEQ ID NO: 36805 - DNA, 25 bp, S. cerevisiae
gaggtatttctatctgcagttagtg

SEQ ID NO: 36806 - DNA, 25 bp, S. cerevisiae
gaggtatgtttttgtgcccttggaa

SEQ ID NO: 36807 - DNA, 25 bp, S. cerevisiae
gaggtactattttggtctctttaag

SEQ ID NO: 36808 - DNA, 25 bp, S. cerevisiae
gaggtatccttcgttgtccattcat

SEQ ID NO: 36809 - DNA, 25 bp, S. cerevisiae
gaggttctctctgattataattcaa

SEQ ID NO: 36810 - DNA, 25 bp, S. cerevisiae
gatccggcttcatattccaagtact

SEQ ID NO: 36811 - DNA, 25 bp, S. cerevisiae
gatccagtcccacagtaagttgtta

SEQ ID NO: 36812 - DNA, 25 bp, S. cerevisiae
gaggaatccccttggatgtcaatcc

SEQ ID NO: 36813 - DNA, 25 bp, S. cerevisiae
gaggatattatagcggagttcaaca

SEQ ID NO: 36814 - DNA, 25 bp, S. cerevisiae
gaggaacttgccgatccaaagagta

SEQ ID NO: 36815 - DNA, 25 bp, S. cerevisiae
gaggattttcctttatgccagatga

SEQ ID NO: 36816 - DNA, 25 bp, S. cerevisiae
gaggagttcatgtccgtgcaagaat

SEQ ID NO: 36817 - DNA, 25 bp, S. cerevisiae
gttgagagatcattgcacgatgcaa

SEQ ID NO: 36818 - DNA, 25 bp, S. cerevisiae
gatgtcgatgtattgcaagtcacta

SEQ ID NO: 36819 - DNA, 25 bp, S. cerevisiae
gatgtacatgtgttgcataggccta

SEQ ID NO: 36820 - DNA, 25 bp, S. cerevisiae
gatggcaatggattaggcagctcta

SEQ ID NO: 36821 - DNA, 25 bp, S. cerevisiae
gatagaatgcgccttggagacgtaa

SEQ ID NO: 36822 - DNA, 25 bp, S. cerevisiae
gaggacgactgctttactcgtgaaa

SEQ ID NO: 36823 - DNA, 25 bp, S. cerevisiae
gaggctcaaatctctgacttagaaa

SEQ ID NO: 36824 - DNA, 25 bp, S. cerevisiae
gaggccacaactatacatgacggaa

SEQ ID NO: 36825 - DNA, 25 bp, S. cerevisiae
gaggccgatttatatctcgaccagt

SEQ ID NO: 36826 - DNA, 25 bp, S. cerevisiae
gaggttattctcaagttcaatctaa

SEQ ID NO: 36827 - DNA, 25 bp, S. cerevisiae
gaggattattccagcattacaaaga

SEQ ID NO: 36828 - DNA, 25 bp, S. cerevisiae
gaggaaattcacagattggacaatg

SEQ ID NO: 36829 - DNA, 25 bp, S. cerevisiae
gaggaaatttccgacgtcacatatg

SEQ ID NO: 36830 - DNA, 25 bp, S. cerevisiae
gaggaattcattaccacttcacttt

SEQ ID NO: 36831 - DNA, 25 bp, S. cerevisiae
gaggaatttatcacgttcattgaat

SEQ ID NO: 36832 - DNA, 25 bp, S. cerevisiae
gaggaccactacgaatcactaagaa

SEQ ID NO: 36833 - DNA, 25 bp, S. cerevisiae
gaggatgacattccacaatccgaat

SEQ ID NO: 36834 - DNA, 25 bp, S. cerevisiae
gatggcagattagctatttggtact

SEQ ID NO: 36835 - DNA, 25 bp, S. cerevisiae
gatggcgactgttttataactactc

SEQ ID NO: 36836 - DNA, 25 bp, S. cerevisiae
gattagactgatttttacctaccct

SEQ ID NO: 36837 - DNA, 25 bp, S. cerevisiae
gttgaactattatctacctcaggcg

SEQ ID NO: 36838 - DNA, 25 bp, S. cerevisiae
gaggcaactttttaaccatccgtga

SEQ ID NO: 36839 - DNA, 25 bp, S. cerevisiae
gaggatcctcttatttcttcgtttt

SEQ ID NO: 36840 - DNA, 25 bp, S. cerevisiae
gaggatactcttgtcatccggtatt

SEQ ID NO: 36841 - DNA, 25 bp, S. cerevisiae
gaggcagacatcagcgtactaggta

SEQ ID NO: 36842 - DNA, 25 bp, S. cerevisiae
gaggagcaatatcgattatctatgg

SEQ ID NO: 36843 - DNA, 25 bp, S. cerevisiae
gaggatccttcacatctcaaggtac

SEQ ID NO: 36844 - DNA, 25 bp, S. cerevisiae
gaggatctttcacctacaagcagca

SEQ ID NO: 36845 - DNA, 25 bp, S. cerevisiae
gaggacggccttgatggcgccatca

SEQ ID NO: 36846 - DNA, 25 bp, S. cerevisiae
gaggatccagaaatattgccccaca

SEQ ID NO: 36847 - DNA, 25 bp, S. cerevisiae
gaggacctggaattttaccagaaga

SEQ ID NO: 36848 - DNA, 25 bp, S. cerevisiae
gaggacccattgtatgttgcccgaa

SEQ ID NO: 36849 - DNA, 25 bp, S. cerevisiae
gaggaccctgagacagttgcagcta

SEQ ID NO: 36850 - DNA, 25 bp, S. cerevisiae
gaggctgcctctggtgagagtacta

SEQ ID NO: 36851 - DNA, 25 bp, S. cerevisiae
gaggatgcctctacaaatgcgacat

SEQ ID NO: 36852 - DNA, 25 bp, S. cerevisiae
gaggaccctgacttatcagatgatg

SEQ ID NO: 36853 - DNA, 25 bp, S. cerevisiae
gaggatgcaccaactatcagaaccc

SEQ ID NO: 36854 - DNA, 25 bp, S. cerevisiae
gaggatcattgaactctgcgcaagt

SEQ ID NO: 36855 - DNA, 25 bp, S. cerevisiae
gaggatgcaatgatcgcccaagaat

SEQ ID NO: 36856 - DNA, 25 bp, S. cerevisiae
gaggacatcaaagctctgagacaag

SEQ ID NO: 36857 - DNA, 25 bp, S. cerevisiae
gatggacgacctgactagagagtta

SEQ ID NO: 36858 - DNA, 25 bp, S. cerevisiae
gatggttgtcccaactgtcagggta

SEQ ID NO: 36859 - DNA, 25 bp, S. cerevisiae
gaggttgaccactacgaatcctgta

SEQ ID NO: 36860 - DNA, 25 bp, S. cerevisiae
gaggaagaccatcaacagctctcta

SEQ ID NO: 36861 - DNA, 25 bp, S. cerevisiae
gaggatagaatcagccataccgcaa

SEQ ID NO: 36862 - DNA, 25 bp, S. cerevisiae
gaggaagagtcttcatcaaacgaag

SEQ ID NO: 36863 - DNA, 25 bp, S. cerevisiae
gaggagcgcgaaatctcaaactgaa

SEQ ID NO: 36864 - DNA, 25 bp, S. cerevisiae
gaggttcctatgttgtctactcaaa

SEQ ID NO: 36865 - DNA, 25 bp, S. cerevisiae
gaggaattcttgtcgttactgccat

SEQ ID NO: 36866 - DNA, 25 bp, S. cerevisiae
gaggagtttttccatctacagcact

SEQ ID NO: 36867 - DNA, 25 bp, S. cerevisiae
gaggagtatctgtttttaatgcatt

SEQ ID NO: 36868 - DNA, 25 bp, S. cerevisiae
gaggataactattcttcttcatatt

SEQ ID NO: 36869 - DNA, 25 bp, S. cerevisiae
gaggatacacaatcacctgtctcag

SEQ ID NO: 36870 - DNA, 25 bp, S. cerevisiae
gaggactcataagagccattctgaa

SEQ ID NO: 36871 - DNA, 25 bp, S. cerevisiae
gaggcagttagacacatatttggac

SEQ ID NO: 36872 - DNA, 25 bp, S. cerevisiae
gaggattcttcgcaagatcttgttc

SEQ ID NO: 36873 - DNA, 25 bp, S. cerevisiae
gaggaattttgccagattttattag

SEQ ID NO: 36874 - DNA, 25 bp, S. cerevisiae
gaggatattcttacgaagcttttaa

SEQ ID NO: 36875 - DNA, 25 bp, S. cerevisiae
gaggaaggtcctgctgtatttttca

SEQ ID NO: 36876 - DNA, 25 bp, S. cerevisiae
gaggaaagccctgcaaattctctat

SEQ ID NO: 36877 - DNA, 25 bp, S. cerevisiae
gaggaaggcccgaaagatgcccatt

SEQ ID NO: 36878 - DNA, 25 bp, S. cerevisiae
gatggaagcgctcaaacagatcctt

SEQ ID NO: 36879 - DNA, 25 bp, S. cerevisiae
gaggaatcatccactgaactcgctt

SEQ ID NO: 36880 - DNA, 25 bp, S. cerevisiae
gatttccccgaacagctaaagtgca

SEQ ID NO: 36881 - DNA, 25 bp, S. cerevisiae
gatagaacaccctctgaaaacctct

SEQ ID NO: 36882 - DNA, 25 bp, S. cerevisiae
gaggaaggaactactcatcttacgt

SEQ ID NO: 36883 - DNA, 25 bp, S. cerevisiae
gaggatagtgtttcatggacgcata

SEQ ID NO: 36884 - DNA, 25 bp, S. cerevisiae
tgctgggagtccagggacgcattct

SEQ ID NO: 36885 - DNA, 25 bp, S. cerevisiae
gatgggttcaaacagactcccttag

SEQ ID NO: 36886 - DNA, 25 bp, S. cerevisiae
gtacagggacgacatcaaatctttg

SEQ ID NO: 36887 - DNA, 25 bp, S. cerevisiae
gatgacgtggacaaaacaattctta

SEQ ID NO: 36888 - DNA, 25 bp, S. cerevisiae
gaggcagtggtaacccaaatcctaa

SEQ ID NO: 36889 - DNA, 25 bp, S. cerevisiae
gaggcggacgtgagactctacccaa

SEQ ID NO: 36890 - DNA, 25 bp, S. cerevisiae
gaggcggtctggaacctgaaactca

SEQ ID NO: 36891 - DNA, 25 bp, S. cerevisiae
gaggaggtttgttcgttcaatacag

SEQ ID NO: 36892 - DNA, 25 bp, S. cerevisiae
gaggatgttagctttgccactagag

SEQ ID NO: 36893 - DNA, 25 bp, S. cerevisiae
gaggatgctttcgattccgtatcaa

SEQ ID NO: 36894 - DNA, 25 bp, S. cerevisiae
gaggcaccttcccaaatgttagaat

SEQ ID NO: 36895 - DNA, 25 bp, S. cerevisiae
gaggccttactctaatgtactgccc

SEQ ID NO: 36896 - DNA, 25 bp, S. cerevisiae
gaggatctggaacctactttcaaaa

SEQ ID NO: 36897 - DNA, 25 bp, S. cerevisiae
gaggatctagttgctacagttgata

SEQ ID NO: 36898 - DNA, 25 bp, S. cerevisiae
gaggagctacttttacgcaaatctg

SEQ ID NO: 36899 - DNA, 25 bp, S. cerevisiae
gaggaacgcgtctatactgaacaga

SEQ ID NO: 36900 - DNA, 25 bp, S. cerevisiae
gaggaaagcttcttattcaacgaga

SEQ ID NO: 36901 - DNA, 25 bp, S. cerevisiae
gaggatataccttttatcaacgcaa

SEQ ID NO: 36902 - DNA, 25 bp, S. cerevisiae
gaggataccgctcatctaatgacca

SEQ ID NO: 36903 - DNA, 25 bp, S. cerevisiae
gaggctgcccatggtacggtgacca

SEQ ID NO: 36904 - DNA, 25 bp, S. cerevisiae
gatggcccaaggtgaaacattatca

SEQ ID NO: 36905 - DNA, 25 bp, S. cerevisiae
gaggatctagatagtgacttattta

SEQ ID NO: 36906 - DNA, 25 bp, S. cerevisiae
gaggcttgccttgaattctgttgga

SEQ ID NO: 36907 - DNA, 25 bp, S. cerevisiae
gaggatgcagccagaaattcttcga

SEQ ID NO: 36908 - DNA, 25 bp, S. cerevisiae
gaggagctgtcttacaattcattct

SEQ ID NO: 36909 - DNA, 25 bp, S. cerevisiae
gaggagcagcgcctacatattgatg

SEQ ID NO: 36910 - DNA, 25 bp, S. cerevisiae
gaggatgacggtacttctgcttcgc

SEQ ID NO: 36911 - DNA, 25 bp, S. cerevisiae
gaggaatagcaatgtatcccatcac

SEQ ID NO: 36912 - DNA, 25 bp, S. cerevisiae
gatggcccatttcacaaagacgtac

SEQ ID NO: 36913 - DNA, 25 bp, S. cerevisiae
gaggaaatctttggccctgttgtca

SEQ ID NO: 36914 - DNA, 25 bp, S. cerevisiae
gaggataatctcatcgcatctggtt

SEQ ID NO: 36915 - DNA, 25 bp, S. cerevisiae
gaggacaattctgcctttgcatttg

SEQ ID NO: 36916 - DNA, 25 bp, S. cerevisiae
gaggaactttccgatttatctgata

SEQ ID NO: 36917 - DNA, 25 bp, S. cerevisiae
gaggatgttcctggtctaatgtgta

SEQ ID NO: 36918 - DNA, 25 bp, S. cerevisiae
gaggcatttctctgactgaatttga

SEQ ID NO: 36919 - DNA, 25 bp, S. cerevisiae
gaggcaattcccgtcgaaattattc

SEQ ID NO: 36920 - DNA, 25 bp, S. cerevisiae
gaggcaaacctcgtaactgttttct

SEQ ID NO: 36921 - DNA, 25 bp, S. cerevisiae
gaggctaactccaaaatcggttcca

SEQ ID NO: 36922 - DNA, 25 bp, S. cerevisiae
gaggctcaagattttttcccatacg

SEQ ID NO: 36923 - DNA, 25 bp, S. cerevisiae
gaggatgccgattttgtatccaatc

SEQ ID NO: 36924 - DNA, 25 bp, S. cerevisiae
gaggactcgtcatttctgtaagatc

SEQ ID NO: 36925 - DNA, 25 bp, S. cerevisiae
gaggatcctcattctcaaataagag

SEQ ID NO: 36926 - DNA, 25 bp, S. cerevisiae
gatggctccatctctgaaaatcaag

SEQ ID NO: 36927 - DNA, 25 bp, S. cerevisiae
gaggctcgcgagcacaaatacagat

SEQ ID NO: 36928 - DNA, 25 bp, S. cerevisiae
gaggcaccttaactgcagccacaat

SEQ ID NO: 36929 - DNA, 25 bp, S. cerevisiae
gaggctggcattaagtgagccctct

SEQ ID NO: 36930 - DNA, 25 bp, S. cerevisiae
gaggcccaatgcagatatgacttta

SEQ ID NO: 36931 - DNA, 25 bp, S. cerevisiae
gatcggtaacgcatgcatttaaacc

SEQ ID NO: 36932 - DNA, 25 bp, S. cerevisiae
gatccgttactgagaaatttcccat

SEQ ID NO: 36933 - DNA, 25 bp, S. cerevisiae
gatcttttgggactttcaactcctc

SEQ ID NO: 36934 - DNA, 25 bp, S. cerevisiae
gatggtttggtacctatcaacttat

SEQ ID NO: 36935 - DNA, 25 bp, S. cerevisiae
gaggcatattttagacccaatttta

SEQ ID NO: 36936 - DNA, 25 bp, S. cerevisiae
gatggaatctaactacccagacttc

SEQ ID NO: 36937 - DNA, 25 bp, S. cerevisiae
gaggacatttgactaccatgaacac

SEQ ID NO: 36938 - DNA, 25 bp, S. cerevisiae
gatgaacttctatcaccatttcgcc

SEQ ID NO: 36939 - DNA, 25 bp, S. cerevisiae
gaggctttcaagtccctatatacct

SEQ ID NO: 36940 - DNA, 25 bp, S. cerevisiae
gaggccttggtgtaggtttactgaa

SEQ ID NO: 36941 - DNA, 25 bp, S. cerevisiae
gaggacgctagttatggtttactta

SEQ ID NO: 36942 - DNA, 25 bp, S. cerevisiae
gaggcccttgatattgtctttttaa

SEQ ID NO: 36943 - DNA, 25 bp, S. cerevisiae
gaggccctatatactgaattctttt

SEQ ID NO: 36944 - DNA, 25 bp, S. cerevisiae
gatgctcgtcaaaagttccgtaatt

SEQ ID NO: 36945 - DNA, 25 bp, S. cerevisiae
gatgttccaacaccttacgctaaag

SEQ ID NO: 36946 - DNA, 25 bp, S. cerevisiae
gaggcttaagcctttcatatcgaat

SEQ ID NO: 36947 - DNA, 25 bp, S. cerevisiae
gaggctcgttgaccgatattccaat

SEQ ID NO: 36948 - DNA, 25 bp, S. cerevisiae
gaggctaagtggacgcaattcataa

SEQ ID NO: 36949 - DNA, 25 bp, S. cerevisiae
gaggcctaagtattttggattcatt

SEQ ID NO: 36950 - DNA, 25 bp, S. cerevisiae
gggccaagaagactcgttctgcctg

SEQ ID NO: 36951 - DNA, 25 bp, S. cerevisiae
gaggaaatcgacatcatctttgcta

SEQ ID NO: 36952 - DNA, 25 bp, S. cerevisiae
gaggagataccaatttcctggcatg

SEQ ID NO: 36953 - DNA, 25 bp, S. cerevisiae
gaggagacaacattgattgctctga

SEQ ID NO: 36954 - DNA, 25 bp, S. cerevisiae
gaggagactcacagacagctacaat

SEQ ID NO: 36955 - DNA, 25 bp, S. cerevisiae
gaggacttattgaacgctgcacacg

SEQ ID NO: 36956 - DNA, 25 bp, S. cerevisiae
gaggactttcgtccacgaccagaaa

SEQ ID NO: 36957 - DNA, 25 bp, S. cerevisiae
gaggcactttctctacagaccaaaa

SEQ ID NO: 36958 - DNA, 25 bp, S. cerevisiae
gaggactttcctgatcatgacgcaa

SEQ ID NO: 36959 - DNA, 25 bp, S. cerevisiae
gaggagtcttctgtaatggctgcaa

SEQ ID NO: 36960 - DNA, 25 bp, S. cerevisiae
gaggcaagtctcctattagcggata

SEQ ID NO: 36961 - DNA, 25 bp, S. cerevisiae
gaggcacagaagcttatcagcgaaa

SEQ ID NO: 36962 - DNA, 25 bp, S. cerevisiae
gaggcactatatgctttcactgtga

SEQ ID NO: 36963 - DNA, 25 bp, S. cerevisiae
gaggagcctgagcatggaactttta

SEQ ID NO: 36964 - DNA, 25 bp, S. cerevisiae
gaggcccgcaaaaaacatttccata

SEQ ID NO: 36965 - DNA, 25 bp, S. cerevisiae
gaggccaccagaaagcaagtcgtcc

SEQ ID NO: 36966 - DNA, 25 bp, S. cerevisiae
gatggcgcatacctaagaacgggac

SEQ ID NO: 36967 - DNA, 25 bp, S. cerevisiae
gatggagctatcaataagaacccta

SEQ ID NO: 36968 - DNA, 25 bp, S. cerevisiae
gatgtactacatttgttctacgcag

SEQ ID NO: 36969 - DNA, 25 bp, S. cerevisiae
gaggactcacaatctatctacgaat

SEQ ID NO: 36970 - DNA, 25 bp, S. cerevisiae
gaggaccaagtaccgctacaattga

SEQ ID NO: 36971 - DNA, 25 bp, S. cerevisiae
gaggcactaagtactgttacaatca

SEQ ID NO: 36972 - DNA, 25 bp, S. cerevisiae
gaggcgtctgaacctttcaaaacct

SEQ ID NO: 36973 - DNA, 25 bp, S. cerevisiae
gaggcgttacaacatttgcaaactt

SEQ ID NO: 36974 - DNA, 25 bp, S. cerevisiae
gaggcgcttagcacgtggatcaaag

SEQ ID NO: 36975 - DNA, 25 bp, S. cerevisiae
gaggccaatggcactgtcgtatcat

SEQ ID NO: 36976 - DNA, 25 bp, S. cerevisiae
gaggcgaatcgctctgatcaactat

SEQ ID NO: 36977 - DNA, 25 bp, S. cerevisiae
gaggcagaacctgtatcacaattca

SEQ ID NO: 36978 - DNA, 25 bp, S. cerevisiae
gatggtaccggttaagcgattataa

SEQ ID NO: 36979 - DNA, 25 bp, S. cerevisiae
gatggaatctcgacttaggcgaagt

SEQ ID NO: 36980 - DNA, 25 bp, S. cerevisiae
gatgagatttgcacctcgggacagg

SEQ ID NO: 36981 - DNA, 25 bp, S. cerevisiae
gaggcactactggtttgatgggcaa

SEQ ID NO: 36982 - DNA, 25 bp, S. cerevisiae
gaggccaccaagattgtcgagcaat

SEQ ID NO: 36983 - DNA, 25 bp, S. cerevisiae
gaggaacaccaacagatgcttgaca

SEQ ID NO: 36984 - DNA, 25 bp, S. cerevisiae
gatggttaaacccttcttggatcca

SEQ ID NO: 36985 - DNA, 25 bp, S. cerevisiae
gatgtgtttaactgttcttggcctt

SEQ ID NO: 36986 - DNA, 25 bp, S. cerevisiae
gaggcacctctatactttcaactaa

SEQ ID NO: 36987 - DNA, 25 bp, S. cerevisiae
gaggaacctgaaattttagcaccaa

SEQ ID NO: 36988 - DNA, 25 bp, S. cerevisiae
gaggaactccaaatttgtctgactt

SEQ ID NO: 36989 - DNA, 25 bp, S. cerevisiae
gaggaactcgctactttacaagatg

SEQ ID NO: 36990 - DNA, 25 bp, S. cerevisiae
gaggaattatctcccattacacaag

SEQ ID NO: 36991 - DNA, 25 bp, S. cerevisiae
gaggacactattccaatttgaaagt

SEQ ID NO: 36992 - DNA, 25 bp, S. cerevisiae
gaggacactccttcatatttgatgt

SEQ ID NO: 36993 - DNA, 25 bp, S. cerevisiae
gaggacttcctgtcaacatggttta

SEQ ID NO: 36994 - DNA, 25 bp, S. cerevisiae
gaggacattctcgtgcaagcagttt

SEQ ID NO: 36995 - DNA, 25 bp, S. cerevisiae
gaggctagtctcgttgatgcagatt

SEQ ID NO: 36996 - DNA, 25 bp, S. cerevisiae
gaggcttgacatttcgcacaatttt

SEQ ID NO: 36997 - DNA, 25 bp, S. cerevisiae
gatggccgcaaccatgataagactt

SEQ ID NO: 36998 - DNA, 25 bp, S. cerevisiae
gaggccgataagctacatttcataa

SEQ ID NO: 36999 - DNA, 25 bp, S. cerevisiae
gaggccatggaacgcataccattta

SEQ ID NO: 37000 - DNA, 25 bp, S. cerevisiae
gaggcagtctactatgctcctttaa

SEQ ID NO: 37001 - DNA, 25 bp, S. cerevisiae
gaggcttccagaactgtcatcgaat

SEQ ID NO: 37002 - DNA, 25 bp, S. cerevisiae
gaggcttgcaaaatcgcttggccag

SEQ ID NO: 37003 - DNA, 25 bp, S. cerevisiae
gaggctctcagactatatgctatgg

SEQ ID NO: 37004 - DNA, 25 bp, S. cerevisiae
gatgattggcatagggcctctgcag

SEQ ID NO: 37005 - DNA, 25 bp, S. cerevisiae
gatgaggccactctgcaacgcagga

SEQ ID NO: 37006 - DNA, 25 bp, S. cerevisiae
gatgacccagctgttaccaagaaac

SEQ ID NO: 37007 - DNA, 25 bp, S. cerevisiae
gatgtccaaatccttcccaggtaaa

SEQ ID NO: 37008 - DNA, 25 bp, S. cerevisiae
gatgtcaccaagcttacccgatgaa

SEQ ID NO: 37009 - DNA, 25 bp, S. cerevisiae
gatgaagcctccgttatcccaggtt

SEQ ID NO: 37010 - DNA, 25 bp, S. cerevisiae
gatgaccaaccattttacaagagtt

SEQ ID NO: 37011 - DNA, 25 bp, S. cerevisiae
gatggccaaccatgtatacaagact

SEQ ID NO: 37012 - DNA, 25 bp, S. cerevisiae
gaggctgataccgatgttgaaatga

SEQ ID NO: 37013 - DNA, 25 bp, S. cerevisiae
gatggccatcagtcaatttaacagc

SEQ ID NO: 37014 - DNA, 25 bp, S. cerevisiae
gaggctctcagacatttaccggaat

SEQ ID NO: 37015 - DNA, 25 bp, S. cerevisiae
gaggctcatccggatatttttacat

SEQ ID NO: 37016 - DNA, 25 bp, S. cerevisiae
gatgtttccgttattcattcggtga

SEQ ID NO: 37017 - DNA, 25 bp, S. cerevisiae
gaggctatcatgactctaagatcga

SEQ ID NO: 37018 - DNA, 25 bp, S. cerevisiae
gatggccatcagacctgtgaatgcc

SEQ ID NO: 37019 - DNA, 25 bp, S. cerevisiae
gatggcatgcaatcacgttgcgaat

SEQ ID NO: 37020 - DNA, 25 bp, S. cerevisiae
gatggtaacccattgcaagctcttc

SEQ ID NO: 37021 - DNA, 25 bp, S. cerevisiae
gatggccaacctttgatgctgatga

SEQ ID NO: 37022 - DNA, 25 bp, S. cerevisiae
gatggctatgacgtttgcagcgata

SEQ ID NO: 37023 - DNA, 25 bp, S. cerevisiae
gatgggagtactttacacaacgtga

SEQ ID NO: 37024 - DNA, 25 bp, S. cerevisiae
gaggcgtatacccagcagaagattt

SEQ ID NO: 37025 - DNA, 25 bp, S. cerevisiae
gaggccttctcccaggcaaatgtta

SEQ ID NO: 37026 - DNA, 25 bp, S. cerevisiae
gatggactgtctactcgcaaaatgt

SEQ ID NO: 37027 - DNA, 25 bp, S. cerevisiae
gatggcaagtgctatcactcaacaa

SEQ ID NO: 37028 - DNA, 25 bp, S. cerevisiae
gaggctctactcacatatttcgttg

SEQ ID NO: 37029 - DNA, 25 bp, S. cerevisiae
gatggcttattaaaactacgcgcag

SEQ ID NO: 37030 - DNA, 25 bp, S. cerevisiae
gatgggatcattcaacttcctgctt

SEQ ID NO: 37031 - DNA, 25 bp, S. cerevisiae
gatggagtcgagaacacacccgttg

SEQ ID NO: 37032 - DNA, 25 bp, S. cerevisiae
gatgacctcgggaacaccggatttt

SEQ ID NO: 37033 - DNA, 25 bp, S. cerevisiae
gatgaacacccgcattctagtttga

SEQ ID NO: 37034 - DNA, 25 bp, S. cerevisiae
gatgaaacctgccaaattcactccg

SEQ ID NO: 37035 - DNA, 25 bp, S. cerevisiae
gatgaccatgtatccaaactcaccc

SEQ ID NO: 37036 - DNA, 25 bp, S. cerevisiae
gatgatccctttacaaagttccaca

SEQ ID NO: 37037 - DNA, 25 bp, S. cerevisiae
gatgggtttccaataggcctacaag

SEQ ID NO: 37038 - DNA, 25 bp, S. cerevisiae
gatggtgctttctacggtccaaaga

SEQ ID NO: 37039 - DNA, 25 bp, S. cerevisiae
gatgggtttatgaagctctccgaag

SEQ ID NO: 37040 - DNA, 25 bp, S. cerevisiae
gaggcagcgaaactgtctccatcga

SEQ ID NO: 37041 - DNA, 25 bp, S. cerevisiae
gaggcggtttcggtcgcaacaacaa

SEQ ID NO: 37042 - DNA, 25 bp, S. cerevisiae
gaggcggttcattcgctgaaactac

SEQ ID NO: 37043 - DNA, 25 bp, S. cerevisiae
gaggcgaattctccagcggatacat

SEQ ID NO: 37044 - DNA, 25 bp, S. cerevisiae
gaggcgacgcaacagcggtatctct

SEQ ID NO: 37045 - DNA, 25 bp, S. cerevisiae
gaggcatacgaccttcttttcgtca

SEQ ID NO: 37046 - DNA, 25 bp, S. cerevisiae
gatggcaaggtttcttttcgagata

SEQ ID NO: 37047 - DNA, 25 bp, S. cerevisiae
gatgttcagggcactttccatgagt

SEQ ID NO: 37048 - DNA, 25 bp, S. cerevisiae
gaggcatttaactccggctgtggaa

SEQ ID NO: 37049 - DNA, 25 bp, S. cerevisiae
gaggctaccgaccacttttgaagaa

SEQ ID NO: 37050 - DNA, 25 bp, S. cerevisiae
gatggcaaacctgctttacttttca

SEQ ID NO: 37051 - DNA, 25 bp, S. cerevisiae
gatggctcaccaggatattccaaag

SEQ ID NO: 37052 - DNA, 25 bp, S. cerevisiae
gaggcgcacgaggatagttcaagaa

SEQ ID NO: 37053 - DNA, 25 bp, S. cerevisiae
gaggccatcgccaacagagatcaaa

SEQ ID NO: 37054 - DNA, 25 bp, S. cerevisiae
gaggcatttctcaagtatctgacca

SEQ ID NO: 37055 - DNA, 25 bp, S. cerevisiae
gaggcatctccaagtctttacattg

SEQ ID NO: 37056 - DNA, 25 bp, S. cerevisiae
gatggcttctttatccactcaatgt

SEQ ID NO: 37057 - DNA, 25 bp, S. cerevisiae
gatggtcttattattcctggattat

SEQ ID NO: 37058 - DNA, 25 bp, S. cerevisiae
gaggcctttactgggatctatctgg

SEQ ID NO: 37059 - DNA, 25 bp, S. cerevisiae
gaggcgttccaatggttatctcaat

SEQ ID NO: 37060 - DNA, 25 bp, S. cerevisiae
gatggcgtttcttctgagttggtaa

SEQ ID NO: 37061 - DNA, 25 bp, S. cerevisiae
gatgggttagctccatttcatggta

SEQ ID NO: 37062 - DNA, 25 bp, S. cerevisiae
gatggtaagaccgttgttattcaat

SEQ ID NO: 37063 - DNA, 25 bp, S. cerevisiae
gatgatgactcctcccttaaatata

SEQ ID NO: 37064 - DNA, 25 bp, S. cerevisiae
gaggcgcagaagctagaacacgact

SEQ ID NO: 37065 - DNA, 25 bp, S. cerevisiae
gaggctacagactttatactggatt

SEQ ID NO: 37066 - DNA, 25 bp, S. cerevisiae
gaggccggtgtcgatttgtgtaaac

SEQ ID NO: 37067 - DNA, 25 bp, S. cerevisiae
gaggctttttgaacactgcattgca

SEQ ID NO: 37068 - DNA, 25 bp, S. cerevisiae
gaggccttgcttcgtatcattgata

SEQ ID NO: 37069 - DNA, 25 bp, S. cerevisiae
gaggccattgtctcgaaagaatagc

SEQ ID NO: 37070 - DNA, 25 bp, S. cerevisiae
gaggctattgactcgttaattgaaa

SEQ ID NO: 37071 - DNA, 25 bp, S. cerevisiae
gaggctcagcgtgacagtgcagata

SEQ ID NO: 37072 - DNA, 25 bp, S. cerevisiae
gaggccacattaagggcgtgcttac

SEQ ID NO: 37073 - DNA, 25 bp, S. cerevisiae
gaggccatgactaagggcactccaa

SEQ ID NO: 37074 - DNA, 25 bp, S. cerevisiae
gatgagtctgacttgggcaggccca

SEQ ID NO: 37075 - DNA, 25 bp, S. cerevisiae
gatgacttcaccagtgaggctgaca

SEQ ID NO: 37076 - DNA, 25 bp, S. cerevisiae
gatgacaacgacaccagcagcgaat

SEQ ID NO: 37077 - DNA, 25 bp, S. cerevisiae
gatgacgactacaccaaagttctga

SEQ ID NO: 37078 - DNA, 25 bp, S. cerevisiae
gatgaggaaaattcaccaggtgtta

SEQ ID NO: 37079 - DNA, 25 bp, S. cerevisiae
gatgagtacaacataaacgcgtcaa

SEQ ID NO: 37080 - DNA, 25 bp, S. cerevisiae
gatgaactccaccaagaactgggaa

SEQ ID NO: 37081 - DNA, 25 bp, S. cerevisiae
gatgaacgctcctcagaaacctgaa

SEQ ID NO: 37082 - DNA, 25 bp, S. cerevisiae
gatgtgcctcgaagtgggagcttac

SEQ ID NO: 37083 - DNA, 25 bp, S. cerevisiae
gaggctcttcattatctccggataa

SEQ ID NO: 37084 - DNA, 25 bp, S. cerevisiae
gatcgcaccgcggtacttggaaagg

SEQ ID NO: 37085 - DNA, 25 bp, S. cerevisiae
gatcccagcctggttcttaaaccgt

SEQ ID NO: 37086 - DNA, 25 bp, S. cerevisiae
gatgttccgtttataactacccaat

SEQ ID NO: 37087 - DNA, 25 bp, S. cerevisiae
gatgttagaaagatctcctacccga

SEQ ID NO: 37088 - DNA, 25 bp, S. cerevisiae
gatatttaagaatccgccgtccttt

SEQ ID NO: 37089 - DNA, 25 bp, S. cerevisiae
gatgtttacagaggtccaggcccgc

SEQ ID NO: 37090 - DNA, 25 bp, S. cerevisiae
gatggttacgagctcacaatctaca

SEQ ID NO: 37091 - DNA, 25 bp, S. cerevisiae
gatggcgtaccaactatcaattaca

SEQ ID NO: 37092 - DNA, 25 bp, S. cerevisiae
gatgtggctaatcctaatagctcta

SEQ ID NO: 37093 - DNA, 25 bp, S. cerevisiae
gatgtgttatatccgaggagcttta

SEQ ID NO: 37094 - DNA, 25 bp, S. cerevisiae
gatggtactttccagttcaatttca

SEQ ID NO: 37095 - DNA, 25 bp, S. cerevisiae
gatgtgtcagtctcgagtgtcaagc

SEQ ID NO: 37096 - DNA, 25 bp, S. cerevisiae
gatggtagtgcctctttacatacaa

SEQ ID NO: 37097 - DNA, 25 bp, S. cerevisiae
gatgccgagccccagtttaaagaag

SEQ ID NO: 37098 - DNA, 25 bp, S. cerevisiae
gttcgtcgatcccaggtagcaaata

SEQ ID NO: 37099 - DNA, 25 bp, S. cerevisiae
gatttacgctcctgggacaaatgga

SEQ ID NO: 37100 - DNA, 25 bp, S. cerevisiae
gatgaaaacgtctggagaactccta

SEQ ID NO: 37101 - DNA, 25 bp, S. cerevisiae
gatgtttccttcaatggttcctact

SEQ ID NO: 37102 - DNA, 25 bp, S. cerevisiae
gatgttatcatttccgagaccggca

SEQ ID NO: 37103 - DNA, 25 bp, S. cerevisiae
gatggtactccaatgcaaccactat

SEQ ID NO: 37104 - DNA, 25 bp, S. cerevisiae
gatggctagtacatccaatgatgaa

SEQ ID NO: 37105 - DNA, 25 bp, S. cerevisiae
gatgccatagtagatcccaaatgcc

SEQ ID NO: 37106 - DNA, 25 bp, S. cerevisiae
gatggccatcaaattcgcagcaaag

SEQ ID NO: 37107 - DNA, 25 bp, S. cerevisiae
gatggccatgaatttccgagagcaa

SEQ ID NO: 37108 - DNA, 25 bp, S. cerevisiae
gatggttcgatgttagcggcagcaa

SEQ ID NO: 37109 - DNA, 25 bp, S. cerevisiae
gatggcggattgtttcctgttaaca

SEQ ID NO: 37110 - DNA, 25 bp, S. cerevisiae
gatggccgcccagtatattttgaag

SEQ ID NO: 37111 - DNA, 25 bp, S. cerevisiae
gaggccgcatcttgtaatttgctaa

SEQ ID NO: 37112 - DNA, 25 bp, S. cerevisiae
gaggccgatttgaactctgagcaaa

SEQ ID NO: 37113 - DNA, 25 bp, S. cerevisiae
gatggccggtaaagcttctgaattt

SEQ ID NO: 37114 - DNA, 25 bp, S. cerevisiae
gaggccagtgtgaaacttgatttac

SEQ ID NO: 37115 - DNA, 25 bp, S. cerevisiae
gatggagcaagcaactcctcttctt

SEQ ID NO: 37116 - DNA, 25 bp, S. cerevisiae
gatggagaatccagcacttgctcaa

SEQ ID NO: 37117 - DNA, 25 bp, S. cerevisiae
gatgtagacccaacactttcagtag

SEQ ID NO: 37118 - DNA, 25 bp, S. cerevisiae
gattagacgctcaggccattaagga

SEQ ID NO: 37119 - DNA, 25 bp, S. cerevisiae
gtattacgttatgacttaggcggaa

SEQ ID NO: 37120 - DNA, 25 bp, S. cerevisiae
gatttactgttatacttcgggcctt

SEQ ID NO: 37121 - DNA, 25 bp, S. cerevisiae
gtgtagtcagggtataaacgttcct

SEQ ID NO: 37122 - DNA, 25 bp, S. cerevisiae
gatgttgtcgggtttatacctaccg

SEQ ID NO: 37123 - DNA, 25 bp, S. cerevisiae
gatggtgtcattggttctagaacta

SEQ ID NO: 37124 - DNA, 25 bp, S. cerevisiae
gatggaacttccttgaccataatca

SEQ ID NO: 37125 - DNA, 25 bp, S. cerevisiae
gatggtactatctctgccttaggat

SEQ ID NO: 37126 - DNA, 25 bp, S. cerevisiae
gatggctcacaactgacatacttag

SEQ ID NO: 37127 - DNA, 25 bp, S. cerevisiae
gatgttgcatacctactgaagtcag

SEQ ID NO: 37128 - DNA, 25 bp, S. cerevisiae
gatgtatgcaaccagtagtcgtcca

SEQ ID NO: 37129 - DNA, 25 bp, S. cerevisiae
gaggccacagagtacgctgtatccg

SEQ ID NO: 37130 - DNA, 25 bp, S. cerevisiae
gatgatctccgaaggcgttattggc

SEQ ID NO: 37131 - DNA, 25 bp, S. cerevisiae
gatgaccgcgacaggattaccacga

SEQ ID NO: 37132 - DNA, 25 bp, S. cerevisiae
gataccaccttctgttactcaggag

SEQ ID NO: 37133 - DNA, 25 bp, S. cerevisiae
gatgaaaccttctgtaatgctctag

SEQ ID NO: 37134 - DNA, 25 bp, S. cerevisiae
gatgaaacgcatcccttaattgtgg

SEQ ID NO: 37135 - DNA, 25 bp, S. cerevisiae
gatggacaccacgttatatgagctg

SEQ ID NO: 37136 - DNA, 25 bp, S. cerevisiae
gatggacaccacaacaagctatgct

SEQ ID NO: 37137 - DNA, 25 bp, S. cerevisiae
gatgtcaccacattagcagcttcaa

SEQ ID NO: 37138 - DNA, 25 bp, S. cerevisiae
gatgtcaagtcttccagtgggacct

SEQ ID NO: 37139 - DNA, 25 bp, S. cerevisiae
gatcttttctcacactggaactcaa

SEQ ID NO: 37140 - DNA, 25 bp, S. cerevisiae
gatgttttagaatgccccatgctag

SEQ ID NO: 37141 - DNA, 25 bp, S. cerevisiae
gatgagactttgtacacacccacta

SEQ ID NO: 37142 - DNA, 25 bp, S. cerevisiae
gatggacttaatcactgcacctgaa

SEQ ID NO: 37143 - DNA, 25 bp, S. cerevisiae
gatagttcaagtgtcgacgctgcgg

SEQ ID NO: 37144 - DNA, 25 bp, S. cerevisiae
gatggaaatcgccaatccttccgaa

SEQ ID NO: 37145 - DNA, 25 bp, S. cerevisiae
gatggtggctcgtacttagttttaa

SEQ ID NO: 37146 - DNA, 25 bp, S. cerevisiae
gatggtgcacctgatgttactgggt

SEQ ID NO: 37147 - DNA, 25 bp, S. cerevisiae
gatggagcacctgatatgacgtctg

SEQ ID NO: 37148 - DNA, 25 bp, S. cerevisiae
gatggtatcgcaaccagtcctgaaa

SEQ ID NO: 37149 - DNA, 25 bp, S. cerevisiae
gatggcgaagcaacctctgcggaaa

SEQ ID NO: 37150 - DNA, 25 bp, S. cerevisiae
gatccaacactattctcagggacga

SEQ ID NO: 37151 - DNA, 25 bp, S. cerevisiae
gatgtgtatcatcaacagaagcaga

SEQ ID NO: 37152 - DNA, 25 bp, S. cerevisiae
gatgtgccgcatgatagcctcatat

SEQ ID NO: 37153 - DNA, 25 bp, S. cerevisiae
gatggcttgtgtgcagctaatccaa

SEQ ID NO: 37154 - DNA, 25 bp, S. cerevisiae
gatggctctgtaatagttgcacgaa

SEQ ID NO: 37155 - DNA, 25 bp, S. cerevisiae
gatggctctgttatcgtcactgaaa

SEQ ID NO: 37156 - DNA, 25 bp, S. cerevisiae
gatggcttaaaaattcagctaacag

SEQ ID NO: 37157 - DNA, 25 bp, S. cerevisiae
gatgggtacaactctcaggactcag

SEQ ID NO: 37158 - DNA, 25 bp, S. cerevisiae
gtaggtataacccacattttgcatg

SEQ ID NO: 37159 - DNA, 25 bp, S. cerevisiae
gataggattatcacccagtaccatg

SEQ ID NO: 37160 - DNA, 25 bp, S. cerevisiae
gatgacgttgtcatcccaacctatg

SEQ ID NO: 37161 - DNA, 25 bp, S. cerevisiae
gatgacgagggttcattcgcacaag

SEQ ID NO: 37162 - DNA, 25 bp, S. cerevisiae
gatggtaagtttatctccacattta

SEQ ID NO: 37163 - DNA, 25 bp, S. cerevisiae
gatggatgtttttctcactctacaa

SEQ ID NO: 37164 - DNA, 25 bp, S. cerevisiae
gatggcctcttctttagcagttgaa

SEQ ID NO: 37165 - DNA, 25 bp, S. cerevisiae
gatggcatcttctactaatgaggaa

SEQ ID NO: 37166 - DNA, 25 bp, S. cerevisiae
gatgtgtctgtctgaatacttccgg

SEQ ID NO: 37167 - DNA, 25 bp, S. cerevisiae
gatgtgacgagctcaaactttcaaa

SEQ ID NO: 37168 - DNA, 25 bp, S. cerevisiae
gatggtaccacgatttttgcaggaa

SEQ ID NO: 37169 - DNA, 25 bp, S. cerevisiae
gatggtgttcaggtttccttctatt

SEQ ID NO: 37170 - DNA, 25 bp, S. cerevisiae
gatgatgttgttgctggttcgacta

SEQ ID NO: 37171 - DNA, 25 bp, S. cerevisiae
gatgatgcttcgagtggatacgtta

SEQ ID NO: 37172 - DNA, 25 bp, S. cerevisiae
gatggtctcgtgtgcgcaagacatt

SEQ ID NO: 37173 - DNA, 25 bp, S. cerevisiae
gatggtaggtgttccattacttttt

SEQ ID NO: 37174 - DNA, 25 bp, S. cerevisiae
gatggctttttgtacataactcttg

SEQ ID NO: 37175 - DNA, 25 bp, S. cerevisiae
gatgtctccattagccaagtactca

SEQ ID NO: 37176 - DNA, 25 bp, S. cerevisiae
gatgatcaataaccgtactcctcac

SEQ ID NO: 37177 - DNA, 25 bp, S. cerevisiae
gatgtgcttaagacatctccccttc

SEQ ID NO: 37178 - DNA, 25 bp, S. cerevisiae
gatggtttctcataacagcgttgat

SEQ ID NO: 37179 - DNA, 25 bp, S. cerevisiae
gatggatttccaacgatgacagctt

SEQ ID NO: 37180 - DNA, 25 bp, S. cerevisiae
gatggcattatctttctgtggtgtt

SEQ ID NO: 37181 - DNA, 25 bp, S. cerevisiae
gatgcctttttgtttggtattccaa

SEQ ID NO: 37182 - DNA, 25 bp, S. cerevisiae
gatgggtttcgaatttttggctcag

SEQ ID NO: 37183 - DNA, 25 bp, S. cerevisiae
gatggcaaatgatgctgctttatta

SEQ ID NO: 37184 - DNA, 25 bp, S. cerevisiae
gatggcaaatgtcctatctgcgact

SEQ ID NO: 37185 - DNA, 25 bp, S. cerevisiae
gatggacatcttacatttgcagact

SEQ ID NO: 37186 - DNA, 25 bp, S. cerevisiae
gatggaacgttctttgcacgattct

SEQ ID NO: 37187 - DNA, 25 bp, S. cerevisiae
gatgtcaatggccagcagatctttt

SEQ ID NO: 37188 - DNA, 25 bp, S. cerevisiae
gatgacatgggcctcaaagttgatg

SEQ ID NO: 37189 - DNA, 25 bp, S. cerevisiae
gatggtcaatcttttaatgggtctg

SEQ ID NO: 37190 - DNA, 25 bp, S. cerevisiae
gatggtagtcttttatatgccgtga

SEQ ID NO: 37191 - DNA, 25 bp, S. cerevisiae
gatggttttcacttatctcgcagat

SEQ ID NO: 37192 - DNA, 25 bp, S. cerevisiae
gatgtattctttcctccaaatcgaa

SEQ ID NO: 37193 - DNA, 25 bp, S. cerevisiae
gatggtgatgctttgccgacatatc

SEQ ID NO: 37194 - DNA, 25 bp, S. cerevisiae
gatggtgagccattgccgaacgttc

SEQ ID NO: 37195 - DNA, 25 bp, S. cerevisiae
gatgtcatcgaatccatttctttca

SEQ ID NO: 37196 - DNA, 25 bp, S. cerevisiae
gatgtcaaacccatttctattgaag

SEQ ID NO: 37197 - DNA, 25 bp, S. cerevisiae
gatctggatttcttgggttccgata

SEQ ID NO: 37198 - DNA, 25 bp, S. cerevisiae
gatggttttgcaacattcattccaa

SEQ ID NO: 37199 - DNA, 25 bp, S. cerevisiae
gatggctatctgatcacacacgagt

SEQ ID NO: 37200 - DNA, 25 bp, S. cerevisiae
gatggcttatgtaccaccgatcaac

SEQ ID NO: 37201 - DNA, 25 bp, S. cerevisiae
gatgggcgtcgttactttacaagca

SEQ ID NO: 37202 - DNA, 25 bp, S. cerevisiae
gatggacttcttttgcgtttaatac

SEQ ID NO: 37203 - DNA, 25 bp, S. cerevisiae
gatggaagctcatgttctcgttctt

SEQ ID NO: 37204 - DNA, 25 bp, S. cerevisiae
gatggatgcctctagttggcgtttt

SEQ ID NO: 37205 - DNA, 25 bp, S. cerevisiae
gatggtgtcacttacgtagatgtta

SEQ ID NO: 37206 - DNA, 25 bp, S. cerevisiae
gatggtgccaatgacctcggattca

SEQ ID NO: 37207 - DNA, 25 bp, S. cerevisiae
gatgtgctactagacgctcttgaat

SEQ ID NO: 37208 - DNA, 25 bp, S. cerevisiae
gatgtttccagacggctcaatcaaa

SEQ ID NO: 37209 - DNA, 25 bp, S. cerevisiae
gatggtccactgcaggtatatgcca

SEQ ID NO: 37210 - DNA, 25 bp, S. cerevisiae
gatggcttccgtcgttattgagcaa

SEQ ID NO: 37211 - DNA, 25 bp, S. cerevisiae
gatggcttccagtagttcgttaagt

SEQ ID NO: 37212 - DNA, 25 bp, S. cerevisiae
gatggcttcactgcagtactaacaa

SEQ ID NO: 37213 - DNA, 25 bp, S. cerevisiae
gatgtcctcacaagcgcaacgaatt

SEQ ID NO: 37214 - DNA, 25 bp, S. cerevisiae
gatggcagccacaacaaatcggtct

SEQ ID NO: 37215 - DNA, 25 bp, S. cerevisiae
gatgcgccaaaccaaacttctgaag

SEQ ID NO: 37216 - DNA, 25 bp, S. cerevisiae
gatggtgcaaatcgcgaactcgtaa

SEQ ID NO: 37217 - DNA, 25 bp, S. cerevisiae
gatggatccaattaatgactcgtta

SEQ ID NO: 37218 - DNA, 25 bp, S. cerevisiae
gatggatccaattactagcaagcgt

SEQ ID NO: 37219 - DNA, 25 bp, S. cerevisiae
gatggaacttttgcattctggtttt

SEQ ID NO: 37220 - DNA, 25 bp, S. cerevisiae
gatggaatcttcaattttcggtaac

SEQ ID NO: 37221 - DNA, 25 bp, S. cerevisiae
gatgatgttttatatctacggctag

SEQ ID NO: 37222 - DNA, 25 bp, S. cerevisiae
gatgtgtattataaattctgagtct

SEQ ID NO: 37223 - DNA, 25 bp, S. cerevisiae
gatgtgccattagggttcggtgtca

SEQ ID NO: 37224 - DNA, 25 bp, S. cerevisiae
gatgtgctctttgggtgtcatcgta

SEQ ID NO: 37225 - DNA, 25 bp, S. cerevisiae
gatgtcaggataaaggtcttactta

SEQ ID NO: 37226 - DNA, 25 bp, S. cerevisiae
gatgatatcccacagttacttgatg

SEQ ID NO: 37227 - DNA, 25 bp, S. cerevisiae
gatgatccacgctacctagagatag

SEQ ID NO: 37228 - DNA, 25 bp, S. cerevisiae
gatgtcatcaagtctgtcatgcaaa

SEQ ID NO: 37229 - DNA, 25 bp, S. cerevisiae
gatgtccgataagcatgccacagta

SEQ ID NO: 37230 - DNA, 25 bp, S. cerevisiae
gatgtctctgaagccgtcaagcata

SEQ ID NO: 37231 - DNA, 25 bp, S. cerevisiae
gatgtcgaagctgatggccaaccaa

SEQ ID NO: 37232 - DNA, 25 bp, S. cerevisiae
gatgttgaactgatccattacgaga

SEQ ID NO: 37233 - DNA, 25 bp, S. cerevisiae
gatggttacattacgctggacgaat

SEQ ID NO: 37234 - DNA, 25 bp, S. cerevisiae
gatgtagtcactgcagctattcaaa

SEQ ID NO: 37235 - DNA, 25 bp, S. cerevisiae
gatgtcattgttgccatattcccag

SEQ ID NO: 37236 - DNA, 25 bp, S. cerevisiae
gatggtatcatcaacgtatctgccg

SEQ ID NO: 37237 - DNA, 25 bp, S. cerevisiae
gatgtggtcatcaacgttgctgaag

SEQ ID NO: 37238 - DNA, 25 bp, S. cerevisiae
gatggttctgcaattgcctctgaat

SEQ ID NO: 37239 - DNA, 25 bp, S. cerevisiae
gatggacattcacacctctgagatg

SEQ ID NO: 37240 - DNA, 25 bp, S. cerevisiae
gatggaccatcaagatcactcagaa

SEQ ID NO: 37241 - DNA, 25 bp, S. cerevisiae
gatgataccacagctactccaaaga

SEQ ID NO: 37242 - DNA, 25 bp, S. cerevisiae
gatgaagccgatgtatttgcacaaa

SEQ ID NO: 37243 - DNA, 25 bp, S. cerevisiae
gatgataccgctattgtgtccatga

SEQ ID NO: 37244 - DNA, 25 bp, S. cerevisiae
gatgttgtcgctactaaatggcatg

SEQ ID NO: 37245 - DNA, 25 bp, S. cerevisiae
gatggtgtcagccactcacaagaga

SEQ ID NO: 37246 - DNA, 25 bp, S. cerevisiae
gatggatgagcaactgtctcgtgaa

SEQ ID NO: 37247 - DNA, 25 bp, S. cerevisiae
gatggatgtcctaccttcatgggaa

SEQ ID NO: 37248 - DNA, 25 bp, S. cerevisiae
gatctattccatgttttgggacttg

SEQ ID NO: 37249 - DNA, 25 bp, S. cerevisiae
gatgtcaaccatattttaggcctgt

SEQ ID NO: 37250 - DNA, 25 bp, S. cerevisiae
gatgttacctttgatatcgacgcta

SEQ ID NO: 37251 - DNA, 25 bp, S. cerevisiae
gatgatttccacatttcacgacggt

SEQ ID NO: 37252 - DNA, 25 bp, S. cerevisiae
gatggtctcccattattacgaggca

SEQ ID NO: 37253 - DNA, 25 bp, S. cerevisiae
gatggtccctgttatttctgatgaa

SEQ ID NO: 37254 - DNA, 25 bp, S. cerevisiae
gatggataccggtacctctaatagc

SEQ ID NO: 37255 - DNA, 25 bp, S. cerevisiae
gatggtaccggtgctctagaattcc

SEQ ID NO: 37256 - DNA, 25 bp, S. cerevisiae
gatgggcactccaattggtattcaa

SEQ ID NO: 37257 - DNA, 25 bp, S. cerevisiae
gatgatgacatcgacatggattcta

SEQ ID NO: 37258 - DNA, 25 bp, S. cerevisiae
gatgtggcagccaaagatcccagac

SEQ ID NO: 37259 - DNA, 25 bp, S. cerevisiae
gatgtcagtgatgcaagatccgcta

SEQ ID NO: 37260 - DNA, 25 bp, S. cerevisiae
gatgatcgatgttccaatgacgcta

SEQ ID NO: 37261 - DNA, 25 bp, S. cerevisiae
gatgatctggttcaatgcacggctt

SEQ ID NO: 37262 - DNA, 25 bp, S. cerevisiae
gatgatgcggaaactgcaagccttt

SEQ ID NO: 37263 - DNA, 25 bp, S. cerevisiae
gatgatgtggtgaaaaagccttctc

SEQ ID NO: 37264 - DNA, 25 bp, S. cerevisiae
gatgagcctaaactatacttattga

SEQ ID NO: 37265 - DNA, 25 bp, S. cerevisiae
gatgtgttgagttctacctgtagga

SEQ ID NO: 37266 - DNA, 25 bp, S. cerevisiae
gatgtcccatatggtaccagctcag

SEQ ID NO: 37267 - DNA, 25 bp, S. cerevisiae
gatgtccacgagctaccatctaaat

SEQ ID NO: 37268 - DNA, 25 bp, S. cerevisiae
gatgatgccagggtttgccatgcca

SEQ ID NO: 37269 - DNA, 25 bp, S. cerevisiae
gatgatgacgaactgatccctgcgc

SEQ ID NO: 37270 - DNA, 25 bp, S. cerevisiae
gatgatgacaaagacccctgctggg

SEQ ID NO: 37271 - DNA, 25 bp, S. cerevisiae
gatgtaatagctacagagccccagg

SEQ ID NO: 37272 - DNA, 25 bp, S. cerevisiae
gatgtcttagtaaattcctccgata

SEQ ID NO: 37273 - DNA, 25 bp, S. cerevisiae
gatgtcttcattaaactccgcgtat

SEQ ID NO: 37274 - DNA, 25 bp, S. cerevisiae
gatggatatccacagcagcaacctt

SEQ ID NO: 37275 - DNA, 25 bp, S. cerevisiae
gatgttttctttttctcctgaatat

SEQ ID NO: 37276 - DNA, 25 bp, S. cerevisiae
gatgtctgtggtatctgtcgtgcca

SEQ ID NO: 37277 - DNA, 25 bp, S. cerevisiae
gatgtctctgatattcttcgggtgc

SEQ ID NO: 37278 - DNA, 25 bp, S. cerevisiae
gatgtgccaatactcttttgggctt

SEQ ID NO: 37279 - DNA, 25 bp, S. cerevisiae
gatgtcacactacctcttggtgaga

SEQ ID NO: 37280 - DNA, 25 bp, S. cerevisiae
gatgggccatgatcaatctggaaca

SEQ ID NO: 37281 - DNA, 25 bp, S. cerevisiae
gatgtgagcctttcaatgcggtttg

SEQ ID NO: 37282 - DNA, 25 bp, S. cerevisiae
gatgtacacatttgacaggctggtc

SEQ ID NO: 37283 - DNA, 25 bp, S. cerevisiae
gatgaatgtcatcaacggcgtggaa

SEQ ID NO: 37284 - DNA, 25 bp, S. cerevisiae
gatgaccatggacggtgaaaccaaa

SEQ ID NO: 37285 - DNA, 25 bp, S. cerevisiae
gatgactcggagcagatagaactta

SEQ ID NO: 37286 - DNA, 25 bp, S. cerevisiae
gatgtatggctcgaaatttattcct

SEQ ID NO: 37287 - DNA, 25 bp, S. cerevisiae
gatgtggagcctaaatatttcgaaa

SEQ ID NO: 37288 - DNA, 25 bp, S. cerevisiae
gatggtttcgaagatctgcttgcaa

SEQ ID NO: 37289 - DNA, 25 bp, S. cerevisiae
gatgagtttgcctgaacatgcttca

SEQ ID NO: 37290 - DNA, 25 bp, S. cerevisiae
gatgatataagcacggccgcttctt

SEQ ID NO: 37291 - DNA, 25 bp, S. cerevisiae
gatggtaaactgcttgctactgcct

SEQ ID NO: 37292 - DNA, 25 bp, S. cerevisiae
gatgcggcccgtgaatactttgaag

SEQ ID NO: 37293 - DNA, 25 bp, S. cerevisiae
gatggtgacgatgcttctttatcag

SEQ ID NO: 37294 - DNA, 25 bp, S. cerevisiae
gatggtgtcccaatttttgctggaa

SEQ ID NO: 37295 - DNA, 25 bp, S. cerevisiae
gatgtgctgggcgaattgccctcta

SEQ ID NO: 37296 - DNA, 25 bp, S. cerevisiae
gatggtgttgctgatggctccatga

SEQ ID NO: 37297 - DNA, 25 bp, S. cerevisiae
gatgggtcttccacagataattcaa

SEQ ID NO: 37298 - DNA, 25 bp, S. cerevisiae
gatgggtgaccaatacgtgcgaaac

SEQ ID NO: 37299 - DNA, 25 bp, S. cerevisiae
gatggtgaaacaaccgatgccaacg

SEQ ID NO: 37300 - DNA, 25 bp, S. cerevisiae
gatggtaagctcatcatgctttcaa

SEQ ID NO: 37301 - DNA, 25 bp, S. cerevisiae
gatgaattgagaaacgccgcttggt

SEQ ID NO: 37302 - DNA, 25 bp, S. cerevisiae
gatgatattactatcccggtggctc

SEQ ID NO: 37303 - DNA, 25 bp, S. cerevisiae
gattctttagtacccgaccaggaca

SEQ ID NO: 37304 - DNA, 25 bp, S. cerevisiae
gatgtttcattgcacccggtgggaa

SEQ ID NO: 37305 - DNA, 25 bp, S. cerevisiae
gattttgcccaagcccgtgaatgaa

SEQ ID NO: 37306 - DNA, 25 bp, S. cerevisiae
gatccaattttccttgttgtcggtt

SEQ ID NO: 37307 - DNA, 25 bp, S. cerevisiae
gatactaactcgttcttggtcgatg

SEQ ID NO: 37308 - DNA, 25 bp, S. cerevisiae
gatgtctccggttagtagtttcaac

SEQ ID NO: 37309 - DNA, 25 bp, S. cerevisiae
gatgtctcacgccaacaatcggtaa

SEQ ID NO: 37310 - DNA, 25 bp, S. cerevisiae
gatgttaccgaagacgtctctctat

SEQ ID NO: 37311 - DNA, 25 bp, S. cerevisiae
gatgttaaccgaagactatccgtcg

SEQ ID NO: 37312 - DNA, 25 bp, S. cerevisiae
gatgattaacctagctattcccggc

SEQ ID NO: 37313 - DNA, 25 bp, S. cerevisiae
gatgaatatactctttgggctaacg

SEQ ID NO: 37314 - DNA, 25 bp, S. cerevisiae
gatgacttcttgacttcgggccaac

SEQ ID NO: 37315 - DNA, 25 bp, S. cerevisiae
gatgtcttttacttggagcagccac

SEQ ID NO: 37316 - DNA, 25 bp, S. cerevisiae
gatgatccttctcaacaattggtga

SEQ ID NO: 37317 - DNA, 25 bp, S. cerevisiae
gatgatatgttctcaaattctggta

SEQ ID NO: 37318 - DNA, 25 bp, S. cerevisiae
gatgtggtaatcaagcagctatcat

SEQ ID NO: 37319 - DNA, 25 bp, S. cerevisiae
gatgttaaatcctcgaagtcgttag

SEQ ID NO: 37320 - DNA, 25 bp, S. cerevisiae
gatgctgaaaatgcaccgaactttt

SEQ ID NO: 37321 - DNA, 25 bp, S. cerevisiae
gatgttcacaggacgtttctttacg

SEQ ID NO: 37322 - DNA, 25 bp, S. cerevisiae
gatgatccaaaccacaatccgtttt

SEQ ID NO: 37323 - DNA, 25 bp, S. cerevisiae
gatgtacaccctaatcaacagtttt

SEQ ID NO: 37324 - DNA, 25 bp, S. cerevisiae
gatgtcatcacttaccaatcattgt

SEQ ID NO: 37325 - DNA, 25 bp, S. cerevisiae
gatgatcatcagttctcaaactttg

SEQ ID NO: 37326 - DNA, 25 bp, S. cerevisiae
gatgtcatcgatttttcagcactaa

SEQ ID NO: 37327 - DNA, 25 bp, S. cerevisiae
gatgtctgtgatattttcaccaagg

SEQ ID NO: 37328 - DNA, 25 bp, S. cerevisiae
gatgtttgtgatatcttcaccgaag

SEQ ID NO: 37329 - DNA, 25 bp, S. cerevisiae
gatgtctttgacactgtaccactga

SEQ ID NO: 37330 - DNA, 25 bp, S. cerevisiae
gatgatcttgctgaacgtttagctg

SEQ ID NO: 37331 - DNA, 25 bp, S. cerevisiae
gatgactcatctttgtacccaattc

SEQ ID NO: 37332 - DNA, 25 bp, S. cerevisiae
gatgacgaagcttcttacgtcccat

SEQ ID NO: 37333 - DNA, 25 bp, S. cerevisiae
gatgacgtcctttatgaccttgaca

SEQ ID NO: 37334 - DNA, 25 bp, S. cerevisiae
gatgacctaatttacactctgccac

SEQ ID NO: 37335 - DNA, 25 bp, S. cerevisiae
gatgagtaaacagccactcgtccca

SEQ ID NO: 37336 - DNA, 25 bp, S. cerevisiae
gatgatttaaatgacctagcccaaa

SEQ ID NO: 37337 - DNA, 25 bp, S. cerevisiae
gatgtcaaaacttacgtagccgcaa

SEQ ID NO: 37338 - DNA, 25 bp, S. cerevisiae
gatgttaagccatacctacctgaag

SEQ ID NO: 37339 - DNA, 25 bp, S. cerevisiae
gatgtacttggctttgacttatgat

SEQ ID NO: 37340 - DNA, 25 bp, S. cerevisiae
gatgttctgagtgctttggaccata

SEQ ID NO: 37341 - DNA, 25 bp, S. cerevisiae
gatgtgcattaagcttcggatgtga

SEQ ID NO: 37342 - DNA, 25 bp, S. cerevisiae
gatgaccctattgtcgatagcgata

SEQ ID NO: 37343 - DNA, 25 bp, S. cerevisiae
gatgttcctattgcgtggactgtac

SEQ ID NO: 37344 - DNA, 25 bp, S. cerevisiae
gatgttcctcgtgcggtgattaata

SEQ ID NO: 37345 - DNA, 25 bp, S. cerevisiae
gatgttgggacaattcgtggcagaa

SEQ ID NO: 37346 - DNA, 25 bp, S. cerevisiae
gatgtgggtgcaattgtccggaaat

SEQ ID NO: 37347 - DNA, 25 bp, S. cerevisiae
gatgacctagtcgttgtggatgcta

SEQ ID NO: 37348 - DNA, 25 bp, S. cerevisiae
gatgtcctgactgtgtagcggcttc

SEQ ID NO: 37349 - DNA, 25 bp, S. cerevisiae
gatgtcattatttctggctcttctc

SEQ ID NO: 37350 - DNA, 25 bp, S. cerevisiae
gatgtgcagtctttcaagtctcata

SEQ ID NO: 37351 - DNA, 25 bp, S. cerevisiae
gatgtcagactaacactgctgctaa

SEQ ID NO: 37352 - DNA, 25 bp, S. cerevisiae
gatgcagcagcagctatcggattga

SEQ ID NO: 37353 - DNA, 25 bp, S. cerevisiae
gatgacgacgattcggcattgagat

SEQ ID NO: 37354 - DNA, 25 bp, S. cerevisiae
gatgtcatcgtcctttatatccacg

SEQ ID NO: 37355 - DNA, 25 bp, S. cerevisiae
gatgattattcttcttctgcttcct

SEQ ID NO: 37356 - DNA, 25 bp, S. cerevisiae
gatgagtacttctacattacccacc

SEQ ID NO: 37357 - DNA, 25 bp, S. cerevisiae
gatgaaagttccactactccaactg

SEQ ID NO: 37358 - DNA, 25 bp, S. cerevisiae
gatgacacaatgactctactgactg

SEQ ID NO: 37359 - DNA, 25 bp, S. cerevisiae
gatgcggcagttgaaaagctacagg

SEQ ID NO: 37360 - DNA, 25 bp, S. cerevisiae
gatgatgccgttcgaaaagctgaga

SEQ ID NO: 37361 - DNA, 25 bp, S. cerevisiae
gatgttcataactattccagcagga

SEQ ID NO: 37362 - DNA, 25 bp, S. cerevisiae
gatgttcgaatgtttccgtagacta

SEQ ID NO: 37363 - DNA, 25 bp, S. cerevisiae
gatgtttgagtgcttccggagatta

SEQ ID NO: 37364 - DNA, 25 bp, S. cerevisiae
gatgtcttagtcatgatcactggtg

SEQ ID NO: 37365 - DNA, 25 bp, S. cerevisiae
gatgtccttacgtagactgcagcag

SEQ ID NO: 37366 - DNA, 25 bp, S. cerevisiae
gatgtccttgtcaaatattacgcga

SEQ ID NO: 37367 - DNA, 25 bp, S. cerevisiae
gatgatcctactattgtcaagccca

SEQ ID NO: 37368 - DNA, 25 bp, S. cerevisiae
gatgagaccagcgaaatttacctaa

SEQ ID NO: 37369 - DNA, 25 bp, S. cerevisiae
gatgattccactggttttaccgata

SEQ ID NO: 37370 - DNA, 25 bp, S. cerevisiae
gatgttctcgatatccttaacgaag

SEQ ID NO: 37371 - DNA, 25 bp, S. cerevisiae
gatgtcctggacaatttcttacaag

SEQ ID NO: 37372 - DNA, 25 bp, S. cerevisiae
gatgtccggaaaagcttctacagag

SEQ ID NO: 37373 - DNA, 25 bp, S. cerevisiae
gatgtcccagatgactcttctaaca

SEQ ID NO: 37374 - DNA, 25 bp, S. cerevisiae
gatgagccgatgactaccttttata

SEQ ID NO: 37375 - DNA, 25 bp, S. cerevisiae
gatgaggctgatccattccatgatt

SEQ ID NO: 37376 - DNA, 25 bp, S. cerevisiae
gatgtcaattcttgctatgcgataa

SEQ ID NO: 37377 - DNA, 25 bp, S. cerevisiae
gatgacgagcctggtgccgatgaac

SEQ ID NO: 37378 - DNA, 25 bp, S. cerevisiae
gatgacggcaccagcggatcaagat

SEQ ID NO: 37379 - DNA, 25 bp, S. cerevisiae
gatgctctgagagttgaagctccaa

SEQ ID NO: 37380 - DNA, 25 bp, S. cerevisiae
gatgttattttgaccttgaagcact

SEQ ID NO: 37381 - DNA, 25 bp, S. cerevisiae
gatgtaacttctaacttcacgcaat

SEQ ID NO: 37382 - DNA, 25 bp, S. cerevisiae
gatgctatgactacggcacctacga

SEQ ID NO: 37383 - DNA, 25 bp, S. cerevisiae
gatgatgatatcagcgagtacttcg

SEQ ID NO: 37384 - DNA, 25 bp, S. cerevisiae
gtgggatcgcagcagctacaacgac

SEQ ID NO: 37385 - DNA, 25 bp, S. cerevisiae
gatgaggtccacaatgctgacaatt

SEQ ID NO: 37386 - DNA, 25 bp, S. cerevisiae
gatgaagccacgacaggatcaatta

SEQ ID NO: 37387 - DNA, 25 bp, S. cerevisiae
gatgaacctgttatcgaagccgctc

SEQ ID NO: 37388 - DNA, 25 bp, S. cerevisiae
gatgatatccatcgcattgttaagg

SEQ ID NO: 37389 - DNA, 25 bp, S. cerevisiae
gatgattcagtacagctcttagcag

SEQ ID NO: 37390 - DNA, 25 bp, S. cerevisiae
gatgatgcgcatatgctaacattaa

SEQ ID NO: 37391 - DNA, 25 bp, S. cerevisiae
gatgatctgatgtctggaagttgga

SEQ ID NO: 37392 - DNA, 25 bp, S. cerevisiae
gatgttgaacttgatgatgtggaaa

SEQ ID NO: 37393 - DNA, 25 bp, S. cerevisiae
gatgatgagctctttcaagcgggaa

SEQ ID NO: 37394 - DNA, 25 bp, S. cerevisiae
gatgagcaatgctgccaacggtaaa

SEQ ID NO: 37395 - DNA, 25 bp, S. cerevisiae
gatgcagcgctagcaacgggtacaa

SEQ ID NO: 37396 - DNA, 25 bp, S. cerevisiae
gatgtttgcattgatgccgctgtca

SEQ ID NO: 37397 - DNA, 25 bp, S. cerevisiae
gatgctacttctgattccaatctcg

SEQ ID NO: 37398 - DNA, 25 bp, S. cerevisiae
gatgaacttgccgaatcaacgccgc

SEQ ID NO: 37399 - DNA, 25 bp, S. cerevisiae
gatgaacttcaattattaccagagg

SEQ ID NO: 37400 - DNA, 25 bp, S. cerevisiae
gatgactttcaatttttcggacttt

SEQ ID NO: 37401 - DNA, 25 bp, S. cerevisiae
gatgagtcccaatttttcaaccaag

SEQ ID NO: 37402 - DNA, 25 bp, S. cerevisiae
gatgttcccaattttatcaagtgca

SEQ ID NO: 37403 - DNA, 25 bp, S. cerevisiae
gatgttgaccaattttactcggaga

SEQ ID NO: 37404 - DNA, 25 bp, S. cerevisiae
gatgattcaaaacctctttccgtaa

SEQ ID NO: 37405 - DNA, 25 bp, S. cerevisiae
gatgttaatgatacttcttccttga

SEQ ID NO: 37406 - DNA, 25 bp, S. cerevisiae
gatgtttagggcatactctgctcca

SEQ ID NO: 37407 - DNA, 25 bp, S. cerevisiae
gatgttctaaagttcaccttcacag

SEQ ID NO: 37408 - DNA, 25 bp, S. cerevisiae
gatgtttccaaactactgttgcaag

SEQ ID NO: 37409 - DNA, 25 bp, S. cerevisiae
gatgtttccgacatatcgttatcga

SEQ ID NO: 37410 - DNA, 25 bp, S. cerevisiae
gatgcaaaccaggactcatggccta

SEQ ID NO: 37411 - DNA, 25 bp, S. cerevisiae
gatgcatgatgaccagccattctac

SEQ ID NO: 37412 - DNA, 25 bp, S. cerevisiae
gatgatgatgcacctcagaatcccc

SEQ ID NO: 37413 - DNA, 25 bp, S. cerevisiae
gatgatatgaccaacgactccgctt

SEQ ID NO: 37414 - DNA, 25 bp, S. cerevisiae
gatgattcacgctgctggatcgaag

SEQ ID NO: 37415 - DNA, 25 bp, S. cerevisiae
gatgattcatcgttcaagttagagt

SEQ ID NO: 37416 - DNA, 25 bp, S. cerevisiae
gatgaccacgaaactcttgctgatt

SEQ ID NO: 37417 - DNA, 25 bp, S. cerevisiae
gatgattatgctcaacctaagacca

SEQ ID NO: 37418 - DNA, 25 bp, S. cerevisiae
gatgattttgcagtcgccatcaaga

SEQ ID NO: 37419 - DNA, 25 bp, S. cerevisiae
gatgtcaatttctatgcaactgccc

SEQ ID NO: 37420 - DNA, 25 bp, S. cerevisiae
gatctcctcaatctggtatttaccg

SEQ ID NO: 37421 - DNA, 25 bp, S. cerevisiae
gatgacctgaatctggctattgcca

SEQ ID NO: 37422 - DNA, 25 bp, S. cerevisiae
gatgttgactgcgtcatttttcaaa

SEQ ID NO: 37423 - DNA, 25 bp, S. cerevisiae
gatgatctagatatcaatctccata

SEQ ID NO: 37424 - DNA, 25 bp, S. cerevisiae
gatgtacatttcacacagatggctt

SEQ ID NO: 37425 - DNA, 25 bp, S. cerevisiae
gatgagcacgttaccaggtggtgtt

SEQ ID NO: 37426 - DNA, 25 bp, S. cerevisiae
gatgctgccgttcaccatggtggtt

SEQ ID NO: 37427 - DNA, 25 bp, S. cerevisiae
gatcccgttttgaagttttatcctg

SEQ ID NO: 37428 - DNA, 25 bp, S. cerevisiae
gatccatcggtggtgaagtcttcat

SEQ ID NO: 37429 - DNA, 25 bp, S. cerevisiae
gatgacatcccagcaaattggcctc

SEQ ID NO: 37430 - DNA, 25 bp, S. cerevisiae
gatgtagctgccacaaagggttcaa

SEQ ID NO: 37431 - DNA, 25 bp, S. cerevisiae
gatgccgtaccaatttttgccaagg

SEQ ID NO: 37432 - DNA, 25 bp, S. cerevisiae
gatcgcttgttcacggtcggaaata

SEQ ID NO: 37433 - DNA, 25 bp, S. cerevisiae
gatgcggccgtatggtgtgaaaatc

SEQ ID NO: 37434 - DNA, 25 bp, S. cerevisiae
gatcccaggtctcacggaaatctta

SEQ ID NO: 37435 - DNA, 25 bp, S. cerevisiae
gatcccgatactcttgacttgttaa

SEQ ID NO: 37436 - DNA, 25 bp, S. cerevisiae
gatccatcgtcctcaatgtcatttg

SEQ ID NO: 37437 - DNA, 25 bp, S. cerevisiae
gatgactcagttctcaatttttgga

SEQ ID NO: 37438 - DNA, 25 bp, S. cerevisiae
gatgttcaatggtttattccctcaa

SEQ ID NO: 37439 - DNA, 25 bp, S. cerevisiae
gatgatttggttttggtcactccaa

SEQ ID NO: 37440 - DNA, 25 bp, S. cerevisiae
gatgtatatactacacttccttacg

SEQ ID NO: 37441 - DNA, 25 bp, S. cerevisiae
gatgttgatgatgaactcccatgta

SEQ ID NO: 37442 - DNA, 25 bp, S. cerevisiae
gatgatatcctttcacacggtttcg

SEQ ID NO: 37443 - DNA, 25 bp, S. cerevisiae
gatgtattatcaaccacaaccgcaa

SEQ ID NO: 37444 - DNA, 25 bp, S. cerevisiae
gatgattttgatgataatggcgcca

SEQ ID NO: 37445 - DNA, 25 bp, S. cerevisiae
gatgagatctttgaattgggagaaa

SEQ ID NO: 37446 - DNA, 25 bp, S. cerevisiae
gatgaacttttgaactggccagaac

SEQ ID NO: 37447 - DNA, 25 bp, S. cerevisiae
gatgaaatcgatcctgctacgctaa

SEQ ID NO: 37448 - DNA, 25 bp, S. cerevisiae
gatgagtctcggtgctatcgcgtga

SEQ ID NO: 37449 - DNA, 25 bp, S. cerevisiae
gatgagtgcaagtccgtatcggtga

SEQ ID NO: 37450 - DNA, 25 bp, S. cerevisiae
gatgatataagaggcgctgtcggta

SEQ ID NO: 37451 - DNA, 25 bp, S. cerevisiae
gatgattctgatttcttgggctgtg

SEQ ID NO: 37452 - DNA, 25 bp, S. cerevisiae
gatgattagatctcctgaggctgct

SEQ ID NO: 37453 - DNA, 25 bp, S. cerevisiae
gatgcattcagttatccgaggatgt

SEQ ID NO: 37454 - DNA, 25 bp, S. cerevisiae
gatgacgatttatcttcgagcttaa

SEQ ID NO: 37455 - DNA, 25 bp, S. cerevisiae
gatgatgcgtttaactttgactcag

SEQ ID NO: 37456 - DNA, 25 bp, S. cerevisiae
gatgatcttgaattaccgacaactt

SEQ ID NO: 37457 - DNA, 25 bp, S. cerevisiae
gatgttctccacttgaacaagttga

SEQ ID NO: 37458 - DNA, 25 bp, S. cerevisiae
gatgttttcaagcatgttccattta

SEQ ID NO: 37459 - DNA, 25 bp, S. cerevisiae
gatgttacccatgtttctgattcaa

SEQ ID NO: 37460 - DNA, 25 bp, S. cerevisiae
gatgttccctcagcttctatgatta

SEQ ID NO: 37461 - DNA, 25 bp, S. cerevisiae
gatgttgttcttactgatttaccgg

SEQ ID NO: 37462 - DNA, 25 bp, S. cerevisiae
gatgttcttcttctacttgtacaga

SEQ ID NO: 37463 - DNA, 25 bp, S. cerevisiae
gatgttcctcttcaatcatgtaagg

SEQ ID NO: 37464 - DNA, 25 bp, S. cerevisiae
gatgttgaaatttctatcctgaagg

SEQ ID NO: 37465 - DNA, 25 bp, S. cerevisiae
gatgttgttatcacctccgatgagg

SEQ ID NO: 37466 - DNA, 25 bp, S. cerevisiae
gatgacgttgtcagctcaagcgagg

SEQ ID NO: 37467 - DNA, 25 bp, S. cerevisiae
gatgatttcatagcatgcaccgcga

SEQ ID NO: 37468 - DNA, 25 bp, S. cerevisiae
gatgttcctcgtatcctggaagaca

SEQ ID NO: 37469 - DNA, 25 bp, S. cerevisiae
gatgactttttggacaattacgaac

SEQ ID NO: 37470 - DNA, 25 bp, S. cerevisiae
gatgacgttttatcgattcctgaat

SEQ ID NO: 37471 - DNA, 25 bp, S. cerevisiae
gatgaagtgtaggtccgtctcgcta

SEQ ID NO: 37472 - DNA, 25 bp, S. cerevisiae
gatgaattccaagtcaccctagata

SEQ ID NO: 37473 - DNA, 25 bp, S. cerevisiae
gatgatttaacatcgcaggcatcaa

SEQ ID NO: 37474 - DNA, 25 bp, S. cerevisiae
gatgatggctaacgacgatcttgaa

SEQ ID NO: 37475 - DNA, 25 bp, S. cerevisiae
gatgctgctgctaagaaagctttga

SEQ ID NO: 37476 - DNA, 25 bp, S. cerevisiae
gatgacactagcaaagatcttggca

SEQ ID NO: 37477 - DNA, 25 bp, S. cerevisiae
gatgatcactcaatacctgatgttg

SEQ ID NO: 37478 - DNA, 25 bp, S. cerevisiae
gatgttctccaaaagctgcatgctt

SEQ ID NO: 37479 - DNA, 25 bp, S. cerevisiae
gatgttgccaccaaatctgtgtctg

SEQ ID NO: 37480 - DNA, 25 bp, S. cerevisiae
gatgttgatcaccagacaagcgatt

SEQ ID NO: 37481 - DNA, 25 bp, S. cerevisiae
gatgatcattaccaagccacgattg

SEQ ID NO: 37482 - DNA, 25 bp, S. cerevisiae
gatgatattaatacccagcctgatg

SEQ ID NO: 37483 - DNA, 25 bp, S. cerevisiae
gatgattatgataagcccgctgaaa

SEQ ID NO: 37484 - DNA, 25 bp, S. cerevisiae
gatgatcgcataatagccgccgcca

SEQ ID NO: 37485 - DNA, 25 bp, S. cerevisiae
gatgagcacaagtgccgcctgaaat

SEQ ID NO: 37486 - DNA, 25 bp, S. cerevisiae
gatgatagaaatgccctcctaaccc

SEQ ID NO: 37487 - DNA, 25 bp, S. cerevisiae
gatgataaaactaaccacttgactt

SEQ ID NO: 37488 - DNA, 25 bp, S. cerevisiae
gatgacgaagactcccacttgatat

SEQ ID NO: 37489 - DNA, 25 bp, S. cerevisiae
gatgaacaagaagcctgatttatat

SEQ ID NO: 37490 - DNA, 25 bp, S. cerevisiae
gatgaaccagtagccgatgccaagt

SEQ ID NO: 37491 - DNA, 25 bp, S. cerevisiae
gatgatcgccactaaccaactagat

SEQ ID NO: 37492 - DNA, 25 bp, S. cerevisiae
gatgagacctacaaacactccgaat

SEQ ID NO: 37493 - DNA, 25 bp, S. cerevisiae
gatgagtctcttaaggtcaccgatt

SEQ ID NO: 37494 - DNA, 25 bp, S. cerevisiae
gatgagtccttaagaaggccgttga

SEQ ID NO: 37495 - DNA, 25 bp, S. cerevisiae
gatgcgtcacttacgacggcattgg

SEQ ID NO: 37496 - DNA, 25 bp, S. cerevisiae
gatcgtctcatttggtttgctggtc

SEQ ID NO: 37497 - DNA, 25 bp, S. cerevisiae
gatgttgttgctatgtccttgtaca

SEQ ID NO: 37498 - DNA, 25 bp, S. cerevisiae
gatgaggacctcagtaaggcatata

SEQ ID NO: 37499 - DNA, 25 bp, S. cerevisiae
gatgaggaccttctagacacgcaaa

SEQ ID NO: 37500 - DNA, 25 bp, S. cerevisiae
gatgaaaccgctgctacaacgataa

SEQ ID NO: 37501 - DNA, 25 bp, S. cerevisiae
gatgaaaacgcgactgacagaccaa

SEQ ID NO: 37502 - DNA, 25 bp, S. cerevisiae
gatgatcaaactgtgcgtagcaacg

SEQ ID NO: 37503 - DNA, 25 bp, S. cerevisiae
gatgagctatccacggacattatac

SEQ ID NO: 37504 - DNA, 25 bp, S. cerevisiae
gatgaggacatcacgttgttataca

SEQ ID NO: 37505 - DNA, 25 bp, S. cerevisiae
gatgctgcgaactcttcgttcataa

SEQ ID NO: 37506 - DNA, 25 bp, S. cerevisiae
gatgctttggctgctttgcaaatcg

SEQ ID NO: 37507 - DNA, 25 bp, S. cerevisiae
gatgacagctttcacagtcggaact

SEQ ID NO: 37508 - DNA, 25 bp, S. cerevisiae
gatgaacgtgtcttcaccgaaagca

SEQ ID NO: 37509 - DNA, 25 bp, S. cerevisiae
gatgaagcctctaaagcaaaagaag

SEQ ID NO: 37510 - DNA, 25 bp, S. cerevisiae
gatgaacgctcttttcagaccaaag

SEQ ID NO: 37511 - DNA, 25 bp, S. cerevisiae
gatgaaacgcaccttatggagcaca

SEQ ID NO: 37512 - DNA, 25 bp, S. cerevisiae
gatgataccgaaactcagggcacaa

SEQ ID NO: 37513 - DNA, 25 bp, S. cerevisiae
gatgaacagctgaactccttggcca

SEQ ID NO: 37514 - DNA, 25 bp, S. cerevisiae
gatgaacactcttgtgcacaccaga

SEQ ID NO: 37515 - DNA, 25 bp, S. cerevisiae
gatgaagctgagacttaacaccaat

SEQ ID NO: 37516 - DNA, 25 bp, S. cerevisiae
gatgatactgacgtttcctccagag

SEQ ID NO: 37517 - DNA, 25 bp, S. cerevisiae
gatgataatgtcgacttccctagtg

SEQ ID NO: 37518 - DNA, 25 bp, S. cerevisiae
gatgctaaaccacttcctaaattct

SEQ ID NO: 37519 - DNA, 25 bp, S. cerevisiae
gatgaaaacccttttgccaatcttt

SEQ ID NO: 37520 - DNA, 25 bp, S. cerevisiae
gatgacagagcctacttttccaact

SEQ ID NO: 37521 - DNA, 25 bp, S. cerevisiae
gataagggccaattagtcgaacttt

SEQ ID NO: 37522 - DNA, 25 bp, S. cerevisiae
gatctaagctcaccgctagtagcaa

SEQ ID NO: 37523 - DNA, 25 bp, S. cerevisiae
gatgaagtctcagatgttgctcaaa

SEQ ID NO: 37524 - DNA, 25 bp, S. cerevisiae
gatgatcattttcatgtgcgtgcaa

SEQ ID NO: 37525 - DNA, 25 bp, S. cerevisiae
gatgatatgtttgagctcgcgcacg

SEQ ID NO: 37526 - DNA, 25 bp, S. cerevisiae
gatgatttcttgtaccaggacgaat

SEQ ID NO: 37527 - DNA, 25 bp, S. cerevisiae
gatgatgttcgtctaaattcacaat

SEQ ID NO: 37528 - DNA, 25 bp, S. cerevisiae
gatgctttcgtgatcaatcctccaa

SEQ ID NO: 37529 - DNA, 25 bp, S. cerevisiae
gatgctaataacatattggcccaag

SEQ ID NO: 37530 - DNA, 25 bp, S. cerevisiae
gatctggtataaaattcggctgcga

SEQ ID NO: 37531 - DNA, 25 bp, S. cerevisiae
gatcgttaattttttgcttggactg

SEQ ID NO: 37532 - DNA, 25 bp, S. cerevisiae
gatccaaatcatgttacctacgtta

SEQ ID NO: 37533 - DNA, 25 bp, S. cerevisiae
gatccaaactttgacttgcaagaaa

SEQ ID NO: 37534 - DNA, 25 bp, S. cerevisiae
gatgcaaatgacttggctgccggta

SEQ ID NO: 37535 - DNA, 25 bp, S. cerevisiae
gatgagaatgaatgcgccccagtcc

SEQ ID NO: 37536 - DNA, 25 bp, S. cerevisiae
gatgagcaatggttgtgcccacatt

SEQ ID NO: 37537 - DNA, 25 bp, S. cerevisiae
gatgatgatattttgggccctagta

SEQ ID NO: 37538 - DNA, 25 bp, S. cerevisiae
gatgatattatctggctgccattag

SEQ ID NO: 37539 - DNA, 25 bp, S. cerevisiae
gatgctagatttccccaacaaaacc

SEQ ID NO: 37540 - DNA, 25 bp, S. cerevisiae
gatgatgagatcaagcgccgcaaca

SEQ ID NO: 37541 - DNA, 25 bp, S. cerevisiae
gatgatcattcgacttcgcaacagc

SEQ ID NO: 37542 - DNA, 25 bp, S. cerevisiae
gatgatgttactaccgaccaattcg

SEQ ID NO: 37543 - DNA, 25 bp, S. cerevisiae
gatgatattaccactgtttctgtcg

SEQ ID NO: 37544 - DNA, 25 bp, S. cerevisiae
gatgcattttccgacttattctctt

SEQ ID NO: 37545 - DNA, 25 bp, S. cerevisiae
gatgatttcatccttgtttgattca

SEQ ID NO: 37546 - DNA, 25 bp, S. cerevisiae
gatgatatttgtagtatggcggaaa

SEQ ID NO: 37547 - DNA, 25 bp, S. cerevisiae
gatgatgccctagatcttgatcttg

SEQ ID NO: 37548 - DNA, 25 bp, S. cerevisiae
gatgatgccacagcccattatttgc

SEQ ID NO: 37549 - DNA, 25 bp, S. cerevisiae
gatgaacgaccccatgtcatttatg

SEQ ID NO: 37550 - DNA, 25 bp, S. cerevisiae
gatgaactgattccaagcctgaaat

SEQ ID NO: 37551 - DNA, 25 bp, S. cerevisiae
gatgaagccttcaacagcagcgcat

SEQ ID NO: 37552 - DNA, 25 bp, S. cerevisiae
gatgaagctttgaaccacccttggt

SEQ ID NO: 37553 - DNA, 25 bp, S. cerevisiae
gatgaaatttttgacgccttggaaa

SEQ ID NO: 37554 - DNA, 25 bp, S. cerevisiae
gataagacttggttaccttcggaga

SEQ ID NO: 37555 - DNA, 25 bp, S. cerevisiae
gataaagtcagtgtaccgtcggaag

SEQ ID NO: 37556 - DNA, 25 bp, S. cerevisiae
gataacgtcttgctacttacgggag

SEQ ID NO: 37557 - DNA, 25 bp, S. cerevisiae
gatgaggagctccaatcatttgatt

SEQ ID NO: 37558 - DNA, 25 bp, S. cerevisiae
gatgataccatttcagctactattt

SEQ ID NO: 37559 - DNA, 25 bp, S. cerevisiae
gatgcattagttatggtccaattct

SEQ ID NO: 37560 - DNA, 25 bp, S. cerevisiae
gatgatggttgcttcttcgtagact

SEQ ID NO: 37561 - DNA, 25 bp, S. cerevisiae
gatgagtctcgcagcagccttgaaa

SEQ ID NO: 37562 - DNA, 25 bp, S. cerevisiae
gatgacatctccaggcaagtggcaa

SEQ ID NO: 37563 - DNA, 25 bp, S. cerevisiae
gatgagccacacaggtatgtccatg

SEQ ID NO: 37564 - DNA, 25 bp, S. cerevisiae
gatgacttcatattggtgcattcca

SEQ ID NO: 37565 - DNA, 25 bp, S. cerevisiae
gatgcaccagcaaatgaggcttcaa

SEQ ID NO: 37566 - DNA, 25 bp, S. cerevisiae
gatgacactgaattccactttttga

SEQ ID NO: 37567 - DNA, 25 bp, S. cerevisiae
gatgacgatgattccgatttttcta

SEQ ID NO: 37568 - DNA, 25 bp, S. cerevisiae
gatgacctggttggtgttgttcaaa

SEQ ID NO: 37569 - DNA, 25 bp, S. cerevisiae
gatgaatctcgatctttctttacaa

SEQ ID NO: 37570 - DNA, 25 bp, S. cerevisiae
gatgaatacgcacatgggctctcct

SEQ ID NO: 37571 - DNA, 25 bp, S. cerevisiae
gatgaatttgctgcggaggctgctt

SEQ ID NO: 37572 - DNA, 25 bp, S. cerevisiae
gatgaactcacgctgtcgtacgatg

SEQ ID NO: 37573 - DNA, 25 bp, S. cerevisiae
gataccataaactctggaaccccag

SEQ ID NO: 37574 - DNA, 25 bp, S. cerevisiae
gatgaccttgaaaacgctgaacctc

SEQ ID NO: 37575 - DNA, 25 bp, S. cerevisiae
gatgaccaattctgcattgctgata

SEQ ID NO: 37576 - DNA, 25 bp, S. cerevisiae
gatgaaacactatgcctcgataatg

SEQ ID NO: 37577 - DNA, 25 bp, S. cerevisiae
gatgaatacctgtcgcacgttatat

SEQ ID NO: 37578 - DNA, 25 bp, S. cerevisiae
gatgagctaaggtaccagtcgcata

SEQ ID NO: 37579 - DNA, 25 bp, S. cerevisiae
gatgatgtcaagatcaccgttgagc

SEQ ID NO: 37580 - DNA, 25 bp, S. cerevisiae
gatgctacaggtaatcctcgtacaa

SEQ ID NO: 37581 - DNA, 25 bp, S. cerevisiae
gatgccactttatcttcggaaaccc

SEQ ID NO: 37582 - DNA, 25 bp, S. cerevisiae
gatcgagtaaaaatgcctttcccag

SEQ ID NO: 37583 - DNA, 25 bp, S. cerevisiae
tacgggaatcaatccaatttcaagt

SEQ ID NO: 37584 - DNA, 25 bp, S. cerevisiae
ttccccaacatcaccaagttatagt

SEQ ID NO: 37585 - DNA, 25 bp, S. cerevisiae
gatccaacaacaacctagagtaatg

SEQ ID NO: 37586 - DNA, 25 bp, S. cerevisiae
gatctcgaacacgaacttcttcatg

SEQ ID NO: 37587 - DNA, 25 bp, S. cerevisiae
gatctcgaaacatagttctaggcta

SEQ ID NO: 37588 - DNA, 25 bp, S. cerevisiae
gatcgttccaaatgctaatacttta

SEQ ID NO: 37589 - DNA, 25 bp, S. cerevisiae
gatgatgctccagaatcaccagata

SEQ ID NO: 37590 - DNA, 25 bp, S. cerevisiae
gatgatccatatcagtttttcttag

SEQ ID NO: 37591 - DNA, 25 bp, S. cerevisiae
gatgatgacaagtcgagttcgtctt

SEQ ID NO: 37592 - DNA, 25 bp, S. cerevisiae
gatgacaacgacaatgattcttctt

SEQ ID NO: 37593 - DNA, 25 bp, S. cerevisiae
gatgaagatattccaaggccgcctt

SEQ ID NO: 37594 - DNA, 25 bp, S. cerevisiae
gatgatgtcaaatcggccaatgctt

SEQ ID NO: 37595 - DNA, 25 bp, S. cerevisiae
gatgatgatatctattccagaacct

SEQ ID NO: 37596 - DNA, 25 bp, S. cerevisiae
gatgagagcactacacgagaacagt

SEQ ID NO: 37597 - DNA, 25 bp, S. cerevisiae
gatgatggatcttcatcgagtgaag

SEQ ID NO: 37598 - DNA, 25 bp, S. cerevisiae
gatgatggcagctcaacgtgcaaat

SEQ ID NO: 37599 - DNA, 25 bp, S. cerevisiae
gatgatgatagctttcacctgcaag

SEQ ID NO: 37600 - DNA, 25 bp, S. cerevisiae
gatgcgaacagattgctcagcttga

SEQ ID NO: 37601 - DNA, 25 bp, S. cerevisiae
gatgaaagccacgtgcagcctaagt

SEQ ID NO: 37602 - DNA, 25 bp, S. cerevisiae
gatgaaacttacgacctggtgtact

SEQ ID NO: 37603 - DNA, 25 bp, S. cerevisiae
gatgaaactggacaggccgccaact

SEQ ID NO: 37604 - DNA, 25 bp, S. cerevisiae
gataaagcgaatccaactgccctac

SEQ ID NO: 37605 - DNA, 25 bp, S. cerevisiae
gatgacaacctcagtgggcactcag

SEQ ID NO: 37606 - DNA, 25 bp, S. cerevisiae
gatgatgaacccaagctttaccaga

SEQ ID NO: 37607 - DNA, 25 bp, S. cerevisiae
gatgcatgcaacaccagtttaccgt

SEQ ID NO: 37608 - DNA, 25 bp, S. cerevisiae
gatgctgaacgaccgattatcactg

SEQ ID NO: 37609 - DNA, 25 bp, S. cerevisiae
gatgctgacgccatagaccatgacg

SEQ ID NO: 37610 - DNA, 25 bp, S. cerevisiae
gatgcgctttcactgaagccaacga

SEQ ID NO: 37611 - DNA, 25 bp, S. cerevisiae
gatgcgtttttaaccatggctagac

SEQ ID NO: 37612 - DNA, 25 bp, S. cerevisiae
gatgatgtttcaaccgtattccaga

SEQ ID NO: 37613 - DNA, 25 bp, S. cerevisiae
gatgacagttattcaccgtctaaca

SEQ ID NO: 37614 - DNA, 25 bp, S. cerevisiae
gatgactttgaatcctatctggcca

SEQ ID NO: 37615 - DNA, 25 bp, S. cerevisiae
gatgcatttctaaacaagatcggtc

SEQ ID NO: 37616 - DNA, 25 bp, S. cerevisiae
gatgacgttatctacgaagccgact

SEQ ID NO: 37617 - DNA, 25 bp, S. cerevisiae
gatgacgctaatgacataccggaaa

SEQ ID NO: 37618 - DNA, 25 bp, S. cerevisiae
gatgaaaatgctgtccacggtgaat

SEQ ID NO: 37619 - DNA, 25 bp, S. cerevisiae
gatgaaaacaaaaccagagtcagat

SEQ ID NO: 37620 - DNA, 25 bp, S. cerevisiae
gatcctgaagacattgccttcaaag

SEQ ID NO: 37621 - DNA, 25 bp, S. cerevisiae
gatgcgaaaagctcggcagactcga

SEQ ID NO: 37622 - DNA, 25 bp, S. cerevisiae
gatcctgaattcatgggctgcgtcg

SEQ ID NO: 37623 - DNA, 25 bp, S. cerevisiae
gatgagtatgactactggtccttga

SEQ ID NO: 37624 - DNA, 25 bp, S. cerevisiae
gatgaggcagtatctggtcctagaa

SEQ ID NO: 37625 - DNA, 25 bp, S. cerevisiae
gatgactcgctttatcgtcctataa

SEQ ID NO: 37626 - DNA, 25 bp, S. cerevisiae
gatgacctggaatttggctctaaaa

SEQ ID NO: 37627 - DNA, 25 bp, S. cerevisiae
gatgcagtttggtttgggccaccaa

SEQ ID NO: 37628 - DNA, 25 bp, S. cerevisiae
gatgcgttggatgttgccgtagaaa

SEQ ID NO: 37629 - DNA, 25 bp, S. cerevisiae
gatgctatgtttctggacgtttacg

SEQ ID NO: 37630 - DNA, 25 bp, S. cerevisiae
gatgctgatcagatttggtcggtta

SEQ ID NO: 37631 - DNA, 25 bp, S. cerevisiae
gatgcatcccacattggtcaagttt

SEQ ID NO: 37632 - DNA, 25 bp, S. cerevisiae
gatgccccactctatcgtaagggaa

SEQ ID NO: 37633 - DNA, 25 bp, S. cerevisiae
gatccagcctacctcgtaacgagaa

SEQ ID NO: 37634 - DNA, 25 bp, S. cerevisiae
gatgctcagccttcctggaaaagta

SEQ ID NO: 37635 - DNA, 25 bp, S. cerevisiae
gatgctatgccgattgccaagagac

SEQ ID NO: 37636 - DNA, 25 bp, S. cerevisiae
gatgaagccgtcagccaaggtaaat

SEQ ID NO: 37637 - DNA, 25 bp, S. cerevisiae
gatgacgacgacaacgacaggttaa

SEQ ID NO: 37638 - DNA, 25 bp, S. cerevisiae
gatgacgaagccaccagagagatta

SEQ ID NO: 37639 - DNA, 25 bp, S. cerevisiae
gatgaatggtttgccgccattgctg

SEQ ID NO: 37640 - DNA, 25 bp, S. cerevisiae
gatgaagcgtttcagtctctctgca

SEQ ID NO: 37641 - DNA, 25 bp, S. cerevisiae
gatgaaggttccaagtctcacccat

SEQ ID NO: 37642 - DNA, 25 bp, S. cerevisiae
gatgaaggatcacggcctcttggct

SEQ ID NO: 37643 - DNA, 25 bp, S. cerevisiae
gatgaatcgttgcatccaatggcaa

SEQ ID NO: 37644 - DNA, 25 bp, S. cerevisiae
gatgacatcataagcatttccggag

SEQ ID NO: 37645 - DNA, 25 bp, S. cerevisiae
gatgcattcaatcctgtttcggaga

SEQ ID NO: 37646 - DNA, 25 bp, S. cerevisiae
gatgcatcttatccgtcaatcgaag

SEQ ID NO: 37647 - DNA, 25 bp, S. cerevisiae
gatcccactgccgagcaattgaaga

SEQ ID NO: 37648 - DNA, 25 bp, S. cerevisiae
gatgactattctgctgttatacaca

SEQ ID NO: 37649 - DNA, 25 bp, S. cerevisiae
gatgaaatgtgtaccctctcaaata

SEQ ID NO: 37650 - DNA, 25 bp, S. cerevisiae
gatgacaatgcagacgccttgaaga

SEQ ID NO: 37651 - DNA, 25 bp, S. cerevisiae
gatgagcgtgcgtccgatttaagaa

SEQ ID NO: 37652 - DNA, 25 bp, S. cerevisiae
gatgacgatgattctccagctaaca

SEQ ID NO: 37653 - DNA, 25 bp, S. cerevisiae
gatgacgatgtcaactcggaatcaa

SEQ ID NO: 37654 - DNA, 25 bp, S. cerevisiae
gatgactattccatatgcagcaaaa

SEQ ID NO: 37655 - DNA, 25 bp, S. cerevisiae
gatgacgcacgagttctgcaaacaa

SEQ ID NO: 37656 - DNA, 25 bp, S. cerevisiae
gatgacgcgctggtagtagagacaa

SEQ ID NO: 37657 - DNA, 25 bp, S. cerevisiae
gatgctgatgtacccaagttcttga

SEQ ID NO: 37658 - DNA, 25 bp, S. cerevisiae
gatgctggtatctccacattatgtt

SEQ ID NO: 37659 - DNA, 25 bp, S. cerevisiae
gatgcaatattgtgtctcagcgtca

SEQ ID NO: 37660 - DNA, 25 bp, S. cerevisiae
gatgctgaagtattactagccgcga

SEQ ID NO: 37661 - DNA, 25 bp, S. cerevisiae
gatgcagagtcttctataagtcgta

SEQ ID NO: 37662 - DNA, 25 bp, S. cerevisiae
gatgacactccaattgcgaaacctt

SEQ ID NO: 37663 - DNA, 25 bp, S. cerevisiae
gatgaagcgactattgcaagaattt

SEQ ID NO: 37664 - DNA, 25 bp, S. cerevisiae
gatgaaggagctattcaagcaccaa

SEQ ID NO: 37665 - DNA, 25 bp, S. cerevisiae
gatgaacggttgtttcagcaccact

SEQ ID NO: 37666 - DNA, 25 bp, S. cerevisiae
gatgaatccgtttttatgacctcag

SEQ ID NO: 37667 - DNA, 25 bp, S. cerevisiae
gatgaaccgcttttcgagcagtgga

SEQ ID NO: 37668 - DNA, 25 bp, S. cerevisiae
gatgaactcacaatatccgtgggtg

SEQ ID NO: 37669 - DNA, 25 bp, S. cerevisiae
gatgaagctactatccttggatcta

SEQ ID NO: 37670 - DNA, 25 bp, S. cerevisiae
gatgacgtcgataacactggtagga

SEQ ID NO: 37671 - DNA, 25 bp, S. cerevisiae
gatgccacatcctgaaagagtttgc

SEQ ID NO: 37672 - DNA, 25 bp, S. cerevisiae
gatgcgtatcaccagaagagttctt

SEQ ID NO: 37673 - DNA, 25 bp, S. cerevisiae
gatgcctctactgagatacgccatg

SEQ ID NO: 37674 - DNA, 25 bp, S. cerevisiae
gatgacttctcggaagccacttttg

SEQ ID NO: 37675 - DNA, 25 bp, S. cerevisiae
gatcctgaaaggtggctgccattaa

SEQ ID NO: 37676 - DNA, 25 bp, S. cerevisiae
gatccgaattccatcggttcagtgg

SEQ ID NO: 37677 - DNA, 25 bp, S. cerevisiae
gatcctactacgttcaattgtccga

SEQ ID NO: 37678 - DNA, 25 bp, S. cerevisiae
gatcctccatacagtgcagatgctc

SEQ ID NO: 37679 - DNA, 25 bp, S. cerevisiae
gatgctgtggctccaggacagacct

SEQ ID NO: 37680 - DNA, 25 bp, S. cerevisiae
gatgctatggtgacaagaacacctg

SEQ ID NO: 37681 - DNA, 25 bp, S. cerevisiae
gatgctcattctcaacaactcagtg

SEQ ID NO: 37682 - DNA, 25 bp, S. cerevisiae
gatgccaggcactagatcaactact

SEQ ID NO: 37683 - DNA, 25 bp, S. cerevisiae
gatgcactcgcagtagctatttatg

SEQ ID NO: 37684 - DNA, 25 bp, S. cerevisiae
gatgaactgcagaagctgttacaag

SEQ ID NO: 37685 - DNA, 25 bp, S. cerevisiae
gatgcacaccgagcttgtacagaat

SEQ ID NO: 37686 - DNA, 25 bp, S. cerevisiae
gatgaatctcgtccacgtaagatga

SEQ ID NO: 37687 - DNA, 25 bp, S. cerevisiae
gatgactttttagtcgacgacgatg

SEQ ID NO: 37688 - DNA, 25 bp, S. cerevisiae
gatgactatctaatttcggagggtg

SEQ ID NO: 37689 - DNA, 25 bp, S. cerevisiae
gatgacattccctttgaagattgta

SEQ ID NO: 37690 - DNA, 25 bp, S. cerevisiae
gatgacttccttactacagaccaaa

SEQ ID NO: 37691 - DNA, 25 bp, S. cerevisiae
gatgaagctcttagtgtggatgata

SEQ ID NO: 37692 - DNA, 25 bp, S. cerevisiae
gatgctcccggttgtgtgattgaaa

SEQ ID NO: 37693 - DNA, 25 bp, S. cerevisiae
gatgcccctatatttaatgtcgctg

SEQ ID NO: 37694 - DNA, 25 bp, S. cerevisiae
gatccagtcgatgttgtttcctgta

SEQ ID NO: 37695 - DNA, 25 bp, S. cerevisiae
gatgcggttgcaacttttagaacaa

SEQ ID NO: 37696 - DNA, 25 bp, S. cerevisiae
gatgcgtgatttacttgttgaacca

SEQ ID NO: 37697 - DNA, 25 bp, S. cerevisiae
gatgctatcattgcctgtgctaaac

SEQ ID NO: 37698 - DNA, 25 bp, S. cerevisiae
gatgcaattgaaaactctcactgaa

SEQ ID NO: 37699 - DNA, 25 bp, S. cerevisiae
gatgcatcttggaaactctctgggt

SEQ ID NO: 37700 - DNA, 25 bp, S. cerevisiae
gatgacatgcatactttcaacgagt

SEQ ID NO: 37701 - DNA, 25 bp, S. cerevisiae
gatgccggcatcgaattagtggata

SEQ ID NO: 37702 - DNA, 25 bp, S. cerevisiae
gatccagacgttaaagtcgttcaca

SEQ ID NO: 37703 - DNA, 25 bp, S. cerevisiae
gatgcaacttacgaccctaaggaaa

SEQ ID NO: 37704 - DNA, 25 bp, S. cerevisiae
gatgaatgcttcctggcgcttgtca

SEQ ID NO: 37705 - DNA, 25 bp, S. cerevisiae
gatgctatcttctactggttgctca

SEQ ID NO: 37706 - DNA, 25 bp, S. cerevisiae
gatgcaaccatccagtgtgatttcc

SEQ ID NO: 37707 - DNA, 25 bp, S. cerevisiae
gatgccgacatccatgggttacgag

SEQ ID NO: 37708 - DNA, 25 bp, S. cerevisiae
gatccccgtcatctttcagaaagga

SEQ ID NO: 37709 - DNA, 25 bp, S. cerevisiae
gatccggaccttttacaaatgacaa

SEQ ID NO: 37710 - DNA, 25 bp, S. cerevisiae
gatccggtggtacgtgccactataa

SEQ ID NO: 37711 - DNA, 25 bp, S. cerevisiae
gatccacggtggtttctccttataa

SEQ ID NO: 37712 - DNA, 25 bp, S. cerevisiae
gatcccggtgttctttctgttaaga

SEQ ID NO: 37713 - DNA, 25 bp, S. cerevisiae
gatccctggttgtttgtttccaatg

SEQ ID NO: 37714 - DNA, 25 bp, S. cerevisiae
gatgccctactggatttattttctt

SEQ ID NO: 37715 - DNA, 25 bp, S. cerevisiae
gtgccttgaaaaccccttttgcgcg

SEQ ID NO: 37716 - DNA, 25 bp, S. cerevisiae
gatactttaacacccaagtttgcca

SEQ ID NO: 37717 - DNA, 25 bp, S. cerevisiae
gatcccttatatcgcccaagttttt

SEQ ID NO: 37718 - DNA, 25 bp, S. cerevisiae
gatgcgtctttatcgtccatttttt

SEQ ID NO: 37719 - DNA, 25 bp, S. cerevisiae
gatgaacttcattactctggtcaaa

SEQ ID NO: 37720 - DNA, 25 bp, S. cerevisiae
gatgaattcgactctttcccagctg

SEQ ID NO: 37721 - DNA, 25 bp, S. cerevisiae
gatgaaatctccttcttacaacagt

SEQ ID NO: 37722 - DNA, 25 bp, S. cerevisiae
gatgaattatttattgccccaggca

SEQ ID NO: 37723 - DNA, 25 bp, S. cerevisiae
gatgcagtagagaccatataccaat

SEQ ID NO: 37724 - DNA, 25 bp, S. cerevisiae
gatgcttaaatactctcccacagtt

SEQ ID NO: 37725 - DNA, 25 bp, S. cerevisiae
gatgctttaaatcctaatggcgttg

SEQ ID NO: 37726 - DNA, 25 bp, S. cerevisiae
gatgcttgtgacaatcctgatgaag

SEQ ID NO: 37727 - DNA, 25 bp, S. cerevisiae
gatccactgttgaatctcgtacctc

SEQ ID NO: 37728 - DNA, 25 bp, S. cerevisiae
gatgcggctttgaatgtttcaccat

SEQ ID NO: 37729 - DNA, 25 bp, S. cerevisiae
gatgcaagcttcctgcagtagctaa

SEQ ID NO: 37730 - DNA, 25 bp, S. cerevisiae
gatgcaatgcttaacgccatgtcaa

SEQ ID NO: 37731 - DNA, 25 bp, S. cerevisiae
gatgcctccaaacaattacaagtga

SEQ ID NO: 37732 - DNA, 25 bp, S. cerevisiae
gatcctcccacgaagcacaagaagt

SEQ ID NO: 37733 - DNA, 25 bp, S. cerevisiae
gatgcctacaattcgcagtcacagt

SEQ ID NO: 37734 - DNA, 25 bp, S. cerevisiae
gatgctctactttctctgtcagaat

SEQ ID NO: 37735 - DNA, 25 bp, S. cerevisiae
gatgcgtccatggttcttcatgata

SEQ ID NO: 37736 - DNA, 25 bp, S. cerevisiae
gatgctatcatgtatgctacgtatt

SEQ ID NO: 37737 - DNA, 25 bp, S. cerevisiae
gatgctatctacttacgattttccc

SEQ ID NO: 37738 - DNA, 25 bp, S. cerevisiae
gatgctttatcagacaactttgcca

SEQ ID NO: 37739 - DNA, 25 bp, S. cerevisiae
gatgctagcttgtcaaaaggtccaa

SEQ ID NO: 37740 - DNA, 25 bp, S. cerevisiae
gatgcatattacacgttgctcctga

SEQ ID NO: 37741 - DNA, 25 bp, S. cerevisiae
gatgctatgatagccgaccttctaa

SEQ ID NO: 37742 - DNA, 25 bp, S. cerevisiae
gatccggaagttacgtcttgacaat

SEQ ID NO: 37743 - DNA, 25 bp, S. cerevisiae
gatccgctacaggtagggttaccaa

SEQ ID NO: 37744 - DNA, 25 bp, S. cerevisiae
gatgccgctcaaggaatggatttca

SEQ ID NO: 37745 - DNA, 25 bp, S. cerevisiae
gatccagtcaaggtcatcgattact

SEQ ID NO: 37746 - DNA, 25 bp, S. cerevisiae
gatccaaaagcattcacctttgata

SEQ ID NO: 37747 - DNA, 25 bp, S. cerevisiae
gatgcttatgaaccaactccgcgaa

SEQ ID NO: 37748 - DNA, 25 bp, S. cerevisiae
gatgcagccaaggaaatcgactcat

SEQ ID NO: 37749 - DNA, 25 bp, S. cerevisiae
gatgcaactatctctactgtgtgga

SEQ ID NO: 37750 - DNA, 25 bp, S. cerevisiae
gatgcagctgacttgtcccgtgata

SEQ ID NO: 37751 - DNA, 25 bp, S. cerevisiae
gatgcgctatccttgatctactccc

SEQ ID NO: 37752 - DNA, 25 bp, S. cerevisiae
gatgcggatatgttgtctcctacac

SEQ ID NO: 37753 - DNA, 25 bp, S. cerevisiae
gatgaagatcacgttttactagaga

SEQ ID NO: 37754 - DNA, 25 bp, S. cerevisiae
gatccgcttgagcaaagccctagta

SEQ ID NO: 37755 - DNA, 25 bp, S. cerevisiae
gatccgttaaaaagacctactgcta

SEQ ID NO: 37756 - DNA, 25 bp, S. cerevisiae
gatcgatcccatgtaagtcctggta

SEQ ID NO: 37757 - DNA, 25 bp, S. cerevisiae
gatccatactcttcgaggtcgggtc

SEQ ID NO: 37758 - DNA, 25 bp, S. cerevisiae
gatccttctaccgagtattgtgttg

SEQ ID NO: 37759 - DNA, 25 bp, S. cerevisiae
gatcctaattccatagttgagtgca

SEQ ID NO: 37760 - DNA, 25 bp, S. cerevisiae
gatgccctttccgtgattggagtca

SEQ ID NO: 37761 - DNA, 25 bp, S. cerevisiae
gatgccgcttttgagacgggattta

SEQ ID NO: 37762 - DNA, 25 bp, S. cerevisiae
gatcggtatttgctacgaacctcca

SEQ ID NO: 37763 - DNA, 25 bp, S. cerevisiae
gatccaagtttgctgatcgaccaat

SEQ ID NO: 37764 - DNA, 25 bp, S. cerevisiae
gatcccgatgcaagggtcgcaacaa

SEQ ID NO: 37765 - DNA, 25 bp, S. cerevisiae
gatgccaaagcaagaaagaaacaaa

SEQ ID NO: 37766 - DNA, 25 bp, S. cerevisiae
gatgccaaagcaagaaagaaacaaa

SEQ ID NO: 37767 - DNA, 25 bp, S. cerevisiae
gatgcttttcaaccttaccattatt

SEQ ID NO: 37768 - DNA, 25 bp, S. cerevisiae
gatagcctagttggtattgatctcg

SEQ ID NO: 37769 - DNA, 25 bp, S. cerevisiae
gatccgtagattgggtgtcatcgcc

SEQ ID NO: 37770 - DNA, 25 bp, S. cerevisiae
gatccttatgatttggttcaacacc

SEQ ID NO: 37771 - DNA, 25 bp, S. cerevisiae
gatgccctttacaagtatctaccac

SEQ ID NO: 37772 - DNA, 25 bp, S. cerevisiae
gatgcccatttgaaggatcgctatc

SEQ ID NO: 37773 - DNA, 25 bp, S. cerevisiae
gatgaattcactacccaacaagacg

SEQ ID NO: 37774 - DNA, 25 bp, S. cerevisiae
gatgaatgtgccgatgaagccaaaa

SEQ ID NO: 37775 - DNA, 25 bp, S. cerevisiae
gatgcttggcactggttgcaactca

SEQ ID NO: 37776 - DNA, 25 bp, S. cerevisiae
gatgccactgattttgccacaaatg

SEQ ID NO: 37777 - DNA, 25 bp, S. cerevisiae
gatgccaatgttcccatcatttggg

SEQ ID NO: 37778 - DNA, 25 bp, S. cerevisiae
gatgccaagcttccgctacaagtga

SEQ ID NO: 37779 - DNA, 25 bp, S. cerevisiae
gatgcagatgaacccttcaaagtag

SEQ ID NO: 37780 - DNA, 25 bp, S. cerevisiae
gatgcaatgggctctaaatcaatga

SEQ ID NO: 37781 - DNA, 25 bp, S. cerevisiae
gatgcaagggcttctgagaccatga

SEQ ID NO: 37782 - DNA, 25 bp, S. cerevisiae
gatgcatgcagagccactagacact

SEQ ID NO: 37783 - DNA, 25 bp, S. cerevisiae
gatgccgatagcgacgagatcacca

SEQ ID NO: 37784 - DNA, 25 bp, S. cerevisiae
gatccagatccaaaagtgccgtcac

SEQ ID NO: 37785 - DNA, 25 bp, S. cerevisiae
gatgctcagggaaacgtgcccatca

SEQ ID NO: 37786 - DNA, 25 bp, S. cerevisiae
gatgctatcgccaaactgaaccaaa

SEQ ID NO: 37787 - DNA, 25 bp, S. cerevisiae
gatgctaagccatatttaccagaag

SEQ ID NO: 37788 - DNA, 25 bp, S. cerevisiae
gatcgcaacaactttgaagccggca

SEQ ID NO: 37789 - DNA, 25 bp, S. cerevisiae
gatctgaacaactagcgaatgcctc

SEQ ID NO: 37790 - DNA, 25 bp, S. cerevisiae
gattttggccaactctaacgacgac

SEQ ID NO: 37791 - DNA, 25 bp, S. cerevisiae
gatctttcccaacctgttcgaagat

SEQ ID NO: 37792 - DNA, 25 bp, S. cerevisiae
gatcttcgtccaagcctttcaaata

SEQ ID NO: 37793 - DNA, 25 bp, S. cerevisiae
gatgccttgcccagagacttagaaa

SEQ ID NO: 37794 - DNA, 25 bp, S. cerevisiae
gatgcccgccgtaaagactcgaata

SEQ ID NO: 37795 - DNA, 25 bp, S. cerevisiae
gatgctgttgtccttaagaccgttc

SEQ ID NO: 37796 - DNA, 25 bp, S. cerevisiae
gatgcattgtctttagttgctactg

SEQ ID NO: 37797 - DNA, 25 bp, S. cerevisiae
gatcctgctttgttgaggcccggta

SEQ ID NO: 37798 - DNA, 25 bp, S. cerevisiae
gatgctaatactttttccggatgaa

SEQ ID NO: 37799 - DNA, 25 bp, S. cerevisiae
gatccatatgcgtattccgtaactg

SEQ ID NO: 37800 - DNA, 25 bp, S. cerevisiae
gatgcactgatggttatgccattct

SEQ ID NO: 37801 - DNA, 25 bp, S. cerevisiae
gatccgttattcctcactaaattgg

SEQ ID NO: 37802 - DNA, 25 bp, S. cerevisiae
gatcgcggtaacagcatcgaaactg

SEQ ID NO: 37803 - DNA, 25 bp, S. cerevisiae
gatctgtttgatccggacgacttct

SEQ ID NO: 37804 - DNA, 25 bp, S. cerevisiae
gatgctttattgaaggaagacgctt

SEQ ID NO: 37805 - DNA, 25 bp, S. cerevisiae
gatcttttcttcttaaattacgagg

SEQ ID NO: 37806 - DNA, 25 bp, S. cerevisiae
gatcttttgcttttatatttcaggg

SEQ ID NO: 37807 - DNA, 25 bp, S. cerevisiae
gatgcttctgctatcaagacccaaa

SEQ ID NO: 37808 - DNA, 25 bp, S. cerevisiae
gatctatcgacttataacggacctg

SEQ ID NO: 37809 - DNA, 25 bp, S. cerevisiae
gatccatctgtgagacccggtgaac

SEQ ID NO: 37810 - DNA, 25 bp, S. cerevisiae
gatcctcttgaacctcctggaaata

SEQ ID NO: 37811 - DNA, 25 bp, S. cerevisiae
gatccttgcggacctctttatgaaa

SEQ ID NO: 37812 - DNA, 25 bp, S. cerevisiae
gatcgcggctggtttgttttccaaa

SEQ ID NO: 37813 - DNA, 25 bp, S. cerevisiae
gatcttcccgtattttttccaaatg

SEQ ID NO: 37814 - DNA, 25 bp, S. cerevisiae
gataacgtcgtccatgtttacgaag

SEQ ID NO: 37815 - DNA, 25 bp, S. cerevisiae
gataataggcgtacgtttacggcac

SEQ ID NO: 37816 - DNA, 25 bp, S. cerevisiae
gataatctgggtattactacggcaa

SEQ ID NO: 37817 - DNA, 25 bp, S. cerevisiae
gatcagacggttcactcaataacgc

SEQ ID NO: 37818 - DNA, 25 bp, S. cerevisiae
gatagtccgcaaaccatcgaaacgc

SEQ ID NO: 37819 - DNA, 25 bp, S. cerevisiae
gatcgtggccaaacctctaaaagca

SEQ ID NO: 37820 - DNA, 25 bp, S. cerevisiae
gatctgggcaactcacttttaagac

SEQ ID NO: 37821 - DNA, 25 bp, S. cerevisiae
gatgcattacagcaatcgcctcatt

SEQ ID NO: 37822 - DNA, 25 bp, S. cerevisiae
gatgcattccagaaaccccatgata

SEQ ID NO: 37823 - DNA, 25 bp, S. cerevisiae
gatgcattgatgaacccctttgaca

SEQ ID NO: 37824 - DNA, 25 bp, S. cerevisiae
gatgctatctcaacccttattgaag

SEQ ID NO: 37825 - DNA, 25 bp, S. cerevisiae
gatgctatctacgatgtcactattg

SEQ ID NO: 37826 - DNA, 25 bp, S. cerevisiae
gatgcttacaccgtgagcttcatgc

SEQ ID NO: 37827 - DNA, 25 bp, S. cerevisiae
gatgcgacagatttcaagattccaa

SEQ ID NO: 37828 - DNA, 25 bp, S. cerevisiae
gatgccgattatactgttggtgaat

SEQ ID NO: 37829 - DNA, 25 bp, S. cerevisiae
gatgcttctttggttgactacgttc

SEQ ID NO: 37830 - DNA, 25 bp, S. cerevisiae
gatgctatttggctgtactccattt

SEQ ID NO: 37831 - DNA, 25 bp, S. cerevisiae
gatgccattagtttgtaccacttat

SEQ ID NO: 37832 - DNA, 25 bp, S. cerevisiae
gatcctttgatatcgacacactaaa

SEQ ID NO: 37833 - DNA, 25 bp, S. cerevisiae
gatctttaacagtcgctgaactaaa

SEQ ID NO: 37834 - DNA, 25 bp, S. cerevisiae
gatccgtgacggttctgacactgaa

SEQ ID NO: 37835 - DNA, 25 bp, S. cerevisiae
gatgcccagatcgttgttgtagact

SEQ ID NO: 37836 - DNA, 25 bp, S. cerevisiae
gatgccgtatcgagctttaattcaa

SEQ ID NO: 37837 - DNA, 25 bp, S. cerevisiae
gatccagattcgacagattcttttg

SEQ ID NO: 37838 - DNA, 25 bp, S. cerevisiae
gatgctgcctttcaatctttgcaaa

SEQ ID NO: 37839 - DNA, 25 bp, S. cerevisiae
gatcctataagaaccccagatgcca

SEQ ID NO: 37840 - DNA, 25 bp, S. cerevisiae
gatcgcttaggatgcttcaatttaa

SEQ ID NO: 37841 - DNA, 25 bp, S. cerevisiae
gatcctaagcaacctttgttccaaa

SEQ ID NO: 37842 - DNA, 25 bp, S. cerevisiae
gatccaatcggaactttgtctacat

SEQ ID NO: 37843 - DNA, 25 bp, S. cerevisiae
gatccgatcgcctctttattaattg

SEQ ID NO: 37844 - DNA, 25 bp, S. cerevisiae
gatgccagatcccttttttgaaact

SEQ ID NO: 37845 - DNA, 25 bp, S. cerevisiae
gatctttccacgaatcttctaagcc

SEQ ID NO: 37846 - DNA, 25 bp, S. cerevisiae
gatcctttacaattctcatatacca

SEQ ID NO: 37847 - DNA, 25 bp, S. cerevisiae
gatgctacatctcaaactacttctt

SEQ ID NO: 37848 - DNA, 25 bp, S. cerevisiae
gatgctgttggtattcagtcgtccg

SEQ ID NO: 37849 - DNA, 25 bp, S. cerevisiae
gatgcttttgctattcattcctcaa

SEQ ID NO: 37850 - DNA, 25 bp, S. cerevisiae
gatgctgtgttgacccatactttca

SEQ ID NO: 37851 - DNA, 25 bp, S. cerevisiae
gatcctgttgactttcctttcatta

SEQ ID NO: 37852 - DNA, 25 bp, S. cerevisiae
gatcctgtgattactagaccctatg

SEQ ID NO: 37853 - DNA, 25 bp, S. cerevisiae
gatctgctggtaatcaagccaagct

SEQ ID NO: 37854 - DNA, 25 bp, S. cerevisiae
gatgctcaagccatcaaggaagctt

SEQ ID NO: 37855 - DNA, 25 bp, S. cerevisiae
gatgccgataccttggtcattgcta

SEQ ID NO: 37856 - DNA, 25 bp, S. cerevisiae
tataggccataaggtcgggtcccac

SEQ ID NO: 37857 - DNA, 25 bp, S. cerevisiae
gtcgatggctaagacgggcgccaca

SEQ ID NO: 37858 - DNA, 25 bp, S. cerevisiae
gatcgaaccaaaaccgtcctatgag

SEQ ID NO: 37859 - DNA, 25 bp, S. cerevisiae
gatcaaacaacaagcaaccctcgtt

SEQ ID NO: 37860 - DNA, 25 bp, S. cerevisiae
gatccaattatcaagaagggccttt

SEQ ID NO: 37861 - DNA, 25 bp, S. cerevisiae
gatcgatttgatcagaaactccggt

SEQ ID NO: 37862 - DNA, 25 bp, S. cerevisiae
gatgctgtctttcagaagcactccg

SEQ ID NO: 37863 - DNA, 25 bp, S. cerevisiae
gatgctggtttggaaatcacctctg

SEQ ID NO: 37864 - DNA, 25 bp, S. cerevisiae
gatgctgaggaattggtaacttcaa

SEQ ID NO: 37865 - DNA, 25 bp, S. cerevisiae
gatgcgtcctcatttgttattgcca

SEQ ID NO: 37866 - DNA, 25 bp, S. cerevisiae
gatgcgtcaccatacgattttaata

SEQ ID NO: 37867 - DNA, 25 bp, S. cerevisiae
gatcccgtctacaagttcttaaaga

SEQ ID NO: 37868 - DNA, 25 bp, S. cerevisiae
gatcccgtatacagtgccgctataa

SEQ ID NO: 37869 - DNA, 25 bp, S. cerevisiae
gatcccgtgtagtcctcgagttata

SEQ ID NO: 37870 - DNA, 25 bp, S. cerevisiae
gatgccgctgtgtacctaaagttta

SEQ ID NO: 37871 - DNA, 25 bp, S. cerevisiae
gatccgtctctaaaacccatttaca

SEQ ID NO: 37872 - DNA, 25 bp, S. cerevisiae
gatgctggttcacgtagactcgatt

SEQ ID NO: 37873 - DNA, 25 bp, S. cerevisiae
gatgcgatttacgatgatgactgga

SEQ ID NO: 37874 - DNA, 25 bp, S. cerevisiae
gatgctgttgatgcctatgagttga

SEQ ID NO: 37875 - DNA, 25 bp, S. cerevisiae
gatgcgcgagtgacctctgagttag

SEQ ID NO: 37876 - DNA, 25 bp, S. cerevisiae
gatgccaaatctagtggatgcttgt

SEQ ID NO: 37877 - DNA, 25 bp, S. cerevisiae
gatgctgctttgaatcagtctgctg

SEQ ID NO: 37878 - DNA, 25 bp, S. cerevisiae
gatgctgcttcaaacatggcgacga

SEQ ID NO: 37879 - DNA, 25 bp, S. cerevisiae
gatgctgctgctgaaattgctgaag

SEQ ID NO: 37880 - DNA, 25 bp, S. cerevisiae
gatctgggttgttggtcgttatata

SEQ ID NO: 37881 - DNA, 25 bp, S. cerevisiae
gatgcggccataacggatgaattca

SEQ ID NO: 37882 - DNA, 25 bp, S. cerevisiae
gatgcggattctttgctagagttat

SEQ ID NO: 37883 - DNA, 25 bp, S. cerevisiae
gatgctggtcaagctgcgttggaca

SEQ ID NO: 37884 - DNA, 25 bp, S. cerevisiae
gttccaacagtaccaccgaagtcgg

SEQ ID NO: 37885 - DNA, 25 bp, S. cerevisiae
gatgctgctaactatgtcttcgaga

SEQ ID NO: 37886 - DNA, 25 bp, S. cerevisiae
gatgctgcttattctgctttcaaga

SEQ ID NO: 37887 - DNA, 25 bp, S. cerevisiae
gatcgcaggagccagcatacttgat

SEQ ID NO: 37888 - DNA, 25 bp, S. cerevisiae
gatccagctgacgaacctgtgtgta

SEQ ID NO: 37889 - DNA, 25 bp, S. cerevisiae
gatccgtgacggacgttgcatgtgt

SEQ ID NO: 37890 - DNA, 25 bp, S. cerevisiae
gatgccggcaagtactggctgatct

SEQ ID NO: 37891 - DNA, 25 bp, S. cerevisiae
gatgccatggtattcatcggtgatg

SEQ ID NO: 37892 - DNA, 25 bp, S. cerevisiae
gatgccatggacattctagctgagc

SEQ ID NO: 37893 - DNA, 25 bp, S. cerevisiae
gatgcctggatccaagtacgacgaa

SEQ ID NO: 37894 - DNA, 25 bp, S. cerevisiae
gatgcgctatccaatttactgaatg

SEQ ID NO: 37895 - DNA, 25 bp, S. cerevisiae
gatgctgatgaggatgttaacgaaa

SEQ ID NO: 37896 - DNA, 25 bp, S. cerevisiae
gatcactgggtgatgacacgcaaaa

SEQ ID NO: 37897 - DNA, 25 bp, S. cerevisiae
gatcctccctcctaaggcaagatat

SEQ ID NO: 37898 - DNA, 25 bp, S. cerevisiae
gatgccgccctggaattaattcaga

SEQ ID NO: 37899 - DNA, 25 bp, S. cerevisiae
gatccattccatgacttcaattcaa

SEQ ID NO: 37900 - DNA, 25 bp, S. cerevisiae
gatccattcctgaagccatttacga

SEQ ID NO: 37901 - DNA, 25 bp, S. cerevisiae
gatgcctttctgaatttcttaccat

SEQ ID NO: 37902 - DNA, 25 bp, S. cerevisiae
gatgctgttggttgacatcatccca

SEQ ID NO: 37903 - DNA, 25 bp, S. cerevisiae
gatgcctgtggatcctctgggagac

SEQ ID NO: 37904 - DNA, 25 bp, S. cerevisiae
gatccttggatctactttcttgagc

SEQ ID NO: 37905 - DNA, 25 bp, S. cerevisiae
gatctctcgtgattatcttttgggt

SEQ ID NO: 37906 - DNA, 25 bp, S. cerevisiae
gatgccggtatatcaatgttcgatt

SEQ ID NO: 37907 - DNA, 25 bp, S. cerevisiae
gatgccgtgaatctagatgcttaca

SEQ ID NO: 37908 - DNA, 25 bp, S. cerevisiae
gatgccgctgtccacattgatgaaa

SEQ ID NO: 37909 - DNA, 25 bp, S. cerevisiae
gatgccgtgtcaatctccataaatg

SEQ ID NO: 37910 - DNA, 25 bp, S. cerevisiae
gatctgatcacttgcttaaccggag

SEQ ID NO: 37911 - DNA, 25 bp, S. cerevisiae
gatgcgagtcattatacaaccctgt

SEQ ID NO: 37912 - DNA, 25 bp, S. cerevisiae
gatgccgtcgcctaaacctaaaagg

SEQ ID NO: 37913 - DNA, 25 bp, S. cerevisiae
gatcgtgggccagaacaccaacagg

SEQ ID NO: 37914 - DNA, 25 bp, S. cerevisiae
gatgcgaactatgatccagatcttt

SEQ ID NO: 37915 - DNA, 25 bp, S. cerevisiae
gatccctctgcctttgaagaaacga

SEQ ID NO: 37916 - DNA, 25 bp, S. cerevisiae
gatcaccccaaagggaacgcacgat

SEQ ID NO: 37917 - DNA, 25 bp, S. cerevisiae
gatcgaccgtgaaggtaacgccaga

SEQ ID NO: 37918 - DNA, 25 bp, S. cerevisiae
gatcgacagggacaataacgccatt

SEQ ID NO: 37919 - DNA, 25 bp, S. cerevisiae
gatcgaaacgacaaggaggcccatt

SEQ ID NO: 37920 - DNA, 25 bp, S. cerevisiae
gatgccataacccattcgaatgcgc

SEQ ID NO: 37921 - DNA, 25 bp, S. cerevisiae
gatgccgacgctgattgcgatgcta

SEQ ID NO: 37922 - DNA, 25 bp, S. cerevisiae
gatccgagcgcagaacttagttact

SEQ ID NO: 37923 - DNA, 25 bp, S. cerevisiae
gatcttaagcttgagttctgactac

SEQ ID NO: 37924 - DNA, 25 bp, S. cerevisiae
gatcctgctgctctaaaacgtgcta

SEQ ID NO: 37925 - DNA, 25 bp, S. cerevisiae
gatgccttcaggtacacaacagatt

SEQ ID NO: 37926 - DNA, 25 bp, S. cerevisiae
gatccagagagcgataccaccttta

SEQ ID NO: 37927 - DNA, 25 bp, S. cerevisiae
gatccgaagcgcaaaacccttttga

SEQ ID NO: 37928 - DNA, 25 bp, S. cerevisiae
gatccaaattatccggttgttcacg

SEQ ID NO: 37929 - DNA, 25 bp, S. cerevisiae
gatgccaaaaatcttgtccattcat

SEQ ID NO: 37930 - DNA, 25 bp, S. cerevisiae
gatctgctacagtggttgacctaca

SEQ ID NO: 37931 - DNA, 25 bp, S. cerevisiae
gatgccggcgttttaacaccatggt

SEQ ID NO: 37932 - DNA, 25 bp, S. cerevisiae
gatcgccgataacgaatccctcgag

SEQ ID NO: 37933 - DNA, 25 bp, S. cerevisiae
gatcgaggacaactacatccgagaa

SEQ ID NO: 37934 - DNA, 25 bp, S. cerevisiae
gatcccgataatgtattcttggcaa

SEQ ID NO: 37935 - DNA, 25 bp, S. cerevisiae
gatccctcgatgctcattggtattt

SEQ ID NO: 37936 - DNA, 25 bp, S. cerevisiae
gatccttttggtaagctggctttgt

SEQ ID NO: 37937 - DNA, 25 bp, S. cerevisiae
gatccctctattattggtgccttaa

SEQ ID NO: 37938 - DNA, 25 bp, S. cerevisiae
gatcctgatcgttattcgaggctaa

SEQ ID NO: 37939 - DNA, 25 bp, S. cerevisiae
gatccatgaagtactctcaggtagc

SEQ ID NO: 37940 - DNA, 25 bp, S. cerevisiae
gatcctgcgcagaacgtcgaaagtt

SEQ ID NO: 37941 - DNA, 25 bp, S. cerevisiae
gatgccttcatcaagcattccaaag

SEQ ID NO: 37942 - DNA, 25 bp, S. cerevisiae
gatcgcactgttctgtgtacttata

SEQ ID NO: 37943 - DNA, 25 bp, S. cerevisiae
gatccattgttcctggttgttacaa

SEQ ID NO: 37944 - DNA, 25 bp, S. cerevisiae
gatgccttagctaccaacagtgtta

SEQ ID NO: 37945 - DNA, 25 bp, S. cerevisiae
gatgccgctatttcacagatcagtg

SEQ ID NO: 37946 - DNA, 25 bp, S. cerevisiae
gatcgtggcttccaaggacttctta

SEQ ID NO: 37947 - DNA, 25 bp, S. cerevisiae
gatcgggttccattgttcatatcaa

SEQ ID NO: 37948 - DNA, 25 bp, S. cerevisiae
gatcgtgcgttatcgttattgcaga

SEQ ID NO: 37949 - DNA, 25 bp, S. cerevisiae
gatcatacgtataccgttgttgcag

SEQ ID NO: 37950 - DNA, 25 bp, S. cerevisiae
gatcacttccttagagcttttggta

SEQ ID NO: 37951 - DNA, 25 bp, S. cerevisiae
gatcctttcgatcggtattctgatg

SEQ ID NO: 37952 - DNA, 25 bp, S. cerevisiae
gatcgttccgatcgcaatttgcatg

SEQ ID NO: 37953 - DNA, 25 bp, S. cerevisiae
gatccggccgatacatcattagagt

SEQ ID NO: 37954 - DNA, 25 bp, S. cerevisiae
gatccgtgggatttactgagcaaga

SEQ ID NO: 37955 - DNA, 25 bp, S. cerevisiae
gatccaattggtggttctcaaccga

SEQ ID NO: 37956 - DNA, 25 bp, S. cerevisiae
gatccaacggtcattatagccttga

SEQ ID NO: 37957 - DNA, 25 bp, S. cerevisiae
gatgccaacggtaagaccatcgtta

SEQ ID NO: 37958 - DNA, 25 bp, S. cerevisiae
gatcccacagattcacccaacgaat

SEQ ID NO: 37959 - DNA, 25 bp, S. cerevisiae
gatcggacttgttcgcataaccaac

SEQ ID NO: 37960 - DNA, 25 bp, S. cerevisiae
gatcgaacggtgatatttgccaacg

SEQ ID NO: 37961 - DNA, 25 bp, S. cerevisiae
gattaccggtggcttgaatcccgac

SEQ ID NO: 37962 - DNA, 25 bp, S. cerevisiae
tgttcaccgtgatgttaaacccgaa

SEQ ID NO: 37963 - DNA, 25 bp, S. cerevisiae
gttccaggtgaagttattgccccag

SEQ ID NO: 37964 - DNA, 25 bp, S. cerevisiae
gatctccgacgatattttgtccgtg

SEQ ID NO: 37965 - DNA, 25 bp, S. cerevisiae
gatctccataccaattttttctcta

SEQ ID NO: 37966 - DNA, 25 bp, S. cerevisiae
gatcctgataccataagctttccac

SEQ ID NO: 37967 - DNA, 25 bp, S. cerevisiae
gatccttactcacgcggtgcttatt

SEQ ID NO: 37968 - DNA, 25 bp, S. cerevisiae
gatctgtttgaacccaagcgcgtta

SEQ ID NO: 37969 - DNA, 25 bp, S. cerevisiae
gatcctcatggaaacaagaccgtaa

SEQ ID NO: 37970 - DNA, 25 bp, S. cerevisiae
gatccagctggacatgtaactcgta

SEQ ID NO: 37971 - DNA, 25 bp, S. cerevisiae
gatcggcaggttccttatctacgag

SEQ ID NO: 37972 - DNA, 25 bp, S. cerevisiae
gatcccaatggtgctatattacgtg

SEQ ID NO: 37973 - DNA, 25 bp, S. cerevisiae
gatcctcaatccagcttgtctaagg

SEQ ID NO: 37974 - DNA, 25 bp, S. cerevisiae
gatgccatggactcgttatctaagg

SEQ ID NO: 37975 - DNA, 25 bp, S. cerevisiae
gatatcggaactcgtatgctttgac

SEQ ID NO: 37976 - DNA, 25 bp, S. cerevisiae
gatcaggtttattgccaacggttat

SEQ ID NO: 37977 - DNA, 25 bp, S. cerevisiae
gatcagtaattgtcccatcgggtta

SEQ ID NO: 37978 - DNA, 25 bp, S. cerevisiae
gatatgtacttagccctgagggata

SEQ ID NO: 37979 - DNA, 25 bp, S. cerevisiae
gatcgattccaagaccgagcgtatt

SEQ ID NO: 37980 - DNA, 25 bp, S. cerevisiae
gatctttccagagacgagaagcctt

SEQ ID NO: 37981 - DNA, 25 bp, S. cerevisiae
gatcctcgttatatggctcagcgta

SEQ ID NO: 37982 - DNA, 25 bp, S. cerevisiae
gatagttgatttctattccaacact

SEQ ID NO: 37983 - DNA, 25 bp, S. cerevisiae
gatcctgctcgaaaacattccaaaa

SEQ ID NO: 37984 - DNA, 25 bp, S. cerevisiae
gatccaccaatacttattccaagaa

SEQ ID NO: 37985 - DNA, 25 bp, S. cerevisiae
gatccaccaatacttattccaagaa

SEQ ID NO: 37986 - DNA, 25 bp, S. cerevisiae
gatccaaactccttcagaccaagaa

SEQ ID NO: 37987 - DNA, 25 bp, S. cerevisiae
gatccaatacccctaattacacatg

SEQ ID NO: 37988 - DNA, 25 bp, S. cerevisiae
gatcgcctacaaaccagattaccgg

SEQ ID NO: 37989 - DNA, 25 bp, S. cerevisiae
gatcgtttgaaagcatactacctgg

SEQ ID NO: 37990 - DNA, 25 bp, S. cerevisiae
gatcgatcctcaattgctctgcaaa

SEQ ID NO: 37991 - DNA, 25 bp, S. cerevisiae
gatccatactgttttctttcattcg

SEQ ID NO: 37992 - DNA, 25 bp, S. cerevisiae
gatctagtcggcaagaacgttctta

SEQ ID NO: 37993 - DNA, 25 bp, S. cerevisiae
gatctattcacatcttgaaggttgc

SEQ ID NO: 37994 - DNA, 25 bp, S. cerevisiae
gatcttggacatttcggcaggtgac

SEQ ID NO: 37995 - DNA, 25 bp, S. cerevisiae
gatctattcactttggtcgttgccg

SEQ ID NO: 37996 - DNA, 25 bp, S. cerevisiae
gatctttgaagctgtccatggctct

SEQ ID NO: 37997 - DNA, 25 bp, S. cerevisiae
gatccaatgactattcctggcttga

SEQ ID NO: 37998 - DNA, 25 bp, S. cerevisiae
gatccaagagcgtttcgatgtcaaa

SEQ ID NO: 37999 - DNA, 25 bp, S. cerevisiae
gatctaagcacagttttgagtccaa

SEQ ID NO: 38000 - DNA, 25 bp, S. cerevisiae
gatccattacacattggtgcaccaa

SEQ ID NO: 38001 - DNA, 25 bp, S. cerevisiae
gatcctgttctgctaggtaacatga

SEQ ID NO: 38002 - DNA, 25 bp, S. cerevisiae
gatcaagtccttgacggtgaagaac

SEQ ID NO: 38003 - DNA, 25 bp, S. cerevisiae
gatagtatccgaccaaggtaagcaa

SEQ ID NO: 38004 - DNA, 25 bp, S. cerevisiae
gatccaaatagaagacctgccccaa

SEQ ID NO: 38005 - DNA, 25 bp, S. cerevisiae
gatccgaatgcaaagacggcttccg

SEQ ID NO: 38006 - DNA, 25 bp, S. cerevisiae
gatcgaatatgttgccaaggcttaa

SEQ ID NO: 38007 - DNA, 25 bp, S. cerevisiae
gatcgtatcatcactcaagttgtca

SEQ ID NO: 38008 - DNA, 25 bp, S. cerevisiae
gatcctcaatctttcaggttggctc

SEQ ID NO: 38009 - DNA, 25 bp, S. cerevisiae
gatcgatgaatattcctcagcgttt

SEQ ID NO: 38010 - DNA, 25 bp, S. cerevisiae
gatcgagcaacaacaccactgattc

SEQ ID NO: 38011 - DNA, 25 bp, S. cerevisiae
gatctggaagacattcatcgatact

SEQ ID NO: 38012 - DNA, 25 bp, S. cerevisiae
gatcgagaaattggtcttgaacatc

SEQ ID NO: 38013 - DNA, 25 bp, S. cerevisiae
gatcgaacctctggatatgtgtaca

SEQ ID NO: 38014 - DNA, 25 bp, S. cerevisiae
gatccagctacttacattcacagaa

SEQ ID NO: 38015 - DNA, 25 bp, S. cerevisiae
gatccagctaatgtcatatgccagt

SEQ ID NO: 38016 - DNA, 25 bp, S. cerevisiae
gatccggtgtagtaggcccatttgg

SEQ ID NO: 38017 - DNA, 25 bp, S. cerevisiae
tgtcggtaatagtgaagccattcct

SEQ ID NO: 38018 - DNA, 25 bp, S. cerevisiae
gatcggctatgttgtcgaagccttc

SEQ ID NO: 38019 - DNA, 25 bp, S. cerevisiae
gatccacattccctagaatccatgg

SEQ ID NO: 38020 - DNA, 25 bp, S. cerevisiae
gatcctttgcctgaaatcgatgtca

SEQ ID NO: 38021 - DNA, 25 bp, S. cerevisiae
gatcctttcctgatgggcgcattat

SEQ ID NO: 38022 - DNA, 25 bp, S. cerevisiae
gatccactttttaggcggtgtgcta

SEQ ID NO: 38023 - DNA, 25 bp, S. cerevisiae
gatacctttgtacctgagcagttac

SEQ ID NO: 38024 - DNA, 25 bp, S. cerevisiae
gatcaacccggacttacagacgcag

SEQ ID NO: 38025 - DNA, 25 bp, S. cerevisiae
gatcgtccagtttatgttccaaagg

SEQ ID NO: 38026 - DNA, 25 bp, S. cerevisiae
gatcgttaagtactttcccatttgt

SEQ ID NO: 38027 - DNA, 25 bp, S. cerevisiae
gatcggtgaaattttctcctcaagg

SEQ ID NO: 38028 - DNA, 25 bp, S. cerevisiae
gatccgtgataattttccattcaat

SEQ ID NO: 38029 - DNA, 25 bp, S. cerevisiae
gatcctgttcagatcttttgtcaag

SEQ ID NO: 38030 - DNA, 25 bp, S. cerevisiae
gatccggctgttaccaagaaggctt

SEQ ID NO: 38031 - DNA, 25 bp, S. cerevisiae
gatcgtgccgttagactagcagtcg

SEQ ID NO: 38032 - DNA, 25 bp, S. cerevisiae
gatctttctgatgaatctaagccgt

SEQ ID NO: 38033 - DNA, 25 bp, S. cerevisiae
gatcttcctatatactctacggttg

SEQ ID NO: 38034 - DNA, 25 bp, S. cerevisiae
gatcctactattcgctcaaatgctg

SEQ ID NO: 38035 - DNA, 25 bp, S. cerevisiae
gatcctgcacattctttaaactata

SEQ ID NO: 38036 - DNA, 25 bp, S. cerevisiae
gatcatttcactccaaaagagcttt

SEQ ID NO: 38037 - DNA, 25 bp, S. cerevisiae
gatcattgtcaccttagaactcctt

SEQ ID NO: 38038 - DNA, 25 bp, S. cerevisiae
gatctggtacggtgtccttttatga

SEQ ID NO: 38039 - DNA, 25 bp, S. cerevisiae
gatatgtactcggtaagccttttag

SEQ ID NO: 38040 - DNA, 25 bp, S. cerevisiae
gatcgagactgtcatcaagccttct

SEQ ID NO: 38041 - DNA, 25 bp, S. cerevisiae
gatcagaacttgaaggtgcctgcaa

SEQ ID NO: 38042 - DNA, 25 bp, S. cerevisiae
gatcaaactatccaggcttgcccta

SEQ ID NO: 38043 - DNA, 25 bp, S. cerevisiae
gataaagttcggtactcacactaag

SEQ ID NO: 38044 - DNA, 25 bp, S. cerevisiae
gatcatattatgtgccctactaagg

SEQ ID NO: 38045 - DNA, 25 bp, S. cerevisiae
gatctcttatgctagacgtgattaa

SEQ ID NO: 38046 - DNA, 25 bp, S. cerevisiae
gatcctgtgttacagccattcatat

SEQ ID NO: 38047 - DNA, 25 bp, S. cerevisiae
gatcctatgtctgttccactatatg

SEQ ID NO: 38048 - DNA, 25 bp, S. cerevisiae
gatcctgttactactgctacattgg

SEQ ID NO: 38049 - DNA, 25 bp, S. cerevisiae
gatcgccagaaaatcactgccgtca

SEQ ID NO: 38050 - DNA, 25 bp, S. cerevisiae
gatctccaaatattaatcctgctag

SEQ ID NO: 38051 - DNA, 25 bp, S. cerevisiae
gatcccatatacgaaattgcagcta

SEQ ID NO: 38052 - DNA, 25 bp, S. cerevisiae
gatccgcataaagcagaagactcat

SEQ ID NO: 38053 - DNA, 25 bp, S. cerevisiae
gatagcggcaacgtccatagacaat

SEQ ID NO: 38054 - DNA, 25 bp, S. cerevisiae
gatcgcatggcttccattcatagca

SEQ ID NO: 38055 - DNA, 25 bp, S. cerevisiae
gatcattgagcttgccaacagaccc

SEQ ID NO: 38056 - DNA, 25 bp, S. cerevisiae
gatcatggtgtactgcaaggcacta

SEQ ID NO: 38057 - DNA, 25 bp, S. cerevisiae
gatcctgtggatttcgtatcatttt

SEQ ID NO: 38058 - DNA, 25 bp, S. cerevisiae
gatccgacgttctgtatcaactgta

SEQ ID NO: 38059 - DNA, 25 bp, S. cerevisiae
gatcctacctgataactcacctaga

SEQ ID NO: 38060 - DNA, 25 bp, S. cerevisiae
gatcctatccgtttaaatgtccctg

SEQ ID NO: 38061 - DNA, 25 bp, S. cerevisiae
gatcttatcctttattggttacctg

SEQ ID NO: 38062 - DNA, 25 bp, S. cerevisiae
tgaccattttggcttggttcccagg

SEQ ID NO: 38063 - DNA, 25 bp, S. cerevisiae
gatttgggcccatattctgacaaca

SEQ ID NO: 38064 - DNA, 25 bp, S. cerevisiae
gatttggaccacactttgacacttt

SEQ ID NO: 38065 - DNA, 25 bp, S. cerevisiae
gatttggactacaccatttggccct

SEQ ID NO: 38066 - DNA, 25 bp, S. cerevisiae
gatcgtgttttcacctctatgagca

SEQ ID NO: 38067 - DNA, 25 bp, S. cerevisiae
gatcgtatgtctacagcctctaagg

SEQ ID NO: 38068 - DNA, 25 bp, S. cerevisiae
gatcgcgtacactcgaaatgagact

SEQ ID NO: 38069 - DNA, 25 bp, S. cerevisiae
gatcttttacctcgttataaaacag

SEQ ID NO: 38070 - DNA, 25 bp, S. cerevisiae
gatcttctatcaggagagttaaccc

SEQ ID NO: 38071 - DNA, 25 bp, S. cerevisiae
gatcttccaaatactgttcaacgcc

SEQ ID NO: 38072 - DNA, 25 bp, S. cerevisiae
tgaaaacggtgtcttcgacccagct

SEQ ID NO: 38073 - DNA, 25 bp, S. cerevisiae
tgaagctggtgacaaattggaacaa

SEQ ID NO: 38074 - DNA, 25 bp, S. cerevisiae
gggcttgagacataagttgtccaag

SEQ ID NO: 38075 - DNA, 25 bp, S. cerevisiae
gggcaccgatgctcaagaagtcgaa

SEQ ID NO: 38076 - DNA, 25 bp, S. cerevisiae
gtaccctgagctgaaaatgtcgaat

SEQ ID NO: 38077 - DNA, 25 bp, S. cerevisiae
gatcgcaccggcattcaaagacgta

SEQ ID NO: 38078 - DNA, 25 bp, S. cerevisiae
gatcagaccagtgttcgtagtacat

SEQ ID NO: 38079 - DNA, 25 bp, S. cerevisiae
gataaggcctattgtcgggtacatc

SEQ ID NO: 38080 - DNA, 25 bp, S. cerevisiae
gatttagacatatgccggagatcaa

SEQ ID NO: 38081 - DNA, 25 bp, S. cerevisiae
gatctttcatcatcgcctaggataa

SEQ ID NO: 38082 - DNA, 25 bp, S. cerevisiae
gatcatttcaaagactgtggccaga

SEQ ID NO: 38083 - DNA, 25 bp, S. cerevisiae
tgactggataccctgacgtggccgc

SEQ ID NO: 38084 - DNA, 25 bp, S. cerevisiae
gatcctggcgtcatgtatggttcta

SEQ ID NO: 38085 - DNA, 25 bp, S. cerevisiae
gatcttgcggtaaatcgtttatctt

SEQ ID NO: 38086 - DNA, 25 bp, S. cerevisiae
gatctttgaatgtacatcctttgaa

SEQ ID NO: 38087 - DNA, 25 bp, S. cerevisiae
gatcatttaatcaagggctcgctaa

SEQ ID NO: 38088 - DNA, 25 bp, S. cerevisiae
gatcgcttgaaaatgtcgctcgcta

SEQ ID NO: 38089 - DNA, 25 bp, S. cerevisiae
gatcgtgttacagttgcgctcgcaa

SEQ ID NO: 38090 - DNA, 25 bp, S. cerevisiae
gatctgcatgttcatggtttccagg

SEQ ID NO: 38091 - DNA, 25 bp, S. cerevisiae
gatctgcggattttgttttgtctgt

SEQ ID NO: 38092 - DNA, 25 bp, S. cerevisiae
gatcgtatgccgtgctttttagaaa

SEQ ID NO: 38093 - DNA, 25 bp, S. cerevisiae
gatcgatacgtctgttttgtaacat

SEQ ID NO: 38094 - DNA, 25 bp, S. cerevisiae
gatctggaagtctctcgtactaaca

SEQ ID NO: 38095 - DNA, 25 bp, S. cerevisiae
gatcactaagtggtccttaccagga

SEQ ID NO: 38096 - DNA, 25 bp, S. cerevisiae
gatctgtgaagtggactctctctgt

SEQ ID NO: 38097 - DNA, 25 bp, S. cerevisiae
gatctgtgataatttcctcatcagg

SEQ ID NO: 38098 - DNA, 25 bp, S. cerevisiae
gatctactgatagttcccacatcgt

SEQ ID NO: 38099 - DNA, 25 bp, S. cerevisiae
gatctgacagagaatacccactatt

SEQ ID NO: 38100 - DNA, 25 bp, S. cerevisiae
gatcgatagatttggcgtcaattct

SEQ ID NO: 38101 - DNA, 25 bp, S. cerevisiae
gatctcacacagtttcctgatgaag

SEQ ID NO: 38102 - DNA, 25 bp, S. cerevisiae
gatcgcaacaatcctccgatgatgg

SEQ ID NO: 38103 - DNA, 25 bp, S. cerevisiae
gatctcaacgtcgtatgcgtgcatt

SEQ ID NO: 38104 - DNA, 25 bp, S. cerevisiae
gatctcacgctgtctatacgctgtg

SEQ ID NO: 38105 - DNA, 25 bp, S. cerevisiae
gatcccttgaataacgaagctgcca

SEQ ID NO: 38106 - DNA, 25 bp, S. cerevisiae
gatccgctagctaatgacgtcgctg

SEQ ID NO: 38107 - DNA, 25 bp, S. cerevisiae
gatctattgactgctatcgctggtg

SEQ ID NO: 38108 - DNA, 25 bp, S. cerevisiae
gatcgtttctgctccattagatgtc

SEQ ID NO: 38109 - DNA, 25 bp, S. cerevisiae
gatcgtttatacctcttatgatgac

SEQ ID NO: 38110 - DNA, 25 bp, S. cerevisiae
gatcgttttatccttctcatgttat

SEQ ID NO: 38111 - DNA, 25 bp, S. cerevisiae
gatcgaccaattttctccggtaatt

SEQ ID NO: 38112 - DNA, 25 bp, S. cerevisiae
gatccgcaaattcaaaggctcctat

SEQ ID NO: 38113 - DNA, 25 bp, S. cerevisiae
gatcaagcctttcatcaaggtcgtc

SEQ ID NO: 38114 - DNA, 25 bp, S. cerevisiae
gatcatcagtaacgccaagggtcag

SEQ ID NO: 38115 - DNA, 25 bp, S. cerevisiae
gatctagcgacaacacaggcagcgt

SEQ ID NO: 38116 - DNA, 25 bp, S. cerevisiae
gatccgccacactacatggtgagat

SEQ ID NO: 38117 - DNA, 25 bp, S. cerevisiae
gatcgccccaataaggctagctttt

SEQ ID NO: 38118 - DNA, 25 bp, S. cerevisiae
gatttccctcacgaggccgttgtta

SEQ ID NO: 38119 - DNA, 25 bp, S. cerevisiae
gatttccccattgacacatgggcca

SEQ ID NO: 38120 - DNA, 25 bp, S. cerevisiae
gatcttacgccgtcatggcaatggt

SEQ ID NO: 38121 - DNA, 25 bp, S. cerevisiae
gatctcgcaccatttgaaggccgat

SEQ ID NO: 38122 - DNA, 25 bp, S. cerevisiae
gatctccactgatttgttggctaga

SEQ ID NO: 38123 - DNA, 25 bp, S. cerevisiae
gatcatttctaacacggttcctcaa

SEQ ID NO: 38124 - DNA, 25 bp, S. cerevisiae
gttcttcccacaccggtttgatcag

SEQ ID NO: 38125 - DNA, 25 bp, S. cerevisiae
gttcttcccacaccggtttgatcag

SEQ ID NO: 38126 - DNA, 25 bp, S. cerevisiae
ggactttaccccagatttgtagttg

SEQ ID NO: 38127 - DNA, 25 bp, S. cerevisiae
gataaattaccctcgactagtcagc

SEQ ID NO: 38128 - DNA, 25 bp, S. cerevisiae
gatcgtgattactacaatagccatg

SEQ ID NO: 38129 - DNA, 25 bp, S. cerevisiae
gatctgctggatgtttcacggtatt

SEQ ID NO: 38130 - DNA, 25 bp, S. cerevisiae
gatcgtaaattgagggcagctgcaa

SEQ ID NO: 38131 - DNA, 25 bp, S. cerevisiae
gatctttcctgtctggacggcaaag

SEQ ID NO: 38132 - DNA, 25 bp, S. cerevisiae
gatctcttgtttgtagcggtggcat

SEQ ID NO: 38133 - DNA, 25 bp, S. cerevisiae
gatcccgacgacttagtcaccatag

SEQ ID NO: 38134 - DNA, 25 bp, S. cerevisiae
gatcaccgacaaaatcgcctacttg

(The sequence listing continues in the following parts.)

What is claimed is:

1. An array comprising a plurality of nucleic acid probes, wherein the plurality comprises each of the sequences listed in SEQ ID Nos. 1-120,855, and wherein each probe in the plurality of nucleic acid probes consists of one of the sequences listed in SEQ ID Nos. 1-120,855.

2. The array of claim 1 further comprising at least one probe that is the perfect complement of one of the sequences listed in SEQ ID Nos. 1-120,855.

3. The array of claim 1 wherein said plurality of nucleic acid probes is attached to a solid support.

4. The array of claim 1 wherein each probe is attached to the array in a different localized area that is determinable.

5. The array of claim 1 wherein the array comprises a plurality of beads wherein the probes are attached to the beads and the probes on a bead consist of one of the sequences listed in SEQ ID NO: 1-120,855.

6. The array of claim 1 wherein the array consists of a single contiguous solid support.

7. A method of monitoring gene expression in a biological sample comprising yeast nucleic acid, comprising:
    isolating nucleic acid derived from the sample;
    labeling the nucleic acid;
    hybridizing the labeled nucleic acid to an array comprising a plurality of nucleic acid probes, wherein the plurality comprises each of the sequences listed in SEQ ID Nos. 1-120,855, and wherein each probe in the plurality of nucleic acid probes consists of one of the sequences listed in SEQ ID Nos. 1-120,855; and,
    detecting a hybridization pattern, wherein the intensity of signal resulting from hybridization to probes on the array is used to monitor gene expression levels.

8. The method of claim 7 wherein said monitoring gene expression levels comprises comparing gene expression levels of nucleic acids derived from two or more different samples and further comprises the step of:
    comparing said hybridization patterns between said nucleic acids derived from said two or more different samples.

9. The method of claim 7 wherein the labeled nucleic acid hybridized to the array consists essentially of DNA.

10. The method of claim 7 wherein the yeast is selected from the group consisting of *Saccharomyces cerevisisae* and *Schizosaccharomyces pombe*.

11. The method of claim 7 wherein the labeled nucleic acid hybridized to the array consists essentially of RNA that is in the sense orientation relative to the target mRNA.

12. The method of claim 7 wherein the labeled nucleic acid is hybridized to the array in a single reaction.

13. A method of monitoring gene expression in a yeast sample, comprising:
    isolating nucleic acid derived from the yeast sample;
    labeling the nucleic acid with a detectable label;
    hybridizing the labeled nucleic acid to an array comprising a plurality of nucleic acid probes, wherein the plurality comprises each of the sequences listed in SEQ ID Nos. 1-120,855, and wherein each probe in the plurality of nucleic acid probes consists of one of the sequences listed in SEQ ID Nos. 1-120,855;
    detecting a hybridization pattern; and
    analyzing the hybridization pattern to determine a relative expression level of at least 100 genes.

14. The method of claim 13 wherein the yeast sample is from *Saccharomyces cerevisisae*.

15. The method of claim 13 wherein the yeast sample is from *Schizosaccharomyces pombe*.

* * * * *